United States Patent 9,328,346 (POLYCOMB-ASSOCIATED NON-CODING RNAS) - sequence listing, part 135

SEQ ID NO: 191783 - RNA, 52664 nt, Homo sapiens
aacagucgcuguggaauuuuauuaagccaucaaaauuuccuucacauucaauacuguugaacaacaagauaacacaucuucuugcucaucccacuugaacucaagucaucaauuuuaggcacaaagguuuuaguuuucucgggaaaucaaguuuuaaccacuugagguuacuacugcagcaagcagauuuuguugacaaaugugaacagcuuucacccucuguuaguacaaauuaauauccuuuccuuaaauaaaguuaguuagcuauuuuugguuucaaaaucaguuuccaucauaaaauaacagcaagacacuguacaccuuuacguucaauacuagaaauuucacccagugcaucagcaucugugcggcauucccucagcacgggcucugcuggcgggcagcaggggugcugagcucucucuagugcgcccugugcagccacaccacugcugucaccacaugucccucugacggcagaggugguauaagcagcuucacccuggcccgacugaaggcugucauaguuguuuuucauauuaugcacaauaaacuguagcacaauaaucaugauauaacaacuguccagcaaaaauaaaaguauuuuacauuugauuaucauacaaaaauaugcauuuuucuauuuuuaaccauuauuaauaguaccuaauauuuuuaaacuuguaaauuaacaacaauaaaauacuacaagaguuaaaauaaacgugaaggaagaaaauuacagagggaaaaaugcucaauccaaaacauuuaguaauaauaaaaaagcagcuaaaugaaaaagggagaauugugauuacacugucaauggcaggauacgcugugguguuauaaggagauugggucugguuucuaaucaaggacuguaaaauguuuaauaauucuauuuguauaaacugaaacuagcccuuauuuucuaggcaacaaguuggcaaaaaccuuggguuuacccauaaagugaauuucuuaagauauuuuuuaagaacuccuguccuguuauauccagagacauuaucaaauuuuaaaaggcaaauaauucaaaaagaaacagcuauucaguacauauaaagguaaaauacaguuaucuugaaaacacuuguuuuagaaaaggaaauaagcuaacuagacacuuuacuauaaaaauuuuccauaucuuaggauggcaguuuaagaaacagucaaauuugaaaguauccauguuuuaagcggggaaugaggagugugggggagguggugccccguuucacugcuguaagaagcuucagcuuugaccgcuacagugguagguaggcucuugucacacaguuuggaaauacuuuacuuuagagagauucagaucaagcaaacaacugugucugcucauucuccucaacuuugcuguccaaaguugggggcugggggagcacuucugucgcuauucaaauggcaguguuuugagagaauccauuuuuuuauuucuccucuauuccuaagcauuaggaacuaugagagaaggacaucugugcaggugcccaacucguaaccucauuaguuauuuccagggggaagugccagcaauaguuuaccacacuggaaauacugauggccaagcccagcacgccucccagcaagccuuguuuguuuuugagggcgaguuuuggcauagauggcacucuccugucuacagcauacaccucuguggaaucagcaccccagaggccacuccccaguggcuuucagaggaacaagacucuggggacuccuggcuaugaagcuuaguaugaaaagccuauuucaaauaugcaaugggauuuucccaccccaauuuuaaaaagugaaauuauauuuucuucuguaauauuuguauccuaaagucaaaggcacuucuaaguuuaauuaucugcagcaaaugcuuuaaaauuaacagugcauaucauuuuaaaguugacccuaugaaguuaaaagcaaacucaugauuucaaaacacagugaucuaagguuccaaagaaggugaucuaaaaucauaaauucuggccccagaacacugaaccuucaucaggugaguucaauuagagacgacagaaaguaaccagaaaaauacaugaauacuuccuaaaaccugcuggagguuuuaucagaugcuccuaaaaaugacacgaaacacaaauuuccuaacuuuccuguugucugcugccuggggcugcuaaugugacugacuaucagauagccuucaggaggugguaggaaaaauggauggagacaaaaauguagcagacaacaugaacaguuugaucacgguuacaagagccagaccuguaaugacagaaagaggacaggaacaaaauuuacaucucucuuaaaauaagugugaaagaagcaugauucaacauguuuuuaaauauuagugcaaauuccaacuauuauucuuacauauaaaguuauuagagauucaaacgccuagguuagcaauguuaauucagaggaaaaaaguugacagcuucccucaaaauguucagaaaacacccuauuuuagucuucauuugcuaaugucucaguagacaaccauauuuuggccccacuuaaaaauuugcuuaaugguguuccuaaaaugcuucgucugcacagauucccuacaggagaaaauggaaaugaggaggagagaaacuccgguguccccgaggugucgguguggugagggccgcuggcguugaaguacauccugcucuggcccagcuccccauagcaggccuccagggggccacugcgcuguugccgcagcauccugcucaguacgucgacuucaucagccaggagggagagcuugugaaaggcugugauggagccacccaggcugaucugggccucgggaacccagcggaaguagcacaguuuccacaguuuuauguguguuccagagacacguggcagaauaacaccgugcagguuggcggguuuggaaaaccauucucuaaaauacugcuccguaucacuguucuggcugucgguuugcugagcuggaucuggcuuugguuuuaauaucaaugaauuucuccuuggaaguaauucuuggucacugaugauuccauucuuuaaggcagacggcauuccucuuaguguggagcuguagcuuuucuauacagaagagauuuuauuauguuccggggauucccuuuuuagaaagauugaaggaugcaauggcaaauauaaacucaauacuaugaaaaauuaauggaauuucagccucaaagaacauuuuccucccuuccuuuguguccuuauucuaauccuccuccccuggaauuacacuuuuuuauguguugacucuaccuaggcuguuacuaucagccugaaugggggcgggaugagaguaccuccuauccacuaauuugcuuaaggauaaguucuaagacgggcuagaaaaaacacuagaccuggccgauucuaucaagaacaauggcaaacugaacagaggcagucaggaggccaaaugucugauucuuuguucuguaccuuucaguagucugcaaauuuucuaccaaaaaaaaucccaagaauuuauuugggaauuauuaaaaaggcaaacaaugaauguuauuaggacaagaauauagcagucaggaggccaugacuacaucacagccaggcggcauucccugccacaguggcggcuugaaucaucaagaaauggauaaauggggcuuuaguaaaucaggcuugcaggcucaaagcugcaaucugcccacucucagguacugagacuuugugggccucagacaccaggaagaaagcugggauacagucauuugaguuaaaaagggaaugaccccucagaaacccgcauuagcaguguuacucuuggaagugccuuuacuuuuaacgcucucuguucugaaaaagagguguuugguuacgugugagccaacaucacguuuuguuagcugugauuuaccuuuguccguuuaaaagacuucacggagccauucuguauacaaggugugcucuuuccaauguagaagggguuauggaaaagggugcgauccuuugcuguaaacuggagagaccagucccaaacagaggggaauuuuaagcccuucucaucacccaauuggauguuuuugcuuauagcaaauuccugcaaaauaaauaaauaaauauuugcaaaacuaaagauucucucaugaaugccuuuuuucagaugagccacucaucauuacacagguuaaauguucuguacugcagcccucaaaacccaccagaguggcacuuucacuucaagagaggagacgcuccuggccuuugagcucagagggccccacaguccccaugaacaaggagugugcuuuucaggugcccucugccuuaggaccccaaggaagccgugcccuuugggcaauaagaauguuauuaagagaaguuucacuaacaugauacuagaaagucuuaaacauguugaauuuauuucuauaauuacaguauuuuacuuuuaugagcacacggucaguacauuuaaguaguuaccuguugguaaguggauuaacaaaaucuuuggauggaaaucacugccaccaauuuuauaacuuacuucguaaguggggagcuacacuucacugagccagugaucucaaaucacagaccacagacucaggguaggaaggaagggaucaacucccugugguccuagcauguggcuaaaaccauggagaccauguacacaggagaccccuccuucacaggaguccaccucuagcccggacucugggcgggugcagccuaguuaucuggcuucccaccacaguaaacugaggcaacacaaggcuacagggugacagccaaccaccgcauugugaggaagacauggagcuccucuggaaggcagcccagaccauuucuaugaagcacagucacauuuagcaauguggagaaaggacucucaucucagcugauugauggcagcaggcuaccacagcaguguauacacaacaguucgcuggaggaaauaacuccagacacaaagucgcuggaugaugggaaaugucugauucuuuguucuguaccuuucaguacucuccaaauuuucuaccaaaaaaaaacccccaagaauuuauuuggaaauuauuaaaaaggcaaacaaugaauguuauuaggacaagaauauagcagucaggaggccaugacuacaucacagccagguggcauucccuggcacaguggcggcuugaaucaucaagaaauggcuaagcuguguaacagcacagggcauuuuguaaaguuuuacaaaauuuucuauuucaaauaaguaaaaauucauuaagcaccaaauacacauacucuuaacaguuuuggccaggcgcaguggugacucaugccuguaaucccagcacuuugggaggccgaaggcaggcggaucacgaggucaggaguucaagaccagccuggccaauauggugaaaccccgucucuacuaaaaauacaaaaauuagccaggcaugguggugugcaccuguagucccagcuacucgggaggcuguggcaggagaaucaccugaaccuggaaggcagagguugcagugagccgagaucaugccacugugcuccagccugggugauagagcaagacucugucucaaaaaaaaaaaaaaaaaaauuuuaguuacuugacauuucaucauguacauggauuaaaaacaauccauuugcuucaaacacuguuaagagcugaaaucuaguaaaacaugaacccaaacguguuuuaauggcccuucaguaaguauauagaaaauguccucuuggccaagcacgguggcucacgccuguaaucccaguacuuugggaagcugaggugggcggauugcuugaguccaggaguucaagaccagacugggcaacauggcgaaacccugacucuacaaaaaaauacaaaaauuagcuaggcgugguggcaugcgccugcaguccuagcuacucaggugguugaggcgagagcagugcuuggacccaggaggcagagguugcagugagcugauauuguaccacuguacuccagccugggugacagagccaaacugucuuaaaaaaaaaaaaaaagauguucucuuuuuuaaaagguaaaaauuaaaaauauuuaucccaagagagaccagauuuucuauaaacacuaccuggccacuagcaccuaagguggccucagaauggaaaaaaaaggaagaaaugcuuugggcuuuugccuguguggaaggggcugagaacgguuaagaaucacgacccuuagacaaugaccaguuccugcuagggaggaagggagagggggauucauguuaguauuugucagaaaaggcuuuugaaagagccaaauuaaaaagagcacuagaacaugaacagggaaagcagaggaaauacuuguagaaaguauuuuuuacagcucccucaauacaauucaguaauguucauuccuggugagaagucuguccgcacacacagcaucagccaagcagcagaggcaguggugucugggggcugggaguccuccacgcagauacccacccaugcacugcccaguccccagaccccaaagucuuuguccucgccucacgcaccuuuugcaggcucacacugugugcgcacgggguagugacgggagacaauggggaagagcugaaggaggcaaacaaggccagggggaaagccuagcucgaggcagagaggggccccaagaaugauuauggugacgaaaaauaaaaacaagcaacugggagagcauguauuuuaggaacaaaugagcguuccaugccucaggagccucuaagccuguaucacugguucucagcacaguaucuggaaaggucaaacuuuccugguggggugggcaggggacagacucuggcucuaucacccaggcuggagugcaguggcacagucucagcucacugcaaucucugccuccugggcuuaagccauccucccaccucagccuccccaguagcugggaccacaggugcgcaccaccaugucuggcuaauuuuuguauuuuuuguagagacaggcugacgguguugaguuucuuugagcccuggguuccccaaaaguggcaaugcuggacaaucucuccugccuuuuguguccugagaacuggcuccuguggacugagacugcccucccuccugauuccccugucuucugacuauaaaaucccaggccuuguccuuuucuuugggaugcccauuaauuaaguucucccuccugcaauagccuaaauaaaaucagcuccuuaacugaccaguguguuuugucuuuuauaccaacaaauccagaauaauucauaugucuuuaggaaaauuugcauaaugauucacaguuuacaaaauguuucaccucauacaaugagacuaaaggcauaaguguuaguuugacagauccauuuuacagguuagcaaccuggacucucaggcugaagccugaguggaacaugggccuagcacuuuucccagaccagggccagaacucagguuucccgcucccuaggucacacugccuagcccagggccuuacggcugaggcugaagaccccggagcucacuaugagggcaauccucuuccuagaaaggcuuccugaagguccacaagagcugccccuuucuguuucucucaauggucuccacggcauuugucagcuucuguuguugguucgaggugggugaaauggcacuuugguucagaaugguuucaaguuuggcuugagacccugcuuagucauaaauccucuacaucaaugaauugugaccagaaacuucaaacucgugaaggaaaauaaucuuguuuuguacaacuuuuuauccuacugaccuaggaaauaaaugucguguaacagggcuuuuguuuuuuacuacccaauagcccaaaugugaaauauaaauacaaaagcaugacauuuaaggugguuaaaguaauuuacaucuuuaaagggguuuacuacaaaacauuuacauuagaguaaaacaaaaaauguucauucauaaaaauaauuuccuagauuuuugugucuucaaaauaauccauucagaaauuucagcugaaaauggcaguaagaauuuuaaaucauaagauuuuaaauaggcagugaauuauacuucaauuaugccucgauaaaguuguaaaaacagggaaaacguagccacagccacaggguugcuuaccgugcuuugcuucacucgcuggugaggggaguugaacaggaaggugccaaacagugagauccgggugcugucauacaacacugccagguagguuucggagaacucaaaagcugcaggauauuguucuaacagcugccagguggcauccaagaauagcaaaaauaaaggagacuggcaaauacaaagagacaaugggaucauuuaauguuauccuucagccguucacauuuacuucaaaauguacugcugauguuaaagaagagaugaaugagaaaacaucgaagccuaaaacacuugccuucuaagcugagcuauacacaucuaucaaacccaagaaguaacauucaaccgugauaaacaucacaacccuuauuugcccaguacauguaacaaguugaaacagcaaagcacacaguugagcggguugccacuauaugaagggggaagagcaaaauauguguuuaagcaugucuuagaaacaauucuuuagauuauauaacaaaacaaaaccaucaaccaaacuucucuaauguuugguugauccuguaggcucagcauccagaaaacauccccauauuucagaaaacacuuugggaugagccuaggucacgugguguguccccaagugcaguagcgggugaccacuauuuuuuaugagacaccacaagucaaauggcgcucucugaaacaaccuucuaaaaacugaucugacugaccugccuggccgguaagauauuuguaaggccuuccgcagccuaacuagagauccgaggcagccacuaacuccacagcuguugcaaagguggcccucucaaacuuuucaucuuaaccuauguaucccauuuuaagaaaauaugauauuccaaaagugauuuuucaaaauagccaaugugcuuguuaucuguuuuucaguauuuuauucagaauuuuuucaguaguuuuccacuuagacaaauucaauagacaacuuuuaaaaauuucaccuucauaguuacgauaaucuuuauaauaaguacaucaauuugaacucuaauccauuaguuagcuuuggacuaaggaaauuaaguuguacuaaauacaguauuuuuuaaaagccccuucaucuuuuaaugacacaaauuuuauuuuguguauccuuaaagacugauaaaaaggcaucaagauuuuguuaccucuuucucugaucucuuuagaugguugcaucugucuagaaacugauauccugccaugacccacuccuucuguaucagacucugaaauccaguaauuguccuaaaauagggauccagcaucacuugaacaagagaagcuacacaacagcucaagucucuuccuuccuccucuguuaauaaaauggaaagaaaaugauuacaacauagaaaaaugcugagagagaaagggaaggaaagguaaacuagauaauuuaguauucugcacaccuaggcugccuuccaaaucuguauaaggaaauuuuacuggauuccagcaacucuaaaauauuacagacuuguagauaaacuaaauuagcauuuaauaggagauggucuuuuauacauggauauuugccagauaauagaagcucaucacucauacuuuuuacauucgaaugguuugugguagaaaauccgucuagacuccauucuacugcucuuuugucaagguauuaaguauaagguaaucuuucuacugacaggccacauggcaauacugagaagugaauggggagagugggacuguucacuaccaacugaagcuguggcaaacgauucccuccugucuuuuauaguuguuguccuuuccaauaaggccagaauugccacgcuaucaaagucagccagggaaaucagaagacaacuauugaccaauaucccuuaugauuacagauguaaaaaucaauaaaaauaugaguaaaccaaauuauccaggaaugcaaaguugguuuaacaucugucaauuguaguaacguaccacaguaauaaaggacaaaaccaacacgauuaucucauuagaugcggaaaaagcaucugauacaauucuaccuucauuccugauuaggaauaaaaguaaacauauuuaaacugaucagagacauccacaaaaaccuacaauuaauguuauucccauuucacuggugaaagacuggauacucucucccuaagaucaggaagaugauaaggaugucuguucucuacacuucuccaucucauugaacuggagaaucuagccagagcaauuaggcaagaaaaagaaaauaaaaggcauucagaucagaaagaaaaagguaaaaacugucuuugaagacaauaugauccuguauguaaaaacuccuacggaauccacaaaauaacuacuagaauuaauaaaugaggucaguaagguuacagaaauucuguacacaacaaucugaguacauaguaaaccugaaaaugaaauuaacaauuauauucacagugacauaaaaauaaaauacuuaagagauuuaacaaaauaaauauaagacuuacauaauaaaacacugcugauaaaaugaaagaucuaaauaaaugaagcagcauaauucauaacagccacaaaguggaaacaacccaaauguccaucaacagguaaauggguaagcaaaaugcauuuacaaacaguggaauacaauucagaaauaaaaaggaaaagauugcugauacacacuacaugaaugaaccucaaaaacauguauguugaaugaaagaagccagcggcaaaaggccacauauuguaugauuccauuuauaugaaaugcccagaaagggaaaaucuagagacagaaagauuaguggcugccuggagcugggacuuuuggggugaugaaaaauuuccaaaacuagacucuguauauuuacuaaaauuuacugaauuacaaauuaaaaaugggugaauuccauaguauguaaauuuuuaacaaacuguuuaaaaauaaacguauauaaaaaugcuaguaaaaugaagguucagugcuacuucugaggccuuuucuauuacaaaugcauggagaaauggaggaugaguaggguucuccaauacgaugagaacacccacuggaugagagaaauugugauuauuaggcucugcaugcauuugugaguuaaacacacacucugacuguaucaguucaggauuacuuuauaugacacauuacuauuugauuuuuuucuaagagucuuaaagauuuuugccuuguuaaagucaaucaaguuuggcaguuguuaaauguacuucugcaagccuggccaggcacgguggcucacgccuauaauccuagcacuuugggaggcugaggugggcagaccaccugagggcaggaguucgagagcagccuggccaacaaggugaaaccccaucucuaguaaaaauacaaaaauuagccgggcgugguggugcaugcuuguaaucccagcuacuugggaggcugaagcaggagaaucgcuugaacccaggagguggagguugcagugagcugagaucguuccacugcacuccagccuaggugacaggagcgaaacuccaucucaaaaaaaaaaaaaguacuucugcaagcuuaagcaacauuuuguauucauauacuaugcaacaugaguauauagucuucccucaguauccauggggaacucauuccagggccuccuuuggauaccaagauccacaaaugcuuaaguccuggauauaaaaugauguuaauauuugcauauaaccuaugcacauccuccuguacacuuuaaguuaccucuagauuacuuauaacaccuaauacaauguaaaugcuauguaaacaguuguuauacuauacuguuuagagaauaaugacaacaaaaaaaaagucuguucauguucauuacggccaaagcuuucccccgccaauauuuucaguccuggguugguugaccacagauggggaagccauggguacaaaggaccuacuacuguauuauacgaagguaguuuuuagucuauugaacuuuaucugcaaacuuacaaauucuauuagcuguaaguuauuuaauauguaauuauccuuugcuuaacugaaagauuuuuacaucaccguuuauuccuaccaaauauuacauuacuagcuauucagcaguucagucuaaauuucuucaucucaaacugcuuccuuagagucauaaucuagcaugagccagaagguauuuaaacuaaaacaaauuuguacaaauuagacagcaaaauuacagagagagaaugcccugucaaaauuaacacuaaguauuaauccauuaggggaugggacccacccuucccauaaaauaggaaggauaauuuaauaaaggguaaaaacuggacuacuuucuauucuucuauuugcaguccuugugccacugguuuuuauuuauuuuuuuuuugagucuugcuguguugcccaggcuggagugcaguggugcgaucucugcucacugcaaccuccgccuccuagguucaagugauacuccugccucggccucccgaguagcugagacuacaggcgcacaccaccacuccugacuaauuuuuguauuuuuaguagagacaagguuucaccacguuggccaggcugaucucaaacuucugaccucaagugauccgcccgccucgaccucccaaagucugggauuacaggcuucagccacugcgcccagccugugccacuguuuuacucaaaugaugugcaaaaucuguaauguauuugaugguacuguaguaaauaagaaauagcuaaaacugaugugauuuacuugaauggggacaagcaguaaaccaaggcuggcugguaugguggucauggugcuuucaggaguuacuuuaguuaccuuguaggacuacagagagauguuugcuuucuagcauguauacaaguucugcugaaugcuuaaggaaugcccugaagagagaaaaggaaaagcaguguuaaaaaucaaauuuccacuacaaauacauaaaguacuugaaaucaagcaaaucuaauuucucacuuuacagaugcucucugaucaugauauucccauaacucaugacccaugauaacccacuguaagcugaaaauacccuaaacugagacuguguggcugacuggcagcuguggcucccugcugcuacucagcaucacaagagaggauugacugcuuucuacugaaugcacauagcuuucgcauuaccguaaaguuucuuuaguuacuuauacgauuucucaaaggaguauauuuuguaauuuuuguuuucuuuuuaagagacaggcucucauuuugucacccacacuagagugcaguggcauaucacagcucauuguaacccugaacuccuggccucaagugauccuccugccuccaccuccugagcagcuaggaccacaggcacgagccaccaugccugccuaguuuuaaaauuuuuuuguggagaugggcaucucacuauguuccucggcugguugugaacuccuggccucaagugauccuccugccucaggcucccuaggacagcaggcacaugccaccaugccuggcuaguuuccaacuuuuuuguggagauggggucucacuguguugcucaggcugguugugaacuacuggccucaagugaucuuccuccccagagcuuuggaauuacuggcaugagcuaccacaaccggccccacuuuguaaauuuuuuuuuuugagauggagacuugcucuaucacccaggcugcagugcaguggcgugaucuugacucaaugcaaccucugccucccagguucaagugauucuccugccucagccuccugaguagcugggacuacaggugcgugccaccaugcuuggcuaauuuuuguauuuuuagcagagacaagguuucaccauguuggccaggcuggucuugaacuccugaccucaggugagccacccgccuuggccucccaaagugcugggauuacaggcaugagccaccacgccuggccucauuuuguacuuuuucaucagggaaauucauaaacccuuuaugaaaaggaagggguugacuuaugacaaaacuauagagauugagaagagauuagugguagucaacagacacagauggcgaugagggugcaccuauaagaaggcuagcacaggggagccuugucauggaacaggucuguaucucccugugguggugguuacgugaaccuacacacgugauaaaaucgcacagcuguguuaagggcaugcacacagacgacagcauguaugaacuggugaguaagagcuauccagugucccagugucagcuuccugguuuggaugcuguacucuaguuacgagauguuacuauugggggaaguuggaugaagaguaaguacauggcccucugugcuauuuuuguaccuccagugagucuguaguuaucucaaaauaaaaaguuaaaggaaaagaaaguaaagaaguacaaaccuuacauauucuaaccaucgaguauuuuccagugaagauaaccauuucucuucaguuucuucaaaaggcucuguaauaaauuauauacauacacauuuuuacuuuuuauuuuauacgaucccuaucagaguaaagagauacaucaguuucuaauauuuaaaaguuagcuuuaaguaaauaucaugcauuuucacuuuaauaacauggaauaagcauuuaagaagacauuacaauucuguaacaaagcaaaacaaagcauuccccuggggcuccaucaucuucucucucgcucuuucagggaaaucuuggaguccaaccaacucugacucccaacagcuaagaauuccagccgucccugcucagccuaugccuugauccuggcccuccugaccugugaggucagcugcccaggcccuagcccuuggcuuucucacugcaagccuugcccuccugcuucccugccccaccccugcugccaguggugccucugugcauggcucacguggccgagggcuagccacugcaugaggacaggcauccucacugcccugcccagagugcacauaaucauucaggacacuaguuuuuucaacaacuugccccugccccgccccugcaaggcccucccccagggaagugcuuacucauugcucaagaucugcugcaaggcugccuuugcugacucccuggugacuuagaggaucucuugaggaggacccacauuacaccaaagaugcuuucaugugacucaucccgcaggacacaugaaagccaccugguacguuugcucagauauaucagaauucugaugcuacagauauaacacagcuguuugauacccaugucaagucaccuaucucaaaguauaacuguauguauuacaaucuuaauaaguuugucuguaagguaauacaguguucuacucagcaaaugcuuuuauaaaaguauucuccuauaccuuucaucaucugaaggaaauuuaauacacucauuuuucccccucuaaaacaaaaaguaguuuaaacuuaauuccuuaggagguucugaaguucucauacaauaauauauaauuuguacaaauaguuccauagacuccuuaaauauaucuauuucuacauuuuuaagaacaucacuuuuccugacaucucaugcaacucuguauccuguguucauuauauauaugaaauaagaaugaaauuaccauuaacgcauagcugcuucaguuuuacaaaugcugccuguacuucuugaauauuaggcaaggucuuauccaaaucugauuuguaaacaucacuucucugugggugacuuuuaguuauugcauuacaaauccuaauaaagacaaaaauacuuuagucauuacucauucauuucagcauauauuuauuuaacccuuacuauagaccaggggauagagagaggaaugagacagguaaggucucugccuucauggaguuuacuuuuuuuuuuuuaagacagaaccauugcuuaucuuauuuuuuaguuuuagagacuauuccaucagguuucucugcaugauuuuucuguauucucauaaaacugagagugaaaucaaggagaagacagguaaacuuuguuucccucuuagcacccaacuucucccacccaucuggcuuugacuacugcagaaugcugccauucaccucacugccacccccacgugcagugcacagaacaaauuagaucauuuccuucuuuuucuuuuugagacggagucucauacugucgcccaggcuggagugcaguggcaccaucucggcucacugcaaccucccccucccggguucaagcgauucuccugccucacccucccgaguaguugggauuacaggcacccgccaccacaccuggcuaaauuucuguauuuuuaguagaggcgggguuucaccauguuggccaggcuggucucaaacuccugaccuugugauucaccccccuuggccucccaaagugcugggauuacaggcgugagccaccgcgcccgggcucauucccuuauuucugaugggagaaaauaaagcacauccauuggaacacuugccugggaaacagaaacacugccaaggggggggcggggcagcacugcauuuagauuaaggagacccuacacucccacaucuuuccacaugauguagacagaaggauggcaaaccagaugcacauucuccagcucuagagaaugcaaagcaccuauucccacagucuuaacgauuugcuguaggauaaacugcaaguacagacauucaccaaaauuccucccacccuuccucuauucuuaggagagaaugggcuacuauaaauaugugccauggggucucuagaucuuuucaaaggaaacagccaggacugggauucccaucuauauucaauggguaacuuccacaccacuuuaaaaaaacaaaacaaaacccugcuguuguuuuuuuuuuuccugaauagaaaaaguaauauaaauuaguguggaauguuuaaaaacaccuagaaaagauaagaaaaacaaaaucacucagaauucuaaaauuuuggugcaaucuuucuagguuuccucuaugcaccuuuauguguauggaauuuaauguaggcaugaaaaauaaaauggcgcuguacauuugcuugauaaacugauuuuuaaaaauuaaauaacaagaauaugcucccauuucauuaaaauauguaaugugucaugaaccugcaugucaucuuugugcaagggcuaugcuaaccuucccuguaucauuccaauuuuacuacugguguugcccaagcaagugggggguugacauucuucguggggugggguagaugauaagauaaaugggcuguggugaaugccauggaugauguaaucaugagauuacaggcuacuuuaggucacauggugaaaaacagcugcucugugaagaugguacugaagccgaaaccuaaaugaauagagaagcaauguaaagaucuggggugaaaauguucuaggcagagggcagcuagugcaagggcccuguggcagguaacaagcauggcugcugagaaaccuaaagaaggccaguggggcuagaugacacaccugagggaaaaagguuaggagacgagguuggacaaaaaagaggaucuguucuacuuaugaagaauaggauagcugaaaacacaaaaggcauuaaaguaauuuucagcuuaauaaaucacugaaacugccacugauuauaagguuuuauaacuaacucucacccaacaaugcuacaauugucccuuuaacagcaaaauuccuaacugugcacuucaucagcauguaugcuaaugaaaacaaggcuuggaguaugacacagcagacaguuaauuccaaauggaguucagguaaaucaaaauccacagagaauacggacucgugugaacuauagucaccuuccuuuccagaaaacugaaggucauuugagggucacuugaugguuauuugcuucagugaauauggcucugucaguuacgguacaguggaaaaacccuacacucuggcuguaccaaaaaggacugugauacacaauuucugaggcuccauaagccuguuuuauaagaucuguucauuuacuccucauuuauucaacaaguauugaauaaauaucauauaugcuuccugggugcuaaauauauaacggugugcaaaacagacauagucccucaucucauggaguaaaaacgacaggcgguaaucaaacuguaacacacacauauauaauuaaaaacugaaauaaauguuaaaaacucaggagcucuaagaacauagacuuuugaggucugaucaaacuuuagaggggagagaaggcuuaucuugaggaaaugauguuugaauugagauauaaagaaugagugagccgggugcaguggcucacgccuguaaucccagcacuucgguaggccgaggcggguggaucaccugaggucaggaguucgagaccagccuggccgacauggugaaaucuugucucuauuaaaaauacaaaaaucagcuggaugugguggugggugccuguaaucccagcuacucaggaggcugaggcaugauaaucacuugaacccgggagccgagaucguaccacugcacuccagcaugggugacagagugagacucugucucaaaaaaaaagaaacaaggagugccaaguggguaagcguggagaguguucccagaugagugcaaagaaggcaguccagaagggaagagcgcuggacaaugucaggagguugaaaacaccagggaaaguccagggggcuggagcccagggguggaggagacauggaaggaggaaaugauagcacuuauaacacacaggcagagguggagcuggguuuguggaagcacauggguuugcaaggugucugaaaagugaagugagaaaaccugaggagggauuggugauggggaagggaaagaaagaggaaggcauccaggaugaccccccgguuucugagagcaggcugggggagggcauggaggccauauccuugaguuugguuuuggacauaaugaguuuaaggggucuuugagaccuccauguagaagucaagguagacugaagauauaaauguguuggucacuaaagccacauucuuggggaaacuucuuuaggaaaagaauacagaacaugaggaagcggccuuagaaucuguguaaugucuggagagaagaggaugggucugcagaaggcacggagugccagugaggaagaggagcuucaggagaguggagaggagcagaggcugagggcccaggcggguuuaaggagagagugaucaauaguauugcucacugcuaugagcacaacugagaaaggccuccuacuuuaaugacguggagguuacuaaugaccacagcagaugaugccagacucgucugugguggcuaauuaaaaccacuguucuagcuauugcaaauguguagaccuaaauaagacacaucaaacuacaagaaaaguuugauuuauccugaagugucucaacuggauaucacugcacuuugaaaguauguuauaggaaaugcuauagcaagaugucagcaauguaagauccacaagugucuuacaaaccaaauaauuaaauuauauuuaguguaacuccaaugucaguuaauuuuaauauuaucacauucuuuucaaaauggcaauucuuauauaaaacauggugcuaacuaauuaguaagacuaugcauuuuguuauuuucaauuaguagggaacucacuguaguuacacaacaaguaaaacuaucuaaagugacaaugaccauuucucaauuaccucuggucaaucuuccucugcugcagcacgucuuugaugagggccauucgcacaagagcacugccguuagaguggcuccagcaccagagcuaggggagagguagaauccuuacuucacuguguagaaacaauggacgucagcauucauaaaauccaacagaaaucacuuacuggcauccuucucccaacaaaagaaugggaaaagaucuuuagaucuuggucugcuaaagaacuuggcacuacaauguauucuggaaggcuggaggggaaaaaaaaaauuauaugagugcugugcuaaaagcaggaauagugugcuccugcagacccuauaaauaauuaagcaaguuguccgcauuuaaugugcaccccacuuaguagccacauggugggcaccaugggggggcagugacgauccuacaccucuuagucuaaaauuggugcgauaugaccaauucuuaaaaaucuaaauuuauagcaugagaaaauuccaaagaagguauuagaaauauuuuccagaaugacuauuaaacauguauguguucacugaaaaauauauccaccuuuguucucuugacaggcuaugguuaaggacaccaggcaaacaaaagaaaaccccacaaaucuaccaggagcuuuagcucucuucuuaagucccucuucuaccuuuccccaugccuaaaaggcacagucagacucuaggacacugaucagacaauaauuacuagugggcaagcucacugcaccucaagacaucuuccuucuuuccccgacguggcugggcagccccaucacauguuucucagcacauauaccagagugugcuggccuugaagcuuaaauuccaggggaagcaaaagauacaagcuacaugcugcaaagcaccuuucuagaacuguacuagaaguuccugguacuggauuaaccaguaauaacacaguagugcuuuucuuccuuuuucuaaaaagcugcuuaugugcgugaacuaaugaggacuucaaugaccuuaaaauaaggcauuccaaaaaauucauaauaacuaaaugacauuaaacaaauuaaaaaaacaaauuccuagucacuucuagaagauccccuagggaaccagcucacuauuuggaaaaauguuaaguaaaggagaaaauguagauauuuauauugcuuuucuuguacgaacuguguuacagggcacuaaagagcuggugagagaaaaguucgauaaaagcagaaagaugauagaauuagaaggugaacaauagcaauccuuagugaaauaacgaucugagcaaugauccucccucccagugcaaaacuauuuuugggagcucaaaccaugauauaagaggggaacuuuuacuggguggaucagguugacacccucuaagcccacuggucgucaggauuacaaugagagagacacagcccagccagccugagaugggaugugacuccacaggagaacacagaaccaccuaaugaaacauucuugccaaaaguacugaaccugaauccgauuaagccucuguugcuaacauuuuaaaggaaauauuagagacagaggaacacauuacgggacacccuggggauaaaacaagcaauaucuacaauguggaaaauucuagggaacaaaugaccugguuugucaacaaauaguagguaaaaaagaggugggaggagacuguuguagauuaaaaggccuaagagacauauuaagcaaauucaaugugaagacuuuagauccugauaugaacaaaccaacuguaaaacaccaguuacaagauauaaugcaauaaacacugacuacugaugacaguaaggaauuacuaucaacuucuuuuaagggauaccguaauuuauauuaauaagccuugaucuuuaaaauaaaauauuuauuaaaacauuauuaaaaacaaauauuccauuaaccacaacuugaaagucaucaaugacaacagaguuugaugauuauucauagggaagugacuuccagccauauauaacauugcuaaaauuguacuuaccaaguggauaucauguaacccucguuaauagaacaaacucuccacccggaagcaccuguccucuugauuucucugucccaauccgaguaaguuucaaagaguggaguuuucuggcugcugccaccaccagcuccauuaccuccuccuccuccuccuccuccaucuccugagggaauuccauuaauuuuguuugcuguaggaaaaagcaacauuaugaauuuuaacagucacauuuuccccagcauucccucuucucugagccuccugucacaugcauacucugaugugcugucucuaaccugcuucaccuuccaagucucuccgagaacugucuugcccuuuccauuuaaaaauaacuccuuuuuuuuuuuuugacggagucucguucugucgcccaggcuggaaugcacuggcaugaucucggcugacugcaaccuccgccccccggguucaagcuauucuccugccucagccucuugaguagcugggauuacaggcaccugccaccaugcaccauguccagcuaauuuuuguauuuuuaauagagacaggguuucaccauguuggcuaggcugcucuugaacuccugaccucaggugccccaccugccuuggccucccaaagugcugggauuacaggcaugagccaccacgccuggccuaaaaauaacucauuuagucuuguccuuauccagcucuuucacaacuccguaaaacagcuuugauuuuucucuccuucuacuggcucuaucuucucugccuucaaacguaaacaggucagucaacaugauauugaaaacacuuugaucacgccggaccacucuagcuacuaugcuauacauuuuucuuccuuccuuuuccugaccaccuucccccagaaugaagaauggcugcugccuagauuuccucuccauuuauuuucucuuuaauuuucaauugucuuccaucccuaccauucuaacagaaacuauuccuaacccuuccucaucuccgucccuaauugugggguaaguccaugucauuugauuauuugcuccacauauuuugccuggaaaaaugaaacauccaacaaucaucucuguccucaagcccuucaaaucuuuaauuuuucuaauaccaacuucucaccuaccugcucuuuucuaucugcucauuagaaaauucuugguuuccuguaucuacucgauuuuccuuugaaaagcucaucagguuccuuguucuuugcuagagugcuguuuccacaugaagauuacagcagggcaggccuagacuugcauuuccuuagaaaggagccugcucugagagagaaguaaugcuaucuucugggagcaugcucacagccucaagagugccugcaaagugauuauugagaaacaagcugucccacaaagucagccagaucuaccuuggcaauaucuggugacagauggcacaacccauucuggcccagggucuuucugcugcaggcugcaacuguggcaagucucccagcuggcauccccaauggaauauucugcugcauuuaaaccagccagcagcuuaccacaagacacacuucccuaaaaagauguguucaugaugcuagucccuugccuuaaacuuucaauaagcucauuuuccaaccaaaucaaaccuaaauggcuucucuuggccuuagagaucccucacguaacuuaucugaccuucauuucccauucuccucugcagccaugcacuacccuccaacgucccaugaacaugucaugcucauuccuacugauuauucauuaauuccugguauaagacagguauuuucugagaacuccccaugugcuaaugccugagagcaaaaagaugaauaagauuuuaucucuaucuugagagcauuaauaagugugauaaucacagaguaccagaugucugagugcaaugaagaugcaaaagagaaguccccuaacucucgcugcagagagaggccggggcaggaaaagcuucaugacuugaccacaacuaaagagaguucuaaggaacaagucaaaaguugccagguagcuggugaggaggagguaggcaugcuagacagagaagaacuuuaaaaagaugguauaacuguauaauaucaaguaacuaaauacagcuagagcauagggauucaacaggugguggaagagaggcgggaaaucaaauagggccuagacucuaguauguuucccaaaaacguaacuucuagccacacaagcccauuuaaauuuaaacugaaaugaaaauuaaauaaaauuaaaaauucaguccaucaguugcacuagccacauuucaaguacuuaacagccacauguggcuaguggcucuaguggcugcccuacuuccaucacuggacggugcugcucuagauuacggaggggcuauguuaggaauuuggacuccucuuaagugguaucagaauuauccagugauucugauuuuaacaaagcucauuaaaaaguaaaauguugcugggcgcgguggcucaugccuguaaucccaacacuuugggaggccgaggugggcggaucacaaggucaggagaucgagaccaucuuggcuaacacggugaaacccugucucuauuaaaaauacuaaaaaaaaaaaaauaagccggguguggcggcacgugccuguagucccagcuacuugggagggugaggcaggagauggugugaaccuggcaggcagagcuugcagugagccgagaucguaccagugcacuccagccugagcgacacagcgagacucugucucaaaaauaaauagacagauagauagauagacagacagauagauagauagauagauaguaaaaugcucauucuaagcccacauccuagagucccacuccaucucagggccuucucuggaguaacacaacuaaaaagcgugucugugagaaggaagacuuaggaguuaugaucucuccagaacacaaaaccugcauauggaauuuuuggcaaagcccaaucuauacaguguuccagugcaccaaaacaaagaaagcuauucaauauuagaaaaucuaaguaauucaucauaugacuacauuaaacacgaaaaaggcuauaugaaugacuagcucuguaagugcagaaaaacauaugauagauaccuguuuaugacuuaaaaaaaaaaacccaacaacguuagcaaguuuggaauaaaagggaauuuccuuaacuggauagaggguguuuaucaaaaagacauagcuaagagcaucuucauuaaaagcgggaagugaaauuaugccugcuaauauuacugcuauucaacacugaaccagcaguccuagccaaacaauaaaaccaccaccaccaaaaaagaauuauaaaaaacacacucaaaauuuuaacaguuauguaaaacaguuuggugacugaguccagcagcacugaauacuuuuuaguguuuuggguugcagacuuuaauaagcuaggcuaagaaugugcuauuguuuaugagauuguuucucuggccaaauuuuguuucaagaucuaacuuacacaaauuuuucuaaacguaaaaugagaacaucuauauuuucuaagcauaaagugagauccucuaucguuuguuauuuuugccauuucucucguucaaauccuguacuuuucuaaacaacugggacuaggucuuuuauauguucuauaucaucuucaguuagagcucauuacagaauguguaauguauacucaaucugguuuuauaguccagaaauuugaaugcuuuccaaaguucaaaagaccugauaccaguggccugcucuaugaguggaucgcuaugaggggcuggaccaacacagugaaaggugggucaucucagggagaccuggcuccgcugaccgcuaccugacugagguuuuaugacaugccuccacagcagacuaagcgugaaauagauauuauaugcuccugaccuuggcuaucuucugugacaguacaaaagucuaauccuauacuguugggguuauuuuagauaauuuccacugaauuggccaauugauaucuagaauggcuucaagcaacagaaaauacaagucaucaauauaugaaaagaaagcccaccacucugaugauacugcagaaauuagaagucacaaaggaauaagguaaaaagaggacugugaguauuaaucaguucaaaagcaugagucaacaaagugguucuuaacugggagauucugaccugugcuggagccaacauggcugcauuucuaaagguuccuccaguaauccugauguauacagcuggcuggaaccaccaauauucaacaaucauuuauagcuauucugagaaucuuaagcaacaaaguuuaaaaauuccuauacuguuucaaauggauuguguaccuuguguuuuucaaauaggcauuuuaaggaaaaucuaauaacaagaucuauguuaauaaaaaggauaaaauuaaaugucacugaaaauguacaacuucugaugugaaauuucauuacaacuucagauuacaucacagcaucuguaagcaggaugucugucaugaagcaguugcugacacuaggcugcagauaacuucaugaaacuuucaauauuuuugguccagaagcauaaucugacaucuuaucaauucuauaagaaagaugaaucuguacuuuuuugacguuauuugcccaauaauaaucugacugaugaaaacagaguccucaugguuucuuuaaaguuaaaagagaaaaaacagaaucauuguucuuguuugugcuaguaauaucuccugggguguuugugcaaagcgauguuccaaagccugggugcuacacaucuuacuuuacuccaggauauucacagaaguguugggaugacugcaggaccuuucagagauggcuuuuccucaugugauacugaauaugaaugaaaaccugagugacuaaggccagcuaaaauaucauuuucucagauaacugcaggggagcuccuccaacuuuggaucuuauuuguggaaacagcuuugucaccuaccugccugcaaaaaggacuucuuuaauccagccaaugaaucaaggugucauccagaaguucaagaguggaugagugggcaucuuucacucacaaauuaaugaauucugacugcaguguguggaaauuucaggcuccuuuugaucuuaaagaugcaguauuuaugcuucuguaacagcauggaaggauauuaaaggauguuacccuacgaggaaucuuaacaaaacuauggccaguguuauguuuaugagguacuugucaaaggaggagucugaaggauguaauauaaaaaagcaucccugaauauuuucaguauuaaucaucaaauuuuaucaauaagcuauauaagaagaaauaguggaacugaaugauguagauuuuaaaauuccaguaguagaagaccuauggguggauaaacuaaaguacuguaaaccagagaugcccacaagguaugaaugaagaaaaauguggaaaguaacugaagcaggcaucagguuaccaacuguauaaugaaguuuacugucuuugcugagcccaagucacuacauuacuguagaaguuauggaucuguaaacugaaaugaaucauuucuauuggaaaaacagcagcaugaagaacuggucuguaucauaaacaguugagcaggaaucaaagacucacuccuacaacccuugcaacucugggugaggaucuuauugaagauaaccuugaucacuguucuguagcuugacgaugaucccaaggaguguuuaccuaauagugcaggaucuguauacuuuauuuuuagacaguaagugaauuuacuuaauauuaauaaacuucaaaaaauaacuguauugcuuaagccucaguuacaauuauguauauaucgauaagaaaaauuaaguuacaaauacuuuuguuauacaauuucuauaaauauaauacuguaugauaaaagcugcucugcaaagcauuauuuucauauauuaucucuacuguauuuucuuuuuuuuuuuuuuuugguccucucagugcuuaacagaaagguaguuaucuuuuaaacuaaggaaaauuuacuuauacacaugcaucuucagauaccguacacugauacauuuuaauguauuuacaauauaguguugcuggaauauacuuuuauuaugccaguuauuuaaauuacuaccauguuucgugguaacaaaauauaaaauuucaguacaauuaauaauuuguauggcccagagcaugcugggugaauggauuuuucauuauaaauacacagcugauuuauuuuucuugcuuaaauaaaagaacacaggcuucgcucaguuaacugacuugcagucacuaacugacaauggggcuaacaggagacacggcucuuuguuuuucucuaucaagauauuuuuaaaaauuguuuauuaaaauuacauuuguacgaaacagaauguacagaauugcaugaucaucuggaaucuucccuggucaugucaugacugucagauauauagacaaaacuauuuacuuucacaaaagcugucuagaauauacuuguccuuggaaaaaugcucaucuuccuuucaucaguauuacucagaaauagaaacucaguauucugagaaucuuaaugaaguccacaaaaaguuuuuaaucacuuuagcuuuugcaugaaaucacaccuugccagaaaagauuaugcuuuuaauauaucuuuuaguuuucugccaguuuucuuaaaagauaagauuacuuuaacucaagcuaucaauuaaaaaggguggguuauauauucuucaucauaaaauacaagccagugacuggagauuaaauaucugacauaacuuauaagcccauauucauagcauuaaagguucuuccugguaacuugucaagaaauaaucugacaaacuauuggcucuuuuagcauguagugcuuacuucucuaagguaugaagcuaguaauucuacaaucauuaaagcucauguacuuggaggcuuccgguaaacauaagaguaaaauuuacacauguaaaauuagucacaauauuuaauauuuucauauuuaccugaauugugguauuuuuucccaacauauucaaaugcaaagaguagcuggaggucuguuggcugggaauaaugagcuauugcaaggcauaccuaggaaaaauucuacauuuagaauuugauuuuaacacacuuaguuaaaugaaauguacaauaaggccuugggcacugggagcaucaucuuggggcagugauuauagauacuauuuacauguuuuucuguugaccuagaauauaaaagagcuccuuaaggccagguaucucauucacuuucaugcccucaagacauuguuuaucuuuagcuagcacauggcaaguauucaguaaauauuugcugaguuaaauuuuaauuggaaaguaauuuuaguccaauaaagaaagcuucaaacuaaagaagcauucuccaaaaaggcagugacuacauguccacuccaaaaaaggaagaaaaaaguuucauuuuugguggacuauaaaggauuaauauaaggcaugaaacuuuaaaguuuacgccucauggauuuaaacaucuaaauagagaaacauaauuacaaaaaauuaaaauuagcaagaaacuccaaaaaugcauggguggcucaaagagguacaucaaaaaaacaacacacacacacacacacacacacacacacacacacacacacaaacuguguuuaaguaaaaugguuugggacugugugcccugugguggaaaacgugcgggcuuuagaaucaaacagaucagggggcuugaauccuagcucugucaaguacuugcuacauaacaugugugaagucauuuccucuuuucuagccucaguuugcucacuuguaaaacaaaaguaauaccuaggcugugguaagaauuaacaagcuuaaugcaggcuaggccuuuggaggagcuccauauauagaaauauggcuguuauuauucucaacugcugcuagauagaaugaaggauggugcucuaggcuuacaaacccugguagucacuagaaugugggagaaaaugcucuucagugagcaaagacgaaagaagaaauuuaagacauaugcaaggaaaacauagcagaaaaacuuauuuaaaagauuaaauuuuauuuagaagguaaagcguuaaguuaaggcagaaugauauacuuuugacagugaguaagaaaaguuaauuguuaguucaugucaaauuagugguguuuggaguggguugaugcacauuucauuaaccaguaagcaugugucaacuuguuuaaacuacauuuuaaaagucuucuauagaauaaauguuuccugucucacuaaguuaaaauauacaaacaaggggacagaauuugucauuaguuuugaccaaaaagaaaaaaaaaacugcuucuugaaacuuacgugguaucucgauuucucaauaccuauaggagagcuuucuaugacggucccacuugcaaaauuuaggagccgguuaucuauauucccauuccuaaucuuuuuaacaguuuuccuuaaagcauuucuagcagcaaaacuacugaaaucuguagcuugaaaaaguucucauccuuccuauuuguuugggcaccguugauaagcuauguugcacuuuucucuagacauuuuucauaguuguccauuuugcuacacugccauagccacauccuuaggccauacucaccuuauggcaccucugagagcuuccuuacauucuagaaaucuacaaaacuuaaggauuaccuucuaacgauguaauucugacuaacaauuuugcucuccugauaaucugcugugguucccagacaucugcauaacaaauuaaaucuccucauucuugauucuucacaaaacuggcucuccucaccagguaacuauaccuucccaauauucccuccgcaaucucaggucagagaaaaacagguuugaacacauucugccugacuuagccccagccaucuccacugucacacucuuugcuuggaaaauccuacuccucuuagccaacuaugcuuucuuggaaacugucaugucuguucaacacuacucucuucacaagccuuccuagagggagccaauuucagaguacuaauuccagaaacccagaacaacaguuucaauauaaagcgucucuuuaguuaagugcuuauuuugcuuuacuuccaagguauucacauaauaguuaugauguggaugaaaaguaggauauaggugguucuguuacacuucuaccaugaaggucaauuccuuaaggauaaaugacacauuucacauugauuuaacaaauauuuacugaguaccuacaauguuguaagcccuagagaugcagugaacaaaacagacacuaaucccuguccucaugaagcuuacauucuagugggaagacagacacuaaacaagauaaagagaaaaaauacagaaaguuagauaacuaugaaugcuaaaagagaaaaauaauagagcagggaaggggaauaugaaguguuacagugagaagagggagacaggcuaaaaaguagagaaggagaccaagaaagaccucucugcacagacuugaguaaagaucugaagaugucugcacuuugcagcaccacuucaguagcuuucugacggugcucuguguccaacaguggcuacacuaauauucacugacaaaaguaguuaccaacauauuaaggaaaaugcuccaagccaauaauaauaauacuaaugucuaucacauucuccaaaacaauuagaaagcaguuacaugcucuuucuguuuacagaaaagaaauucacagaucauugaucauggacauccuuuuuuuguggccaugaggcaaaaaagaaauaaagccuauuuucaaggcaaaacccaacacagcguauuuuuuaaaagccccuuaaaaauagcacaauaucacaucagguuaggaaacaaaugaguauguccaaaagcaucuacgcugaaagaagucuauaaaaauauuguaaaacugcaagucaguugaauuacucguugauuuuuuugggguggcagaacucgaacuaaauacauuguuuuucaguagugaauuucaaguguauaacuuauguucauaugaccuaaguaagaggccucuuuggacacacagacuaaggcacauacaaacuuguguaccuggauugucuucauguuguuacuguggaacacuccgagaagagaaagccagggccccauucuuugcacuuuuacauacacacuauuuuaaaaaccuaaguccaaauuccuaccuuucauccuaagaguuuuugaaagaucugaaauacuucauuuguccuggcuaccacaggaaaugaagaaaauguugguauuaaagacauuaaauuauggcaaauauuuuauuggagaaaaagaaguaaacuacuuuuaaaucaauuuuuggaccaaagcugauaaucuucucuggacagaagccagaaguacccacaguggaugguuucuuuccuaagaucaccuggggugcaguacugaagaaacucaaauccaggaaacacucaaaccucauuaaguucuaucucauuugcaaacaaaagugguuuauuucuguggccugaaagccaccaaaaaacaguaccagauucaagucaaaaaugacaguucaugaaaaggccaacuuguuccuuaaucagaugaauggaauucacuucuauaaaguauuccugaagaagugauucacaacccacuaaucagagaacaaaguggagacaaaaggcauguauuucacuugucacucauguguaucuauauauuuaucuuuaucuacacagacagauauauagauaaaucauuaaaaacaaccuuuauuauuuugcccuucaguuuugagcaaagguucugcaaaagaaaauggugguucuaaguugcuaugagguuagauguccaauucugcaccaucaaauuccuucuuucuuuauacagaccuuucccaaauaucacuauuuuccugugacagcucgaggauaaugaggaugaauauuaaugaguacaagugcccaaagcaaucuaauuuugucauaauacaauugaaacaacaccaacaagacaaccagaaggguucagaacauuuaacaaaaugugaaccaauuuaguauucuugaauuucauuuuucaaaacaaaaacauaaauggcuuagguauuucaaaaugaaucaacgguuuacccaccagagaacuccaaacaugcauuucaucauuuuaaagcaacugauaaaauagcaaagcauuuuccagagaaaacaguauuccaagcuuccaggagguaaaaaugagccauaauuuccuaacugcuaccgaauuuuagaugaaaacuuuucacuugaaauaaaagaauaugccauaauuuuuguuuuuaacucacaaagccgucaagcuuugguagccauauacaacuuaacccuguuugaaaugcguaaaucccaaaaaaacuauuuauauucucauugcaucuauuuuuuuuuccugcacccuccccugcccugcaacccccguggcuauacaaaagacagagacucacaugcuuuuuauauuuuaggauacuggggaaaagauuuuugucugaaacuuggucuuaggaaagggcauaugagggacuggcuuguuuugugcagacgguuuaguaaggcccucuucaugaaccagcagcacaacacauaggggauauucugaauuuccacagcacuuauuaugcucuguucaucuggaaaucaacuauuuguguaguugauuuuaugcugccacuuuguaccauuacuuuucauuuguucaugcuuuaucuucuucacuagauuuaaguucucuagggcaagaaacugcaucuuacccuucuuucuacuugcaaaauuuagcacacugccucaacaugaaaaaugaccaacaaguacuacagaugguucaagaacuaggccaaauaauuauuauuuccacucauuaaaauaguguaaacugaaaaauacaguaaaagagggagaauugaacuuuccgaaagagauccggucaauugcaucaauuucuuccuuaggaauaugcuguccuaacucaaucuagcaaguucugugaugucccuaaucuugagaugcuacacaucuuaagguuuucauaagcaggucuuugaugcuuugaucaauuaaauuacaaauauaaauaagcuugaggaauuaaccugucugaaauauuuuauguacagucuaauacaucaugaauucuaaaguccuucuauauaauaggcacuuuaaauuaguaaaaugccaaaaucacaaacagcacaaucgaacaggugaaagaggcuuuaagaguuaucuaguugaauuuucaauaaugcagcuugcugagagaugguuauacagaccauuugaaaacuuuuacccauagaggagccuacaaccacucuacucugcuagacagucacauauuuucagauguauuuucauauauucaucuccugcuugccuuccugugaagaaacuguugguucucaaucuaaaaacaaaucuaccaccucuucaccaaaguauaugaagacagcugccuuacaguauuuuugccagccuuguuuugguaucaacagaagauuuacugcagucaguugacuaaccauggaaaacaaaggcacucauugcuugguggugcaaagacugccuccauucugagagaaagccacguccuauuauacuaagauacuguugcccuauucccauacacacgcgcaagcuuccuacuggaaagucugugacucugcauuugcugcagcacagacuggaacgggggccauauuaggucuaccagcuucacuccucuggcaaagcaaaacauggaaaacaugcccuugacucuuacaaguaggguaauaagucauuaucuggaaggccguggaaaaauaaggcaguuaaaaaguuacuagcuuuguguugccccuguugagugucacucaauucauaauauuucuuuaaaccacuaauaauuacuaggccuuucccguaauuauauauuuaccuaaaucuuauguaacauaagucuagcuuacaguuuguugguaaaguucugcaguacugaauuaaaagccuaaccaaaccuuaauuacaguauaucaccaacuuuucaaccuuuuaaccaagaaacugacaaguaaugaucuuuauguaaaaaaaugcuaauuuccacguaagagucuuuaauauuugagaagcugauaaaaaguuauauagaacacuuuaaaacagccauaaaccaauccaagaaaauaguucuauuaauauucuuggcuuugacuuuacuuaagaagaugucugauaacuuccccuaaaaaacaucugagcaauugagaaaugaaaacugccauacggaauugaaaucaguaaacacaguacagaacccagaacuugauaaaccuuaacaguauuaccuuuuuagcacuuucgggaccugauucaucaaagcgaaaucugacaauucugaaaucuuuacaauaaauaauuaacucuguuggauuaaauuucaguuucugguuggggccuaggacuuucugcuuccucuuguggucguuuacuaaaaaagaaaaaaaaauagagaaaauaaaaugcguaacaguuauuuguuacucacccuuuaauacaaauucuuagugaaaauaauuggaaggucacccaacauuugagcucugcuugucuagaauguuucauacuuguaauuccuagaacuuggggguugguuuuaacuuugcuuuggaagauauuuuaaaugauuauuugcauaaaaccaccaucuagacacauuuaaugauuaauuuuaauuaaaaagaggacaaaaaaccuagaaacuaugaaaaguuauacauuuuauaucuuccuuuuaaaauaauuuauuaacauaucccucuuuauguucccgggacucaaaaaaacggcaaaaguaaacuuacagaaauaaaacgccaauccaaguauuuugagagguaugacuuuucaaauaauacuuccagaguggaauugacuuuuagaguauguacggaauacuacguaccugugacaauuugcucaauacauguuaaagggacaucguguucaccaagaagaagguuucuguaauggaauuucuggaauaaaaaauuauguucauauuaauucuuuucccaauaaucucacaaugguaguauaagccuuaaacugugaugauaaacugugacaguuaucucuaaaaagcacaaaaagcuuuugucuagguagcuagggccauuccaauguugacagauagaaauuagguuaaaauguacacaacaaucuuauuauaauaccuaagauagggaauaucaucaaucaccuuaccagcaagcauuugcaugucuagaucuggauaagcuggccacaacauauuaaagaaaaaagggcucuuaggucaucagauuuuaaguggguaaaaucauguuugauuuucacacugaagauuuuaaagugcaaaauaacuaucuuuuuaaagcacaaagucuacuagaaauaaaaaccauuagaaaagguuuugcauguucaaacuaaggacguaguuaacacuaucaaucugcugucaguagggcacugguuuacuuuuuccuaauagugguacuggauuuaagcuguuccagguaucugcuucucauuuacagugaagucuggggccaaugaucauuaugaagcuaaaaacaaagagaaacacacaagccuauauccaaauaagcuacugucccuacacaguggguaucuuuaagugccuuaaauuuagucuaaauauaccuacauaagacuguaaugaacacacaaauauacaguacaauaaauauuuguacaguauaauaauuaugguaaauuagugagugacuacaugaaauauacuuacacuaaacuauuagauccuuaaauuuaaaaguuuacaguucauauaccaauauuucauuaaagaacaauuacuauaaagaaagaucuagggguaaguguguauaauacuuuauaaaacaaaauacaaaauggcugacagaaaaguccaggguuuuuaaguuaaucaaaugaaugccugaacuucuaaaaaccaaaauuacauggaacuauuacuuuccaguaagaacauaaaauagcaagagggcuacugaaaauuuuuaaaucgauacuauucuucacucuuccuagaaauuagaauuuaacuuuuuaggaaaauaacacuaauuaguuuaaaaaaaaaaaaaaaagguagcugggugcaguggccuguacucuggcacuuugggagggggaggcaggcagauugcuugggcucagaaguucaagaccaauccgggcaucauaacaaaaccccaucucuacaaaaaaauacaacaguuagccgggagugguggcaugcaccuguagucccagcuacucaggaggcugagguggcaggauagcuugagcccaggaagcagacagagguugcagugagccgacaucaugccacugcacuccagccugggagacaagacagagcgagauccaggcucaaaacaaaaaaaucaaaaacccaacaacaaaaaaaccuaugaaaucacuaaaauguguggcauuuauaaaaucauuuagcaaacaaccuuuucucuuuaugucauuuuuauaagcagguuaaaagaucugcaacagagggaauaacuuccuuaaugaaaaggacauauaaugaacgaucacagaggauaaauaaagcaaggugacuuacaauccucucacuaauacuccucuagcaaguuccaacauucuucuuaaacuuuacuuuaaaucuuaauauaauuuaucccaaacauugcauuaccuaauacuucuacuauaacuuuuccauaccuauguuuuauauaauaauauguaccacuuagaguugaaagccugauagaaugaaacaguguacuaauaaaacacaccuguaauggcauugggucaucuguaauaaaggagauuuugaaguuacugcauaucagcuuuccccacaaaucguacuggcuugugucuguugcaaugcauuuucucacaaaauugacuucauuuacgacaauuucuccuuuaaaaaaagaaaaauauuuguaagguacuuugucauaaaauaccaacggucuuugugggaccuagaaggaguguuucaugagggcaaggaugaggauagugaaaacauucaccaauugcccaccaggugccaggcacuguauggucauaaagugaauaguaaugacaaggcauuguucuccaaggcguaaaacugaggcaaaaauagcucaggggucugagcugguugaaccagaaaggcugacuucaguguacuuuuuuccuaugccauacuaccucucauuauuuaucugcuggaagacuuucuggagaagaaauaaacuacaccugcuccuucagaguauuacuugauggaauauuuguguuuuauuaacacaugacuugaucucucaaaccaaugccuuugauuccuuuuguaaggaaugagaaacagagcucagcuucacugaauguaaaauguauuccauaaagccaaaucaaguuuccuucugcacucagauuauaacuuaguaggcaacaaaaccuuaaaacguaguuugaguuaaaagaaaagauuaaaagaaauaaauauaagaaaccaauauaaaaguuauaauguacuuuugaaagaauacuuuucuacaauuuauuuaaagcuuggucaucauuaaaccuuaauuucaagaucuaaaagucaacuagacgcagaacauuuuaagccaucugucuccagggucaaugguagaaaagugaguguacugauccacuuugccuauuucuuucauuauaaaaaccuuuagcccgauagaauguuugcugacaaacuccaaacuccuaccaauucaugaagaauggaacuauagucucaaaacaauccucucuuuaacaaauagguuauaacaaauuugagcugcaauaacuuuuauucgaaguucuuaaaaauguacaaggcuaguuuuaguaacugccccuuaacauuuaccuaaaaucugcucaugucaaauucacagugccaacagcuugaguuaacuuccacuuugaagacaagccucccucucauggcugggagcccugcauacccagccagcuaccagccuuccucacccucacugcucugcccacagugguggccuauuaaucccucaugggaccaugcuucuucccauuucauggaauauucuuuucuucuaccuuaguccaaccacugucuagggaaugccucuuuaaaaaaaucuuccuaucuaguuuacauucacauaucgaagcauuguauuuccagcacucaugauagcuacaauuauauuuauauauuuuuaaauuaaugccugcauuacccucaggauuauaugcuccaugaggguagaagauggacugacuuuauucacugcugaaauguuagugccuagaacagugucuggcacaggguaggugccugugaaaagagugcugaaugcaagaaugaauaaaaucacuucaugacacuugguucuguccaccaugaguugggcagaaguuguucuagauaagagaaacuaguaauucaauauggcuaagcagccaagcuggcuggaagauaagggcuguuuggguaaaugauauguaaguuagagaagagucacagaacugccacugcuugccuacauaugcauuaaagagcuauaaauaggacaucuguccugucugauucuuucaacaaccuguaaggugaggaaggcagaugguuuccuuaauacacagauaaaggauuugcacccaaagagguuaaaucacuuuccuaagaucuuaaaaagaaguaguggacuucgcacuuauaaccaaguguucugacuucaauucccauagucuuucccuauaauuacauacaauuaaauguacugcaguguagcaaguaccaaaacuuauuaaaguucaaauauuggccuuaacugaauucuaacgagaaaaaaaauuuaagaugaccaaauauauauauauauagacgcacugaguaauucaaauacauaaaauuuaaaucuucuuuggcuccuugaacauaaaccucaccaauucccauaucagauucugggccacugaauacucaacccuuucuccucuccaguaaaucuuagauaugaauuguaagcaggcccucaauuuaaacaacuaaacuaaccaugccaguucagauagaggacacagcccuguaacaaugacuucuuuacacggaaucaucacauacugugccaccuuagcaaacucaucuaaaaacagacucuucaaaccuugcuacaaaaauucauccacuucuaagacuuaugauccacacaaacuuguuaugcauguuauacucaaauaaaaauucacuuaaaggcugggcgugguggcucacaucuauaaucccaacacuuuggcugaggcggguggaucaccugaagucaguuugagaccaccugagccaacauggugaaacccaucucuauuaaaaaaaaaaaaaauuuagccaggcgugguggugcgccaggcgugguggugcgcaccuguagccccagcuacuugggaggcugaggcaggagaacugcuugaacccaggagguggagguugcagugcacuccagacugggcaacagagcuagacuccaucucaaaaaaaaaaaucacuuaaacaaacaaacuaccauaugauuucagguuccugagaagggaagcagaaguaauaacaggaaggaagagacagagcuuguguggcagagccuuguggccacacuaguaccauaaacaaacuguauuuaggagucaaacgcccauggacagcccuucuucucuagaagccagauucuuuuacugaugcacgaauguuaacguaucaagccuaugaacgcagugagaaugagacaaagaagaggaggagaauauacuuaauggguccaacggaugguaaaccauggcccacgggccaaauacaaaaccuuguuuuuguaaaugaaauuuuaguaagacauagccauacucauuuguucaugugccaucuauggcugcuuucacaggacaaagacagagcugaguacuugaaacaaauaccuuaugguccgcaaagccuaaaauauuuacugcacuucacagaaaagguuugcugaucccuguguuagagauaguuacugaagcgacaacucuuaaaauuaucugaaacaagguuuagaagacacaacugggcaugucccaucugaaaggugagaagugaagcaccugaaaagcagguguuuuugaucugcaauguuguagccauuucaaagagcucuagaggaccacucacaggagugaugaggacagacaaccuuccuacuagaauguguccaugcaagucaagucaaaagaucccuuucucaccaaugagcuacagcacucagcagaaaguaaauauggaaaccagguuuaacugcuguacugcccauacuccaucaacaaaaagcaaaagcaagaauuuggaaaugaaccccgaggggcuagauuaagaguuugagauagcagaaugaacuuaugcuugccuuaauaaacauacaaauagacaugcaguaacagauguguguacaccuggguugguacauguguguauguuuucuagcucugcccucugaaagugcuaaaagcagugacgcuccagcaacaacauacacacucaguacccagcucuugcuuuuaaaauaccauuuuccaauaaaaagaacuagggcucuuuagagaaauggcugauuccaaggcuggggcaggggaaacagaagaugagucuguagccucugguaaugccagaauaccagaaaauauggaagugggggugaagaaaagcggggggacggcauuuccaaaggauacaagagccaagaugaaauaacucucaauggccaaagcuggaacaaucugagcaacaaaagaaauaacaaaaaugccggauuagaaaguaaauuaaaaaguaucugugaauccauacuguugucaacagaugacugaauaauaaauaaauaaauggcggagaagagacaaaucuuccucacagaagaauuccaauuaauaaauguaggaggaauaaggaaacaaaaucaugauuagaacauuacaguaaagaucaagaaacuaucauggacucaaugucauagacugaaugacugcugugugcaacaugcauugaugaaugcuaaauucagagagccaaacuuuaaggagaaacagguuauuuguauaagcacaaagcuaucuucccaaaaguauugacuaauuacugugguaguuuuaagguaugcccauaaauucgugauucuccucucuccaggaaguggagcuuaauucccaaucccuugaaugugggcugcacuuagugauuuguuucuaacaaacaguacagaaaaggaaaaacagucacuuucuagaggagaaaccugacagauaucacuuuaaccugaagugaucgagguuaaccucaccaauaaccaaucauguugaugucuugugccugcucacaugacacaagggcaaaggauaccaccucugugggucuuucccaaaauccauaaccucugcuuaaucaaaagaaaacaucggacaaauccaaaccaagaggcauacuacaagacacuaccugaauaauaaucuuccaaagcgucaagguuuuauuggggaaucuaaggaaaggguauccacagauucuucuguuauuugcaacuuuucucuaagucugaaauuacgucuacauuuuuaagucaauuugaugauguuucuagggggugguuuguuagaacagaaaucuaguaauuauaaaauuuuuccuuuuguaguaguauauuucuauguuuaaagagcuuuaauauguauuauuugaggcaaaauaaaaaucucauucucaugccuguaaucuuagcacuuugggaggcugaggcaggcagaucacuugaggucaggaguucgaaaccagccuggccaacaugguaaaaccccgucucuacuaaaaacacaaaaaauuagcugggccugguggugcgcaccuguacucccagcuacucaacaggcugaggcaggagaaucgcucaaacucgggagcuggagguugcggugagcggagaucacgccacugcacuccagccugggugacagaacaagacuccaucucaaaaaaaaaaagaaaagaaaaagaaaaaaaagaaaaucaaauucaauagaaaaaaacacgucaaggucuugaaagaugagaugaaaaagcugucacagacugagacauugagaauaaggagacacgacaacuaaaugcuauguaguauccuggaugugaaccugaaacagguaaagaacauuuguggaaaaacuagggaaauacgaauaaaaccugcaguuuagcuaauaguauuguugguuucucaguugagcuaaauucaccaagguuacauaagcuauuaacauuagcggaagcuggcugaagaguucacauuaacucuauccucuuuuguacaacucuuacaaauucaaauucauuccaaaauaaaacuacuaaagaagaaaauaaacaagagacacaacauuaacaacagccaaaaaaaagaaaaaagaaaaaaaaagugaaagaaggacucucugggccagggucuuuuaagcgccacacagccuuuucuuacagaauggaaaugagcccuuggaagagagcaaagaacagaaguacagagggauacaggggaagaagaaagaaaagaagggcacuucugaggauaugcuacaauugggucuuccuauuacaauaauuaagugucgaguuagugacaugaguuuuauuugauaaugcuaaauuuuguucaugcagaaccagucuuuaaaauauuuggaucauguagcacagcugucugcucacguaagucauuuguucauaauuuuaaaaaaaaggaaugcugaagaggagcugucauaagcuccugccaugcacugaaacacugugggccagaaaacuagcuuauacacagggaagaaaaagaagacacaaaguggccucuucccagauaggauauauaaaaagaagguacugagacugcucuuguucacauguuaaauuaagugaccuugaagagaaaacuccgaauaaaagcuucaaagcucuagagguucugaaguuuucagggagacuauacgccugugcuuuuuaugcaguaaaaggguggugugcuagagacggcuggcuggccugcuugugagaacccaccagacuccucucucccagcucugugcuaugccaucagccacggugggaccauuuacagcaccaagcacuucccaggaugccacaaggaagccucaugaagccagaaaaagcaggaaauuagcuucagugugcgguaagcaaaaaccuucuaaauuagaggaugaugagccaaagguuucuacuaacaccugggaggaaaucaagaaauccaaguuuauuuucucaagacccuuucaucuguaaauauaaauaagaagggaaaugcaauuacaguuaauaaaccuccaaaugauauggcuaggaaaguuuuuaacucccugaggaccucaaaaccauguuguauuaucuuuccuaacaccuuauacauuuagaaauucaucacguuugauggacagaaauaauguuucccauacauuuuagguuggaacacaguuuaaggcaaagucucacggcacacguggcuaauuaaccugugggauguguagaggccaaaagcauaacuuaacuugggcuuuuaacaguagggugacugccccaguuugucugggacagagggguuucccugggaugugguauuuuuagcacuaaaaccaggacagucucaagcaaacugggacaagcuggucacccuagcuuuagguaaauucaggaauuaaaguggcucaaaaguuaucacaggaaauugaaacuauguggaagauaaacacaaaucuuuaaugcugguacuaacacacaauguaaaaaagcaaguaccaaguccagugaguagcacucaggauaggauggggcaggaggaaggguauagugccgaucucaggaaaaauuguagaaugaaaucuugaaggaagaagagcauugagauaguagagaaugugugauaauaacaguaacaagguccuaaauaaggaauaaggcaucuggaagagaccaaggaagcggcaugauugaagcaaauaucaauauugggaaauacugagaaaugaagucagugagguacaguguuagcaaauuacaagguuaaagaauuuggauuuuauccugcuuaaguaggauuuuauuuauggagguucaugaacgguguugacaacgauagugaggaguuuggagggguaagaaaaugcuggccuaagguacugcagcaaaagccuaaggaauggacagcuccaaacauuccuaaggcucuacggguaagguauaaagcuaaugcuaagauaguacaguuacacuguucacuguucugaggguguguuacaaguccuuuggucuuucaaaaacaaugcauucacaaauuaaaauacuacaaaaaucagucuacaaucauuuaugaagccuaccuacaaaaaggaauuacauaaaacacuugaaagauaaagucuuugccuuuaaggaauuaacaacccaacugaggaaauaagacguauggugagacagaaaacaagaacaguacgggccagugagcuuguaaaaaauaaacaagacaucuauacaacaauggcuauuuucauuucccagauggcccaugguuguaugcuuuucugauccgauuacaaaagacucugacaaucacugcauucauuaucuaauaguuaaucucaagaaugaaagugcugugagcacuguagaugcgaacagggaaagaacugagcugacgcacagccucagcacaggggcccaggcucaacgggcacucaagauucagagcacaagcauuuguuuccagagaucuuucuugacaccccugcccuacuccaaaucuggcuuaggugaccuuccucugagcucuuacuacuuuuucucuccucuacugaagcaucucuccagugaacugaaacugucuaagaacaggaucccaucuccucagcauuuuacccuucugccaaacugcaucaagcacacacucaauaccugcagaacaaauucauuaucguuagucuuggcauuucaacucuucucccuuaaaaaagagcaugcccuggggugagaagagagcaaaggccaucaagccccacucacugcaaaucuuacauccucaauacaaagcugcuggcauuucaccagacugugcuucggcacagccagcaacaggaaguccacuaccucccuaagacauuccauuuucuggcagcugaaauucucugaaaguucuucugcacgcugggucaaaaucugucacuguugugaaaagggcaaagacaaggacagagcucuuuuuacuucacuagagaacucccucuaggcugacauccaaucuacuccccaacaguuccaaagcauaaaucuguacccuagugucaccagugcagccaggugggccgugcuacuuagcaguuaguggcacagccugggagcuggacagagaacucuggcucugccuugcuagcugugugacacugggcaaguuacuuaaccucagcaaacuauaguuuucacaucugucaaauggagauaaacugguauccuagcugacaagacuguuaugaugauuaaucugcaagcuauauuaguuaaggauccucguucaaaguauguucagaaacaugccugguaauagcuuagcaaaaagaagaauacaaggcuuuugugucaccuggccugcaaggacaaugaaacccagggacuucaacacacauuagugcacuuccuugggguucuucacucuuuucaacagauucuucuggaacuguggccacuugcagcauuaccaaagaggaccucuucccuuaguaccaaccuaacaacauccagaggcagaccuguguucaugcuugcaguccaggguggguuauuaaccuugcuggccacacuggaacccaagguuggguggaguuagucaggaaaggauaauuugucaaaagagggaggaugcauuuuucagaggaugguggaagggggcugggugugguggcucacggcuauaaucccaacacuuugggaggccaaggugagccaauugcuugagcccaggaguucgaaaccagccugggcaauauaguuggaccccaucuccacaaaaaauacaaaaauuagccaggugugguggcgcacgucuguaguccuagcuacuugggaggcugagcugugaggaucacucgagcccaggagguugaagcugcaguaagccgugaucacaccacuacaguccaaacugggugacagagcgagacccugucucaaaacacaaacaaaaaaauggcaguacuccuaggcagacaaaauaauuaauguucucugugugagugcucacaaaauuguaucuauaguauuauaauaaucucaucuaguagguucuaguuuagauuccaaaccagguauagugcaaaacuaauuuaaaggaccaauaaagaguuuuuaacuuuuuaauuuuguuaacuuaaaaacuuuuuuaaagcuacagcuauuaucaccaacauuuaacaaaaaaaguaucuauuccaaguaaguuagaagaacauaaucucagaauaaaagacaaucuuuuaaaucaaauaaauuuaucuuuauuaaagaaaacugcacuuuucuuaauuuucucacuuugaccaagggcugguaaaaacuucauccaaaucugauaccaggcccuggcuggaaucuggguaccagugauccaggucacagucuucuaccuugucaacaggcagcuuagggcucaccccacgccuuucugcgauacaggcacaugacaccuccagcauucucgcuauccaggacagaccuggcacccaggagauacucacauccucaccgaaccgauccaccaguccagcagcuaaacaggacagagucuggcauuacaugcucuuaacaaauauauacuggaacacaaacauauauacacacacacacuuuaaaagucaaacucaguuuucaaguauuggagugauuuuacacauauacaauauaaucacugaaagaaugaaauucacauaaugagaggaagauaaagagaaagccuacacaaaagcugacuacuuugacagaguacucuauuucaauuccaggcuccgacauaaaucucuugaaaugucuggcauaaaauaacacagucuucccuuuacuccuaaaucugaaaguuagucugugugugugccuggguaagguaacaguuuaagccagguggucugagagguccuuucguucagucccucaguaaacaucucagugucuaccacauuccuggcacuuugugagacaucaagaccacaaaguugaaguaggcacaauacccaucucagaguuucauguaucaggaaagcugaaaauuacuaacauaaaccacaaucuaaauuaaauuacuagucauuuucuucuguuuucuuuacuuaauaaaagaugaggaucauuuugaaauuaggcuuaaguuccaacagugcacauggugacagcacacaaauaaacaacucauuuuguguucuaauuuucaucugcuuauugaauuagaaguucaaacuuugggcaacugaaguaggauacccuuggacccaaggcauuaugccaaagcaaagcaugcaauaccauaucucuaacaauuaauucuuuuuuuuuuuauuuuuuuuuuuaaguucugggauacaugugcagaaugugcagguuuguuacauagguauauacgugccaugcugguuugcugcacccaucaaccccgucaucuagggaugacgccgggaauuucaagccccgcacgcauuagguauuuguccuaaugcucucccuucccucaucccccacccccaacacccccgacaggccccggugugugauguuccccucccgguguccauguugaacaauaacuucugcaucccuguauauagccacaggugauguggccagguuuucuauugauucugauagucacaaaggcaagaacuauauuauucacucccucuuaguaaaagcucuagccuagucuaggucuuuagaucaccaauaguucgguaacuuuccacuugucuuccagauuucauggguagagcaguaggcuacaggccaacaaagagcaaaugguagcagugagagaugugacaggcgagguaaagcaggaaacagagaccacaacagggcagccagacagaacacagccaggaugggugcaggaaggccagaaugagaggguaagaacagaaggggagaggaagggggcaaaagacauccuaauucaggaccggcuaaauguuggguaaggauaagucagguacaaacagaaugcugggugauagagccgucauguaugcauguacagauuucagcuaugauuuggccgccaaugcaauaaaaauuaacacaggucagagaauuccuuaaugggcaacuaaaagguucagacuuaguguuacagcucuuuuagaauuucucuaaaaauaauacggaauuuagcugccauuucugggacaagaaaagcacagucagaaacuugguuuacaacuuccccagaaaacucugacuuuuagccauuuuauagaauugauaacccucagugagaaaguucuucaaguuuaugcauacuuaguaacaccuuuucuuagcacauaucuuaaauuuaaaagcuaauuuuaaaaaaguggccaggcgcaguggcucacgccuguaaucccagcacuuugggaggccaaggcgggcggaucaccugagggcaggaguucaagaccagccuggccaacauggagaaaccccauuucuacuaaaaauacgaaaaauuagccaggugugguggugggcuccuguaaucccagcuacuugggagacagaggcaggagaaucgcuugaaccugggaggcagagguugcagugagccgagaucacgccacugcacuccagcccaaguaagagugagacucugucucaaaaaaaaaaaaaaaaaaauuuaaaaaaaauuuuaaaaaauuaaaaagcaagcacugacauuuacagcuaagaccauguuguuucugagugugaaaucauaguaugcagaguggaggaaucaaagccuaagaaccaggccuguucagaguaaacgaagucaaaguucaauagcucauaggcacucauucaagaugaguacuguuuccucgucccugcauuuuaaaugcucagagugacuaagacuaaaacagagcacacagggagcaaggguuacuuaguaauucuacuguucacucugaggaaaaguacaaaugauuaauuaguacacacuguugagugaaaagcacuaacaaaaucaagggaaaauauuuaugacucccauaguaaaguuuaaaaaacacuuuuuaaacuuucauauggaaccaaaguuugguguuuuuaauauuuugucccuauauaauauuuaaaauuuuaaaguuuccacauuuguucaauuuuuaccuacaaaauucuaauuauuuuaccgauuuggcuuuaaguaaugagucagauuuugcaaugcugauaguagccacacaaacuaguauuugauuucagguuuuuuuuuuuuuugagacggugucucacucugccgcccaggcuggacugcaguggcaggaucucggcucacugcaagcuccgccucccgaguucaugccauucuccugccucagccucccgaguagcugggacuacaggcgcccgccaccaugccuggcuaauuuuuuuuuguauuuuuaguagagaugggguuucaccguguuagccaggauggucucggucucuugaccacgugauccacccgccucggccucccaaagugcugggauuacaggcaugagccaccgugcccggccgauuucagguuuaaaacaggcuuuccuaaguaucuggcuacuuccccuaauaaucgcauuaaacaacugacuuuuccuaauuauuauacaauuguuauacaauucaaaauaccauaccaauauucuguaugcucuaaaacaaaccccuuucuaccaccaaucccuacuuccaucucuaaggucaccuauagcaaauuuuguucuaaagcagugauucucaacugugagauuuuugucccccagagguaggggacaaaaaaaaauuggcaaugacugguggcauuuugguguggcaacuaggucgcaacuagguggugggggauaaggguacuacuacuggcaucuaguggguggaggccaucuuuguugcuauacacaggacagccugcccguccaacuaugaauuaucuggccccaaaugucaauuaagugucucugcugggaaaagccugguucuaaacugaaacaagcaaauuugcaaauacagcugacaacuucaaaaaacaauugccaagcaaguaauucaaaguucacuaagcucuguuauugguauagagacacacacauaauaaaggcgucuuuuuauacuaucaaaaugcauuaaaaugauuaaucauuaaugcaauaaguggcaaacacgucagcaaagaguacuuuuacuacccaagcaauuaaacauauacaucuuuucaaaaagaaauucgggagacaaaaaaggaaaugagguaaugacauucuugacaguuccuuuuucuccucucagucacuagacuuuuaacuggagaaaguuuaaugagagaagggaaguuaaccacaugauacuagucggcagaauaaucuuaaaccaaaauacguugcuaaaguaucuguuagaauccuaacuaauguuuaccuggcaaaaggacuggcuccaguuuuuuaaucuucgguuccgaauugaucuuaucgucagucugaaauacauuagcaaaauaaaucaaaaucucaauccccccacccuccguaaaaugcuacagcaaauguuguuuucuaagugaugacacaugcgaaagacacacagccccccauuuaaauucuuucgcauauuaacugagcuguuuuuaagaucugcucauuaucgacuuggaagccuaauaauaaaaaauguuuaaacugccagugucgcuuccagguguucacauuuaugacagacggguaaccgccucgaccagugaccccaagcgcugcaaucaugcuggcggucauacgagggagggucgauggguuggaaacuaaagaaaaccccagcucccaaggcuccccugggccucaacacuccgcaaaacuacggacgacagaacuucgggcagagaauggcugcagaagaguuuuacaaguuuucgccgagccagugggggcucccgagaaggcgcauuucgcggcgccgggaaucaggcagccgcgcugcugugggcagggagacgcgcgcagccuccugggguccuccaguucccgggggucggccuggaggcuccacggaagcgcagaggagagucgggcgcucgcggggagggguuguuuaccuggggcgguggcaggagguaggaccugaagguggguuugggcggcuugagggagaacauggugccgccgccuuuucgccccguucccgucgcgggccaguggcagcgccgacgccuccgggcguaaagcucucagugcggccgcccaggcccuuucu

SEQ ID NO: 191784 - RNA, 13746 nt, Homo sapiens
gcgcggggcacgcugggacgucucgcuggcgggaggccacgggcuuuccacagcgcgggggaacgggaggcugcaggauggucaagcugacggcggagcugaucgagcaggcggcgcaguacaccaacgcggugcgcgaccgggagcuggaccuccggggugaguccgggggcgugggcggccaguccccaggcggcaccgagccgccuuauuuuccgcgcuuugccgcgugcaccgaaggccggagcuuggcccgcgggccgguugucugggcuccgaccgggcugcgcagggaacgccgggccugauucuugccguuguugccagaugagcauccgguuaagcuccugggagccuucuguuagcgccgugccucuugacaggcacgggugacuucauuacuuccuggugcguccucguggggcccuguuaggccuugcuuggcuguuucgccgcuggcuguuugagggcccggaagagcggcucauuaaugguuguaacgcaagugcagggcgcgggauugguucuuaauacuugccgccagaugauauuuugagcguagauaggauauguguucauuauuccuaaugugagggaggaaacuaaguccccgaacaaccgcgauuguuuccuccaguauuuucuacuuaguagcuuuaauugucuggcguuuccccuauaugaagacguuuuaaaaauugaacugugucacccaggcuugcaccgccgggugcuguguguaaguuguggaagcgcucgcaauuauucagauuccuguacuauuucaaccuuagcaagacuugguaagauacugggagggcagcuagcuaguuggcauuucaggagacggcuuuaaaagggacgugauagagcaacuucucugaggauaagaccaugcugucguagccugagauuuguucccauggggaccuauggccucggagcagcaucgcugcgggaucugcuuagauuucuugccgaccuuugggaaaucccacuguuuuguguuguguuguguugagauggagucucgcucuuuccgccccagcuggagcgcaguggcgugaucucggcucacugcaaccgccgccuccccgguucaggugauuccugugucucaagccucccgaguagcugggaauacaggcaugcgccaccacgcccggcuaauuuuuuguauuuuuaguaaagacaugguuucuccauguuggucaggcuggucucgaacucccgaccucaggugauccgcccgccuuggucucccgaagugcugggauuacaggcuugagccacugcgcccggcccaacucaccacuuuugaugaucucugccauuucucuuuauggagcaugugcaguguugagaauacguauuuugaugcaguacguguaguacagcucugaauuguguccuuuaacuuuggguaaguucuuuuuuuaguagaccuugcuucuucggaauauuucuuuucuuauagugccuaacacaauaauuaugcccaaauuagacaaauuaacauuugaguguucacagauuuauuacuguauuuaaaccauugaucuucaauucugaauuggagcugggggaggggagggagaacugucgugauauguugaggcuguucugauggguucuaagaaucuggccuguggagaugcaagaguggagaacugucguccacaauguuugaacgccguuugggcacugagacuaagcagcuccaaguguaaacuccuguugugccgauuccgcuuaacuagcccaaacgacuuaggacagugugaggcaccuuguaaauguucuuauaaauguuagcugccuauaucagccauuguuauuguccuuguccuuguugucaucagauucuaagcuucauggcacuggggacuugagacucguucagcguuuucucucuaguaucuuaaacagcggcaagucaugcgugacccgacauaggugcuagguaauacuuccugaauaaaucaaagccuggagucagauacuaugaaauacagcuaaugcuuuaaggggcaacuguuuaguuauauuaauaccucuuguguuuuuuuccuccauuuuauaggguauaaaauucccgucauugaaaaucuaggugcuacguuagaccaguuugaugcuauugauuuuucugacaaugagaucaggaaacuggaugguuuuccuuuguugagaagacugaaaacauuguuagugaacaacaacagaauaugguacgugucuguaggggaaaguaauuuuuuccccuagaguaaauguugcaguguuuccugaagaaguuguagcacgugcuacugguuaaaccuacauguuucuuuuucuuuuucuuuuucuuuuuuauuuauauuuugaaaaaauauuuuuuccauaauggaagccacauucaauacauguuuuuucuuaaaaugagaaaugaacuucacuuuuccuauagagauccagagauuaaccuggcauuagucuagucuuacuuguaucuguucagaaaucauguauuuuuauuuucaugguuaaguuucuaaauaaaaacauguugcuuuguauacauuuuggcuucuaaaacaauuaucaaaggggucauaguaaaaggauauauaaagguaacaauuauacuuuugacugagcgucucugcuuuuuuuuuuuuuuaacugcaacuaauuucuagacuguuacuuauugaaauugagaucuuuuuugacccugccuucaucagcucuguguaaacuuuauuggaaaaaaagcacuugguguauagauaaugucuuuaaagguacuggguggugagugggauuuccuucagauagaaauauuucucauagguuaaccauuccccuauaguauaguuguugugucuuguaccugagcugggaauccagaauuauuuguauuucugugcugccugcacaaaaaaucaugaagugaguuaaguaguuugugccacccaggaguugcaccuuuucucagguuccacuagaugguaugacaguggaauuagccccaggcagugucuaaaaucccacuucuguugcugacccuguggccucagaaaaggguucuuuuugcuuuguuuccucuuuaucaggguguuggaagaaggaucucuaagugucucucugugauccucugagcaaggagguagauaaaauuguuagcuuauuuaauuuucacuuuuacuaagacucuauuuuuauuuuagccguauaggugagggacuugaucaggcucugcccugucugacagaacucauucucaccaauaauagucucguggaacugguaaguugcacagaaggaaaauguauuuggugggugggguuaaagguacuaugugcuuccuacagaaaauuuacaaaaucuagaaaaugaucucaguauccucuuucuugucuuuuucuuaauucaggaucugggccuuuuggguucugcagccguauguugcaaauauuuuccuacuuuuacuugacuuuugacuuaggaugucuuguuagagaaguuccuaauuuaggugcaguccaaugaaucaaucuucuucuuuauuguagcccuuuugauguuuaaauuuccccuauuccaggguuauaaacuccuauguuguuuucuacaauugcaguguucaauauaguaccaguaacuacagguggcuacuuauaauugagaugugcuagaacuauaaaauacacacuggauuucaaagacuuaagugcaaaaaaaaaaaaaaguaaacuaucucaguaauuuuuuuauaucgauguugaaaugauaacguuuuggauaauaaguuaaauggcauauuauuaaaauuaguuucaccuauuuuaacauggcuacuagaaaauuuuagauuacauaucugauaugcauuaaaucuugcugaacaguuccagucuagaaaccuuguuuuacucuucacguuagaugaacaauccacuuggaacuguuuucaugcuuuuuaaauuucuguucuguguauccaauuuuuaacauaauugagauacuguguauuguuuuguaaccuaaauucuucacuuaaacacuggaugcuuaaauuuauauuguaggccaggugccauagcucaugccuguaauccaagcacuuugggaagccaaggugggaggaucacuugagcccaggaguucuagaccagccugggcaacauagugagaccuugucucucucuauaaguaauuuuuuuagaaaagccgggugcaguggcucaugccuguaaucccagcacuuugggaggccgaggcggguggaucacgaggucaggaguucaagaccagccugggcaauauggugaaaccccgucucuacuaaaaauacaaaaauuagccgggcguggugguggguuccuguaaucccagcuucuugggaggcugagacaggaggauugcuugaacccaggaggcagagguugcaaugagcugagaucaugccacugcacuccagccugggcaaagaaagagacuccgucucaaaaaaaaaaaaaaaaaaaaugccaaaagugguagcgugcaucuguggucccagguauuccaguggcuaaagugggaggaucacuugagcccuagccaucagucgaggcugcagugagacaugaucaugucucuguacuccagucugggcaauagugcaagaccucaucucaaaaaaaaaaaaaaaucguauaacuuaauuuugugacuuaaccuuccucccguauuuuccugauuguugagaaugaacuguguuccuuuccuuguggacaagguccauagcauccuucagauucucaaggagaugcuugacuacaaacauaagacagcacugguccauggccauguccuuucugaagugugugaaguauucaacccgaaauacauauuuauaggcaaugugucucaugauaggugcuguuagagaaauuagaguuguauuuaaagcucuuugcaaagaugaagacuacugggcuuaucaguuauugagagagguauguuagaaucucacagcaugguaguggauuugacuaucccugaaguucugucgauuuuaguuuuguauauuuugaaguugccuuauuugauacauacaaauuuuaaauuauucauaucuuucuggugaacggaaacuuuuuauuauguugugacccucgaucucuauuaaugcuguuuaccuugagguuucuuuuaccucgaaacaaucuuuguuuugguuaguuauaugcaugauaaaucguuuuccauccaaaauuuacuuucagcuugucuguaccucuuguaguuuagauuucucucuuaaaaacuguaugguugaauuuuuuuuuuuuuuuuuugagauggaguggcuggagugcaguggcgagaucucggcucacugcaaccucugccuccuggguucaagugauucuccugcugccucagccucccgaguagcugggauuacaggugggcgccaucacaucuggcuaauuuuuguauuuuuuuuuuuuuuaguagagacgaaguuucaccauguuggucaggcuggucucgaacuccugaccuugugauccacccgccuuggccucccaaagugcugggauuauaggcgugagucaccgcgcccagcucugguuggaauuuuuuacaauccagucugaaagcucuuuuaagugaauuauuuauauuuagucuguuuacauuuaauguaauuacugguguguuccaguuugucuucucucuguucuggggcuuccugucugucccacccguucuucaauccguuuucucuccuuuauuguagaugcucuccuucugucauuccauuuuuucuucugaugguuuagaaauuacucucuuucaaucuugaguuagcaucguaggaauuaaaacacacauauuuauaaaaguuuaaaauuaaauguuaagaucacuguaccaugaccuucaacauuuaauuuuaaacuuugacaccuuuacccugcuaaacaauacaguacagugaccuucaacauuucagcagccuucggguuguuacauauuuauucuuuuuugaagcccaucacuacaucgccauuacguuuuacacuguguauguaacaaauguuaccacuuuguucuuuauuccuuuuuggaucaucuucaguggggguaaaacaguaucaagcucuagagcucccucuggugguuuuugugacauauuugaagauggcagcuugcuuuuugagaauuucuggcucugcucucccuguuuuuaucuguacuuuuuuuucucauugugccucuugcacacacacaccccuuccccaccaucuacccaauuugcgccuguuccagcaguuucucuucagggcagggccguguugggacaugauuucuauuaagagugagggcccaaauugcucuugccccugcagcccuuaucacagaccccuguagucauuauuggaacaugcuggucuugggccugcuuuucucagucacuggaguucuccaguuuguaagacggcuccucgccuccccucugcuucuuccuguacaaaggccgucacccugcaagccuuguugcucucaacauggguugucucuacuuguuccuauuuuagaguuacugcagaaugccuugccaucuagcuugguuguagcugguaaccauagguuuuuguuuuuuugcuauccuuauugcacuauguuuuauggaacaauuggagaagauuaaaaauucacccugcccacugggcgugguggcucacgccuguaaucccagcucuuugggaggccgaggcaggcagaucacgaggucaggagaucgagaccaucguggcuaauacagugaaaccccgucucuacuaaaaaugcaaaaaaaauuagccgggcaugguggugggcgccuguagucccagcuacuugggaggcugaggcaggagaauggcaugaauucgggaggcggagcuugcagugagccaagaucacgccacuguacuccagccugggcaacagagcgagacuccgucucaaaaaaaaaaaaaaaaaaaaucacccugccuucuuuccauuaauucgaucauuuuuaagcuauacuauuccuugucccugcaaauuuuauuuaaagagauuuucaggggcagcuaggauaaauguaccuucuuucaaaagacaguauaccuuuguuguucuuagacgcugaagcuggcgcuagcaggaaagcccacuuacaccaagauucuggcuugcaguucccagugugaauagguugcuccagagucccaucagcuuugccauuguuuucuuuuccaaaucauggcucagcagccacuuugagauuccuguaggaaagcaauuucuuaucuccugcuauugagacagaagcuguuaaugccaagauuuuaagaagcucccauguauucaucgguagaaauuauuuaaacauuugugaugugcuaguauugggcuuguugcuagagaguaaaaauucaguaaauaaugaaaagacaacuugcuucaaaagcacucuccauuucagaaucucaaaauagcgugugguauucgcguucuuaccuguggcuauugcuugacagggugaucuggacccucuggcaucucucaaaucgcugacuuaccuaagguaugggaauuacauauugugacaaaaugaagcccuuuaaaauaacauuacuuuuaccagccuugaccuuaauguaaucagauaauuaaaaaauguggcacauaugcaccauggaauacuaugcagccauaaaaaaggaugaguucauguccucuguagggacauggaugaagcuggaaaccaucauucucagcaaacuaucgcaaggacaaaaaaccaaacaccccauguucucacucguaggugagaauugaacaaugagaacacuuggacacaggaaggggaacaucacacaccggggccuguugugggguggggaaaggggggagggaaagcauuaggagauauaccuaauguaaaugacaaguuaaugggugcagcccaccaacauggcacauguauacauauguaacaaaccugcaaguugugcacauguacccuagaacuuaaaaguauaauuuaaaaaaaaagugccuuuuacaaagaaagauugaauauauuuccuuaauguuaaauuguuacaauguugcaaugugaagaaugugaauguucccuugauuuauagguuccuuagacuauucaaacagaccucuugagugcugugccaugaacaaguuugccauugugucauuccuuuucuuguaguauccuaagaaauccgguaaccaauaagaagcauuacagauuguaugugauuuauaaaguuccgcaagucagaguacuggauuuccagaaagugaaacuaaaaguaaguaguaaucuguugcuugugagccauuauagaguuguguguuuuucuuuauauuuuuguuacugauuauuaaaauugucuaaaugaguaaauuuuaccauuaguuuguaauaaaagugggagggaaaauguuacaucacauuuuuuucuaauagcagaguuuaugauagaacuuuuaaguuggagcucucuuauguaaugcuggcuauuccgaaguucgcaaagugcugaggccacggugagcagucuuaacaguggauugucugccuagauacguucccagcggagaacuuaauguaaccuacuuucgugcagcuccguguguuaggaugauuuuucccuuuauuaggaauucauuauuuuauuauucauuuaauugccuucuuaguucccugggauccccuccuuggagcuaggagaaugaacuuucuucagggagcucuaccaaagaaagaagaccacugugucuucucuuaauuugaaauugcuuuuugguauuuucaccagcccggaguacuguaggagaguucgcuuccaugucuucugaggaaugcaucuaaaugcaugugguauuccuauuuccauuaacucuguguguggugucgcuguaggagcgucaggaagcagagaaaauguucaagggcaaacggggugcacagcuugcaaaggauauugccaggagaagcaaaacguaagacacggauauccaacuuaacucuacuucaccuucagaaacaugaucugaucugucuggcaguucgucuccuacaaaauuaaccaaaaacucugacauauuaaugugguauuaaauuugagugcuuauaguccauguacaucaaugguccacacaucacaagaaauuucuaccagcuuagcagagcaaauauuucaguagucagucuucaugugauaccauguacauccuauuuucuauauaggaagaugaacuggaugguguuucugaaggagagaguucuuguaucaguuuguuaacaaagauaagauacuacacugguugaauuacuuucaaaagcuuuugaaaguaaaagagaagcaacuucuguuggucuaggucuaacaguuauguucuucccccucuuaaguuuuaauccaggugcugguuugccaacugacaaaaagaaaggugggccaucuccaggggauguagaagcaaucaagguaaucauguguuaggauucuuggacuggaaugagcuaagauggguucagaacacaaagcuggauaauaaacauguuccgaacauugcagauuucauuuucccacaguuauuagcauacagcaauauuucuguuuaaggaaaaacuagcauaaaguuauuauuugaucagacuugaaauuacacaagcuaauuaauguggaggcagcuuugucuuucucauuuuccaaggugcauuuaucacuucgaacaguuacuuaccuugguaugcugucucaguguuugccuuaauuuuuacuuucgaagauuugcugucuggcaaauccuuuugacugaucaguagggacccucguuuuauaauauugccuccuuaaauuauucaguaacauaauugcaaauaguuacuucacuuagcuacgauuuuagaacauguggagugauuauuuauaagaaggccugcaucucuucaccaauuuuagaaauuugugguuuggcuucuaguuuuauuuuugugggccaauaacauucuucccccuacaccaaaguauuuaauguuccugauggagaaguugcugugaauuucuguaggugauugacacuuaguuuucuggguagcugauacuugguugaaguuaaucauccaucuccauugcccucuguccuccagaaugccauagcaaaugcuucaacucuggcugaaguggagaggcugaagggguugcugcagucuggucagaucccuggcagagaacgcagaucaggugaacaaaugguguucuuuguauguucaaauuaauguuacacucagaguguaacucacaaccauuuagaugccaugacucuggaaugccagaguagugccuccuuacaucaaaucuaauauaugaaaucucuuuaaaugcucuuugaagauaaaguauuugauggguugggugcaguggcucacgccuguaaucccagcacuuugggagccugaggcgggcggaucaccugaggucaggaguucgagaccagccugaccaacauggagaaaccccaucucuacuaaaaauacaaaauuagccgggggugguggugcgcgccuguaaucccagcuacucgggaggcugaggcaggagaaucgcuugaacccgggagguggagguuguggugagccgagaucgcacuuuuguacuccagccugggcaacgagcaaaacugcagcucaaaaaaaaaaaaaagguauuucaugaagaaaguuaaguuacagcacugugggggguuuuauguaaaaguugaagcuagaauuacuucagccauggagugcaccgaacacuagcgauagccauguggacuuuuaccuauauauauuugcgugugugcaugauaccucaguaguuaggaacacaggcucuagagccaagcaguccgaggcccaaaucucagcuucaccagcucugccuuuggacaaguuucuucaagucuuuccucaucuuuaaaucugagauaacaauaguagcaaaccucaaaagguugccgagaggcugagagacugaacacagcacaaggcucaacauuagcgaguuuuugauaagugguaacuguucugacaucugaaugccugcuuuaugcuaggcugcauguggggcacuagggauauaagauaaaaaguacugaaauacgucuuacaaguuuugauaugaauguaacuggggacagccacucagacugccgucuuggggaaguuuccuagggaaauaauguuugagcugggagcuaaaaauuaaaaagacauuuuuuuccuuuuugagucggaguuuugcucuuuuugcccaggcuggagugcaguggcgcgaucucggcucacgccaaccuccgccucccggguucaagcgauucuccugccucagccucccaaguagcugggauuacaggcaccugcuaccgugcccggcuaauuaauuuuuaguagagacagcguuucaccauguuggccaggauggucucaaucucuugaccccgugauccaccugccucgucuucccaaagugcugggauuacaggcgugagccccgugcccagccaaaaagaaauuuuuuaagaccaguaauucucuacuguaugguuugugggccucugggagucuguaaggugaagacugauuuuguuguuguuguuguuuugagacggagucucgcucugucgcccaggcuauagggcaguggugcaaucucaccucacugcaagcuccgccuccuggguucaugccauucuucugccccagccucccgaguagcugggacuacaggcgcccgccaccaagcauggcuaacuuuuuguauuuuuuuuuuuuuuaguagagacaggguuucuacuaaaaacacauguuagccaggauggucucgaucuccugaccucaugauccacccgccuuggccucccaaagugcugggauuacaggcgugagccaccgcgccuggccgaagacuguuuucaucuaauaacaccaagguguuacuugcuuuaguaugaacauuugcacugauggagcaauaguggguagaacugcgggcaccucaguaggagucaaggcagcagccuaaauaauagcuguuacauucuucccugcucugcacucccaguagcgugcauaccaguuucacuuaagaguguccuggaugcagcaguaaagauaauuaaauaucacuccucgggcacacgucucuuugauauucugggugacagaaagggggugcacaugucugcauucuugaguuaggugguuaucuccaugcacuggugcaguuguuucaguugagaggcagcuaccugucuucucaaacaugaugaagugagccugucacuucagggaaaacaauugaaaauucaagguuuaaagcaaaaauuaaaauuuagaaaacuuguauccacugccguaaccugccagcuucccaguacuuuaagacuuuucuggggaacucaauaguaauguuaugugcaugugaauuaaugggugugacauuuuugauguguaauuacauggcucaacguuuggaagaucugcaaaagucggugaaccacaguuuuccaaaugauacgaaaucauguacggguaaaagauuuguucaaaguacaagauaaaccaaguaagaguaugaaaaguucauugauaagguuucagacuuuuacacugccaucuaaccuugaggaagcuaccauuugucaaguuuuagcauaguaucuaaaaagagcauccaccauuaucugcacaggcuguuaaaaucuuccucccuuuucuaacugugugccuguguggccagauuuucuucaugcccgucaaucaaaaugccguauugcacaggauggaaugaugaaaccaauacaauaauucagcugacugauguuaagucagacauuaagucaacaauaacaauuguuucccaaacaauugaaggaguuacaacuuuuuuuucccccuggaauacauugagcaaaauaccugccauaaauuguugaacaaauguaacauuuuuugguaguuguuggcauauuucccuaauuuagagacaauaaagucauugaacuguugccaguauauggcauguaguaggugcccagauguuuuugaguauuuccgguuucuuugccuacgguagugccaugaaaagcacaugaguauaggcuuuaccuucaccaaaaaugaauuauuaucaacuacaaugggaggcaacaauuuugaaaucuuugugacccuuuuccuuugaaauugagcaucccuuccaguaccugccaaagacagacuagaccgucccuggacgauaagcuccucaaaggcaggugcugcuuuugaucuuuuuguaccuacuucaguguguaacaaacaguggccacagaacaaacacuugcaugcuaagggaauggauucucuaaaauugauacuacuuuugcuuuggugguuuucuuuagggcccacugaugauggugaagaagagauggaagaagacacagucacaaacggguccugagcagugaggcagauguauaauaauaggcccucuuggaacaagucuugcuuuucgaacaugguauaauagccuuguuuguguuagcaaaguggaaucuaucagcauuguugaaaugcuuaagacugcugcugauaauuuuguaauauaaguuuugaaaucuaaaugucaauuuucuacaaauuauaaaaauaaacuccacucacuaugcuaccaa

SEQ ID NO: 191785 - RNA, 52436 nt, Homo sapiens
auggcaugcugucacaaaguaaugcugcugcuggacaccgcgggcggcgccgcccgccacagccggguccggcgggccgcccugcgccuccucaccuaucugaguugccgauucggccuggccaggguccacugggccuucaaguucuuugacucgcagggggcgcggagccggccgucccgcgugucugacuuccgcgagcuggggucccgcucgugggaggacuuugaggaggagcuggaggccaggcucgaggaucgcgcccaccugcccggcccggcgcccagggccacccacacgcacggcgcccugauggagacgcugcuagacuaccagugggaccggcccgagaucacgucgcccacgaagccgauccugcggagcagcgggaggagacugcuggacguggagagcgaggccaaggaggccgaggccgcgcucgggggcuuggugaacgccgucuuccuccuggcccccuguccgcacucgcagagggagcugcugcaguucgugucugggugcgaggcccaggcccagcgccugccgcccaccccuaagcaggugauggagaaguuguugcccaagagaguccgggaagucauggucgcccgaaaaaucaccuucuacuggguggauaccaccgaauggucuaagguaaggaagguuacugucgucucagauggcgugcacggugcuuuccuugcuaaccagaacuuggcagcguccuuagaacagccacagaccccgaaugagacuaauaugacuaugcgucccuucggaaggaaacaaauaaauaggaacaguuuucacaacaaaauggguaguuccucacuaccuacuguuuaagaccccucacaauuugggcccuaccugccuucccagacuugauuuuccuacacacuacaucuacucuagcauauugaaguccaguccagaaaaucaacaggucuggacugcuuguuuuguguuauguguguuguucaaucugccuggaaugccaguucucacucuuccaggccagucuuaacuucacuuacccuuuaaggcuucuucucccagugacaacugcucaguccagcgucugaauugccauacacauuuuguguggcacuuaaccauuucuccauauguuuugauuaugcacaucucucacccuccaucuagucuaaaaauaccucagaggcaagcagcagguuuuaacacaauacccagggguguguguguauguguguguguauauauauauauauauauauauauauauauauauauauacacacacacacauauauauacacauuuauuuauauacauauauauauuuauuuauuauuauuuuuugagacaguguaugucgcccaggcuggaaugcaguggcucacugcaaccuccaccccuccggguucaagcgauucucaugccucagccucccaaguagcugagacuacaggcccacgccaccaugccuggcuaauuuuuuuguauuuucaguggagaccagguuccaugcugcccaggcuggucucaaacucuggccucaggcaauccgccugccuuggccucccgaagugccaggauuauaggugugagccaccacgcccagccacccagauguguauuaaacguuguagguguucagucaguauuggcugacuaaaugaguacauucuugcguacauucuugcaaacuuaaagucuuaaauggcuaauuuggauuuuugcugaggcggugaggcccccugcuccuguuaagugcuaggauaaguauauacuuuugccuucauccuucucauugcacuucauuuagucaacaaauguucauugagaagccaguaacaucugagugccuaccacacuguuugagcugcuggggacaugguaaccaaagcagggaacagauuaaacagauaagcaagugacaauuucaaaucaugcucuggagaaaauaaaauggggugagaggaugggaguagaaggugguuauuguauacagagugguagugagggaaggccuuuuuuuuuuuuuuuuuuuuuuuuuuugagacagagucucgcuuugucacccaggcuggagugcaguggcgugaucucggcucacugcaaccuucaccuccuggguucaagcaauucuccugccucagccucccaaguagcugggauuauaagcgggcgccaccaggccuggcuaauuuuuuuguauuuuuaguagagacggaguuucaccaugcuacccacccuggucucaaacuccugagcucaggcaguccgccaaccucagccucccaaagugcuaggauuacaggcaugagccaccgugccuggcagggaaggccuuuuugagcagagaauugaauggugaaggaggaggaacucaaagguagguaaagaacauuccaggugaggagacaagcagguguaaggauuucagcuggaaaugaacuuaguuuguuucagaaacaaaaaggcaaggagugcugagaccuaguaggcaaggggagcagugugagagaaagucagaaagcaggagaggccgaucuguagggccaaggucaaaaauguggauuuuguucuaauuaauuaaugggaaggcuuuggaaugugguuuaaccaagugaaagaugugauuccacuuaauggaaauacaugucacuaacccaggagugaguuaaauugcaagauuacagauggaaaaugagcaagcauuuaaauaauaauaugguauguuaaaauuuucaaagugcuuucacaugcgaagcccaaaaaaggcguggcaaaugcaaaauaaggcagcagugguuugucaagaaaaggaagggacaaaaaguguuuaaggggaugguaaacauuugauggggaaaaugaaauccuagauauauuaaaauuuaaggcagccagucaagccuuagacacaguauacaacacauugcucagcuggaaacaauugauaucacaucaaagacuuucuucuggaauuuuauuauguuaaauacuggcuagaaauaaguuagauggggcuugauggaucuuggagauucuuugucucucuuuuuuucucuuuaaucucucucucucuuuuuuuuuuugaauagcauugaaauaaguggguugacuggaucuuuuuaaagaucccuuccaggucugauguaccgucgacugaggggaugggucaucucugaggcuucccuucuuacaucggcuguauccccuaagaaaaugcccaucagauacucaaguuuuucuggaauuuucuucugcugaagaucuaucauuuucuauucaaaaaccugcccagccaugcugggcaaaaggaagguuugggcuguguccuuggggagugcucuguccaggagcagggagaagggaggaagagaaaauccagguccugccuuggggagcgugcagucugggaaguagaacugggagaaacagaaccugcacuuacauuggaggcagagggauccaagcgcauaaaacaggauaucauauuugcaaagauauaggacagaauggaggauaagagaccucugacacauuuucaacuuuaugccuuagauuuauucaauacauauuuguuccauaccugccagguaugcuaaggaaucaaauagauguggucccugcccucuuggagcuuauagucuaguggacauuuacagauccccaaauuugaaacuaccacuaggacaugucugucacuuauccuauaauacgcauacgagugaaaaaugugaccauacucuauaguauacuguuuguauuuuuguuuuuguuuuguuugagacagagucuugcucugucgcccaggcuggagugcaguggcgcaaucucggcucacugcaaccuccgccuccuggguucaagugauucuccugccucagccucccgaguagcugggauuacaggcgcuugccaccacgccuggcuaauuuuuguauuuuuaguagagacaggguuucaccauguuugcuaggcucgucucgaacuccuggccucaagugauccacccaccucggccucccaaagugcugggauuacaggcuguuauuuuuuuuuaaucacauguuuugcuaugguuugaauauuuguccccuccaaaacucauggaguaaugggugucaugggagugggauugguggcuuuauaaaaagaggaagaaaguguugagcucacuugcugagccucaucgcccugcuuugcccugugcugccuugggacucugcagaguccccaccagcaagaaggccuuugcaaaguacaacccccuggccuuggacuucucagccuccauaacuguaagaaauacauuccuuuucuuuauaaauuacccaguuucagcuauucuguuguaagcaacauuaagcagacuacgccaugcacacauuaccuuuaauagaaacuuaagguccuuuucaacacuuauuaaaguuacaucuucccacccaccucccgagacagaguuucacucuuuucaccuacgcuggagugcagugguacaaucugggcucaaugcaaccuccaccucccagguucaagugauucuccugcaucagccucccugguagcugggauuacaggcacccaccaccacacccagcuaauuuuuguauuuuuaguagagauggguuuucaccauguuggccaggcuggucuugaacuccugaccucaggugauccaccugccuuguggaucaaagugagggguguugggauuacaggcgucagccaccacaaccggccauaaaguuacaucuuaaccuuucauuuuauuaacaggguuuuuuuguuuguuuuccuggcuggucuucuggcugaaacaauuucaacaaaauuuuuguguccauuuggcagaaaauccuaaucaggaucuauggcgucugaacuagguuaccauucucuccauagcagugaacacagauauagauacaugggugguaacaucacauacuaauuaauugguuaaucuaauacagcauuuuccagauugauauucaugacugaaaaguuuagauagauuagaagauaaugugcuccaauacauuguuuaucuucauuacaugggaucuuuuuuuuguuuguuuuuaaugcugaucauaaaccacucaauccaucagagaaucuaucaaaguccgucagauggucaugauccgaauuuuaaaagcagucuaggccaggccuaguggcuuauaccuguaaccccagcuuuggaaggcugagacaggaggaucucuugcacccaggaguuugagaccaaccugggcaacauggugagaccccaucucuacaaaaaauacaaaaguuagccaggugugguggcacaugccuguacucccagcuacuuacucaggaggcuggggcgagaggauugcuugaguccagaaaguuaaggcugcagugagccauguucauaccacugcacuccagccugggcaacagagcaagauccugucucaaaaaauaaaaauaaaugaaagcagucuauucagaacaguccuggguucuuggacuugucuaucauugccuugcugggaccauggacgauucccugcuugucuuugaacuugacuacaaugggaaguuugggaaugaccuaguugacuuucgagacccuucuaguucugauuccuaacauucacauagcaauuauaauuuauaauuguuacccggcaugaugagcauauucuaaggggugugcuccuucauauucccauaguagcugaauauuguuguuauacugugaugccacguuaaacauuuuauguugguacuguuuuauucacaccccccgccccacuucgagauccuagacauggcacauagaaguuacucaauaaaaguuuguugacagaagguugacugaagagucagcugugugugaaggagugaagcagggcuuuuacaaagaaagcaggauuugagccagauacagaagcguaauaaccauucaguuggugaagaaagaaggggaggcccaggaaauagaaaucagcaaaaacagggaagccuuaaaauauggcauguucaggaaauagcaaaugguucaauaugccuagaaggaguggggguggaugagggguagaagauaauguguuccaaaaggugguuuaggguuggcuugugaagggcuuugugauuaugcugaagaguuacuuuauucuggaggcagugggaagccuuucagaauuucagagaaguagcgugaccagagaagugauuuggaagaauacuuagagcaccauggaggaacgauuagaggcagagcacagacuuuacaggcuaugguaacaguuagggcaaaagaugccacgaggccucgguuugucucgucucugcacaggccugugggugggcaagucagagugauggucaccgucugggggaggugcuccugccucacucccaugacaccuggccauuauuguguugugcuguauaggacauaauuauuuuuauuaauaggccaggcacaguggcuguugccuguaguccuagaacuuugggaggcugaggcaggcagaucacuugaggucaggaguuugagaccagccuggccaacauggugaaaccucgucucuacuaaaaauacaacaauuaggcgggcaugguggcgcauuucuguaaucccagcuacuugugaggcugaggcaagagaaucgcuugaaccugagagguggagguuccugugagccgagaucaugccacugcccuccagccugggugacagaucaagacucugacucaaaaaaaaaaaaaaaaagguuauuuuuauuaauguauaaugguucuauguuccuucuaacauuuuaugaucuauacccagugauuugugucacuucuuucuguuccuugacaaaaaauauaaaugagguacuauuuuuacuaaaugaaugcuuucucaaagggauauaagguaguaauuuguucuggggcugcacaguagcuugaugcugaccauuauuucuauuuagcucagcaaauacauugguuguguaauucgauccuuuaauauugguaucaacuuuacuuucuccugauuuccuuuacuuuuauuugugaaugccuaauuuauaguaaccuaagguuguuugucguuuuauuuuaguugugggaauccccagaccaccuuggauacuggacuguuugugaacugcuccaccacggagguggcacugucuugccaucugaaucuuucagcugggauuuugcucaagcuggggaaaugcugcucaggaguggaauaaagcugucaagugaaccucaucuuucuccguggauuucaaugcugccaacugaugccacuuuaaaccguuugcucuacaauucuccugaguaugaggccucguuuccacgaauggaaggaauguuauuucucccuguugaagguaagcaaauaauauuuuaagguuuuuuuuuuuuuaaaucucaguuacauuaauuucuucaaagaagcuuuuaacuucuuuggcauuucucacagcccaggcacucaacgaaugcuugucaugaaagaauuaaaagacaucaaggcaaaaucagagauacuguaggaaagaguugaacucuuaauucaguacaacugccagccuuuguacaaaaaaacaagugaaugauugauuuuaaaguuuaccagcuguucccaaagaaggguaauauuauucaggugcccaagcacauggguauacgauuucauugccucauagaguagauugauaaauugaagaccauagagaaacaauggucgacuaaaagaagaaauaaauuagucuacagaaacccagaaugaugcuuguuaccaggaaaagcaaacauguuggaaucuucauuacauuaguuucaccauaugauuugcuauaugguaaaucucauuucugaauauauuguauauucacagaaauaauacuuuauagagauauguacauaaaacuguuguacauuaugugcaguuuaaggaauuuucaagaguaguuuuguuuauauaauuucauuacacagucuuuagaauuuaaccuccucauaagauaugaugcacuguacuuuauggauuuaagaaguggugucuucuuucuuauaaguaguaaacauugcuugaauacuuacuucuuuuuuuuuugagacaaggucuugcuuugucacccaggcuggagugcagugguacgaucauagcucagaucgcagcucacugagccucgacuuccugggcucaagggauccucccaccucagucucccaaguagcugggacuaaaggcaugagccaccacaccuggcucauuuuuguauuuuuuguagagaugggguuuugccuugaugcccaggcuggucuucaacucauggaccucaagugauccucuggccuuggccucccaaagugcugagauugcaggcaugagccaccgugccuggccuucaauacuuauacuuauuucuaagucauaauuucugagaaguucugccaucacauauugccuuuguaacuccauuuguuuauagcuuuuucuauagagcuaaaugaacuugcuaugaugacuuggcaguagaauaaguguugaaguguucaacuaagugacaguaucucaauugacaacuugauuauuuucuuauuguuauuaaaucucuuuuuaguaucuauuccuuauauuggaauuuuaaucuuuuuuuaaaauuuuaauuuggcauccuggucuaauuaaucuuuauuucuagcaggcaaagagauucaagaaacauggacagucacccuagagcccuuggccaugcaucagagacauuuucagaaaccagucagaauuuuucuaaaaggcucaguggcccaguggucucucccaacgagcagcacuuugggcacugacagcuggaugcuaggaaguccagaggagagcacagcaacucaaaggcuguuauuucagcaguugguaagcaggcugacugcugaagaguuacaccugguagguauccuccacacgggaaguuauucuugucuaacaacacacugguaaagugaaauaaguguguuuauaaaugcccuacacaauauagucuuaguaaaacugauuaugcuuuugcaaauaauauuguugacauuauaguaucaugacagcaaugcuuauuagagaagaaaucacuuauaaaauugcauguaccaagaauccaauuaaguuaaauuauauucacauagggaagaaggcaguuggccagaugaagugcuuauguuaggguaguaaugugaugagugauuucucauuguuuuuuaaauauucuguuacauauuuacuacuuuuauauaaguauuuaagaaaaagcugcuacacaguaaaauuagauguaauaguauaauaguuguguaacuauauacaauguaauauaauugucuguguaacucagcaguuggacaguaguuacacaaauguagaaaugucuucugaaaaggaacauauacauacccagauuugauuuaacggugagaauuauuuuuaaacuaccagcaaauuccuuaccuuacuuugucuuuugccuucauacucucaggaggggucucuauucugguucccauuguaaaauauucuagagaaaaauacgguagucauuggacagaugcuguucugagaguugugugcucugaggaaaagggcacuggguuugggagucagugaucuggauuaggucucagcucugcugccuacuguauguucuggauaaaucacucaagugguauuucugccucaugguuaaguacauggguuucaaagucacauaugcuuggcaucuucucuuacuaaguagguggcuuuaacagguuacuucugccucagccucaaucccuccuuuauaaaauggggauaauaauuauuuuuaccucagggcgauugugaggauucaguaagcacauaguaaauaccuaguaaauauuccugguaaugucagguuuuacuuauuuguaaguagaaauaugaggacucugugauuaauaaauucccuucuaccucuauuaaugaucaaaucuaucuuuuucauaguuuucacguuaauaauaauugggaaaaugguuauucugucuuuuaguacacuacauucuucuuuaggcauauugacaauaauauucucaacuaauuagggcuucucacguagguugcugauguggacccuggugaaggccggccccccaucacuggaguuauuuccccacucucugccagugcuaugauccucacugugugccgcaccaaggaggcugaauuucaacgacauguucuccaaacagcuguggcugacagcccccgggacacagcuucccuuuucucagauguuguggauaguauauugaaucagacucaugauucgcuugcagauacugcuucugcugguaagcuccuaaacuaguaacuaacagagucuagggugguuugcagucuuuucaagcaucgggacuuuuucacugugcaguuaguagaaccccaauauguuauaacacagaugaaagaaagcuauaauacuucaggcaguuuaaaucauuauuauuuauagaauuccuuaaguacuucugaggaggcugcagguuccaugaaaccagucugaaaucgaagucaugguuuuuaauauauuuaagaaauacugcauauaaaacuguagugauucugucuacccugcauugcauuguuacuacuagcauugcaacuaaaugcauuguuacuacuaaaucuaccuagcauaaauaagguuuguaucauguuaguauuacaaaccuuauguaagcuagguagauuuaaauauacguauacauauauauauauauaaaaucaacuugauauuucuuuaauucauucauucauucaacagauuugaguaccugcuguauggcaggcacuguuugaaguacugggacuauauuagagaacaaaauggacaaagaugucuucccauggagcugaccaucuaguccagggagacaaaacaauaagucaggaaaauuacgguuuagucuaaagagacaaaaauuguaguaguaaagcagaaacaaaggaaugggguguguuaggguagggaggguugcaauuuuaaguaggguggucagggaaggccuugcugaaaaaaugauauuugagcaaaggcaugaaggaagugauggcagggaguugcugguagaggcgacagcgagugccaaggcucagaaggguguuagaggaauggcagggaagccuguggcugcagugaaaggagcaaggagagaguaggagggggugaggucagagagccagcagcagaccaaacugggcagggcuuuacaggcacugaaaagacuuuggcuuuuacugugagugagagaggaagccuuugggugauuuucugcagugacaccaucugacuuauguuuuaacagcauuacucuggcuuccauauugagauuugacuauagaaaggcaaggauagaaccagucagacauauuacaauaauccaggcaagagauggugggaaauguagggaguuggaaguaguuggagcucuuggauauauuuugaagguaaagccaacaaaauuugcuguuagauuaaauguguagagugagcuguagggaaauugaaagugacuccagagacuuuugcccuaagcuacugguagaaagcaguuucuuucugagauagggaaggcugugggagaaccaggggcugggguggugaggacuggaggguuuguuuugggcaugguaagucugaguuguucauuagacauccacacaugguauugaguaggcaucaacuaugcauguuugaguuugggagauuugucuggacuagagaugaugggagucaucagugauguuuuaaagccaugagauggguuaagaucaccaugggggugggcguagaugggaaagagaaggggacuaaggacuaaccccugcacccuaauguuaagcagucuggggaaugaggagagagaaaccagcaaaggagacaaaagggggacagucgcugaguuaaagaaaacccagauugugguacccuggaagccaagugaagacaggaaaugcuuggcuggguuauuuacuacugacaggccaaggaagaugaaggcugggagcugacauucaacugagcaauguggaugcucgggauaccaucacaacgugaugguugugauacuaguuuugguggaauugugaggguagaagugugagugggaauacguucaggagggacugugaaaagaggaaaacagcaaguguggacaauuuuuuggaguaguuuugaucuaaaagauauuagaguaaugaaaacaguggcuagagagggaagaagagucaagguuuuugguuuugauuuuuagaaauaauaauagccugcuugcauguugaugagauaauaugguaaaaauuaaugcaggggauggagagaauugcuaguuagagggcuuugaggaagugcaaguggagggguuggucuugggaacaagcacaguucaucugugacaacugggggaaggcaaaaauguaagggcugggaugccaaggugagugauguuggugugaguguacgggguucucuuccgauugcuucaguuuuuuuagugaguuaggaagugacaucaucagcugaaaaugaagacuuaaggagaugcuggaggcugaggagagaggggaggaggaaguggcucuugagagggugaagauagcaggaagguggaggaaguuugccgggauagucgugaagguaaagugagaucccucugugggcuugccugccuccagccacauucaccagcuggcacagcugcagaguaggcagggagcuggauuaaccaggguugggauuuucccaaaugagggugguaaagcuagagaggggucagggauucaaaagugugaacaggaagagauuacaggauuuguccauggaacgaggcaggguaaggagggaagugaggacaacggaaggacaggcgaucagaucaauggguuauaggggucucaggauuucuggagccaaucugcucaaaggagagagcuaaaaaauagguggagguggucagaauggggugcuugagaucauagaggguggugaccagggggagagagugacugaaggagggcaacacgcuggggcaccagaggugaggaauucaaggggacaaaggccagaguguugguagcaucaaauguguguauggaaguuauccagaguuaagacugaguaguacuggagagacugacgguggugagucgggagcuaacagucuuugaggaguaagggggaaugauccaggcuuguuagaugacuaugagcguguagccuuugaugugagacucaaagcuggauuuuugucguuauuuucagcagguagagggaaaaugaucuggaagaggcaaggaggauaccagcccaccucagggccaaguggaaaaagagcauggcgggggaacagcaagcucucuccagcgcugcaggggaagcaguguguucagggcaggaggagauggaauugaggacauaggggauuuugcugaugagggucagugaguuccagagggcagggugggaggauuuuacguguggaagggcuaggcuguggugccaggaugggagacggaaggagcagugaggagauuccagugggcagacuggagugaccugggggucuagggcuucgccugacgggaaaaagcagcuaugaaggggagcaugagauugauuccugaugguuucaacgcagcuaauggugcugaaccugugaguuugggggguaagaaggguggguguuuggcccacccccacuccugcccaugucggcguggagacuagaaggagggcaucuaacuccgagggccuagggcucccuccaaagcccugcccaggcggccaguggaggguggccuuguuuuuagcauggggcuccugcuugacauuugcuggaagaggugcagguaacucugaggggcacucucuuuccaugcagagggaggcuugagacuuggaggccugaggcagguauuuuuggccuuucuccccuaauccagcauacaacgacuugagaagaaaucaugucauguuuauucucauagaccuuuacugcacuugucugaauuuuguaauauaacagcaaaugcaauuauaggcauuuaugcuguccugugaugugaaguuucuuuugcuuguuuaaaaaauucuacaaaaucuuacacuaaaaauaauagcuuugggaaaacuacaguuggggcagacuucucaaaaucuuugguagugauaaaaacuaagacaauccuggguguggggacacaugccuguaaucccagcuccucaggaugcugaggcaggaagaucgcuugagcccaggaguccaagaccaacauagcaagacccugucucaauuaaaaacaacaaaaaaaagugcaauccuaauaaaaauucuaguuugauuaaaagacacauuaaauccauaauaaguaaaguccauaauaaauauaccuuguccuuuaaaagaaaggugaagauggcaugauggaaggguugaggcugugguauuauggagacaggggccaaugacaaagauagggaacuauaucauaagcacuuucaagaaagugcacguggccaaacagccaaggagaagaaaaggagaagaauacggguugaaaggacguaguguacagcacugcgcuccucuggcuuguuguauuuaguuauguuugugcacuuugaauucagcugcuacuuggugguauaaaauauuagcacauuaggaaugaucacauaaccaaagcaacguaauauuuuguacuacugucacuaccuuacuuaccaauuguguguaggcuauuuguagaaaauuuuguauuguagaacagacuguaucuugacuauuuauauagucuuggaagcagcucagaaaacuguauuuuggaaucugguaaaggaagaacugcaguauuuuaccaguacucucugcuguagcauggcccacaguuucuuccagguuauaaaucagugugccggcuuauuguccagucuccccaccaugcuccaucugggugagguccuauucaugcauugguaccuagcccaaauacugcauucuccaugagaccuuccuugcccaucuagacggaguuagcaugugcuaacauuuauacguaucuccaugacuucacaagaguggaucuacucuuccuauacugggagcuccuuucgaaguaugcauuguauuuaucucugaauucuuucacugauagaaagccuagaacuugguugucucaauaaguuugaauacauuuuaaguauuuggguuuuuuuccccaagacuucauuaaugucuaacauuucauuugucuggggucuuagauggaucucucagaauuacagaguucacugaaauuucuguuacuguucccccaaccaccuccuccaucaggcuuauuuuaagagagccuucuacccucacacuccccaauacagagccacaucuucuuauuuccaauuuuccuacucagugcagcagaacugugauauucugcaguuuuguuacuguauauuuauucuuguacaaagccaauuuuugugugugugugugugagacggagucucgcucuugucacccaggcuggagugcaguggcgugaucucggcucacugcaaccucagccucccggguucaagcuucuccugccugaaccucccgaauagcuaggaauacaggcaccugccaccacgcccagcuaauuuuuguacuuuuaguagagacgggguuuugccauguuggccaggcuggucucaaacuccugaccucaggugauccacccaccucggccucccaaaaugcugggauuacaggcgugagccaccguacccaaccauacaaagccauuuuuaagaacaggaccaggcacgguggcucacaccuguaauuccagcacuuugggaggccaaggcaggcggaucaccugaagucaggaguucgagaccagccugaccaacauggagaaaccccgucuuuacuaaaaauaaaaaaugagcugggugugguggcacgugucuguaaucccagcuacucaggaggcugaggaaggaaaauugcuugaacccgggaggcggagguugcggcucaugagccaagaucgugcuguugcacuccagccugggcaagagcgaaacucugucucaaaaaaauaaauaaauaaaaagaagaacaauauauauuuuuaaccuguuuagaggaacauuucagaaaugagaggauuuauagccaguaauaagaacaaaagacuuuaaauugugucuguauguuuuucaguagcauuuuuuauuuaccacauaggccuguagcaguuuguggugccggagaacaaauguuaacugugcacuuuguauguccuuuggagggaugcagucaguccaggggaggagcaagugcuuagaauucucugcuuugguucucaugcuguuuccucuccugccgcugcuccuuugcuccaauagcuucuccuguuccagagugggcccagcaggagcuuggccacaccacucccuggaguccagcuguuguggaaaagugguuuccuuucuguaacaucaguggugccaguuccgauuugauggagucauuuggguaaaacguuuuuauaucucuugaauauugauuauuaaaaucaacguucaguuaucugcauuuuuuucuuaacagaccacauucucugaguauagucuaauaauauuaaaaaguaguuacaaaaauaaaauacucucauacuuaauauauauugugagaguauguuagcuagauaauauguuaacaauauauaaauauauaccugccaaaaauucuuuaaaauuuaccaaaguaauucgucaaguuaaauauaaauaaauacucccuuaaagugagaaaauauuuauaacuaaguaucaaugcaaauagaaaacagcaaacuugaauaaugcagcugaauuuauacuuaaagaaguauuugcagaccguuuuuguaaggaaaaaaguuaacaaccgauuacuaagaauccaacaugagaaguaaauaagaaaguaaccuccacccuacaaaagauaacaacagaaauaaauagaaaacaaauaaauguaagugaucaagagaaacaaaagaugguucuuugaaaagccaaauaaaauaaucuauagcaagaucaagcaauuaaaagacgaacaauauuagaaauguaaacgauauggcagaaauucaaacuauuauuaagagguaugguugacguuuauuuucuccacacauauauccauucaguuguuccaacaccauuugcuaaaagacuaucuuuucccacuaauaacugugguaccuugucaaaaaucaacuggccaccuuugugcagauugauuucuagacagaauacaguccagaaacuauguuaauaccacauuaucuucaauauugcauuauagcaauaccauauacuguagcuuuauagcaccagucacuaaaucagguaguguaaguccucuaaacuuugguuucguuuuuuuaaaauuuuuuugguuauuuuagauacuucgcauuuucauauaaacuucagaaccagcuugucaguuuccacgcacacaaacaucuguugaaacucuaggagugcauugaaucauagauaaauuugggaagaacugacaucuuaacaauguugagucauccgauccaugaacauggugcagcuauccauuuauuuaggucucucuuuaaucucccucaguguuuuguaguuuuuaauguacaaauguggcccauguuauuuuuuaaaauuaucucuaaguauuuuuaugagauguaaauauugaagaguuugaagauaguaugauugucuuuauagaaaauccaggcccggcaugguggcucacacccguaaccccaguacuuugggaagccaagccagugaaucucuugaggccugggguucaagaccagccugaccaacauggugaaaccccgucucuacuaaaaauacaaaaaaauuagcccggcgugguggcacaugucugcagucccagcuacuugggaggcugaggcacaagauucacuugaauccaggacgcggagguugcagccagccaagaucgcgccacugcacuccaggaugggcgacagagcaccacacacuuagggaggauuaaucugcuucauauuggcuauaugaaugaagcugauagacccaacacauauuccacccugugauaucuguucaacuaauaucaccguaacuuucuugcacuuuuuaaucaguuauaucagauaauggaaaauauuaaaauacaaauaacacauuuugaauguugugccauuuucauaauuuccuuaaugacagauauuuagcucuagguggaaaaggauuuaauaacuaaucaccccuccugccugcccuacuuccuccucuucucaucaaucccaaauuaguuuauuacaaugugaaagaauuauucgaagucauugcaauacuuacuacaauguguuaacaucauuuuguacuuugauauauggaaacugaguaaaaaauaacuauggaagcuugaagugaaauaguugccauaauuagacuugcauccuaauucaugaagaauccuauuaauaaaagucaauauuauauguaaugguuaaugguuuugugaacaagacagcuuugguuccugcauucguucaaaucgaaaaugagaggagggacauuuucucuccuaagaaaauauauuuuugaaggcaucuuguggggacaucuuuuugguuagcuuuuuagaggauaguggguauuuugguguuauuucuaaagcauuuugcaaaauuagaauguugguuuuauucuagacaucuugacuucacagguuacuacaggcugccucagcuaauaaggaagagucuuccaaaacugaaggcgaauuaauacauugccuugccgagcucuaccagagaaaaucucgugaagaauccacuauagcucaucaagaagacagcaaaaagaaacguauguaccuagaaaggcuguuucuuaaggcauucuuuuuugagacuguauguuuuaaaagaugggcauuuccugaaaugagguugaaaugguaacuaaauaaagaagggcaaauuuuuauauuuaaauuuuaaaauaauuacauuaguucaauagugauuuuuaaaaaaucaaccagucuuaucugucuaaugaauaagccaucuucauuuuuaauuaugauagaaauucaaauacaacuuuguguucugcuuauuaguauuuuuucuuuugcuaccuugccuuuuuagauauuauuccaucucauugcuuaacuaaauuuacaaaauucucauguuguugaacauuuagauugcuuucaguuuucaucauuauaaauaauacuguaguauacauuaugcguauaauuuguuuuuuaaguaauuaccuuagcagaaguuuccaggaaccaguuacugugucaggguaugaaaacuggcucuuuauguagauugcuaaauugucauucagaaauuuucaucaccauuuuucguggccauuggguaacaccaaaauaagucuguuuggcauuugccuuaugggaaaaccauccauugagauguuuaguuccaauccaaucacauugagauguuuaguuccuaaacuucgguuaaaagaaagguucucuuucuacccugugugugggcagaaagagaugcaagaacuuccuaauucaaaucauucuggagggauaugcuucauuuugauauucuuucacaguaaucugaauuaaaguaguucuucuuuccacagaaguggaaggcaauuuacuuucccuccucugauguuguuuugguaggaggggucccucguacuccagugagacagaagaugaauaccaugugccguuccuuaaagauguugaaugucgcaaggcugaaugugaaggcccagaaguuacauccagauggcaguccggauguggcuggggagaaaggaauccaaaagauaccuagugggagaacaguggauaaauuggaagacagaggaagaacacuaagaaguucuaaaccuaaagguauuccucuuagucuauaauuuacucuuuuauaccccgcuuuuuuaaaaauaaaauuuaaucguacccuuaguuuauugacuaucugcuacaugcacaaaaagguguuauggugaauacaguaaauaauaagauaaugugcuauucuuagauuuaugaucuagcuacaaagauaagggaggcggagguuguggugagccgagauugcaccacugcacuccagccugggagacagagcgagacucugucucaaaagaaaaagaaaaaaagaaagaaaauucugagguguaaauuuuaugcugcuuuacagauuuuuuuuuuuccuguggaaugugagagccauagaugauaaucaguuugaaugggacagaacaccuuuagugggcuaguaaaggugugugaaaugugcuugauacaugcaagggaaggcugaaacaacaguacugaagacaguguggcaggaacauaauuucuggacuagauucugucuagcaguagaccugcacaauagugggcaaaugauuuuugacaaagaugccccaauaauuccgugagaaagacauaaucuuuucaauaaaugaugcuggaacaacuagauaccuuuauggaaacaaaauuagaccuuacuuuuaauaguauuuuguauuccugcuauuuuuaauauuuaugccuuccaucucucucucuuuaauugcucaaucuugcuauagaguuuucuguuuuauuccucuuuucuuuuuuuguuguuuuuugagacugaguuuugcucuuuuugcccaggcuggagugcacuggcaugaucuuggcucacugcaaccucugccucccggguucaagcgauucuccugucucagccucccgaguagcugggauuacaggcgcaugccaccacacccggcuaauuuuuguauuuuuaguagagacaggguuuuaucauauuggucaggcugguuucgaacuccuaaccucaggugaucagccugcuucggccuccuaaagugcugggauuacaagugugagccaccgcgccuggccuuauuuggcuuuucaaagaaccgucuuuuguuucuguugauugcuguuguugcuuuguuuucaauucauuucuguucuuuaugauuaccuuccuaccuuuauuuuugggguuuacucucucauauuacuucacguguuggacccuuagauaguuaauaguuuuuaauuugucugcuuuacaaaaauaaucacuugucuaaagucuguacauuuucucuuuaaguauaacuaacugcauuauguauuuacuguuuucuauuuucauugauacuuauuuauaaauauuuucugacauccauaauauaagggaguguuuuauaauuagcuuuuaauauuuuugaacugugcucaauguggucuguaagauugauucuuuaauauuugcugaaacugaccuaaugugcacuugaaaauaauggguauucucuaauuguugaauaucugguuuuauacgugucuguacaucaaguuuauuaauguuugaauauucaacauuuuuaguaauuuuuuucugcugcuuuuaucuauugcuaagaugauuguauuagucuuccacuauuguauugucuuugcuccuuugucaaagaucaguggaggccaggugcagugacucaugccuguaauccuagcacuuugggaggcugaggcgggcagaucacccgaggucaguaguucgagaucagccuggccagcauggugaaacccugucucuacuaaaaauacaaaaauuagccaggcgugguggcaggcgccuguagucccagcuacuugggguuacugagucaugagaaucgcuugaucccgggagacagagguugcagugagccgagauugcgccccugcacuccagccugggugacggagcaagacucugucucaaaaaaaaaaaaaaaaauccguuuacuauauuuauguaggucuauuuccaggcucuccuguuacauugaucucucuauucuuuugcuaauaucacacaaacugucuugauuacuguagcuuuauaguaaguccugaagguugguacuaucaguccucaaacuuuguuuuucucauucaauauugaguuaguuauucugggucuuucgccucuucauauaaacuuuagaaucaguuugucaauaugcagaaaauaacuuauuugauagggaucacauagaaucuauagaucaaauugggaaucugaaaucuugacaguauugagucuuucuugcugugaacauggaauaucucuccacuuauuuaguucuuugauuuuguucacagaauuuuguaguuuuccgcauauagaucuuauacaaauuuuguuagauuuaauaccuggguauuucauauuuagggggggugcuaauuuaaaugguaauguguuuuuaauuuuaaauuuugcuuguacauuacuggcauaugggaaagcaauggacuuuuauguauuaaucuuguauccugcaaauuugcuauaaucacuuguuaguuccaggaguuuuuuguuuguuuguuuguuuguuuuuuuuaguagagaugggguuucaccguguuagccaggauggucucgaucuccugaccucgugaucugcccaccucagccucccaaagugcugggauuacaggcgugagccaccacacccggcccaguuccaggaguuuuguuguuuguucuuucagauuuucuaaucaugucauaucaccaaagacaguuuuauuucuuccuaccuuuaaauuguuuguuuguuuguuuugagacggaguuucacucuuauugcccagacuggagugcaauggugcggucuuggcucacugcaaccuccgccucccagguucaagugauucuccugucucagccuccugaguagcugggauuagaggcgcccgccacuacgcccggguaauuuuugguauuuuuaguagagaagagguuucaccauguuggccaggcuggucuugaacuccugaccucaggugauccacccaccucggccucccaaacuguuaggauuacagacgugagccaccacgccuggccuccuaccuuuaaauuuuuaacacuuaaacuugguauacagagccuuaaaauuaaucacuuggcugggcaugguggcucaugccaguaauccuagcacuuugggaggccagggcggauagauggcuugaguucaggaguucaagaccagccugggcaacauggugaaacccugucuuuaccaaaaauacagaaaauaagcuaggugugguggcacaugcuuguggucccagcuacuccagaggcugaggugggaagaucacuugagccugccugggagguggagguuguggugagccgagauugugccacugcacuccagccugauugucagaguaagaccuugucucaaauaaaaugaaauaaaauuaaucacuuaucucuguaguuucucagucucuggacuauugacauuuuagaccagauaauucuucguuguagggcuguccuauguauuguaggauguuuaacagcaucccuggcuccuacauacuagauggccagcagccacccccgcccccaccaccaucagucaugacaauccagacaaggccaaauguucccugcaaggaaauauuuuccccaguggacaacaacuggccuaaguaauacaaggacuugagcaagauaugauuaauccauuuuauuuuauuuuuuucucagauuuuaaaacugaggaagagcugcuaucauauauacgugaaaauuaccaaaagacuguggccacaggagaaaucauguuguaugcaugugcucgaaacaugaucucaaccguuaaaauguuccuaaaaucaaaaggcaccaaggaauuagaaguaagaggguccagauauuguuguuugucauggauguagugguugguugguugguuggugguggauuugguuagugucuuggaaaaugucuguuaugucauaugugauucaaaaaugguaagauaaguaagggaguaaguacaguuccagaucucagaagguggauauggugaacugguaaggcagaaaucaaagagauggggugagcggggauaauuacauauaauucucuccuaaugaaaagccuuuccucaugugagcuauauguuagcugcaugauuaagccagugguuuuuaacccuggcuauacuuuagaaucacuuacagcauuuaaaaaauauauauaugccaacuaaccgugguggcucacgccuguaauaccagcacuuugggaggccaggguggguggaucacgaggucaggaguuugagaccagccuggccaacauggugaaaccccgucucuacuaaaaauacaaaaaucagcuggauguggugguaggugccuguaaucccagcuacucgggaggcugaggcaggagaaucguuuuaaccugggagguggagguugcagugaggcaagaucguaccauugcacuucagccugggcaacggagcgagacuccaucuccaaagaauauauauauaugccuugcucucuccagaugaacugaaacagaucucugggguuggcgcuuuuaaaaagcccccuggauaauccuuuugcacugggaguguugcaaaccacuguuuuagaccguguuguuguuuuauucauguucaguggccaucacggagcuccuucucuaaagcaaacaggaggauuuguuuaugauacuuagguuucuuaagcacugcuuuauggaacguuucuuuuaagacacuuuauuuagggcaggcuuguuuuauccaugcccacuagcucucaaaauaacuuuuaccauguucuuuuuaaagauauaaaagaagaauauucacgucacuuuuucauucaaaugaaagaauagagaaguuuauaagggaauauauuucccuuuagucaacugugaaagaaauuagaaauaaugacaaguaacacuauucuccuauguaauaauuuuguauuuuuaggugaacugccugaaucaaguaaaaaguagucucuuaaaaacuaguaaaagucuucgacagaaucuaggaaaaaaacuggauaaggaagacaaaguuagagaguaaguaacuaccauuuuuuaaaaaaucaucacucuaaaagcugugagauuagcucguaucaguuuaaaauagauuguucgugacaugguggcucaugccuguaauccuaguaccuugggaagccaaagcaggaggauugcuugcagccaggaauuugaggccauccugggcaauauagugagaccgugucuaccaaaaaauuuuuuuuaauuaggugagcauggugguguacaccuguagcccuagcuacuugggaugcugaagcuggaggauuguuugagcccaggagcucaagacuacugugagcuaugaucccaguacugcacucuagccugggcaacagagcaagacccugucucaggaaaaaaaaaaaaaaaaaaaaaaagauuaccaacugcaugaagaugcuuuuguagccaauucuuuuuuauguuauaauaugcagcuugaaucaccuauuuaucuaauaacuacaucaguuuuuagaaaaggcacuggcucuccuccuuuuugguuguugugucuuauauaaauagaucuaugcuuacggaaggagcuuuuuguuuagugacauccaaaguagauaugaccaaguauuuuuuucucucaaggugccagcuucagguauuucuucguuuggagaugugucugcaaugcccuucaauaaaugaaaguacagaugauauggaacaaguaguggaggaggcaaguauauaguuucgugccauugaaauacgcccuagaugcuuucagcuucccugcagagggcaucuauauaguaacguucuaaaaucuccuucaggugacagauuugcugcgcaugguguguuuaacugaggauucagcguaccuagcagaguuucuggaggaaauuuugagauuguaaguuugaugguuacuaacuuaacuuuaaaauuguuuugucaaaaccuauguaugguguugucucugaauuuuggaguuguaaggacuacuuuuuaggcugggugagggagggaauagagaggguaagaugguaacuguuccguauucgaucaaucuguuccacagguauauugacucuaucccaaagacacuuggaaaucuuuacaacagccuaggguuugugauuccucagaagcuggcugguguccuuccuacagauuuuuucagugaugacuccaugacacaagagaacaaaucaccacuucuuucugugccuuuuuugucaagugcucguagaucagugucaggcagcccugaaucugaugaacugcaggaacuucguaccagaucagccaagaagagaagguaagaggucaaagaaucaaaggaauuauuugcacuguuauaguucugauaaaagauguguuuaaacuacaguccagucaucuuuguccauauaauuuguugaacuaauagcugcccuuaugucugaaucagagaagccaacuauuagagcuccuaauaggagcaucugacaaucuuuauauuaucuaggaaauauauagucauguuuugcuuaacaacagggauacauccugagaaaugcauuguuaggcaauuuuuguuguacuaacaucagagugugccuaccaaaaccuagauaguauauauuuuuucauuuauguauauuuuuucauauggaaaagcuaauguuccagcauuguuacugaauagcagucauuuccccuacuugaucuguaaugccaauaucaagugucauuuauuagguuucuauauaggcuccauuauaaccuaugggaccauugucauauaugcaguucgucauugaaggaaacauugcaugacuguauaguguuuauuuccuauuucacaaagucuucuuuacuguccacaugaggucuccagaaacuaggccuucuaugaaauaagcuuagaguuucagcuuuuuaaauuucccuugaugcuuuucguuguucauaacugguugaauuuguuacuuuugaaaauucuggggugacuuguuuuauuauaaacccagaacaaccuuaagauaacuggcuuuuauuuaaaucauauuuuauuuuacuuagacuccaguuccauuugaauuuaacuauauauaaccucuaucuaguauguauuaacuauuucuauuuuuaaaaggaaaaaugcauuaauaagacauaaaagcauugcugagguuucacagaaucuucgacaaauugaaauuccuaaagugucaaagagagcuacgaaaaaaguaaguaaaccuuccagcuugagaugacacaguaaauaagaacaaaaaggcagugucccuacuuuuaggaaaaugaacuuuggaggauacagaaauaauauuaaauauuuuuaugaauguguauaaaacuauaauccaaggaauaaagaaauauaaacuugucaagagauuaacaauuuuacucaagagugugauaguuagagguaaugugaagaaaaauggcaaguaaaaguuaggaaugaauuaauucaaaaucuuuaauguagauaggaaaacucauaaaacaauaacuaaaauaagcaaagcagucacuggaagagaauauacaauuguaaguggacuuugguugcauaccagaaggugcuuuucaauauguuauauuuuacuuuaauaacaaauuuaggccaggcacagcggcucacaccuauaaucccagcacuuugggagucagaggagggaggauaguuugacaccaacagucugagaccagccuggacaacauagcgagacccugucucuacaaaaaauaaaauuaagaaaaaauuagccaggcaugguggcacaugccuguaggcccagcuauucaggagucuaaggcagggagauugcuugagcccaguaggucaaagcugcaaugagcuauggucgugccacugcacuccagccugggugacaaagcaagacuucaucucuuaagugaauuaaugaaugaauaaaugaaugaauaacaaguuuuuugaaaaagaugaugaccaucauggagccaggagguggaguagucgccccuuaucugcagaagauauguuccaagacccccaguggaugccugaaaccacagauaguacugaacccuauauauaguacuguuuuuuccuaugcaugcauaaguucaauuuguaaauuaggcacaguaagagauuaacaacaauaguaaaauagaacaauuauagcaauauaauauaauaaaaguuaugugaauguggucuuccucucaaaauaucuuauuguacuauauucacccauuuuggggccaugguugacuaugggaaacugaaaccauggaaagugaaaucacagauaaugggguacuauuguuguuuuuuucauggcaguugauauaaggacuugagguuuuuauugguugaaaaaaaaauaaaccuagcuggaaucuguuuacuaaguagaauuaaugucucgcugaggaaaaaagggagacuaaaaacacaaugaaacuuuucaacugcaugaacuaucugagaagaguuaaaauucaauaagaacuaucuuuagaagcauuaauuauuauaauagugguuuguucuguuucuagauauuuguagcaguccuuuggaauuggaggugggauuucuuuuaaaugguuaaugguguucacuuucuuauacuuugugaauaaaaugcauaucuuauauaucucacaauccugauugaagauuggaaaauccgaaagugaauggccaaaaguugccaggccuuuauucucacuagauuuuacaaugauuugcagaucuuucuagcacacuuugaaacuuugguuuuagauuggacaagacaguuuucuucucuaagaucagaauuaacgccugggcgcagugguucaugccuauaaugccagaacuuugggaggccaaggcaggaggaaucacuugagcccaggaguuggagaccagccuaagcaacauagugagaccuuggcucuacaaaaaauuuaaaaauuagguaugguggugcacuccuguagucccagcuacucgggaggcugagguaggaggaucgcuugagccugggaguuugaggcugcaaugaacuaugaugaagccacugcacuccagccuggguuacagagagagacucugucaaaaaaaaaaaaaaaaaaaaauugaggucaggauuugauugugguuaguaauguuuuuucaugucaaaguugguaccauagauaagugacaauuguuuaacugaaaggaccagauguuacauuuuuaaaagaauaaaucucaguucucugaaggaccaauauaguuaacucgggaagcagugaacuuacaacuuaagcguagacauauaguauuaauuacauuaauguauauuaauuucuuuuacguaucuuaacuccagaagaucacaaggauuaaaaaaaaaauauuugauccugccuuaauaccuucaggacauacucuccuaguuuuucauucaauuacauggauuaacaaggguugacaaacuuuuucuguaaagggccagauaguagauguuuuagccuuugcaggccauacgucucugcaacaucuauucaguucugcuauaguggaaaagcagcuacaggcauuauggaaagaaacgagcaugacuauguuucaguaaaaacuuuauuuucaaaaacaagagguggcccagauuuggucuguacacuguaguuuacugaacccuggauaggaaauuggauguaugacuuuuauuuuuauuuuuauuuuuugagauggagucucccucugucgcccaggcuggagugcaguggcacgaucucgacucacugcaagcuccaccucccggguucacgccauucuccugccucagccucccgaguagcuggcgugcaccaccacgccuggcuacuuuuuguauuuuuuaguaaagauggaguuucaccauguuagccaggauggucucaaucuccugaccucgugauccgcccacucgaccucccaaagugcuaggauuacaggcgugagccucugcgcccagccggaugugugacauauuuuuacaauuauaguuuaucucuuuauaagaguuauuaaucaauauaaguaagaaugaucacaucucaugucuuaucagcaagaccuugguuauaucacugagaccauuuguuaaguuucugcccauaugugguggcuucuucaauuauuaugaugaauugaaaaaacaaaaaaucuuuaaaaaaacaguuuccuuguuuugaugcaucugggguuuagacucuugaaucuucuauuguaauagcaaguacauagcagucugauaaagaaauguuucugagaguauagccucccucuaauuaauguauauggcuuuucccuuauuagguauaaaagguaugcaugauuaucguuaaaaaguuaaaacauauaaaguuaaaaguuaggguguuccuucuccauccauucaucagaaguaaucacugaugauaguuuguuguguauauuuccaggcccuuuucuauaugcaccaauaacaccaaagauuuaugcagauccguuauauacauauauauaaaugauauaacuuagaauacuuaauauuuuccuuuuuccucccuaucacagaucucuauguuaguacaaguugaguaucucuuacccaaaaugcuuaggagcagaaguguuuccauucuuagauguuuuuggauuuuggaacauuugcauuacauguacuuacugguuagcaccccacauccagaaguccaaaaugcuccacugaguguuuccuuugaguguuguguuggcacucaugaaguuuuggauuuuggagcauauuggauuuucagauuagggaugcucaaccauauauagagaggucuuccuuccuuacucuuguaaugucugcauuggauggguauguaauuuauuuaacuguuucacucuuuaugggcauuuauaguguuuuuuauuuuguguuauuacuauagugcagcauugaguguuuuuggaacauuucuguuguacauuuuauuauuucuauuauggaucccuauaaaugaauuacaagagucaaagaguucaugugaaaucuuuauucuuuuauuucaaugaaugccuauuuaaauuuucuuucuggauuuucucauguuucaggagaacucucacccugcuccucagcagccuucccagccagugaaagauacagugcaagguauacuguuuucucaguguauguauuuauucacuagcaugacaacuuuauuuuuauuguauguauuuaagcagcugcuuacagguguaaauuaaggcuuuguaugauuguuggcuaauaaaauauguccaaauaccauggacauaguccccuaggaauagucucaaaauauuguauuuuacaaaauaacuggucugaaaucuuuaaaaacaaaaacaaaauuaaaaaaaacaucaugaaagcuggaagaaaggaaaaagaaaagaggcagugggacuguuucagaugaauggaguuuaagcaugauagcuaaaugcauuccaugaucccugcuuggaucuuaaauuuagggaaaaaaauacuagaaaggauauuacugagacaacuagagaaauuugaagaagcgguguaugcuagauaauauuguaucaaugcuaaagauauuuugaguguaauaauggcguugggguuauggaggagaauguccuuguuuuuaggagauacaugcugaccuuuaggaagugaacaguuguuugcaauuuacucuccaguguuuaggggaauaacguacauacagagagaaggaaggagaaaacaaauauugucaguuggugaacuuuagugaugggcguauguuuaauuuuauuauuauuugaaacuugcuauagaaauuaagcuuuucaaaacauugggaaaauagagaauaacaaaccaaauuuggcuuucaggucauaaaucaauuucaccaacagccuaaguuagguaacaggaacucuuauaauggagauaaggaaacaauuuuuaaaacuuugguguguguuauugauguccuuaauaaccuuaaugugaaccuuuaugucauugauggguaaacacaaggguugcucccaguuuguggauccuagauuauuugguuuggguuuaaaugauuaaucuuugaagaauucacccuuggugaauuuuuggaucacuuccaccagacuaucuuaagauuaagguauugucuugcuggcuuugccacguacuucuugacuuuucagcuauuuuuuucuaacuuugagucuagaugaugagaacuuucaugcuuuggagucaagaauaaaauuuaaaaugucccagcagcuuaguaaaguagucagaagaagaagaaagaaauuauagaauugaacaauucuuugcucaaugcugagcugaauacacagcagcaaaaauguccaaagugagaaaaauaaucauaacaugggauauauuaaaaggacgaugaccuauguuagccauccucuuacuuaagaauuauguccaucuuacauugaguagcuucuaacucaauaaguggugggggccuuccuuguguuccugaaaaguuagauuuaaauugaauucguaauggaauacuacaaaccacuguauaccaacaaauuguauaaccuagaugaaauggacagacuccuagaaagauacaaacuacuaaaaacagacucaagaagaaauagaaaaucagaauagaucuauaacaaguaaaaaguuugaauuaguuaucaaaaaacuacucacaaagaaaugcccaggacuagaaguuuucacugcugaauucuaucuagccuuuaaaaaagaaauuagcacuagcauuuauuauggucaacugauauucaggguaccaagacaauuugauggagaaugaauagucuuuugcacaaaugaugcugagacaacuggauauccacaugcaaaagaaugacauuggaccccuaccucaugcaaaauaacauauaaaauuuuuuuuaauuugcaaaaguaaauauuuuuaaugcauuaugggaauaugcuauuuaaggaaaccuuauuagcauaugugacaauagcaaucuguaguuuccucaaggagcuucucuguuuugguuaucuuuucucagauacggcauuuauugaugauaaucuuuggguuuuucuuuuucuuuuaauuuuugaugcuuucagaagugaccaaaguucgaagaaaucuuuucaaccaggaauugcuuuccccuucaaagagaucacuaaagcggggguugccuagaagccauucugugucagcuguggauggucuagaggauaaacuugacaacuucaagaagaacaaagguaccacauuucagaauagcuaggaaaaaggaaagggagauucuguaagauuaguaguaauguaccgucuuucuuuccugauuuaguaauuugagucuucuucccucuuuuuuccuucagucuagcuaaagguuugucaauuuuguuaaucuuuuuuuuuuuuuuuuuuuuuuuuuuuugagacagguucuugcucuaucacccagguuggagugcaguggcgcaaucucagcucacugcagccuccaccucccaggcucaagugauucucccaccucagccuccugaguagcugggacuacagauguacacuaccacacccagcuaauuuuuaaaauuuuuuuguggagacauggucuuaucaugcugcccaggcuagucucaaacuccugagcucaagcgaucugcccuccucggccucccacaguugcugggauuauaggcaugagccaccacacccagucaauuuuguuaaucuuuucaaagaauuuacuuugguuuauuguuuuuucucuauugguuuucuuugucuuuuuuuugagucagagucucacucacucugucuccugggcuggagugcagugccgugaucuuggcucacugcaaccucugccucccagguucaagcgcuucuccuaccucagccuccccaguagcugggauuauaggugugcaccaccacacccggcuaauuuuuguauuuuuaguagagacgggguuucaccauguuggccaggcugcuuuccaacuccugaccucaagugaucugcccgccucagccucccaaagugcugagauaggugugagcuaccgcgucuggccucuauugguuuucuaaucucaguuucauuuuuuuuuuuucccucuauuggcuuugguuuuuguuugcucuuuuucuacuuuuuuaaggugaaguuuaagcuauugauuugagaucuuuuuuaauaaagcacugcuuuaggcauauccuauaaauuuugauaugauuuguuuuuguuuucaucaucucaaaauauuuucuaauuucccuugugauuucuucuuugauccauugguuauuucggagcgcauuaauuuccacauauauguauuuccuaaauucucuucucugcuuauucuaguuucauucuauuguuguaaaacauacauuguaugauuucagucuuuugaaacuugagacuuauuuuguggcuuaacauuuggucuauccuggagaauguuuaaugugugcuugagaagaaugugaagcauucuauagauguguguugggucuaguggauuuaugguauuauucaagucuucuguuuccuuguugagcuucuguuuuauuguuuauuuauuauucaaaguggcauauuaaagucuccagcuauuauuguugaauuauuuauuucucccuucaguucugucaauuucugcuucauguauuuugagacucuguacuuaaguauauaugucaauaauuauuaugucuucuugaucaauuaaacuucuuaccaauagguaauguacuuuguguuuuguaaucuuucuuggcuuacagucuguuuugucugacaauaauacagcuccccacccaccagcucuuuugcauaggauaucuuucauuguccuuuuacuuucaaccuuagugucuuuguaucuaaauuaaauaucuuauagaccucauagaguuggaucauguuuuuuuaauccauucuucuuaucucugcuuuucaauugcagugcuuaauccacuucuaugaauguaauuacuaauaaggaacaacugucauuuucuauguuuuaugcuuuuuuguuucucaauuccuguuuuuuuguauuuagcugauuuuuuguaguauacuaguuuaauuccauucuuucuuuuucuguguauuuuuaaguuguuuucucagugguuaccuugguuaacccagcuacugguuaccucaguuagcaucuuaagcuuaaaagaaccuggcuuuaugaauaaagccaaccucuuuucaauaauauacacucugcuacuauguauuucugucucuucuucuuuauauuguuguagacugcaucuuuauacauuguguaccuguuaauacagacuuaaauuauauaggguuuaaaaaaaaaacaaaauuaccauaaugcuggcuuuuauauuuaucugucuaguuaccuuuaccguuguuuuuuauuucuucucauggcuuugaguuauugucuacuaccuuucauuuuagcuuuucuuacaggguaagucuacugauuaugaacucccucagcuuuuaucuauuuggaaaugucuuacuuucuacuuuauuugugaaggacauagaauuuuugguugacaauuuuuuuuucccccuucaggacuucaaaugugacauccacugccuucuggucucccaaauuucugaugagaaaucaacuauuaaucuuauuaagcugcuucucuauugcugcuuuccagauucucucuuuguccuuggguuucaacacuuugacuacaacgugucucagugugaaucucuuagaguuuauucagcuuggaguucguggaacuucuuggauguauauguucaugucuuucaucagauuuuuggaagguuuuaaccauuauuucuucaaaaaauuuucugccacuuuuggucucauuuccuccuuagacucccaugauauauguguugguacacuugaugguguccuacaggucccucagacuuuguucauuuuuuuuuuaauuauuuuuucuuucugcucaggcuggauaauuucaauuaccuuaucuucacguucacugauucuucugccagcucaaaucugugguugacccuucuaguuaguuuuuucauuucagcuccagaauuucuacuggauucuuuuuuaucauuucuauugcuuuauugauauucucauuuuguucauauauuauuuuccugauuuccauuaguuucuuauauaugguuuaagugagcucauugugcauauuuagagaaguugauuuaacaucuuugacuaguaauuccaaugucuuggcuuccuuagugacgguuuuugccaaauuucucuuuucugguaaauaggccauacuuucuuguuucuuuguauacuucguaguuuuuuguugaggacuaguuauuagggauauuauaaugugguaacugcauggaggucagauccugucaccccucagggauuccuguucuuugcuuauuaaggaucucagcuauucauuugugccuuuucugaacuauuuguguaaaguauguauaccuuguuguguguggucacugaaguuucugucuauuaucucuguggucagccaaugaccuaagaaggauuuccuuaaaugucugauucaagaaacgaggagggggaaggugugucugucccuuaaacuucugauaauugggagaaacccacuguagccuaagagagcugaaaccaaggcagugucugcacugcuccuacaggaaucugccugguugaccaaagcaugcaacccccaauuuuuggaggacgaggucuucacugucugcccuagcaccagccagcugcuccuggaaugugggcugcuaucccaauagcuacagcagggaugagaaaagggaaaugguagccaguucaugcacaucauucccuuccuaaagaucaucagucucucccaucaucaagcacuuccuagguuauuacagguguucaaucaaguugccagguuccaaaauagugaauucugaucuuuuuuucuaguuuacuaguuauuuggguugagggacugaccccuagagcuuucuucuccaucauguugcauaaccucacuccccuuggagauuacaauuaagauauuaacuuauaacagccuaguucucauugauaccaauuuaacuuugacaguuuauaaaaacuuugcuauuguauaguucuacugacuaucccuucuuaguucuauauugucaugcaaauuacaucuauacauuguaugcccaucaacacugauuuauaaucauuacuuuguauuuuaaauaacaggggggaacaguuacaaauaaaaaacacuuuuauaauguuuuucuuauauaguuaccuuuaccaaugcuguuuaacucuuuauguggacuugaguuacccuagugcccuuuccuuucagcccacaggacuccuuuuaguauuauuuauaguguaggucugcuaaugacaaauucuguuuuauuuuguuucauucugagaaugugaugauuucuccucauuuuugaagaauacuuucauuggguauagaauuccugguuggcagucuuuuuucucucagcacuuugaauaugucaucacacugccuuuugucuuuuguuucugacgagaaagcagcugcuaaucucaucaaggaucuguacacgaugaauagcucucuggcuucuuucaagaucuucuuuuuuucacuuuugauaguuugauuaugauuugucugguuuuggaucucuuucacuuuauucuacuuguauugaguuucuuagauguguagugucuuucaucaaauaugggucauuuuuagccaauauuuauucaaauguucuuucugccucuuccuuucuguccuuuccuucuggacuuccgguauguguguguugugcuugauggugucacaaguaucugaagcucuguucauuuuucuucauucuuuugucuuuaucuuccuuagacuggaucaucucaauuaaccuugucuucaaauuuguugacucuuucuuugccaccucaaauuuacuuuucauuuuuguuauacuuuuuaacucuagaauuucuauucgcuuuuuuuuuuuuuuuuuuuuuuccgucuguugauauucucuguuuggcaagucauuggacucauauuuuagaucuuuagguaugauuuucuuuaguucuuugaacauauuuaaaacagcugauuuaaagucuuguucuagccgggcgcgguggcucacgccuguaaucccagcacuuugggaggccaaggcggguggaucacgaggucaggagauccagaccauccuggcuaacacagugaaaccccgucuguacuaaaaauacaaaaaauuagccgggcgugguggcgggcgccuguaguccugguuacuccggaggcugaggcaggagaauggcgugaacccaggaggcagagguugcagugagccgagaucacgccacugcacuccagccugggcaacagagcgagacucugucucaaaaauaaauaaauaaauaaauaaauaaagucuuguucuaguaaguccaaugucuggacuuucucagggacagauucuguuggcugauuuuuuuuccccuguguaugggccauacuuuuuuguuuuguuucuuugcaugacucauaauuuuguugacaacuggauuuuuuuuuuuuuuugagauggagucuugcucugucacucaggcuggagugcagugguaugaucuuggcucacuguagccucaaacucccugacuuccuggcuuaagcaauccucccacccaccucagccucccaaguagcuagcuggacuaaaggcaugcaccaccacuccuggcuaauuuuuguauuuuuuuguaaagaugugguuucaccacguuggccaggcuugucuugaacuucuggacucaagcaguccgccugccucagccucccaaagugcugggauuacaagcaugagccacugcacccagcauggauauuuuaaacaauauaaugaggcagcuguaacaaucagauccaccccaacccugccaggauuuguuauuguuuuuguuuagucacuuuucuaaacuauuuguuuaaauuuuguauucuuuaucauguguggccacuaaagccucugcucaguggucuuaguggucaacuaaugauuggacagagauuuccuuaaaugccuggaacccauaaguuucacagccccuacugaggggcucuguguguugggucaugccuucaacacucagccaggcaguuuagaauuccacuucacuuucuguuuugccagagccucaagguuagccauagguggcagcuuacaggcuucucaagucuauccucggcacaugcacagugcuacacguguguggacuuuuggaugccuaagaaugucaucagagauuugcaaaguccccugugaugucucauuccccaauuuucccaauuaaacuuuuggccagcuuguuauugcaccaaauguuaccaccaccucaggcagcuguaacauuuaacaauugcugcugauuguuuucaguaaaugcugucagggaaaaaggugguuuacacuguaugaguucugagucaggucaaagcaagacaagccuugauuugaguaggauucuccagggaacugccagacagguuaauggaugacaguuaucugagaauggaguuuuggaggagcuccaaccccauucugcccuguccagaggcugcugggcuguugguuuucacugugauugugggaaauugauuuuuaaagcuaccguagggcuagggggaaggggcagggacuaaggcaaguuaaagcuuccugagauucaaccauuuuucuugaacaaauacucccuagauuguugcaaaccuuuaauuaauguucagaguucuggaaaagauuuuugaccauuuuucccagugaucucuguuccuuuauggaggagaguguucagagguccuuaccucaccauucuuacuggcaucacuccucuuuacuaaucauuuuaagcucacuuuaaaucaguccucucauaaguagcuuggcugccuacucuacuaagaaauuuuaugccaccuacguuuaucuuaauaauuaacauuuauguggcauaucggcauuuucacauauuucauuuaaucauaaauacuagaaccaccaacuagguguuagucuuaacaagugagcaauuuucauuuuuucaggauugcuuauuagauaaaauuuuauauuuauauugucuuuuuuuuuuuugagauggagucucccucuguugcccaggcuggagugcagcggcaugauuuuggcacacugcaaccucugccuccuggguucaagugauucuccugccuccgccucccaaguagcugggcuuacaggcacgcaccaccucgcccaguuaauuuuuguauguuuaguagagauaggcuuucaccguguuggccaggcuggucuugaacuccugaccucaagugauccgcccucauuagccucccaaaguucugggauuacaggcaugagccauugugcccagccuauauuuacauugucuuaugucauuuuuuaaucucuaauagugcugacaaacuucuaucauguugaguccuguaaccauagaacuuagcccaaagaccauuaagauccucuccagcuagguaauaagccauacagaaguucaaacugcucccuuggccuuacugcugcuucuugaugagguuaaaugaaauuuaugauuuaagcuguguuuacauuuuagguuaucacaaacugcugacuaagaguguggccgagacuccagugcauaagcagaucuccaaaaggcugcugcacagacaaaucaagggcaggugagugacauccccauccgggcuucuucauacacccacaccaccucaaagcggccuugugggccacuacuucgcuucucuugaccuucaugacuuaaaucuuaacuauguugcuuaaaaccaaagagcauucuauaagcucuccaugggagcaggagaaccauauaaaauauacacuugucuggccucaauuauuuugagauucauccauguuguugcaugcaauaguucauccuguuuuauugcugagaaguauuccauggaauagauacuccacgguuuuuaaauccauucaucugugaacauagagaagguggaagucugggaucccaacucagccuuugcugacagagguguggguggggcugcaguuuuuucugcagcgauugguuggaguagggcuguuauugucugaaaguuuucugucuugcuuggcugacccuuuccuaguucuuuggcuugagagcucuccuuccuuggggcaucuguaguuugcuccugguauaccuggguugucagcuuuucuggcacccagucuagggguguaggcagcaaacagaaaacccagggagcuagcucacugcccuccucaggucccaaaguccccagccaggcugccuucuucucucugccuuucagaauugucuccugcucauuguauagauaaugucauggguuuuuagcuugauuucaaggguaauagaagcacaccuccuucuauuuugucagaaacccaucucgacauuauucguauauggauuuuacacacuugugaaguuuauagguuaaauugcgaaaagugaaauuggugggucagaggcauauauauuuuuaauuaaauuuuuuauaacauccuugacacauuggcagaaauuaaggcucuuaaacagaaacuugaauguugcugcucauuacugugauagucugauaguuugguauaauuuuuuaauauauuaaugggguuuauaauucugauguuguaaaauugcuuuccaaaaaauaaaagcaaaacaaaaccacauucuaaccaucucacucuuuuucugaguaggaaucucacucugucacucaggcuggagugcaguggcacaaucccagcucacugcaaccucugccucccagguucaagugauucuccuaccucagccuccagaguagcugaacuacaggugugugccacugcacccagcuaucuuuuuuuuuuuuuuuuuuuuugagacagagucuagcucugucgccaggcuggagugcaguggcgcgauccuggcucacugcaacgucugccucccggguucaagcgauucucuugccucagccucccaaguagcugggacuacaggcgcaugccaccacgcccagcuaauuuuuguauuuuuaauagagucgggguuucaccauauuggccagacuggucucgaacuccugaccucaagugauccgcccgccuuagccuccuaaggugcugggauuacaggcgugagacacuguggccagccucccucuugacaauaaucacguaugagagcccuuuaccagcacugguguuaucagacccugugaucuuugugaucuuguuaagugagaagcugccugucuccuuaauaaguguuaauuacaagugguauggaguaauccuugugcaugugguuccucgagguccucugauccugguccugauauugguguuguugaagaguccccugaaaaaggagauggugaguguuaucucuuuuuguuuuuaaugcaaucuacccagcuucuaugaaaaccuuucuguauguauuguuacuuggcauauccuaagauauuuuacagaaauugugauggcucugaguccacaaugcagcucaguaaauauuuauaagugaauguucuucugcauagaagguacugagagaauucuggaaaagaaauauuuuugcacaacagauaugaaauucaggaugagggcuaaacuguguuauacaaagugcuaugacuuauuuuaaaaguauauauaacuuuguuggagcuuuucacuacauauuuuuucaagaaggcagggaaauuuuuuauuggggagugucuuuucugagacauuaucuuugcugcugccccuuauguaucuguguauuccgugcccccaacacacagugccuggcacauagcaggugaucaguaagcacauguugaaugagggugagcagcagguguggugguucacgccuguaaucccagcacuuugggaagccaaguggggaggaucacuggccaggaguuugacaccaucuuaggcaacacagugaggugcugugucuauaaaaaauuuaaaaaaucagcuggucauguuggcauacuccuauggucccagcuacucgggaggcugaggugagaggaucucuugagcucuggaguucaaggcugcagugagcuaugaucgugccucugcacuccagccuagcgacagagcaagaccaugucucuaaaaaauaaaauaauaaaaguauacaugaugaaggagggguuuuaaaaaacuaacuucuaaguugcucaaguaauucacauuuauuguggaaaaaacaggaaacaugaagccaaaaauuuuaaagcacuugguaauuccacaacucagaaauacucuaacauuuuagcauauacucuuacugcuauuauuucuauauaaaugcauguaacauauacauacgaaaccuaacauaaauacuuguuuucgcccuacaccauucuucuuuuuuuuuuuuuuuuuuuggugagacagacucuugcucugucgcccaggcuggagugcacuggcaugcucuccgcucacugcaaccuccaccucccagguucaagcgauucuccugccacagccucccaaguagcugggguuauaggcacccaccaccauaccuggcuaauuuuuguauuuuuaguagagacaggguuucaccuuguuggucaggcuggcuacaccauucuuaagguggcaguaaauaagacuucugaagguaauagucuagugggucaguguuuuuuuaauaccuuguugggaccauguaucaaaccccucuuaguuuguuaagagacacuucagaagucucuuaaagcuaauagcuugcugaauuuccaucuuauaugugguacuauguaaauuuugcccgguuuuggacaacaugagaaaaugucaagcuuguaguugucuuugguuacuuacugugguucugauuuuacagaaauaagucugagacgaaguccucgaaucaagcaguugucauuuagcaggacacauucugccuccuucuauucugugucucagccgaagucucgaagugugcaaagaguccacucuuuccagcaagauaagucagguaacauacgggccccucugccuucacaaguccgugcugacuuggugagaaguguuuuugggaaaagaagcaagaaauuugacauuuucuuucuugacauuggagaaguagaauagguaugucuaguugagguucagggugauggcuagauggacaguccaugacuuuguaaucagucaucccuaggacuccuacaacuggucauccaugcuaucauuauagguagcucauucauucaagaggaagcuacccauaauuucccauaaggacagaaccuacacaucauuaucuuagguggaaggugauaucuguguuuacguucuucauucuucuauccaugguuagcuugcuaauagauuuguguuucuuauuuuaucuuuuuuugagacaaggucucacucugucacccaggcuggagugcaguggcacgaacacagcucacuguagccucaaccucccaggcucaggugauccucccaccuuagccucccagggaggugggacuacaggcaugcaccaccacgcccagcugauuuuuuguuuuuaguaaagacuggguuucaccauguugcccaggcuggucuugaacugcugggcucaagugauccaucugccucggccucccaaagugcugggauuacaagugugagccaccacacccagccagauauguguuuuuauauuuacaaauuaaaguaguucaguugucuacauuuucuaacauaggagcugggguuaauaugccgucuuacuaaaauuaaaaaaggcagcaguuguuguaguugcugacauaaauaggugggauuuucccgaguugcucucaaaaauuguugccuucuuucuuuuaugaacuggcuggguuuuucuuauguuuuguuuguuuguuuguuuguuuuuugagauggagucucacucuguugcccaggcuggagugcaguggcgcaaucuuggcucacugcaagcucugccucccggguucaugccauucuccugccucagccuccugaguagcugggacuacaggcgcccgccaccacgcccagcuaaauuuuuuguauuuuuaguagagacagguuucacuguguuagccaggauagucucgaucuccgacuuagugaucugcccgccucagccucccaaagugcugggauuacaggcgugagccacugcgcccggccuuguuuguuuguuuuugagauggaguugugcucuuguugcccaggcuggagugcaauggugcaaugucgucucacugcaaccuccaccuccuggguucaagcaauucuucugccucagccuccugaguagcugggauuacaggccccugccaccacgcccagcuaauuuuuuguauuuucaguagagaugguguuucgcuauguuggccaggcuggucucgaacuccugaccucagaccauccaccugucucggccucccaaagugcugggauuacaggcgugagccaccaugcguggcuggcuguuuuaauaguauuggaagaacaggaauugagaaagaauuaaauauuguugcuguuuuugacuugcagaccaaagagaaaauucuccaguccaaaguauucggucucccaagagucuucuuuuuggggcaaugucugagaugaucagccccucagaaaaggguucagcucgaaugaaaaagcguucaagaaacacuuuggauucggagguaccugcagcuuaccagguauaauguuucuguaauguuugaaauaauauaaucuccuggaacacagagacauggccaaggaacucagaguccauuagggaagagaaagcaggugaccucuagauaauacuagagauuggaggugacuggguggagccacaugaaugauuauuagacacgugggaacuucaagcagcagguuugacugaagccacggugggggcgguggaggaggagauagagaggaucucaucuguucucuuggcuuugucuacuguuuauauuauauacugcacagauaccuuucuggagugugugacacucaucuuuuccguuugauugcccacuccauccagucaccaacauuagaaaccugggagucauccuuuucccucuccccaggcauagccaaucagucgaguccugcccauuuuauuuacaaacugacucuuuuuuuuuuuuuuuuuuuuuggagacagagucuuacuauuuugcacaggcuggagugcaguggcacgaucucagcucacugcaaccucugccucccaguucaagcgauucuccugccucagccuccuaaguagcuaggauuacaggcacccaccacaacgcccaacuaauuuuugugcuuuuaguagagaugggguuucaccauguuggccaggcuggucucgaacuccugaccucaagugauccaccugccucagccuuccaaagugcugggauuacaggcaugagccacugcgcccggccuacaaacugacucuuguacccacccccucuucuccccuacugcaauuccuacccuaguucaggucuaccuggaacacuucaacaggcuuuucccucucaaagggaaauccuccacccagaggucagagugaucuuucugaaacauuccucucaguuugcuuaaaauguucacuuugcuuaaagcucuauagacuccccguccgcuaaagcaaggcuuuaaguuuuccuaaguggaacucuuggguucaaaaauaaucaccuuuguuuggaaacucaguaaauugcuuggagguugggaaagacauagagcucuggagaagggucugaaaaccauagaucuacacaaccaagaucagucuccucccccaggcaggcagggucuuccguggucuguucccucuggccucaccccuccccgcuccaccuccccagcaacaucaggcugggugccauccugcacagccacugcuuuucacuuccaggccuuugcuaguauuguuuucuaugccuacaggccgccaccaccccacccacuuuuccuguguuugccuuccccugccgacacccaagcuugaagaccugauccaggcuggguuaggcagcccuucuuuguguucugugaugccccucgcaugucccugucacugcaccaaucacauuguauuuucaccugcguaugccccacugaacaggaaaugccagcuagacugagaguccccugacgggaugaaggaaggcuguaggaaagauaagcauugauuuccuuaccuguuggagcuuuucacuacguauuuuugcaagaaggcagggaaauuuuuuauuggggagugucuuuucugagacauuaucuuugcugcugcaccuuauauaucuguguauuccaugcccccaacacacagugccuggcacauagcaggugaucaguaagcacauguugaaugagggugagcagcagaugagguggcuccuggaggcugcuuuaggcaaagaucagaaauagcugccuuaucugaaaagaaggaagagcuagagaguagcugcagugguagaaugauuccauuagaggcaaaaagcaugguuuagcaauauguagauuauuaaaauuauuuguucuaggacaaacuaaacuuggauaguguuugguccuagaaaaaguagacaaguaaaaucugagucauguuuuggagagggaaacgggucacuauuugagauuuccaucuuuagaucauuccuuuggcugacuauaaaucucccauuuggucuuagagauuacuaaaacacuucagagaucaugaguuauaauauucaaggacugaaauaagcauuucucuuuucagacucccaagaagagucaccagaaaucucugagcuuuucuaaaacuacaccaagaaggaucucucauacaccacaaacuccguuguauacuccagaaaggcugcagaaguccccugcaaaaaugaccccuacaaagcaggcagcuuuuaaggaguccuuaaaagacuccuccucacccggccaugacucaccauuggauucaaaaaucacuccucaaaaacgacauacccaggcaggagaagguaccucucuugaaacgaagacaccaagaacuccuaagaggcaagguacucagccgccuggguuuuugccaaacuguacuuggccacauucagugaauuccaguccagaaagccccuccuguccagccccuccaacuucaucgacugcccagcccaggagagagugucucacucccaucagagacccucucagaacaccuccgagagcagcagccuucaugggcacgccucagaaucaaacacaccaacagccccauguccucagagcugcucgggcagaggaaccagcccagaaacuaaaggauaaagcuaucaaaacuccaaaaagaccagggaauucaacugugacuucuuccccaccuguuacgccaaagaaacuguuuaccucuccuuuaugugaugucuccaagaagaguccauuuaggaaaucuaaaauagaguguccuuccccaggagaacuggaucagaaagagccccagaugucacccagcguagcugcaucucucuccugcccuguucccucaacucccccugaacucucacagagagcuacauuggacaccgucccuccuccacccccuucuaaaguugggaaacgguguagaaagaccucugaucccagaaggagcaucguggagugucagccugaugccuccgcuacuccugggguuggcacagcugacagcccagcugcccccacagacucuagagaugaccagaagggacugagccucucuccucagucuccuccugaaagacggggcuacccaggcccuggucucaggagugauuggcaugcauccucuccucugcucauuacaagugacacagagcaugucacucuccucagugaagccgaacaccauggcauuggugacuugaaaaguaacgucuuaucaguggaagagggugaggggcuaaggacagcagaugcugagaagucuucucugucucacccugggauucccccaucuccuccuuccugugggccuggcucuccucugaugccuucccgugacgugcacuguaccacagaugggagacagugccaggcuucggcacaacuagacaaccugccagcaucagcuuggcauuccacagacucugccagcccacagaccuaugagguugagcuggagaugcaagcuucuggccuucccaaacuucgaauuaagaagauagaccccagcucuucauuagaggcugagccccucagcaaggaggagagcucucugggagaagagagcuuccucccugcucucagcaugcccagggccagcagguccuuaagcaaaccugaacccaccuaugugucaccccccugcccccgccucucccacagcacaccuggcaagagcagggggcaaaccuacaucugccaggccuguacccccacccacggcccuucuaguacccccucuccauuucaaacagaugggguuccuuggacaccaucccccaagcacagugggaagacaacuccagacauaauuaaagacuggcccaggaggaagagggcggugggcuguggcgccggcuccucuuccgggaggggcgaggucggugcagaccuuccugggagccugucacugcuugagucagagggcaaggaccacggccuugaacucagcauccacaggacgcccaucuuggaggauuuugagcucgagggagugugccagcucccagaccagucgccucccaggaacagcaugccuaaggccgaggaagccucuuccuggggacaguuuggguugaguuccaggaagagaguccuguuggccaaggaagaagcugaccguggagccaaaaggaucugugaccugagagaagauucagaaguuaguaagaguaaagaggggucuccaaguuggagugcauggcagcuacccuccacgggagacgaagagguguuuguuuccggugaguucguuuuugaaacccaguuuccucaugguuucuuuuggucagagugcuugacaaggaggcacuugggaguugcuucuugggaggccugggcuucccgguugggggucuggggacgcugcucuuacuaugugggaucucuuuaggcuccaccccaccucccagcugugccgugcggagcugccucucugccagugcccuccaggcucugacccagucuccgcugcuguuccaggggaaaacaccuuccucucagagcaaagaccccagagguaauguuuguugaaggucuaggacccuuuccugugacagacugucugaauucaccaggguugccaggcagcucgauucuagaggagccccagggagugccaagugugggauaggugacuucgcgccuacagcgucaugugugcccuucccagagaaacuccacauuagaacuugugugcaugugaacagaagccccucaaaauccugcuaaaauuccucgguccuccugaaaauguugacagucgugggcuugccgcaacaugcugcucaucugcagucuaagaaucugaacaggaaggcguucugagcagcacgagugauaggccuguuuagagcuaguuccccacagcggguuuauccgcauguucuguauauucggugggacacaguacugacuguaguuauaaucagccugcaggcucuaggauuccccuuccccuuccaaauccuauucccaaaagacaaggauuuggccuguuaacugcccugguuagcaauguugccuucugcugcuagaaucaaagggggagugcaggaggagggggccuuuggugguucaguucccucaagaccaugauauaaaucaugcaaaacagcauaaccccagagaucugagaccuagaaagaauacaggauauuaaccugagggaauucaaaccacagguacuuugcauuuucagagcugcuucuugcugccagcacggugcauagcuguuaagggcaggguccuucuaaaaaguguagguaccauuucuguaggauaagcgaaccuccaagcagugcugauuuucuuaaagucuguuuuuguguguaacccucugcaauuuaagccaauuuuuuucaguucgguccucugugacuccugcaugcuaagccuuucuaccuucuucuagaugaggauguggauguucuucccuccacuguagaagacucuccuuucagucgcgcuuucuccaggaggcgccccaucagcagaacuuauacacggaagaagcucaugggaaccuggcuggaggacuuauagccacaaacauuacugagcccaaaagaucaaggagucagccaggacccuguggacauaaagaaguuggaugccuggucccaagccucuuuugccauggucaguguucagauugccauuagaaugccuuaggguuuucuaauuccccuuauggauccaauccaucuccuggcccugccccuuguuggggaaguugcaggaggagagguggauggcaaugugauuggugcuauaacucaggcagccugggagucaggaacccagacaaggaaucccauuccagccucaccccaaccaugaccuuggcaagucagggggccacucugccucauuuaugcaaauggagaaaggcgcccucccuggggucccuugagcugcuguaaggcugggcugcugcgacacaggcagcgcuuuguaaacugugaagccauauacgugaaacugaagagugcauugggcaguggaagcuauuuuuugccuucccuguguaacaguaaaaucaucucuagugacugagcacucaguacauuuuuguuuaauguugggccugagguuaacugugaccaugguccagcuugaguggcuucuggagcagccacauuuucaaggacuguccaagagccagccaguucagggcucaggccucacccauugcccacuccuggggagaccaucaccuggcucaucguuuccaccaagagugccccacaggagugccccacagacccgcuggaccagccugcugcggguccuggccaggggucuggcuaacggugagggcugacucugaacugucucucagucuccagaaaguguucaagccuguuguguucccaaaucugauuccuccuauugucuuguaaaucaaacucuaagugaaaacuucccauuugucccuucaaagauuuuuuuuuauuaaaugguuuuuuaagauccuaa

SEQ ID NO: 191786 - RNA, 18497 nt, Homo sapiens
ccagcguuagcccgcggccaggcagccgggaggagcggcgcgcgcucggaccucucccgcccugcucguucgcucuccagcuugggauggccggcuaccugcgggucgugcgcucgcucugcagagccucaggcucgcggccggccugggcgccggcggcccugacagcccccaccucgcaagagcagccgcggcgccacugugagugccgcgcggaggguccaggcaggcgcgcgcccccagcugcgacguggcggcuucccaggcuggggccgggaagcacgucccgccagcccgcagcccggggacggcggggucaggcgcacaaagggccgcggggcagcuucgcuccgcgcucccccgcccggcgcuucccggccgugccaggcgcugggguggggacuugagggacgguggcaacugguggcccgggcgacggccagcucugcgcgggcgggggcucggggcugccgcgcgccccuagguauuucgggaggggguccugagagugucccggacccgaaggguggccugcccgcccugcgccccuggaacgagacgagcacccguggggggcuggagcaccccgcgcgcuccccuggcgagagggagggucguggcucggccccugcucagacaaaggcugggaggcgggagacaugcacuuccccuuccuuuucagccaggcgcgcgcugauaccaggcccacgucagcuauuuuuggagccuuuuacacgacagcuggaggagcguccuuuuuaauuuuccccuuuuguuuggccgcccccacccccaccccuucgccuucaucgcugcacuugaggcuccauccuggggccucuccuugacuugaccugccuuggcaggcacaugcccucccugccuggcucacucgccgcagagaccuggcagcccgcgcaaaaugucacuuugcggaaucguucccacggcuucuggguacccuuaguucccugcuuaggagggaagacaguagucgggucguaauaagcaagacuuagcccgagccuccguugccaacgcaggcugccuugcuuggcgugugggcaucggccugcccccucacccuggcuacccaacacagcuacaaaaggcagggaacaauguaggucccuuggcccugccuaaugccuguugccauggaaaccccuauccuaaucuggccaggagccccuugcagugagccaggagagugaggaagaggggauggggcccgcuggcccugaccuggccagaggagguaaugguuaaccggauugugggagcagcugacuagagccggggggguagggaggcuugggccccaguccuaccuucccugccaaggagaaaggggcaugucugcuuuuguaccucugggaaucuaccucagggaucugcccaacaacucccagguuccaagugccccaggacccaaagauucccauauagcacaccaccuucagcaaaaauaugguggaaguuagccacauucuuuaauucucccuuuuuuucugccuugaugguaaaaaaaaaaaaaagaaacaaacaacccgaaaaacacacacaaacaggaacacaaagcgccuuuuaaggguccugaauuuggauacagaaaaagcagucaguugcaggcccuucuagaaguccccauguggguugguuaugaauggggaaauugcuugguguuggaguuggacaucagacucuacaguugcgacucugccagcuuguuaccuggcaacgcagcuggagacagaauacuuggcauuccccuugaugacaaggaaagaauauuuuggggcuaaaagagccccgugucuuugcugccugguaauuccugcacgcaucuuuuccuauuuugcaacgccauaggcuuccagcgacugcuggugauguuucugguaaguuagagcuuggggcagugcggaccaguucugugaacggcucaguggcagaauuacuuaucuagccuuccuucacuccuaacccagaaacuucuuaauucuugccccuuaagugugcagaucuuucugccacgucagauaaggcccuagcugcccugccagagcugauuggggugguuguguuuaggccuaguagguacugaggaaaagccucuuuggaauggcugaggccugcucccacaucuucugugugaaguugagggcccuugggcugguuccauucaggguaugaggugcuggaaacugcucucagauuacuggaagccagggucuguggccuucccugggguuuauacucuguaaacccauguuaaaaauaccagcagauugcaaauauuaguacacuguagguuguaagcuucuucagggcauggggccuauugcuggagagagaugccacccguguacaucuggugcaggcugcugguaagaacucacuggccccuguguggcaaugcauaccagaugggugagaggggaggaaacacauucagugaaacagaaggugagggcagggcagcccugaccacagauggaguugacuucaacuugaccuuuauuuaugucuuugacaaaaguaguauacuccuacuuugugccagacaccaugccgggugcuggggauagagcugggaauaaaaccagcagagacucuuucaaaacccuuaggagcucaaauucugaugugggagggggcagacaguaagcaagauagauguugacuaguaugauauauggguacaagagcuaaggaaggccaggcacuguggcuuacaccuguaaucccagaauuuuggggggcugaggugggaggauugcuugaggcugggagcuccagaccagccugggcaauauagugagaccccaucucuacaaaaauaaaaaauaaaauuagccaggcacgauggugcaugucuguggucuuagcuacucaggaggaucauuugagcccaggaggucaaggcugcagugagguacaauugugccacugcacucuagccugggugacaaagcaagacccugccucccccuucuccccccaaaaagagaagagcuaaggagaaacaggcaagaaaggugugugcacaaaaguuuguauagggcagccagaaaaguccucacugaaggaaucgcugaggaggggaggaagcaggccauuuucgguauugggggaagagggacucgcaggugccaagggcaugauggaagagcagagaggauggugcgaaggcuggcucagcaggcaccagguggagugacaggaugagguucggcaguggggucuguagagggcucacaggccauuuuugagagcuuucgcuuuuacuuugcaggguuuugagaggaguaucguuaccugauuuccaucuuaucgggagcauucuagcuucagggaccuggcaagagaggaugauggcuuggaccugggugguggcgcuggggauggugaagaagugguuggauucuggauauauuuugaaggaggagccaguaguggggaaagguuccaauucaggcgauuuuacauaaaaaucuagauacgcagcaggcacucacuuauggcaagggugggcuugucugaggguggcuucugguuuuggugguuuggaugugagagaagggaaggaaugaaggaugacaccaaggagucuacuagaguuuguuccaaaauggcuguucuggccgcgugcgguggcucccaggacuuugggaggccgaagcaggcggaucaguuggggccaggaguucgagaccugccuggccaccauggugaaacccggucucuacuaaaaauacaaaaauuagcugggugugguggcaggcgccuguagucccagcuacucaggggcugaggcaggagaauugccugaacccaggagguggagcuugcagugagccgagaucacgccacugcccuccaguguaggcgacagagugagacucugucucaauacauacauacauacauacauacauacaugcaugcauacauacauacauacauacauaaaauauacaaaguugcuguccugccuucuugagcccccaggaauuggaaccuuuccccacucucugaucuuuugcugggacaugcugacugagcagccuuucugcugagagcauggguaggaauguggagggagcaguuaugccuggggcuggcugccugcggcuggaccucuagccuccugcugggagcagcaagaagccagggauguguuuugaaauccuuacuugguauugggugcuaggagccccagacagggaggagagucagccuaacgugccucuggugacugguguaauuccauccugcacucucgccaagaggacaguguuugugcaaugcaucagcugaagauucgugguggcugucacuucggagguuuucagggaggccuagcugcugcucuguguauuucagguagcuugucaccacuuaucucucagagaagggcagaccauggcuguaucuccaccauacaggcugaacagcagacaggggucucaaacuccagugcccugggccacacuggagggcacuuggcugucauggagugaagggagaggccgccuucagcccagcccauccuugccaugagugagugccugcugcauuucuagauuuuuauauaaaaucuccugauuuuuuuugacugguuuaaauuuuuauuauuuugguaaaaaacguauaaaacuuaccaucuuagucauuguucaguguacaguauuguuaaguacauucgcacuguugugcagacauuaccaccauccaucaccagaacuuugucaccuugcaaaaccgaaacucucuacccaugaaacaauaccuccccacuucccguccccagucccuggcagccaccuuuuuacuuucuguuucuaugaauuugacuauucuagguaccucauguaaguagaagcauauaguauuugucuuuugugacugguuuauuucacuuaguuagcauaaugccccccagguucauccacuuuguagcaggugucagaauuucccuucuuuucaaggcugaaucauauuccauuguauguagauaacaguagucccccuuauccuuggaggaugcauuucaagauccccaguggauaccugaaacugcaaagccuguagauacuauguuuuuuuccuauacauacagaucuaugauaaaguuuaauuuaugaauuaggaacaguaagagauuagcaauaauaacuaguaauaaaauagaacaauuauaacaauauacuguaaugaaaguuacaugaaugugaucucuuaaaauaucuuacuguacuguacucaccuauuuucagacuaugguugacuguggguaacugacaccacagguaacugacgucauggaaauaaaaccuuugauaaggggggacuguaucacauugucuuuauccauucaucugugauggacacguggguugcuucuaucuuuugcuguugugaacauugcugcuaugaaugugggcauacauauaucucuuucagaccccgcuuucgauauuuuuggauguauauacagaagcagaauugcuggaucauauaguaauucuuguccuuuucuuuucuuuuuuuuuuucgagacggagucuugcucucuuucgcccaugcuggagugcaguggcgcgaucucagcucacugcaagcuccgccucccggguucaugccauucuccugccucagccuccccaguagcugggacuacaggcgccugccaccacgccuggcuaauuuuuuguauuuuuaguagagucaggguuucacuguguuagccaggauggucucgaucuucugaccucgugauccacccgccucagccuuccacagugcugggauuacaggugcgagccaccgugcccggcaguaauucuuuuccuuuuagcuaaggaacacccauacuguuuuccacagcagcugcaccauuucacauucccaccaacagggcacaagaguuccaauuucuccacauccuugcuagcacuuuauuuucuguuuuguuuuucuuuuccugauaguagcucucuuagugguugugaggggauaguggggugauaucucauuaugguuuugauuugcauuucccugaugauuagugauguugagcaucuuuucaugugcuuguuggccauuuguauaucaucuuuggacuugaaaugucuauuuaagucuuuuguccauuauauuuauuuauuuauuuugagauggagucuuccuguuacccaggcuggagugcaguggcaugaucucugcucacugcaaccuccaccuccuggguucaagcaauucuccugccucagccucccaaauagcugggacuacaggugugugucaccacaccaggcuaauuuuuuuucuauuuuuaguagacacagaguuucaccauuguggccaggcuggucucgaacuccugaccucaagugaucugcccucuucagccuuccaaagugcugggauuacaggcaugagccacggugcccagccagucuucuguccauuuuaacguugaguuauuuguuuuauuguugagauuuacugauuuuuaaaacuuggucaccaauuaagauuuuuuuaaaaaaccaguaccuggaacaagcagaacaagucucugcuggccuuggcucauguugcuguucucaguuccccugggauguuugcuuccagggaggccugggcacuccugacuuuggugacagcccugcuugcucucucucuguuaccuguagguuuccccuuccacauucacugccuccgggcaggcacuguuguguuuuaggcauuucaguaucccagugggguacuggauaagugcuuaguuagcaccugccggugaguaaauaaucagguccuguggucucugaggguuugacacaucaggucuuugaucuugaccuugaacucuccuagccaugccugccugaagcccaaccguggagcccaggcugaggcugaaaccugaagaacuggccccaagugagucucuccuuagggcuccugauuaugauaguucauuuuuuuuuuuuuuuaacaaauuugauuagcuguccucaaauuaacucauaggagaugcuccccagaacuaaacuagcucugcaacagcucaacagacuuuccgcagguucugcagcucuuuccacucaagcuucagaaaaaagugaaggaauauuguagauuggguucaaaauccccaucgcgucuugggaaaggcaguagagccagcagccagccaccuuuuguucucuagggaauggaauaguccaaggcuguguuuguguucugcuucucuacaucugacccacgggucuuccagaggcugcauuugggucagggaccugggcucuaucuugccucugaugcagaccacacucucugagucucauuauucccccuaaaugaucucuaagauuauuuuuagauuaaaaaaaaaaaacaaacucuuugcauaucuuuggaaagucaguuguuugaggucuguuaggcuuuaaucacuuuuguuuuaaaugugccgaggugguuucuaggccugcuuuucacagguauucugucccuugucaguucuucccacccaguuuuuuuuguuuguuuguuuguuuuuuugagauggagucucguucuguugcccaggcuggagugcagugccgugaucuuggcuuacugcaaccuccaccucccggguucaagcgauucuccugccucagccuccucgguagcugggauuauaggcacgugccaccaugccuaauuuuucuauuuuuaguagagaugggguuucaccauguuggccaggcuggucuugaacuccuuaccuugagugauccaccugccucagccucccaaagugcuaggauuacaggcaugagccauuacacccagccccaacccaguguuuucaaauaaucauucucuucccuucaccugauuugcugugucuaaucuagaguggagcugaagacacaucaccaccucucuaaggacuguguguaacacaagaguaauugggcuguaagugaggcugaggagugcugcuuugaggaaagggcacagcucucagcugagcuggugagauuucccugugacugaaguuuuauuagaucuuguucccugcucugcauuugcugcuucuucccaggcugugggcagaggagcaggcuggugccccggugccccuaucugcugcaggcugagguucaacaagccuuguccaaggcagcuguacugauucauuguuagguggccaguuccugaguuuucuuugaaauucacuucccagacuguuggguauuccugcgagucagacucuccuucaguagcguccccugcccccuacccuccacuggucucccuggaccucugaucagccccucauugaguccuuugaugcuucucugguaggacugacccaccugcgucggcugggaucaaggguucugaguuccauucgcaggugcuguaagccuguccuuccuguugaauagggucagaguccucgugacucugcuguuuucaagcucuguaaccuugggcaguaagcuguuaaccucucugagccucaguuucccacacuuaaaauggagauaauggccaggcgugguggcucacgccuguaaucccagcacuuugggaggccaaaguggguggaucaccugaggcuaggaguucgagaccagccuggccaacauggcaaaaccccgucucuacuaaaaauacaaaaauuagccgggccugguggcgugugccuguaaucccagcuacucaggaagcugagacagcagaaucgcuugaacccgggaggcagagguugcagugagccgagaucacgccauugcauuccagccugggugacagaccaaagacucugucucaaaaaauaaauaaauaaauaaauaaauuaauuaauuaaauaaaauggagguaaugauaccuccuugggguuguuuuugggauuaaauggaaucacauuguacagcauugguacacuguaaggcacauaguaggcacucaauaccuaucuauacuauuuccuuuaucaccacaaguuaguugagggcucuuggguugcacgcaacagacaaaguuagugacugguuaacuuggagaggauuuuauuaugagcuacacagcguagcucauagaauugcagggaaaacuauaaagaacuaagucuuggacaaaaguaauaucuuggcaugggccuguagccccagcuacuaaggaggcugaggugcaaggauugcuugagccccggagucugagccuggcuugggcaacagagagagauaaagagacccugacucuaaacaauaaguaaauacauaaaagaggacccaggcccuccuuaggaacuggauggcaggagccccuggacaaccucuuacugauuuggugcuggaugaggcagccgcagcuagccaguguucuuuguguugaucuccucugccuucauauuccagggggagagggucugacaggccagacuggcccccacccucuuggccacuggugggcugggcauguuuuuggguaguucuaccuagccagauuaaagugggggugggguggggaguccagccagccugggcaacagggcaagacuccaucucuacaaaaaaauuuuaaaauuaggcuggcacgguggcucacgccuguaaucccagcacuuugcgggggucaaggcagguggaucacuugaggucaggaguuugagaccagccuggccaacauggugaaacccugucucuacuaaaaauacaaaaaauuagccagguguuguggugcacaccugaaauccccgcuacuugggaggcugaggcccgagaaucacuugaacucgggaggcggagguugcagugggcugagaucaugccacugcacucccacccugggggacaauagcgaaacuucgucucagaaaaaaaaaaaauuaaaaauagcugggugugguggcaugcgccuguagucccagcuacuugggaggcugaggucagaggaucacuugaagccaggaagucaaugcugcaguaagcuaugauggcaucagugcauuccagccugaccaauggaacaggacccugccaagaaagagagagagaaagggaggaaggaacgaaaggaaggaaggaaggaaagaaaggaaaggaaggaaagaaaggaaaggaaguaaguaaggauggauggauccaggugcucuaaaccagcaguucccaaaguuuuuggcaccaggggccaguuucauggaagacaauuuuuccacggguggcaggguggugggcagcggggaugguuuugggaugagucaagugcauuacauuuauugugcacuuuauuucuauuauuauuacauuguaauauauaaugaaaaaauuauauagcucaccauaauguacaaucgggggguccugagcuugcuuuccugcaacuagacagucccaucuggaggugcuggaagacagugacagaucaucaggcauuagauucucauaaggaguaugcaaccuagaucccucgugugcgcaguucccaggcaugagcucaggugguaguagugcucacucaccugcagcucuccuccugcuguguggcccaguucccaacaguccguggaccugcacuaaaggcuguggccuggucugcugaccucucuccagagcccacgguacuaguccauggccugggaguuggggaccccugcucuaagcagugagggagcugauuugcagacgggggaguggacaccgggcagcuggagcccuggcuuucugccacugucuccuggugaagggcgggccuggcugggaggagagggccccccuccagccuccccaggggcaugaugcgcugugugucccugcuucuagaugccgacaaaaggaucaagguggcgaagcccgugguggagauggauggugaugagaugacccguauuaucuggcaguucaucaaggagaagguagugcccccuccugaaguggguggcucuccaggugggcuggccagggauuguucugucccacagggucuucuggacugcaggucccuaggacccccccguuguccugguaggcagcagcagcucuguuucucucccucugucuacccuucuuucacaucugguccacuaauuguucagaagucgucaggcgggggccuguccccagcaguccguguugugauggugccagaucccacacguucugucaacuuugagaagcuucaagguuaauccuguaucauuuccaucuugauccccuacguuuugccucacuucuugaaaaggagugaaaagggaacagggcugguguguagggcagugacccagccugcaguugugacgagccaccauggcaaaggggucccagaguggccgcuuggcuucuccaaaguugccguggucuauguauguccaggagagcauguaguccuugugaaggccccacacugugugugcguucaugggacaaagguugagaacugucacuuccaacuguaagaucucaaagcacuugagaagaggaaaccaguuguauagagaaaucuagauguacuugggguugggguuuggcugaguugaugggccaugugaggggggcacacaggcacaguggaggaagaacccuccaaaagacugcggccuggccugccaaccucucuccaaagccccagccucugccagcucuggccaggccccacugagaaauggcugacuccagcuuucugcugcgccccuccacuggccuucacucaucccuguuuugacugacuguccccugccauggccugcagacuucuuauccugcccuuuguugucaugucccugagucacuggggugacgccuugcucuggcccucuguccccagcucauccugccccacguggacauccagcuaaaguauuuugaccucgggcucccaaaccgugaccagacugaugaccaggucaccauugacucugcacuggccacccagaaguacaguguggcugucaagugugccaccaucaccccugaugaggcccguguggaaggugcgaggguguggaggugggcgggccagggagggucacaggcuucucccaccggccucuccagacuugggguggggcaguuggccaugucacucaucucgggacugggagguugggaggcuccagagcuggggcuuuccugaggccaacugcaccugaggccagucucccugugugugccugguggacaguggggccucagaggucaccuuugaugaggcuggggcaggcguggguaaggggcuggccucagguuccacgguuagggcacagcagagcugagaacagaauccaugucuuccaucucccaggccagugguguuucugcuucacucuggcucugacagugguaggugucaucggugacagggcugaggaggaggaggaggaggaagguaaugcugauguggucacaguaaggauggcuucuuugggcaguaguccauucuggcguggacagucuugcaggcagguaugcagagagauugugcagaggagugcuguguguaaggccuguguccuucagagccucagcagccucuggggaacauugcuguugcccuccugccacuggcuuggccuugcaggucugccucuguccccauggucaugcagggucacugagaggugcccccaccaggccuagacuggcuucugguccuuggcuguuggggccgcucucgaggguuccaugaagucacagcagugugugugcagaggggccagguuuggauaauucgagaaaggaugguugaggaguuuucugagcucucucuuccuacuuuccacaguuggagggagcuggcggaaaguacucgagauacaucugcaaauuccccaggccugccccuguccugcaggucaugccugacccacagcacugggaucauuugaguguugagcucuucauuucaccugaaccuugggaguuguguauccccauuuauggacaaggcaggagagggucacagccuuaggaacugggguggcguuggggccaggaccggagcauguggagugggcaguguguugucaggcuucgucagacaaguccuucccccggacuguacucccuccaugugugaugugggaaucauaauggccaacagagcacuuagcauggaccgggcaccguucuaggcccuuuacacacgagcucauuucguccucacgacaacacuuaggcugguuauuuuuccaguaauuuuuuuuuacagcuuugguugagccacuuuuguaagccucaccauuaaaacuggcagacuugcugggcaugguggcucacaccuguaaucccagcacuuugggaagccgaggcggguggaucaccugagguugggaggucgagaccagccugaccaacauggagaaaccccaucucuccuaaaaauacaaaauuagcuugguguggugucacaugccuguaauuccagcugcucgggaggcugaggcaggagaaccgcuugaacccaggaggcagagguuguggugagccgagaucgcgccauugcacuccagccugggcaauaggagcaaaacucugucucaaaaaaaaaaaaaaaaaaaaaaaaauuggcagacuccagagcccacacauuugcacucuagacucuacugccuuccucaugaagaauuuuaggacccccgucuggcuguguuguugcuugggguucaaauucugguugaaagauggcggcugcagugggaccacuauuaucucuguccucacagaguucaagcugaagaagauguggaaaagucccaauggaacuauccggaacauccugggggggacugucuuccgggagcccaucaucugcaaaaacaucccacgccuagucccuggcuggaccaagcccaucaccauuggcaggcacgcccauggcgaccagguaggccaggguggagaggggauccacugaccugggcaccccccgacuggagcuccucgccuagccauccucuugucucugcaguacaaggccacagacuuuguggcagaccgggccggcacuuucaaaauggucuucaccccaaaagauggcaguggugucaaggagugggaaguguacaacuuccccgcaggcggcgugggcaugggcauguacaacaccgacgaggugaggcuggcuugggcauccugggccccuccucucccagcuugucucuucaucucugucucguggcuuuccuuucuucuguaauggccucauucuuaggccacaaagaggcagaaauggccaccagggcugggcaugguggcugacacuuguaaucccggcauuuugggaggccaaggcaggauugcuugagaccagaaguuugagaccagccugggcaacagugagaccccaucucuugaaacaaaaagaaaagaaaagaaaagaaaagaaauggccacgagcagcuccaggcguacuccugccugcuuggcuacccuaucagaagagaaugccucuuuauccccaguuccagcuccaaugccaggcugagucacaugaccaccucugagccaaucacagaggcccuggggagaaaggcuucugauuggauaagccagggacacacugucaaccccagcgcuaggccugggaauuagcccugccccagccacauguagucuaaggcggugcuuuccaaaaaaaaguuguuuccaaaaaaaaaaaaaaaaaggcgguguuuuccaaaaaaaaaaaaaaggcgguguuuuacaaagcaaaguugagagggagaggcugggccagcagaaacaucgugugcacugcacggaggcugguguuaaacagucgcgugggcggcgggguaccguuccuggagagcugggccuugcccugggaggugggagguugccggcaaucgccaggcuagggcaccacgccagggcccugucucucccccugcaguccaucucagguuuugcgcacagcugcuuccaguaugccauccagaagaaauggccgcuguacaugagcaccaagaacaccauacugaaagccuacgaugggcguuucaaggacaucuuccaggagaucuuugacaaguaaagccucauccauguacucuguggccuuucuucccuuccccccaugcuguucccauccuacccugggaaggucgcuauuagagugcauuuggcucagcuccgaggcucagggagggauccccaaccugucagccuucugcccucuccccauaacagaccuuuuuacucccaggcacuauaagaccgacuucgacaagaauaagaucugguaugagcaccggcucauugaugacaugguggcucagguccucaagucuucggguggcuuugugugggccugcaagaacuaugacggagaugugcagucagacauccuggcccaggguacgcugggaggacgcugcucccuguggggguggacuguuggucuucucuggcuggagggauuuucagacccuuuugguagaaaacucuaguggagcaggacucauugcaggguccucuguggacagcagggggcaggagcucccuggcaucugagugagagaggaucacaaauuagguuuggacugguguaugacugaggcugcucuuagagagaaaggagggcacaggaauuccagggcuagguugacagcccuaagguugcuccaguccaugauggagccucaugacucuuugguuccaguaggaaaaugggaucaagcgggacuggagguucuuuaaacuacagcgaaugcauuuugcauagugaaccuaauggauggaagagaauguuggggaagccugcaaacccccaagcccuaggguguccuaaaagacaaaucagauugcaguaaaaaguauaggugaugaggucaggaguuugagaccagcguggccaacaugacgaaaccccgucucuacuaaaaaugcaaaaaaauuuagcugggcauggaggcgggcacagucauggacaccuguaaucccagcuacuugagaggcugaggcaggagaaucucuugaacccaggagguggagguugcagugagccgagauugcgccauugcacuccagccugggcaacaagggugaaacuccgucuccaaaaaaaauaaaaaauaaaaaauaaaguauaggugagaccauuagagaagaacagcgagaaaugggccaauuguguugggaacaagagcaggaaaggugguaggugugggaaacaggcaggacauagagagugaaagagaaaccuaagcuuaccagggcagcuccugguauggggaaaagggaagcccaggacggguucugaugaaaagcagagucuuguuacuuuguguaaaccuuuggcuuuacuuuggaaaguucaguggggauccucucaccgaacaauucccaucuaggauagaaggaugaaacgccauagcagaugaggcagaggcaugaaaaugaaccuuaagugucuaaggaauggugugaaggugcagguaaaauggagaagggauugcuuacagccaaaauucuuagaauucauagacaaagcauuuuccuguagauguuguccauguuuucuuucuucaauccuuauuuuggugucaugggggugccuuugaagcccuggaguccuugacaauagaaaagcuugcuggaguugacauguggauuugggagcauucagaaauuaaucaaaaagcuugaaaguggccuaagagaguagcugcaaaagugauuguugggaaauagcugaccacagcuuuauuguuuuccuugaaugugccuccgggucacgagccaggcuggguggcaggcugugggggaccacaggacucuguggccucuugggcccugugggccacaggcuguggggcgccuggagcuggugacacagauggauguuaaugugcuggugauagccacccuccagugcccuccagcccugugcugggcccuggagacccacaggagggugaagagaccuggaacagucccuguccucccaguugcagcugggggaggcugaguagagccacgaacuauggcagcuacaauauuggguuguagagggcagcagggcucagcuggguggccccaggagaggcgaggcccugagagaaaggcuuucuacccuccaggcuuuggcucccuuggccugaugacguccguccuggucugcccugaugggaagacgauugaggcugaggccgcucaugggaccgucacccgccacuaucgggagcaccagaaggugagugcagggcauggggccucacaaugccccucuaccccaggggccuaaagcccacugggcugagggcuggaaggacgagccugacccaccagcccaggggcgggcagcuguaucugggcagccuccucacuagcuggcucggcucuugaucucccugcaacccccguccccagggccggcccaccagcaccaaccccaucgccagcaucuuugccuggacacguggccuggagcaccgggggaagcuggaugggaaccaagaccucaucaggugagcauggagggagaggccggagcugcccaggacaggcucuggguccugcccuugcacagauggggucucauucugccccauccccauagguuugcccagaugcuggagaaggugugcguggagacgguggagaguggagccaugaccaaggaccuggcgggcugcauucacggccucagcaagugcguggccuggggugguaggcagacccuggggccaugugggaggaagccaggggaccccuccuaaagucccccucaugagucagcuuagcugcaagggggccuggggcaggacauguccacagcccugagagacugcucaggccagccucuguagaccaggucuagugaguuccuccccaucccugaggcuggcuacucagagcuccuuccgacccugcccacaccccuuucccagcuucucucaggagagcaguuaccuggcaagacagacccugcgggugccugccgaaucucgguggccucaugguagggggcuauagcuggccucuggccuguagucuggguggcaggagauggcuguucugaugcccaagcucaggcuguucccuggaagggccuggcugauggccuuggcaaggccuggagccaccccugaugugaguggugcucucucugcagugugaagcugaacgagcacuuccugaacaccacggacuuccucgacaccaucaagagcaaccuggacagagcccugggcaggcaguagggggaggcgccacccauggcugcaguggaggggccagggcugagccggcggguccuccugagcgcggcagagggugagccucacagccccucucuggaggccuuucuaggggauguuuuuuuauaagccagauguuuuuaaaagcauauguguguuuccccucauggugacgugaggcaggagcagugcguuuuaccucagccagucaguauguuuugcauacuguaauuuauauugcccuuggaacacauggugccauauuuagcuacuaaaaagcucuucacaa

SEQ ID NO: 191787 - RNA, 3803 nt, Homo sapiens
uagggucaaacuucuaaaccuuuauuacugauuaguacaaacacaaacggagcaaugacaacagcagugaggagaggcccugacaacgagggccgccccugcccggggugaggcugcacagcgccagcuccaggcugggccagcuuggcccgcacuggcaacacaggcuugaccuuggccacagcucagcaguagaaagguucuuggacagggugccaggacacacgcuggggcugcugucacaggacaaucuuaaaggagcugaacaagagaaaagcgguggguuuucugcuggaagaggagggcagggacuaaacccgaacuugcccccuucucccuuuagacccuucuuuggaacgggcuauguuccgugugucagcccccucugcaagaacuccccgagacauccagagggagcuuucuggacccacacacugggucagagcuucuaaaccuuuauuacuaaugaguacaaacacagagcaaugacaauggcagugggaaggggagaggucuugacaaggagggcugccccugcccggggcgagacugccagcuuagccggcccuguguguggggacuggggcuuucucucacccuggcaccaccuccuguagccaugcccuaggcccagaggcagcaggucggaaccugcagguacccagaaugaagggggaccacugucauaccuggcaaagucuggagaacgggagaugacgugcuggaacucagagagguugaugguuccaucccugucaaugucagacuccuccaggaucugggaaagggagaguuucaggccagagccccaacugcucccucccgcucccaggccugcucagcugcucacguugucgaugagcugcuucaucucagacgcacuaagccguguguccucgcccucucccgugaggcaguucaccagccggcucaggucuucucuguucaagguuccgucaucaucaaagucuagagagcagacacaggaagccaaaagacacgguugggaggggcucugagguuccccaaacggcgcccauuucccaagcagggccaccacaaagcccacgugggaaggggugguguccugccgggcugcuccugguucucaccaaagaugcggaaggcauaaugggacuugaugucuggcguggcugugucacugaacacacugaggagauccaggaaguccucaaagcuaaggcugucuuuggcuggggauguggagaagacccugcagauucgcuccuugaagggguuggccuaggagaacaaacgccacaggacguggcccaggucacacgcucauuaaagccuaccagaaacuugagagagcaggucacaggaccagcaccagcgagcucagccucgugggggugaacagucagugcuuuggggccaacauggagggcagugggggcacaggaaagcaaacugacccagcuggggaagggacugagauggcuuccugggagucaaguguuuaacccaaaggcaggucacauacaacguaagugugggcagagagggaagaagaagucauccuaaacaaagggaacgagaugggcugguuauuuuaaaacacaaauauuuacuugaacagcuauuguguuacaggcaccgggccaggcccuuugcacagaaauuuugcagcagccuuacggaguggcaaucagccucuagaacacgguuccucaaacucuaaugagguaccucaacuccucuuaagggacaaaacuucuuugaacuuccaagauuauguucuagaauccccauuugaaaagcaccauucuagauaauucugccaggugauuuugguaaaguccuugccccuagaaaaucagaacuaagcagaaaaaugaccagaguggggaccagugaccccaugaucccaaagcuaguggcagauggaguuagggggucuagcagggagggaguggugggagaggugucaaaggaggggagcgcuugcaccuugagcucuggaaggcugagaaucugcucgaagggcacuugugcccgaagugacgacuccacgcuccgcugcuccuggggaagcagcucacaaaaccgccugugggcucugguagagagaggggaacugucgguguucucagcgaucggucucccuguguguucauucccacuccuugccugcugcucauugucaaccaggugaggagcuaaaaccacguacacagaacuuccgagucaucaggcaacgguaagcaaaaggacaugucacaaggcaguacagccuaggagucuauucuugcaaugaguauuuacugagcauuuacuaugugcuuggcacugauucuagagauccccaagggaugaagaaguugggaaaggagccagaaguuggcccuaaagaauuggccaggcacgguggcucacaccuguaaucccagcacuuugggaggccaaggcgggcggagcuuuggaggucaggcgucugagaccagucugagcaacauggugaaccccuucucuacuaaaaauacaaaaauuagccgggcaugguggcgggugccuauaaucccagcuacucaggaggcugaggcaggagaaucacuugaacccggaggcaggagaaucacuugaacccggaggcagagccugcagugagccaagaucgugccccagcacuccagccugggcgacagagcgagacgcugucucaaaaaaaaaaaaacggagaaaagagcaaaaccaaaaaucucauucucaccuucacuccagggaucucuuacccucaaagccuccuuuuuagcaaccacacugaacuguccuccucggccuccaccuccuucccaugagcuuaucuuugccacaggaaccuggccugcauaaauccggcaaaagggcuuccagcccaaguucaaaucuacuuacucagaguguugucuuaagcaguuaccaaaccuuucugaaccuguuucauuguccaguaccucucuccuaaagauuaaauuagguaacgcaggcaaccauuuagcacagucccuggcacauggugagugcucagaaagcgauaacgguuacuguauuauucagguaaaguugggagaaggagccgggcuccccaaggcuucugugguuuagccacugggcaaggucggccccugccggacuggggcaggaaguucggcagugcugaagcuaguggagcccagggucaaagagcgccuaacuuuuccuggaggcuguaagguggcuccgcggugccacgcuggggccucaggcgagggcggggagggcgugccgggaggagggcgcagcccgggcuaggucucccggccuccagcucccgcuccucugcagaccucaggccagcccccgccccucccucgggacagcgcccccgaagcugucucuagaggaucccggggucggaggcaggguucaaggcagcacuuacaggaggaucuccugcuucgucaggaacgucaaguccuggaaggcaaagccagagcggggauuagcggaccgcugggaggccgcggccgccccgcagccagcucccggacccugcucccgagaagaggcccgcacgcgagcuccccagggccaggcgucccgcgcaccugguacucggccagcagcuccuuggacaggcgacugcccgagccccccaucgccccgccgcgcgcacagcuccgccaacucgccucgagacgcagacaacuuucucacuuccgcccuugggccgcgucacugcccgguccccgcggcaaccgcuccuggggccaccacccccgggcccgcccccuccuaaaagcugccaggcguucccagcc

SEQ ID NO: 191788 - RNA, 1620 nt, Homo sapiens
cgcgaugggcucugaggcggcgcagcugcuggaggcugccgacuucgcggcucgcaagcaccggcagcagcggcggaaggaccccgaggggacccccuacaucaaccaccccaucggugggcgcgucggccgcggagcgccggcugcggcaccugggugguggggacugggaaggaaacguggggggcgugcaccucauugagcaccuguuuugucccaagcuuagugcgauauaccguuuaagccucauaacaauuggaacgguaggcaugaucguucccuuugucgguuggcucccagaggguaagguacuugaccaaggucacccagcuagucagaguccacaaggggccacaucuggcucuccaaaacccacaacacaccgccuugggacuaccuccgaccugacuuccugcuuugccccuccccgucagguguggcacggauccugacccacgaggcgggaaucacugacauugugguguuacagguaacuuucccccuucucugccaggagccugggauggggauuaggggccccauucagcaaugggcaacccuuggcugacaucucagggcugagugggaacuuguccccaggcggcccugcuccaugacacgguggaggacacagacaccacccuggaugagguggagcuacacuuuggggcacaagugcggcgccugguggaggagguaacagaugacaagacucugcccaagcuggagagaaagaggcugcagguggagcaagcgccccacaguagccccggggccaaacuggugaagcuggcagacaagcuguacaaucugagggaccugaaucgcugcaccccagaggguacgcuuucguaugggcuguaagggaaaagggagggggaugccgccuucugaagacacauguuggucaguuccccugaaaaacccugggcauucuuaauucccaaauuaauccuacuggaccacucuuugaucuucuuucauacaguaaaaauacaauagcugggccaaggggaaguuuucaggacagcucauuccaucaggaacucauggccuugaaccaagcuugccaggaaguggggaaaaggcagugcuuuccuugacaucacgcuagcaaguuucugucgacucuuaugcaggauggucagaacaucgaguccaggaauacuucgagugggcagcgcagguggugaaggggcuucagggaacaaaccggcaacuggaagaggcucuaaagcaucuguucaagcagcgggggcugacaaucugaucagugcuugaagcuauccagaggcacaacuccagccucguucaggccggacaggauucauacgccaucuuuucugugucuccugagcucccuccauccuucccagauauuagaggccaaaaaaagacuugcauuuuuucucagucugaaggucuccugcuaacuaagcugagccccgcguggugggaaucagauguacccauccauuucugaugcacucaccgccucuccccaagucuugggucuguuugcuauuuugcauggugggaucucuggccccucagggacuugagauuauuuaaguacuaguuccuaacacguucuggaaaauaaaaauaacucuggguuaa

SEQ ID NO: 191789 - RNA, 61115 nt, Homo sapiens
gcugcacugcaugguugcugcuggauguguuguguuccuggcuucccucuggaugcugacagaaacaagggugagagaaaaggacaguaggagaggagggaaggcgggacugaagaaaggaggggaaggggguagcacagggcaaaguggaaaagcagguagcguccuuuuuuucuucacuagggcuuggcgaagaccccuucgaggacagcuccaggcccaucccugugguggccacccauggagacaguagugcugcucagaggcauuuaguuuuuguuucuuuucuguuuuugagguagagucucgcucuguugccgaggcuggagugcaguggugugaucucugcucacugcagccuccaccucucggguucaagcaauucuccugccucagccucccgaguagcugggacuacaggcaccugccaccaugccuggcuaauuuuuguauuuuuaguagagacgggguuucaccauguuggccaggcuggucucgaacuccuggcuucaagugaucugcccaccuuggccucccaaagugcugggagugcaggcaugagccaccgugcccccccucuuuuuuuuuuuuaaagguagagucuugcucuguggcuaguuuucaaucaagguaacacaugggcucucaacagugugcggaacucugcuagaaaaaucaaauuaugagaacacuguuacugugugauccccuauuggaaaaugaauaacauaaaauaacauacauuuaggaaaaaaaaaguggagaaaaggccaggcgcgguggcucaugccuguaaucccagcacuuugggaggccaagguggguggaccaccugagguuggaaguucgagaccagccugaccaacauggagaaaccccaucucuacuaaaaauacaaaauuagccaggugugguggcgcaugccuguaaucacagcuacuugggaggcugaggcaggagaaucgcuugaacuugggaggcggagguugcagugaaccgagcucgcaccacuguacuccagccugggcaacaagagugaaacuccgucucaaaaaaaaaaaaaaaaaggaggaaaaugccacacaaacucaauaguggucaucccugagggcucagauuccggggacuuuaacuucccucauucuguauauuucucuaauguuuaaauguuuaaugauacacuuguaaugcuuugguaauucaaaugacagaugaagaaaaaauguuuucaaaaagaggggguguccauccaccauccucuccaaacuuccaaaacaaccaggaggugccgguacuagcaaguauuuaugcaucauagaggauuuuguccugagcgcguaccauuaauuauuaaagagauguugugaaucccgucagaugaguuuaauguuuagugugaggacuggaaaacuaaagcauucagcccuucgcuuugcacaccguuggcuuagguauucauuuaacaaagaugaaaugaaggggaaauggugugauuugguuuuguuuucuugacagaccugaaacacuuuuacuauuucucacagcuacacugcuuuccucauuuuccagcacaggaaaauugguugcuguuauaauaaauccccaucuagugagaaagggagauagagaaagaugcaaaaugaaagauaaaaugcaaaaagcuaacagccuggcuggggaaaggaggccaugggaaggaaggagggggagggaaauaaucacauagguggcuuccuggaagaagcggcccuaauaggccuggaagaggucaguuugggaacuggggagagggcagaggagggcaucucugauggagaagcagcagccagugggcaggagcugcagggagccagguugcaagugggccugcuuccuguaucccugagaccguguugggguccccacccuggcuguggcccuggccucuggggaggcgcugggcagaacuggguggcaggcccaaccuacuccgacccuggacucugcccaggaauuucugcugaagugacaaggcaagccagagccaaagcagguuggacccagcuuguccccacagagacgugugcuucccucucucucugagagcgaccuguuaaccgcaaauacgugaguagaaacagggccccgcuucugugugcgcugcugugcgucugugugugagccagggcauucccaggcucugccugugugugugcacgcacaugcacgggucucugaguaugucagccuaacugggcuggcauuuggauggaguagggcaccacccaaggggagaaaaaggagcgggaacaagagaagggagagaggagguguuaguuaccacucuuauuuacagaugagcuuaagccuacgaacugagcuucagcaaaaaaugaacuauauugauucuugcaauggaaaguccaggaguaggauugguuucagguauaguuggauccaggaacuggaaugaugccuuuaaggauguugcaccuccaucuuucagagauggaaaaguagaauacacugaagaucucacuuaaugguaauaguuuuaaccaguuguagggagugaugaaagcuagguccucucuucagaaaaaugccuguaucagauacauaugcaggcuguauauaauucuuuacuuuccuucccuaugaagugggcagaauuugcuguuucugccuggaacucccagaguucacaaggacuugccucuuacagguucagaugugggugcaggcuggggugguggcgcacgccuguaaucccaacacuuugggaggcugaggugggaggacugcuugagcccaggaguuggaggccagccugugcaacacagggagacccagucucuagaaaaaggaagagguaccuccuccaugugcugagaagucaagguugcagucccagucacaaggaggggugagcucugggauggcauagguggcccccaggcagggcucuggcugugccaggcaucugcuccccccacucaguccucuccccuuuccccgggccccuaaacugggcccugcccggccucccuuucagcguugggcgcucccugauuugucuuucagcuggaaggucugggacauggagaacgaccccucgagacgaagagaguccaucucucucacaccuguggccaagggucuggagaacaugggggcugauuucuuggaaagccuggucuguacccuuccccaucagucauccugaccccucagccucuuuggcuugagcccggcugccgaggugaugaggcuuuugcucaccaccuucccucauaccccauucuucugcccccuucucaccucuuugcuggcacaguuaugaaccucccaguguguuggccuccucaacacaaggcagaccccuuuauuucacucauuaaacauugacugagcacguacugugugcacuauagucugaaaguccuagucugaaagggcagggcaggccccagugaggaagugacauuagagcugugaccuacagaaugagaaucaaaaccagaugaugggggaggggggucucuaaggaaaucucagccuucaaggagccuuguccuugcuuucaaguggccaggucaggucgaggcacaccacccagaacucggagccugguaggauacccugcacgcucccaggcuccucugacaaagcccccuccccuucacugcccuugucucuuggggugcuccuuucacgcugucauaugcaagaauacccaccccccacccaaaacagcuccacagacggugggugcauggugcccugaggucaugugaugagguagcccugccuggggccucccuuacaggccuccccucggccccucucagucacagcugggccgcaggugucugucccugcgcagaccaugagcucgcugagggcaagaugugucuggcagagcccugcacacaguaggugcucagugccugccuugcagaauccaguuuaguagccuucuaauuccucccugugccccagcccaguccccuccucagccagggucucaccguggcccccgacccccagcuguaaguuccuggggguggguaaggggcaggccgaccugacggcucccugcgggcuguaggaggaaggccagcucccuaggagugacuugagccccgcagagaucaggagcagcuggagcgaggcggcgccgaagcccuucuccagaugguaggugaucucuggagagacaagggcgggccugggguggaggcugcuugggaacaggauggggagccgggccuccuggcggaugggaguuggggggacgugaaccuuuguugaagggaggaauaaaggcgcuuuagccaacacgcacaggcacaugagccucgagggugagccaagucacaggcuccccaccugcuuuugaacagcugaaacgaaaucccaucaggaaccccaguauguaccguggggccugcccugaaccagccaggccucccucucaaccucccccuucugccuucuacccccauucagucucugggguaccucggggagucugaagacuccgguuaaaaauccugaacugggcaaggucccugauuuuacacagggagguagaagcccagagaggggaagggaccagccaggauggcauaggcagcgagugucugaggugagcauagaacuccaccuccugaugccugggccaucuggguccuuguuggccagauccggagcugaggacaccgugaugggcagggggugguggugggggagggauuccgucucucugccugggcaggggauaugggaagaaugccuccuccacccucucaggaggaggugggagguggggacugagaggaggugaggcuccuuaaaauggcagcugguggguggauuccaauuagcauugagugggcgucuacucaaugugugucccaugggcagguggaugaacgacaggggaggggaggcagccauccauguuuuucuuuucuuuucuuuuccuuuuucuuuucuuuccuuccuuccuucuuuccuuccuuccuucuuuccuuccuuccuucuuuccuuccuuccuuccuuccuuccuuccuuccuuccuuccuuccuuccuuccuuccuuuucuuucucucuuccuuccuucuuucuuuucuuuuuucuuucuuucucuuucuuucuugcuugcuugcuuucucuuccuuccuuccuuucucucuuuuuuuuuuuuuaggcaggucucacucuguugccugggcuggagugcaguggcacgaacccuuccugggcucaagagauucuccugccucagcuucuugagcagcugggauuacaggcgcacgccaccaugccuggcuaauuuuuguguuuuugguagagaagggguuugucauguugcccaggcuagucuugaacuccugggcucaagugauccacgcuccugggccucccaaagugcugggauuacuggugugagccaccgcgcccccccaccggccacauuucuguauguugaugagguucugccuuuucagugaacuuccuccugagcccuggaggcagggacuaucacugggguaguggggccugugggugcugccacagaggcaggaaggccugaaccauuucuacauuugcccugggcugggguugcccugcagcccuguggggaugucaaggcaagcccuggcuugccccuguugccacuuuacuggggacauaccugaguggaggugcugaggaucucccccagauggggucugcucaugcacucauggacccugcuggucuuguucccaggaggaaccugcagccagcccugagagccagaagcuucugcagggagcacaugcagcuguuucgauggaucggcacaggccugcucugcacuggugagccuggggcccagcacuacccaggacacaaugacuccugccucagcuauccaugucucagggcagggucauucacucacccagucauucaacaaaugguuguugagcaccaacucagguccagcucccuugcuggguacugaggcaucuguuaagccaggccagaucuuguucccaaggcacucccucaucaguaagggaggcggaagaaauagucccacauaaugcagcaugucaucugggaacaccaaggaggaaugggggaugaucagggaggacuuccaggaggaggugacauuggagucucacaggcuaaguaggaguuagccagguggaggugauagauacuaaggagggcaaaggcacuccacacagaggagucacaggagcaaaggugaaaacuggcaggguguggguuucgauaaaguucgacgucugcacuguaaggucuggaggguaaaguucuagacaaggagugucaggggauggggcuggagagauaggaaagggcccaggauggggaguggguagggauaugggaggaugcucaaggacuuggauuuuacccucaaggccagagagagccacugaagguuuugaacagggaagcgucaagguggaauucacacggugggacccuggaaggagggcaggaaagagggggagauggagacauugaggacugcaaugccugugugagaaugaagcuguggaaggugggcgggggcaaugggagagguccuugggaagcaaugcuagcuguacuuggcaaugacugggugugcagcaugaaggaaacccugaauuagggcugccccaggggccugcucgggugauaggaggaugauggugucuuccacagagcuagagaacaugcgugcagagggagucuuggcaggaagggggauaauuaggauaguuuguuggagguaccacugccaggccaucugagggagagaggaggcuccccaggcacacuuggagaaugaauugagaagugggucaaggacagaagccuggagaccagccacacagaagggguuggcggcagccaaaggagcaaggguuucaaggagggaaagaucagcagcaucucugcaagacccgcaggacaaaaacugagccauguccaccgauuuagggacaaggaggccacuggugacuuaggguguaggugcaaaaacugaauuggagcggauggcagaugaggcugugcagacagcaaguguaaauggcuuuuuggaucaauuuuuaugagaucaggcggggaggcugaaugggcagggugugacccagugucaaggaugggcaugaguuuggggugggagacacuuuguuuguacgagcugagguggggaguuuguagaaggaauaugaaggaaugggagaugaagagauguccgauggagcaagguccccuggcacggaguagaaaagcuccccaccccaccgggaggggugggucuuugcaggagcaagcucaccucauucugacagguuggaauuaaagaggggccaggcauggcaggugguucaugccuguaaucccagcacuuugggaggauguagugggaggcuguagugggaggauuguuugagcccaggaguuugagaccagccugggccacacagcaagaccccaccucuacaaaaaauuuuaaaaauaaaaauaaauuuuaaaaaaagaaaaaggaggauggguacagaugcagagucauuauaggugcucuggaggggaggggcagugagagaggcgacagcaaugaccuggucugcuuggugaacuugaaaguagggucaucugcugagaugggguggguccaugucccucacagcuuccuucuagagauggugauguccaccuuuggcagggucugaagccagggccaucucuguuuccuuggcugccuccuucacucagaucugauuuguuucucuugaagaacaauugaauucucuccaguagagaaugaaaauuaccccacucauccuauuuccauguuugccauggcugucaggaaugcaaucugaaucauugaaugaucccuugcaauggucagcagugacuuucucuguuucugggugacuuugauuucucuggcuuuucaauaucuuuauuacaucaccucuuuccuggggaggcuguucacagacguucugggaauagcugugauagagaaaugaggcucauauucucaggacuuggcuccugagcugcgacaguggcuugcuugccuuagguaggccuucuccaugggugcagcgacagcgcuggcaccaucagacuaacaaggauggccuugguguccccagucuuagaagaaggaggugccucuugcccgcucucccagccaaagcccagggaggucuucaaggagcuuagcucagguccugcccguccccaaaccaaucccugugaauggauccuagaugaauaaaauacuuccaaaagcacuucuguccuugugccccuccuggaggaccccuccacacugcccccucucccugaguccccauccuggccugcccagacccccccagccuuccuggcccgccccgaccacaaagcacaggcccugaggcgcacagaccuucuuggccuccuagccccaugcccucccugugugaggcacucaucucggcuggccucagaggccucccucuccaagugggcaucacuguagaccccaccuuguaggggucuugugaggauucauugugaaaaugcaucugaagugccaagcucaccuccuggcgaccacggagccucucccuggccaggucccccuccccugaacccccauggccggugccagcagccccagcaccgcucuguggggcuccacccgugugucucaaugacacccguucagguaggaacuccagcccacaagcuuccaugugagagaaaggucauuuuauuuuuuauaacucaacuuaucuucucccucaauguuaucauuccagugagugacgggaacucaauuucuguccauuuggaaccucccuucaucccuuccucugggggucaccgggggggcuuaucuaucauuacuccucaagugucuccugaccuguccacuucuccagcugguccuggguccucuauccuugcagguggccauggcgacccccucuucuccauggugggcucauucuggucucccgccucucuucucuucaggccucucguggagacuaguuccgcuguuuuggugccugcagagccucacuggcuuucuagggcccugcuugccacgcaccacacgggcauuccucucucugcaguccugggaccucccugggacucgaccaggaagccagucacagggcuucacugcuugcaaugcugcaaacacaccuggcuuggcggccuugccaggcucaggcgcuuucucugugauaccaguguccuuguuauugccuguaccagagggguuggguagaacuuaccuuuauucgugauguuucagaucacauuuuuuauccauggcuaugaguccuuuccauucuucgaagauccuggauucugaaauucaaaagccagggagaggccgggcgcgguggcuuacgcuuguaaucgcagcacuuugggaggcugaggugggcggaucacuugagcccaggaguucaacaccagccugagcaauauggcgaaacccugucucuaccaaaaauacaaaaauuagccagccauggcggugggcaacuguaaucccagcuacucgggaggcugaggcagaaggguugcuuggacccaggaggcagaguuugcagucagccgagaucaugccacuguacuccagccugggcaacaaagugagacccuaucuccaaaaaaaaaaaaaaaaaucuagggagagacaucucccccucugcuauccauucuuaugugucuuuccugauggacuggcugaguggcucaaagaagagaagggcaaaaggggaaaggaaacuccaggaagcaugcucauugaugaacauuucagaacgcaguccgagcacacauguguaaacuccuucacggaguagcugaugggcucgucuccuuccuccguggggccuagcauggcgcuggaccacagcagaugcuccacugaugcccagcgccucuugcuguuuggcuucacggccuccuuacacaucucccucacauuugguaagcacuuuacaguuugcaaggcccuuucacaacacuuucugccaguaccuccuaacuacuuuuuggcacaguagcggugguuguuuucauuuccagaugaggaaacaggcucagugagguugggugacuuuccugcccuccacgcucuggguggaguaagguggaguccgcgggcggggcugcaggguucugaagaggugguguccuggcuguugaccccuccucugucucaucccccagggcucucugccuuccugcugguggccugccuccuggauuuccagagggcccuggcucuguuuguccucaccugugugguccucaccuuccugggccaccgccugcugaaacggcuucuggggccaaagcugaggagguuucucaagccucagggccauccccgccugcugcucugguuuaagaggugagugagcucacagccccgaggcagggcaggggagggcccaugagcugagggguuggcuccaggguuauggccagggcuggaggaggaggaaggcucugugucauggagaacucucuggcgccccagggcaggagccaguggguggcuucaaacaaagcagcaucuuugugguguuucaccaguucuuagucccaguuacagcaggugacugugguggacgaaaacuggacucaacaguuuccuccauucagggaucccaggccauggagcaaggagggcccgaaucaguaccucccucagaucaccuggacagugugagacaaaaagccgcagggaccaucccuggagggggauucagcaggcucgaucgggguccaggugcugguauuuuucauuagccuccaggggauucugauguagccagcagcguccuuggacaacaguuugagaucugcugcuuuucaaacuggauuccuuggagcgcuggaaaucucagcgaugucacagggcaggagagggagguuguggagggaaaauucagacuucccgcccagcccaccauuucaccaggcagcucuaaauuuauguguuuuauaagccaagguucacacaaaaaagaaaauucgcugggggaaaaaaacaguuucuauggcuuaaaaaaaagucugaagaccaccagucuauuucaauacucuauuuuguugaugaagaagcuggugaccaaagauacccaaagacuaagucagggggaugcagggguacaggggugccucucacuuucccaaagugagauccacauaccacagcaaaaugauuugagccagccuguggaugaacacauuuaaaauuuuauuuauaaauacauuuacuguuacauuugacuucucuuuauuaaauacauuugugauuuauuuuugcaauggucuucugugacaagucauugauaaugguuuuccgcuugagggacugauaggaaguuuccuuuaaaaaaugcaugcagauaaacuggacuucauaaaagcuaaaaacuuucugaugcaacacacacuaucaaaaaagugaaaagacaacucacggaaugagagaaaagauguacaaaucauaugucugcauaaagaaacuguaugcagaauuacaacucaaccauaaaaagacaacccauuugaugaaugauaaaagguuuugcuuuagccaaaaagcucaugcaaaugugcucaacaucaguagccaucauggaaaugcaaagcaaagccacaauaagauaccacuucauauucagucagauggccauaaucaauaagacagaugauaacaagugauggcaaagauauggagaaauugaaacccuuagacacugcugguggaaaugcgaaacagugcaguugcuuuagaaaaugguuaggcuggccgggcacgguggcucaugcccguaaucccagcacuuugggaggccgagguggguggaucaugaggucaggaguuugagaccagccuggccaacauggcgaaacccugucucuacuaaaaauacaaaaauuagccaggcaugguguugggcgccuguaaucccagcuacucuguagugaaaacuacccauaugucuauaaacugaaaaauggauaaagaaaaucuauauauccauacaauagaauauuauucagucaugaaaaggaauguaguauugauaaauacugcaauaaugauaaaccuugggaacaucaugcucagugaaagaaaccagucuuaaagaaccauauacggcaugauuccauuuauaugaaauguccagaaugggcaaaucuguggagacagagaguugauuagugacugcuagggcggaugggaagaggagguggugaccaccagugguuugggguuucucuuugggcugaugaaaauauccuaggauuaugguaaugguugcacaaaucuguaacuauacuaaaaaccauuaaaccauacacuuuuggccaggcacgguggcucacgccuguaaucccagcacuuugggaggcugagguggguggaucaugaggucaggagauggagaccauccuggcuaacacggugaaacccugucucuacuaaaaauagcaaaaaaaaaaaaaaaauggcugaguguggugguacgcgccuguaauugcagcuacucaggaggcagaggcaagagaaucacuugaacccgggaggcagagguugcagugagccaacauugcaccacugcacuccagccugggugacagagcgagacuccgucucagaaaaaaaaaauccaaaccaaacaaacaaacaaacaaaaauacacuuuuaaaaauugcugcauaguauuauuagauuggugcagaaguaauugugguuuugccauuaugcaaaaaauuuugcaccagccuaauaaaugugcauaguuucaggguauaugugauaauuuaauacauucauauaauuuguaaagaucaaaucaguguacuugggauauccaucaacuuaaauauuugucuuucuuuauguuagaacuauucaaauucuccuagcuauuuugaaauaugcaauacauuauuguacacuguagccaccuuacugaucuaucugucacuaggucuuauuucuucucucaaacuguauauuuguacccauuaaucaacuacucgucaucccgccucccuccuccccuucagagucucugguaaccaccaaacuacugucuaucuucauaagauguacuuuuuaagcucccacacaugagugggaacacacaguauuugucuuucugugcuuggcuuauuucacuuaacauaaugaccuccaauuccauccauguugcugcaaauaacaggauuucauuguuuuuuuauggcugaauaauauuccauuguguauauacaccacauuuucuuuauccauucaucuguugaugagcaccuagguugauuccauaguuuggcuauugggaaucaugcugcaauaaacauggagugcaggugucuuuucaauauauugauuuccuuuuuuuuuuuuucauauauacccaguaguggaauuaccgaaucauaugguaguccuauuuuuaguuuugugaggaacuucuauccuugaaccaugcacuguaaaugggcaaauuguaugacauguaaauuuugucucaauaaagcuguuagaagaugcaugcauuuggucgggugcgguggcucacgccuguaaucccaacacuuugggagggcgagguggguagaucacgaggucaggagauccugaccauccuggcuaacauggugaaaccacaucucuacuaaaaauacaaaaaaauuagccaggcgugguggcgggcgccuguagucccagcuacucaggaagcugaggcaggagaauggugugaacccaggaggcagagcuugcagugagcugagaucucgccacugcacuccagccugggcgacagagcaagacuccaucaccaaaaaaaaaaaaaaaauacaugcauuugauuuuggcucccaguuaagaugugguaacagagaccagguuuauccucccaguugaaacagcuaaaaaacuggaaugaauacaugagacaagagcucuuagauguuggacaucaggcaauaaaggacacugauccuugaggauuaggaaacaaaugaguuuagcccuacggucuccccagcugacugccuggagagcguuuccagaccacagcacagggaaggaaaacugaggugggaccaggagauucccuaaguugaagagacagagcuggaaauccagggaagccauggcaggcaggguucacguugcagagcacagagacacaguugagagaucacagagcaaagcccagagguaugcagagaauccuugaacaugcaguugaguucugcucagagaauacagacaaggaaacuacccuagggcuaggaaagaaccacccaaaaggagaagagggaaucauaccuggaaucacacagggccaggaauagugucuauuccugacaggugaauaaaccucagaauucacagggcauuguuuagcguacuaagaagguuuuggcucaguagcagagaaaaaaaaaaucaacucuagaauaaaugcuucucaggcccugccuaacacaucuuaaagacaaaaccugaaaaaauucaaacagagcaucaguuaaccacggcacaacuucaguggcaaauauacacaauugaagucuccagaggagaaggagggcagaaaaaaaauauuugacgaaauuauguccaaaaaaaaaauccaaauaggaugacaauuggacacccaaagauuaaagaaauuucaugaacccccagcacaagaaacaugaagacuauaccaaggcaauaaucaaauuacuuaaaaucagugauaaaaccuuaacagcaacuagagaaaaaagacgugcagaggagcagaaauggauuacuagcagauuucuugucaaaaaugagugagaaaauaauggaacaguaaacaauagcaaauacccaaaaggcugucaaccuagaauucuuuaccagugaaauguauuucaaaaaagaagaggaaauaagaacucuuucagucauacaaaagcugaaauaauuuuucagacauaaaaagcagauuuacgcuacaagaaaugcuaaaggaguggcucacaccuguagucccagcugcuugggaagcugagaaaggaggaucgcuucagcuugggagacauaggcugcagugagccaugaucgcgccacugacugcugccugggcgauagagggagauacuaaggcagaaagaaagaaagaaagagaaagagggaaagagggaaagaaagaaagaaaggaaggaaggaaggaaggaaggaaagaaggaaggaaggaaggaaggaaaagaaaaaggcaggcaggcaggcaggcaggcaagcaagccugccggccaggugugguagcucgugucuauaaucccagcaauuugggaggccgaguuggacagaucacuuaagcccaggaguucaagaccagccugagcaauauggugaaacccugucucuaauaaaaauauauauauaaaaaaauuagccaggcaugguggcaugcgccuguaguaucagcuauuacacuuggguggcugagggacaagaauugcuugaaccugggagguggagguugcagugagccgagaucacgccacugcacuccagccugggagacagagugagacacugucucaaaaaaaaggaaaaaaggaagaaagaaaugccacugcacuucagccugggagacagagugagacacugucucaaaaaaaaaaaaaaaaaaaaaaagaagaagaagaaagaaagaaauguuaaaggaaauucuucgaagagaaggaaaaugcuacuagacagaaaccugguucuacaaaaagaaauggggucaggcgcaguggcuaaucccuguaauuucagcacuuugugaggcugagcuaggaggacugcuuaagcccaggaguuugagaccagcccgaguaacaucauaagaccccaucucuacaaaaaaauagauaaauaaauuagccagguaugguggugugcaccugugaucccaguuacuugagaggcuaagguaggaggaucaccugagcacagaaggucgagacugcagugagcuaugcacaauaugccuauaugucacugcacuccagccugggcaacaaagcagacccugccucaaaaaagacagacagaaagggaaggggaaggggaaagggaaggggaagggugaaaggcaaggaaggaaggaaggaaggaaggaaggaaggaaggaaggaaguuaguugauuaaaauuuaauuaacuuaggccaggugugguggcucacgccuguaaucccagcacuuugggaggcugaggcaggcagaucacgaggucaagagauugggaccagccugaccaacagagugaaacccugucucuacuaaaaauacaaaaauuagcugggcguaguggcgcacaccuguagucccagcuacucaggaggcugaggcagaagaaucgcuugaacgugggaggcagagccacggugccuggccuugucauaaaucuuuaauaagaaaaauaaccuaauuuuaaaaugagcucaaggccaagagcaguggcucacgccuauaaccccagcacuuugggaggccaaggguggguggauccccugaggucaggaguucaaaaccagccuggccaauauggugaaaccccaucucuacuaaaaauacaaaaauuagccagauauggugacgggcaccuguagucccagccacuugggagacugaggcaggagaauugcucgaacccaggagguggaaguuguagugagccaggaucuugugccucugcacuccagccugugugacagagcgauacuccaucucaaaaaaacaaaaaacaaacaaacaaacaaaaaacaaaaaaaggcucaagauaugaacagacauuuaaagaagaugccuaaguggcaaauaaguacaugguaagaugcucaacaucauuuaucaguagagaaaugcaaguuaaaagcagaaagagauauuaccauaugcugauuagaauggguagaauucagaagacuaaccauaucaaguguuggcaaggauauagaggaacugaaauuuuuauauacugcuggugggaauauaaaauugcacaauugcuguagaaaacagauuggcacuuuccaggccuaucauguaaucuaccuauuucacuuauaggcauuuacccaagagaaauaaaagcauauauccacacaaagacuugcacaugaaguuuugaauguucauagcggcuuuaucugcaauagccgaaaacuggaaaucaccaaaauguccaucaauaggugaacugauaagcaaagugugguauauccauauaauggaauacuacucagcaauaagaugaaacagacuagugaaucaugcagaaaccuagauaaaucucaaaauaauuacacuaagugaaagaagucaaacaaaaaaggacacguacuguaugguucuauuuauauaaacuucuuucuuuucuuuuuuaaaaauuuauauaaaauucuuaaaaaugcaaaguaggcagggugcgguggcucacaccuauaaucccagcacuuugggaggcugaggcgggcagaucacuugaggucagaaauucaagaccagccuggccaacauggugaaaucccaucucuucuaaaaauacaaaaauuagcugggcaugggggugcaucccuguagucccagcuacuugggaagcugaggcaggaaaagcgcuuaaaccccggagguggagguugcagugagccgagaucgugccacugcacugcagcuugagcaauggaaugagacuuugucucaaaaaaaaaaaaaugcagacuaaucuaguggcagaaaacauaucaacuguuaccugggaacggggagggaggcaaggauuacuaaaggugugauggauacguucacucucuugauugcggugaugguuucaaggaguauacguaugccaaaacguaucaaauugaacaccuccaauaugugcaauugauuauauaucaaccauaccucuaauaaagcuguuaaaaauaaaaaaucugagacaagcauuuaaguuuuuuuuuuuuuuuugagauggcgucuugcucugucacccaggcuggagugccguagugcgaucuuggcucacugcaaccucugccucccagauucaagugauucuccugccucagccucccaaguagcugggacuacaggcacccacugccacgcucggcuaauuuuugaauuuuuaguagagaugggguuucaccaugguggccaggcuggucucgaaugccugaccucaggugauccacccaccuuggccuccuaaaguacugggauuacaggcaugagccacugcgcccagccacauuugaguucuuauaaagucaguuaaccucaagagaaauaguaaguaaagagagguacaguuggcacaaaaacaaggcaaagauugugcauguugaacuggaaugagaagaguuuaaaaauaugagcagaaagaaaagcaguaggcucuggaauuagccugcuugaguucagcucuucgaucuccugcuuaucagcuaggaccggccuggauaaaacuguaguuaagugaauagaccuugcuuccagagugccuggguugaaaucucagcucugccacuuucuagaugaguggccuugggccaguuauuuaaccucucugugccucaguuuccucaucucuaucaaaagaacaugucucucgcaucgguauaguaccuggcauauaauaggugcucaaugaacguuaacugucauuaguaguacccagugaauugaugaccggauuggggugagaucuugaguaccugaugccaaaaccugaauucucccacccuucagggugcauccuggacaaacaaaucccagccccagggagggaaguguugcuguuaagguaggauccguuccuuggucucaggugcucagcuuggagguccaaacucacaucacaugcuucuaggcauuuugcagucauggcugguaguguugaguccuggguggcacagguccuuucucccccaaggucagaggcugagcugagcaucacugcagcggugagauuccuguagcuggauggagccaggugcuugucacuaugcucagcuugguacauauauccccuuauauaauccucucaacaaccuugagaaaugaggggucucuggcuucauuugacccaugaggaaacuagacucagagaggcaaggugaucugccugaggucacacagcgaggucagcccuucccagcaugugguuccagagcuggugcucuuuccacucugcugugcuguuucuccuccucccagcccugagcacccuuucucuggguccccgggugcuauuguguguggguggggugggggugcaaugcugaggguaauggcuuucugucucuugccugcaggggucuagcucuugcugcuuuccugggccugguccuguggcugucucuggacaccucccagcggccugagcaacugguguccuucgcaggaaucugcguguucgucgcucuccucuuugccugcucaaagcaucauugcgcagugagugcuaguuguggggcccagggcuggaaguguuugccucucucuucugccccuaggcuggaucugggagcugggguauaggcagauguuccuguugggagagcccuggaggcucagggccuggagaaggccuguguguaucaggauaggcuuccugugaagaagaagucuucaaaauccccagcagggaugucuuuccagacucagaggccaccaggacauuuguuuccuuggugacauguccucuggucagucuaauccuggucuucaggucuguaggcucaggaaccaccuccacccccaaccacagaaaacacaggccagaacuccagccugucugcagagccaaggguuuccuggaaucauuagcuuaaaauagugcuucucaaagucugcuccccaguccagcaacagcggcgccuccauggaacuugccagaaauguaacuucuuaggccccacccuaggcccacugcauuagaaacucaggggcaagggcagcaaucauccugucagcaagcacaauucugauguguacuaaauucugauguguacuaaauucugauguguacuaaauucugauguacacucaggcagccacgcacccauuugggagggcccugccauaggcagauggaaucuucucucucucugccuccauagcauaagaucccucccuguuucacaguguggcuaccaccuuccccaggcuacagccaagccucccaggagcuuaugauacacaccugagcuuggacucacugcuaaggaauuauuaaaugcucaucaaggaacagcaaccugaggagcccagcucuugucugcuaggaggggcguggggugugggcauggagagagucggggucgaggcggcugggaguccagccuauuggaggagagauuggagacggucaggcagacaggguucacacgagcugggaggagcugggcccagaguagucuggugcugauccugaggccagacccccaggccacaucucuggcagugaugaccaggagacgaagugccauggcaugcccaaggcugguccgguuucaccugaguucuugguuagaaucuuggcccaccccuccucacugcccaggcccauuccuaccaagcacauggccuguucugaaucccagggagggugugaccacuggcaacaggccuaguacucugccuggcuccagccccauccucugggcagggcaaugcccccugcucucacccccacccggcucccugcccaucccucaaggaacugaacucagcuuucuguuggguggggugguagguguccuggagggccgugucuuggggacuuggacugcaguuuguacuuggacuccucgucaucagaacagaaccaggauucauugcguucgaguggcugggcgagcagauccggguagguauguggggucuggcugcccagagcaucuuagauuacugggaguaggggagaagccacuuggcagggggaaaaguggguggugaggccauagagaaggcuugggaccuggagggugggguggacuggggccccagaccaggugggcagcuggggaccaggcagugcagcugccacuucccucaugccugguacugaggucccaauagaguagucuuuccagaggcugggucugcaaucagcaguaacuuggaaauuguaauaguuaaaagugcuaaaaaaaaaaacccaaaucugcaaaugauuuacuucuguguguguguguuuaaaaauaacguuuauugaaguuauacauuuuuguucuuuuuuuuuuuuuucuuucaagaaggagucucgcuuugucacccaggcuggagugcaguggugcaaucuuggcuugcugcaaccuccaccucccugguucaagcaauucuccugccucagccugcccaguagcugggauuacaggcucccaccaccaugccuggcuaauguuuauauuuuuaguacagacaggguuucaccauguuggccaggcuggucucgaacuccugaccucagacgauucgcuugccucggccucccaaagugcugggauuacagguguaagccaccacaccugggcccauuuuguuuuguuuugagacagucuugcuuugacauccaggcugagugcagugguguggauauggcucacugcagcguugacauccugggcucaagugauccucccaccucagccuccccaguauugaguagcugggacuacagguguaagccaccaugccaagcuaauuaaaacaugguuuguuuguuuguuuguuuguuuguuuguuucuuucuuucuuucuuucuuucuuucuuucuuucucuuucuuucuuccuuccuuccuuccuuccuuccuuccuuccuuccuuccuuccuuccuucccuccuuccuuucuuccuuccuuccuuucuuuuuuuuuuuuagguacagggucucccuauguugcccaggcuggucucaaacuccugggcucaagugaucucaccuugagccacggugcccagccaauucuguuuuuuauuuugguaaaauauacauaacauaaaaucaaccauuuuaaccccuuuaaguaucauuaaauucaugcacacuuguuuugcaacuaucaugauuuacuuuugucaaaagaaaauuagaacaaauuuaguuuaaagaucuuaauuggcuuuuauuugugauuuuagaauuaggcaacaccucauucuauaaaaauagaguggguguuccgaugaguugaguggaggagguuggcuuuauagacagagaaaggcugaagaaagcagaaacagaaaauaaauagcagauugguuguuucaaggucacuuuccuuauaaaggucacagcugaggggacugccugucaugcugcauuuggggauuuggcuaucugucucauucuccugauuuuuuggaaggucagaagacagcuuaguuuugacuugugauguggaacuuuauagcaugagugauuccauugugguuuggucuguugggaguagugcaggagcucagucuaaacuaauggucuccuuuauuuaacacuuagaauuuuuuuuaaaucuauuuauuuguuuauuuauuuugaaaccagguuaugagacuagcuaauuuuucuauuuuugguagagaugggguuuuaccauguugccaaggcuggucuugaaguccugggcucaaguaaucugcccgccuuggccucccaaagugcugggauuauaggcauaagccaccaugcuggccuuuuuuuaauuuuaguuuaguuuaguuuaguuuaguuuugagacaggauuucacuuccaucacucaggcuggagugcaguggcgugaucuuagcucauugcagccucgaccuccuggaaucaagggaacuucccaccucagccucccaaguagcugggacucuaggcaugagccacuacaccuggcuaauuuuuguauuuuuaccacuuuaaaaaauauaaaucaucaaggacauagguuaaauauguuaaucuacucaccucccucucaccagcuugcaguucccugugcucugugcaggguggagcaugagaacccugccgguccaggaaugugcacaccugcuggccucacugacaguaacuguacaggguguggaggaaaagacagagaguuucuuuucuggucauguccccauuuuauagaugggaacacugaggccugaacaagagaaaugacuugcugccccugcagucacauugcaaguucaggauauaacacaggucuccuguagaagcauggcugggcucagacuccaaggccacaagcccgggauggggacaagaugaggggagacuuugccguugguugucaggggccugagcggcacaagaggcacugccuucuucacaugucucaugguuacuucuucuguuaucucuucuuuauuguccuaauaacucccagagcauuucuuuuuuuuuuuuuuuuuuuuuuugagacagagucucgcucuguugcccaggcugcagugcaguggcgcaaucuuggcucacugcaaccucugccucccggguucaagcgauucuccugccucagccucccaaguagcugggauuacaggugcccaccaccaugcucagguaauuuuuguauuuuuagcagauaugggguuucaccauguuugccaagcugguuucgaacuccugaccucaggugauccgccugccucagccucccaaagugcugagauuacaggugugagccacugcacccagccugcagagcauaucuuuaaaauugaccaaaaaggugucucuuuggcaaauaugcuuaggagugagugcccgugacagcagcuuuaacgcaccuugccagguggugcccccccccggauaagggccuggggggacuacgucccugggccaacccgccugucucuggccgcugcuuccucccuccucccuucccagccucacugccuguuuuuguuuguuuugcuuuuuucuuucagaucuuccugagcuacacgaaggcuggcuccagcuucguguuuggggaggcgcuggucaaggaugucuuugccuuucaggucagcuugacucagggucccagaggccuuuagcagccaccgcccagcgacuccagcuagaggggagucugggcauggugggggcccagguggaggggaggaguccugugggcagaggucgccguacugggaaguuagugaaccuuaagccuggggcccgggaggagcccagcaauguucaccucaugagauguuuuugcuauauuuuguaaaauuugcaaaaguaagauauuucuguauguuuuuuuuuuuagagaugaaccuccaaauuauagaauuacugaguagcugaggacaagaaguggggguaggggucauggggacagcuccugcugagaccuuagucccugaugugcugcagagacucugggcccagaaagagcaguuuccaggaaggcuuaggcucaaaugauccucucaggcgcuccuccuucagggccccucacaggccaccucugccaggaagccagcccuuacuagucccgcugcaauagcucccuccuuugugaccuccucaaccuacgaucccacuuucccucccucccagccuccauccauccuuccuuucuuucuuccaacaaaaaucuauuguacauuuacugcacugcaaaauauuauaggggaaauggagauaaaggcacuguucuguuucaaagaccuuauugucuaaugguggagccccaacccuaauuuaaaaacaggucagccugugcggaggaugaggaugcuacuggugggacugcuucacuguucuggguggagcugugguuguauucuuuuuucccuaguucauuguuuaagcaccgaaauggcuuguuuaguaagaacucuaguguagcccuccucugccugucuuacacuccaacugucuaagaccagcuugcucuaggcuuaagcucccuugccaggcagaagagagagaccugggccccacucacccaguaguuggccccaguuuucugccacugaugcguggcacugagagggaaaucagggcugcccacucugguacauccgggaccgccaucaccauggagcugcuaugcaagaccccaugugcagguuccagagguuucuucuguuuuucauuaugcuggccacuguucccagagucuccccacccugcugggggucuuggacccaggagacuuuuggcccaagccauggacuuagcuauggacuucugggcuggcguugagccagaucaugaguucagacccuccugccuaccccugacccugacccugaccucuggugagcuccccuuggagccuuagcaucucuugugccagcagacuccuagggaauguccagucuaacaucgucagcccuaggaggaaagggaggggcccagguuccuaucuucucugaagucuucuugcccccugggcaaauuugcccaucauguuuucugagaccaguucugcauagggagaauauugggagggggagccuaugucagccccgcaaaggccccuaauaccauauuccuuuaggguaacgagcagcugcucccuuaccuuugcauaaccaaugcggggguacccgaaguuucagaaaagacaaguaaggucugcuucagggugaccucuggcguccacccaggcagggaggcucccgcagcuucuuacacuuuaaaacacacacacucagcugggcgcgguggcucaugccuguaauccuagcacuuugggaggcugaggcaggcggaucacuugagguugggaguuugagaccagccugaccaacauggagaaaccccaucucuacuaaaaauacaaaauuagccaagugugguggugcaugccuguaaucccagcuacuugggaggcugaggcaggagaaucgcuugaacccaggaggcagagguugcagugagcugagaucaugccauugcacuccagccugggcaacaagagcgaaacugcaucucaacaaaacaaaacaaaacaaaacaaaaacacacacacccgacacucugcaguucaaccuccccaggcagcugcguucaagugcaguaacggaggggccugaggagugcguauaaggagagauucuucuaauaagagaccgugagggagacuccuugaggaggcagcauuugacauggaguuuaggacagaagagauuuggacagacugagcuaggcaggaagaggaaauggcaugggcaaagcauggaggugagaaugugcuggcguguccacagugcagggcagaguucaguggauaggcagguaagcuguuucccaaagggaaauuaaagccucguuagccaaaaagcaggggaagaggugcccggcgggccacgcagcugcuguccgccagagcgccuucccccgcccaccacuggcccgcgucucuccugcgucauugcugggcuugccucugugucugcccccuggccacauuagcuaugucuccucccagccugccucccucucuggaaggauguguacacaccugcugcuugcaucucucccugaaucacccuuuagaaucauggauuccuugaccauugguaccaggagggagcucagugguguugcggccucccuuuuguauuacugaugguccagccaagcuccagacaggagcaguguguuggccgcaauggcacagugaguuggcgcagagccagagcuagaaccccuccacuggacuucugguuaagggauguauucuuccucauacuaucagcagaaaucaacggccucaugucucuccuccaaauacaaaaagcacucugaauaacaaaaaugaucauuuaaaaauguauccauuaggcugggcgugguggcucacgccuguaaucccaguacuuugggaggcugaagugguucgaucgcuugaguucaggaguucgagaccagccuggccaauaugaaaccccaucucuacuaaaaauacaaaaauuagccaggcaugguggcgggcgcuuguaauuccagcuacccaggaggcugaggcaggagaaugacuugaaccugggagacggagguugcagugagcggagacugcaccacugcacuccaggccaggcaacagagugagacuccaucucaaaaaaaaaaaaaaaaaaagaagaagaagaagaaaauaaaaauguaucagugguggcaaaaaacuuugaaguugaauguucgguuaagacaaaaaugauagugagguggguuuaucauuaaccagccucagcauuucccagcgaaacaccagcaguuuccuggccccugguaggcccuguccucuggacaaauuccuggaccguguauuggcugaugcaccauccauagcaaugccaggaaagaggaaggaggacuaggauaaaugcucuguggccacagaauucucuuucucacuaaucacaacauuuuauucagccucccccucuccccuauaucacacacauauuauugggauuugcccucaagguaggggugguuuuguugaaugcugagcugaacagaagacucaggaaguucucucuauucuuucuaugaaucauacagaccuaguccaaggccuuuggccaguuucagucuggggaagucuucucugagcucacucagauuuucagaauccaagcugcuuccugcugggccaugguccagcugcucucuucuggggggaaguaaagucucucccuagggcuucuucagcccucagcuugcccuggaccuggaguccagcacaguggacguggcagucaccccuuggcuguaucagcuggauuagucauuccaccuuggcucugucucccuucuaguaacuuuccacccgcaugaucauacuccccugggucuggcugacccgggagcagacucucauucuuucacuauuguucuagccucuggaacaagcacccacugcuaagcuuagcagugcugcucagauuuucucuggaggaaccccuagggucaaggaaaaugucuucaucuccugagaguuucgggaugucugauauagacucugcaguccccaguggucaacagugccaaauuuugcgcgcgcgcacacacacacacacacacacacacacacacacacacacacagaucaaauaaggaccaaaagguaucauuggauuugguaguuaagggguaacugguaaccuuagugagcaugguuuucggugaagggaaugggaaguaaaugaagccuggggugggauggcugaaagaagggagaugggacagccgaggcaggaggcaucuuguugaaaacccaggauccaggcagaaaugggaaugaggggcaaaaugcugaggccauucugggcaaagggauggcacaaacaggaaaucaggaggcguagcuagguuacagccagaaaugcagcuacucuggacuuggagaugagucccuuccacuuucuggcggugguacugguacagugugcaccacagcugcugccccgagcaucuuccagcuuuggguuuuaguggcucacuguggccuggggcuggugacagggcacugucgacagugcucaagccuuggggucuggagacaugaggguuugcccagacagccuuagaaagucagcaggagcccuggcucagcuuccuccagggagaggagggggcaggccauguccuuagugggguuuaucuggccuucaaagccuguuucuuggcccaggugaugaaguuugcucagagcgucuaaucuagucuccagggcugugguugucagagugugguguccaggucagcugcaccagcagcaucuggaaaggccaaacaucaggccccacuguagaccuauuaaauccaaaauauuuuuagcaaauucucaaaggaugcugcugguccacgugcugagaaccacuggccuagaagagcuagaauuuccuucuuccuugaguuaugguacuagcaggaccagccuccaaagccauuucuacaaggcaguggucaggacuuacuuggcucuuccuugaaggggacugccuuaguccauccaggaggccauaaacugggugguuacaagcaacagaaauuuauuucucacacuucuagaggcuggaagucugagaucagugucccugcaagguugaauucuguugaggcccacuuugcucucugccuacuuggucgucuguguccucacaugguaaaagaggugagggagcucucuggagccucuuuuauuuuuuauuuuuauuuuuuugagacaggaucucacucuguugcccaggcuggagugcaguagugugaucacugcucacugcagccuccaucuccuuggcucaagugauccuccugccucagccuccagaauagcugggacugcaggcacaugccaccaugcccagcuaauuuuuuugaauuuugguagauacagggucucacuauauugccgaggcuggucuugaacuccugaacucaagggauccucuggccucagccucccaaaaugcugggauuacaggcgugagccacugugccucuuuuacaacggcacuaaucccauucaugagggcuccacccucauaaccuaaucacccccaaaggcuccaccuccuaauaccaucaccuagggaauuugguuucaauauaugaauuuagggggacacagacauucaguuuccagcagggaugcaugcugccccugaaggcagagaaacaagccuccaggacuguucccagggcaaaccucccaaggggcauggcaggaccuuggcaaucugcaugguggcugggaaaugcaucugccucuuugcaggugugugaccucggguggguagccaagaucucacagccuccgugugcccauuugugaaguggcgacaguuacauccaccacagaugcuaugaggauucaugaguccccacauauuagggaccuggcccaggacaagcccucgugguuggcacacaguggaauuuaauggcacuugccuccccuuuccacagcagcacugccucgagcugcugcccuguucugccaccucacauccugcaggccccagagguguuuccugggcuguaagaugauauuggccacagggaccuuauuuaauauucuauccuaccuuagaaaauuggggccaccucuuuucucuuucauuccccuccccucccuagacaggccccacuuaauccaaaacauagcuucucuucuaccauucuccgucucacagauagaaaaucuuuugauugcuggcaggagaaagucccaaugcugcagugggguccugaugccccgggcacucuccuuccuggcgugggcccaucccugcaggccugcuagcugcccugcagucccucucaggauccacuggacaagcagucuagacaguacgugacucucucugcaucucagucccaggagugugggaugaugucauccuacccgugcuggagguguuucuagccccaggcgggaggaggagucacggggcacaguucugguguucucugucgggugacuuccccaccacagggaaguuggugacagaugacagcagagcaaguccagauacaaccugcagcauuggucugggaagggacaggagaaagaaaaggccucagcagggcuugccucccagcugcccgggcagaaucuccauucucuucaggguccauucuguaaucccaguucacuuugaacuagagccuaaauuugguugcucaagacucucccuccuuaaaaaauaaaagcagcccuugccgggcccucaccagucuccggcagugagcacagugcugcuucuugcaagggcuguccauucuuguggucuccccuucuucaugucucacuuccaccuuggcucacugacaucagccucaguccccacgcuuccucugacacugcucucaccuagaucaugggugccuccaaguugcuaagucccaggggucuggcucaguccuuaccguuccagaguucucugaugccccugacacagugcuagugacuaucccuucuugaaaagcugccccucgguuuccauccugccucucuucuggccguccuccagcccuuggcuauuucuuugucuccuucacaggcuccuccuuccccucucacccuuuaaugacacacugaccacagggcccuguccuuagcuccuguucuucucacucagggcuauuucugcagugaauugcauccaccagccaccucaaccuguuguuguuguuguuguuguuguucuucuucuuauuauuauuauuauuuuagacagggucucacucugucaccccaggcuggagugcagucggaugaucucggcucacugcaaccucugccucccggguucaagcgauucucaugccucagccuuccgaguagcugggauuacaggcacccgccacuaccccuggcuuauuuuuuucuauuuuuaguagagaugggguuucaccauguuggccaggcuggucucgaacuccugaccucaaaugauccaccugccucggccucccaaagugcugggauuacuuuuuuuuuuuuuuuuucaaacauggggucuuacucuguugucugggcuguagugcaguggcaugaucaugacuuacugcagccucgaacuccuggaauccaguaauccucccacuucagccuccagagcaguuggaaccacaugugugugccaccauacauagcuguuaaaaaaaaauuuguuuauguagagaugggggccuugcuuuguuuccuaggcuggucucaaacuccugagcucaagcaauccuccugccucggccucccaaagugcugggauuacaggcaugaaccaccaugcugggccaaccuguacuucuuaugaaagagccccaagccaaagccuggcccagaugucccuaacccuuuuauccagcugcccacuugguauuccacaggcaucucaaauucaaaguucaaagccaaacugaucuucccacaaaccucuccugccuaugcuccuucccuugagaaauguccaccuauuauugaaaauucuaggaacaacugggcacaguggcucacgccuguaaucucagcacuuugggagaauggggugggcagaucacuugaggucaggagcucgagaccagccuggccaacauggugaaaccuugucucuacuaaaaauacaaaaauuagcuggguguggcagcaagcgccuguaaucccagcuacuugggaggcugaggcaggagaaucacuugaacccaggaggcggaggcuguagugagccgagaucguaccacuguacuccagccugggcaacagagugagauucugucucaaaaaaaaaaaaauaaauaaaaaagguaggaacagaugagaaauucagaaauaaagaaaaaagaaaacaacauuuccauagccccagcacauagaaacaaauccuuuggcuauuugggagugcuucuuucuauaauuuuaauauuccaauuuucccauuuaacauuguagcauaagacugcucccaugcuauuaccaguucuacaugacuauuuuaaacuguugggaacacaggacacagaauagagcaaacauuccaacacaaaaggguauaagguaaaaaagaaaacuuccuuucaucccuggcccccaaggcacucaguucccuccccaaggcaccugcuguugcuggccucuugcacauccuucuaaugauuccugugccuauacaagaucacacacaacgccccucacacacaugcuuuuggagagguaggggaccuuacgauguugcccagccuggccuugaacuccugggcucaagcaauccucuugccucagccuccugaguagcugggacuauagacaugugccaucaugcauggcuaccccccacccccuucuuaaacccacauaacagcauagcauacacucuugugguacaccuucucuuuuuucauuuaacaacauaucuuggaaaucaguccacagcugcccauagagagcuucugcauucuuguuuccugaccuuuagugcacuaggguaugucuguauccuaggugaugaaacuagucuuccacuaaaagaccucuccauuuuuugccaguuuguuacuaaacaucagacuacaguaaagaaagacuagggugcagaaaagcaaccuccuuuuccaugggccuggaaaagagggaaugggugugagagaaauucuaaagggagaaugggugagcuuggagugaaggaagaggaguguuaagccugguacuaauaauaggaaauggggugaugggaggagaugcuggcucagguccgggauaagccuaauucugagcauguuggugcugagcagaaguggagcaccaaaaugaugaggguccccucauucaggcccaaagcaugagagggagguuaaggccagagucugaggccaaggauugagcucauggagaagggugcacacugccaccuucacaacgacccucagaugugggcauuuuacuccccuuuuagagacaaagaagcaggagauaaaagugguacacucaggccccacccuaccacagcacaggccuaccugugcugaggagaggggguggucuggcggcuggucacuauuuagaggggagccgagaggacaaggcugccuccaaagaggcccugcauguggaacccugggacuucaugcacugaucucagagcaucuucccggauccugucaggcaucugaguggcaaggccugggauggagugggcugucuggggucuccugggccccgccuggcacccugcauccugccugccucuaaccugcgguccuaugaucuccuucccggcagguucugcccaucauugucuuuuucagcugugucauauccguucucuaccacgugggccucaugcagugggugauccugaagguaaguucccagugcccauggccagggcucucccagagucaccagcucacaggguucacacugucccagaaugccuugcucccagagcccaaaccuccccagacacacugcuccccaagcccacacccuuccagaguccccuguucccagugccuccaccuucccagaauccccagcugccaaguuccacaccuuucuggaauccuuugcuccugaggcccauaccuucccagaauccccaacucuuagaguucacaccuuccuagaaucccuugcuucugaaguccauaucuucccugaaccccuggcucuuagaguucacaccuuccuagaauccuuugcuccugaggcccauaccuucccugaauccccugcuuccaggaucuucacccucacagaaucuagugcugaccaaauguccuuucccagggucuccugucaugauacuaaagagaaauagcaccaaagucuaaugugguccuugcuagaggaaagguugcaguuuugaggcggcacugaaaagguguagagggaagaaaauaauuuauaccgaaaagauauugagagacuguagcaguggaccauguuggccagacuuagcugguauaaaugucagauccugugcuuauguucauaaaauaugcugcacaaaacuaggauguaggagauagcauuggacagcaacagauagcauuggacuuggcaaaagauuccaagguuuuagcugauugagcucagaauaaaucagcaacaucagauggcuuccagaaaugcaaaaacaaccugugguuauuaucuuuguucauuuucuguugcuauaacagaauaucacagacuggguaauuuauaaagaaaagagauuuauuuggcucauggccaaauagaggguaugguuucaagauugaaaccuuggcugggaaggccaagagcauggcacugacaucugguaagggccuucuugcugugucauaacaugguggaagggcagaaggcagaagugagcacacaagacacagagagaucagggccaaacuuauccuuuuuaucaggaguucacucccaugauaaccaaacuacuccugcaauaacagcauuaauccauucaugagggcagagccuucaugcccuaaucaccuccucaaggucaugccucucaacaucguuacaauggcaaucaaauauauauauauuuuuauuuggcaaucaaauuucaacaugaguuuagguggggauauucaaaccauagcaguuauguuaagagcacacacagcauagcauaaaggaggugauucuccccagaccuggagacuguguucaaccaagaggcuaugacaaacugaacuauaagcaggauagugaaagggauugaaaccaugcccuccacaaaaugguugaaggaauagggaaugaggagcuuggagaagaggaaguuaggggaggauagcugucuccaaauacuuacagaagagagauuaggcaaagggcaaccugagaggcaccagcaguggagagaauuccagggaagcagauuucaucuugauuaaaaagaagagcuuucuaguugggcgugguggcucaugccuguaaucccagcacuuugggaggccaaggcagacggaucaccugaggucaggaguucgagaccagucuggccaacauagugaaaccucaucucuacuaaaaauacaaaaauuagccgggcaugguggcgagugccuguagucccaacuacucaggaggcugaggcaggagaguugcuugaaccugggaggcagagguugcagugagccaagauugugccaccgcacuccagccugggugacagaacgaggcucugucuuggaaaggaaaggaaaggaaaggggaaggggaaggggaaggggaagggcuuucuaauagaauguuucccaaaaccuuuuccacaaaacucuaguuccacagcauguuaguaaauguuaccagguaaagguagccuaaucccauggucaaauaauuuagggaaacuaggcuagacauuaugcuaugaaaauuuaaauaggcuuaaugcaggacuucucagaggcuuuacuaagcuaauguguauugguaaucuccaaggggugugugugugugugugugugcauuucacaauucucaaauauauugggccaggaaauccuuucugcauuccuacggugaaaugaauggccuugggaagggguaagcccccaucaaugaagguguggaagaagaagaugaauggaccuuuugggaaaauguagaugaagggguccuacacugggcugggaguugggaggaaacuguguaaggucuuccacuccagcccccucugacucugggguuugcugaugucagcccacaaagaacauucugcuuccuucuagauugccuggcugaugcaagucaccaugggcaccacagccacugagacccugaguguggcuggaaacaucuuugugagccagguggguauggaagccuccuacccucaugcucaucagcagcuuccccaaagagggcaguuucccuggauccccagagcucugauucaguccaaggaagagccauuugaaccuucucccagggucaucaaauucugcugcuccagggauacucuguuugggggaugccugggucaugccagggaggaugucaucugucuggcuucucuuaccacucuagcccuaggcggucuucaucagcccaaagacucacaaauccuccagauggauccaguuucucauuuuacacaugaggaaacaggcucaggggaugggaaucccuugaccaagauuccacacauauaagccacggcuucaaauccagguuuucuucuuucuggucagaguuuuuuccacugcaucauuuugucuuuucuuuucucccucuuucuuaaaauguguuuuccaaaguaaaugugacucugaaaguacccuuggugccgagucccuuucagaaagccugaucccccugaggauggcccucuggagacucugccaaggccuguccuggcccaucugccuaauguuugagucaccaagagacacacugguuagaagaugccauauuucacuggacaguuuaggaaacuuuggagaauauuuuuaucuuuuuugcuacggugcauguguguugauuugaaaguuuuuguucugguuauuuuuuguuuaguuuugucuuguuuuuagccgaugaagauagacgugcucucagauaaacugucaaaaaaaucccuuaagguguucaaaaugaggcaaaagaggaaaacacuauuaaaaugcaaagcaguuauucuauaugaaaggcugcaaauguguuccauguguuuugcugggaaaauauguaggugaaagugacauugggcgaugugaagcgcugccaaggugaauucacuuuggacaagcuguugauuaagcugaccuagaugccggggucuacgccucauuucccccaagagggagggauggggagccuucagggaucaguggcaucauuugaaccucucuacuuguggcaggccugggcccucugcucuuguccauccacacucccucccugcaggaucacauuagccccauggcuuuaaacacuuuaaaugucucucagguccugcucugcaguccugaucucccaugaacucaggacugacaggucaacuggccccuugaccguccacuuggagaucuaaggggugucgcacauuaagacgcuaaguccaaacaaccugaacuguugcuccccucccucaucaccccugccccucucaagcccuuccccucuuggcaagugggaacaucuuccacaggaugguucaggcggagcuggaagagcugcccugccuuccuccgcuucccccacugcggcauccaaucuaucagcauucccacagcgcugccucuguggcccaucuacaaccccccgcugcccgggccaccugccucucaccuggacacugccgucuccuccuaccucuucuuccuucccguacuauccguccuucacucauacacccgagugacccuucaaacacacaaagcggaucauuccacuccugccuaagcaagcgugccccucaccguggcuuccuagccccucuguggcccaccugcccccucugccucugucucaggcggcucccccgcgcccaucugcagcagacaugcugacugcuauggcuuuuggaccuugcagagcuucuugcugccuuagggccucugcuauucgcuugccuggaaugcuaugcuaucaaaccaugucacuggcuccuucaggucucagccaacccuaaccuaaugucaccuccucagagagggcuuugccgauuucucaguuucuuuguuuuuguuuucugagauggagucucgcucugucaccuaggcuggagcgcaguggcacaaucuugggcucacugcaaccuccgccucccggguucaagcgauucucgugccuaagccucccuaguagcugggauuacugacaugugucagcaugcccggcuaauuuuuguauuuuuaguugagacaggguuucaccauguuggccaggcuggucuggaacuccugaccucagccaauccuaccaccucagccucccaaagugcugggauugcaggcgugagccacugugccuggccuacucaguuuuaaacaccccuaaccaguaggcauuaucacacauaucuucauagcuuucaucaccaucuaaaaugacauugcuuaccugcuugguugcuuguugauuaucuauauccucccacccuccacggcucccaggauauaagcccuaugaaggcagggacuuuauccugucgacgccauguuccuauucuauauaacagugccuggaacacaguaggcgcucaacaacuagauacugaaugaguaaugaagggcuucgggcugcccagaugcccagaaaugcaccccucauccaaugcccaagcuccuuucuuuuuggccaccgcuguggcugcaggagagcuugggccugcagcaggaccugcuucacauccuuuuacaugagcaggggucauuccuggaaccccaccgaaccucuguugcucuccuggaaaacggagauacccaauucuaucucagaagguugugaguaacaaaggugacgugcuuagcggggugccuggcacguggcaggacaucaacacaggggagcauugucaggccgggagggagggauggggguccuucuguagagguaggcaaugcugagguucagagaagcucagccaaguacagacccugguccuuaccccauccugcugccucuuaccgugggacucccagcugcucacugugaccugugaagggagaggaugugcccaaucacccccacccugcuugucugacaucuuuccuguuugcagaccgaggcuccauuacugauccggcccuacuuggcagacaugacacucucugaaguccacguugucaugaccggagguuacgccaccauugcuggcagccugcugggugccuacaucuccuuugggguagguagagcccuccuucugcuuggcuauguugaggaccugaagcccaucuuugugggagccccacacagcuccuggccagagcagcccucagaucuucucucuugggccugcugugcuggcaagaggaguggcuuccccugagcccagugggcuggaccauuugcucgggcuuugcgcauggccaccuggggcaaagcuuccugguguuccauuuacugagugcaugcuagguaccaggcaguaugcuagguguuuuaauauccccauuuuccagaugagaaaauugaggcuccagaguaagugagaugcccaaacccagaucugucugacuccaaaauuugugcucauuucuccagucucacaccugggcugucccuagagauccguccuacuccuucccuccucccuuuccccacacucucucugggcucaaguccugccucugcuccuaaauuauugccugugcaguuuacacagcacaaagaauuuguaggucaaauuccaguggugugaauuaggcccuaaaagcaaucacaaugcuacugcauggugggcagagggaaauucucaaaugcaucccucacauaaugcccgguaauaaugcuuuacauucauaaaacaccuuaugcuuucacauuugugcuuucacaggcaaaucuucaaaggucucaauuuuauuuccuuaaugaucaaagaaauucuugcuuauugcagaaacaaauaaguuuuuaaaucucuuucuuaaccccacuucccauggguaacugauuuuauuuuuuauuaauuuuuuuuguuuguuuguuuuugagacggagucuugcucuguugccaggcuggagugcaguggcgcaaucuuggcugacugcaaccucuagcucccugguucaagcguuucuccugccucagcguccugaguagcuaggauuacaggcacgccccaccgcgcccagcuaguuuuuuuuuuuuuuuuuuuuuuuuuguauuuuuaguagagacaggguuucaccauguuggccaggauggucucgaucuccugaccuugugaucugcccaccucagccucccaaagugcugguauuacaggcaugagccacggugccuggccugguaauugcuuuuaauagcguagaacagcuauucugaaagugggguccauggaccagcauugucagcaucaccugcgaacuuguuagaaaugcaaauucuugggcccacccuagaccugcugaaucagaaacgaugggggaugccaaggcggguggaucaucugaggucaggaauuugagagcagcccggccaacauggugaaaucucaucucuacuaaaaauacaaaaaaauagcuggccgugguggugggugcuuguaauccuagcuauuugggaggcugaagcaggagaaucacuugaaacugggaggcggagguugcagugaacugagaucgcaccacugcacaguagccugggcaacagagugagacuguguuucaaaaaaagaaaagaaaugauggggguggaaccagcauacugcguugcaacaggccucacaggugauucugaugcccgcccaauuugagaccacugaccuaaaaugucauuccaaaucuuucuguguaaguaggcuuuuagguauauacaccugaguacucacauacuuucucucucuuuuuuuuuuaauaaaaguugagaaucauugaucaggagaaaauaguucacaaauuauaaaaagauauucaagcucacugauguucaaaggaauuaagacgauaauaacuuaucuuucuucuaagugauaugaaacccuuuacgugcccccaaauggcaagugugugguacucacccacucaugguaacaguuuaauuuacuguaaccuuuuuuggugaaggccuaucagucuauuuauuuuuuauuuauuuuauucuauauauaauauuuuguuuuuuuauuuuauucuauauauaauauuuuauuauuuuaucauauaucacuuuuaauuuuuuuauuuauauaauaaaauauuguauuuuauuauauagagcaauuaaaaauauuuauuuuuuguuuuuuaacuccccacaugacaccaacauguauuuauauagagagagacagaguuucccucuguuacucaagcuggagcacaguggugcaauuacagcucaccauagccucaaacuccuggacucaagcaauucucccaccucagccuccugaguagcugggacuacauacgugcgccaccaccccuggcuauuuuuuuuuuuuuuuuuugguagagacgggaucuugcuauguugcucaggcuggucuugaacuccugggcucaagcaauccuccugccuuggccucccaaaauauuaggauuacaggcaugagccauugcauccagcuucaaucacuuuaaaaauauucuuucccuuugauccagcuagaaaaauugugauauagggauauucucacaaguguucaagaaaugcaaaauuccaacauuugcaaaagcaagaaaacuggacagccuaaaugcccagcaguacagucauaagcuggguaaguugccccacacaaggugguagcauucagcaugagagugagguggccuguaugugcugauuuggagauugacccugcccugccuucuggcucucugccccugccccaggcucucuggaugcugugugggggguggggggaggggggggguggugguaggcggugaccagaaaaugaccuacauuguccccuucuuuaaucccaaauuccaccugucucucucaucucugucccuggggaugaugagagaugggugaacaaacagccagccugccccuccaucucuccuucacuccggaugccuggaccacaccaauaagcucagcucuacaugccacagagcugucugggcagggccagcuguugcgugacuuuucaagaaguccccuugggcucaggggcuuugguuucuggccugguacccucccaucuagaauucuagagacugucaucugguuugcaccugucuugcugaggccuagaaaagggcucauuaaaacuggugcacccacccaccccaccaccaauuguuuuuggaaguguggaggccaagggaaaauuuccccuacguccucugaagguucacugaaaaaucagcucacaaaagggagauuaacaggagaaaggcacacaaauuuauuuaaugcauacacacgggggccuucagaaggaagacccaaagauacagggaaaauuguccauuuuuacgcucagguucaacaaaguauggauagccacauagaaauagaauuggacaaacagagugugaucuaauacuaaucgacugaguggaggaaaaacagcaaagccugucuguguagacucuucuugggcucucugagcauuuuuuccuucuggguauggggcaagauccucucuggaagggggggucuuaugaccuacacucaaacaaaguaggucagauaauuucuuuauugccacuuuuuacccagaaaggcagagggaaguuaaagcaauguuuuuaggcuuuauggcuggcuuuggggaaaagggcuucuggucuccgugcccugccuuggagaaggggaauucuaguuuuuauggcuagccuugaaggagaauuggacugauaaaugggagggcaggacagaaaaacuucuucugaggcuacuucugagcccuuuauucuagguuuuguuuuaagagucccagcagaaggaauuugauauuucaaaaauggaaacccaaaacuuuguuccugaaacuuuuuuucauggcaggauauugggggagggggaugccauaauauuuucagaacuuagggcuuuaaaugucuuaaccuuguucugguccccuuagacaacgaaaagaauaacgcugguguuccuccuagucauuacuuagaacuuaaacacuggaagaaugcucgcccauuuccacaaucuggcuuaaaacucagcccucuuuucuucccuuucucaggcaaaaguccaggcccagcccugggcagucuggcuuccccauugacagggccuggguacccacuucccuuuagcugcacagaaugggcagaggcagccaggaucaucccuaggugcccuugagccuccauuuuacagucucugguuugaaagccccagacuacaacuauagcuggcccagaggaaaagcaccuaacaaacaaaccuuccuucccuucaaucucugggucugccccagucuuuucuccagagcagcucucuuuugcccccaccuggcucaugacagucacugcaccagcccuguacugcacgcccucuaacuuccuuccccagucaguuccucaguaucuuuggcucugcccucagccucugaaucccagaaaggucucucuugcccuuuccuucaagcucccagguucguucguucuuucuuucuuucuuucuuucuuucuuucuuucuuucuuucuuucuuucuuucuuucuuucuuucuuucuuucuuuucuuucuuucuuuucuuucuuucuuucuuuuuuuuugagacagagucucccucugucgcccaggcuggagugcaguggcucaaucucggcucacuacaaccuccaccucccagguucaagcaauucuccugccucagccucccaaguagcugggauuacaggcaugcgccaccaacccagcuaauuuguguauuuuuaguagagacaggguuucaccauguuggccaggcuggccuugaacuccucaccucaggugauccacccgccucggccucccaaacugcugggauuacaggcaugagccacugcgcccagccuccaagcucccagauucuuaaaaccacuuuguugcucaaucucuggcucccuucuccgcacaucccuccuauugcuaauaucuggauauuucuagaucuccacgguccaguacaguagccaccaaacacacauagcuauugagcacuugaaaugaggcuagucguauugaaaaacuuuuaagauguuuuauuaauuuuaaauuuuuauuuugucauccauauugauaguuuuauauugauuacauggguggaaagaaaauauuuuggauauauugaguuaaauaagacauuauuaaaauuaauuuaaccuauuucuuuuuccuuuuuaaaauguggcuauggccgggcgcgguggcucacaccuguaauuccagcacuuugggaggccgaggcggguggaucaccugaggucaggaguucaagaccagccugggcaacauggagaaacccugucucuacaaaaauacaaaaauuagccagguaugaugucaggugccuguaaccccagcuacucaggagucugaggugggagaauugcuugaacccgggaggcagagguugcagugagccgagaucgccccauugcacuccagccugagcaacacagcaagacucuguuucaaaaaaaaaaaaaaaaauguggcuucuaggcugggugcaguggcucaugccugucauuucaguacuuugggaggccaaggcaggaggauggcugagaccaggagcuugagaccagcaugggcaacauagggagaccccuaucuccacaaaaaauuuaaaaaauaaaaaauuacuugggcaugguggcacacaucuauagucccagguacuggggaggcugaagugggaggaucacuugagcccaggaggucaaggcuauagugagccaugaucaugccauuacacuccagccugggugacagagcgagacccuuugggucagagagagaaggguuaugggcaggcgugggcccugggaugcuaggauggaaggcucuccugaccaggugccugggaggcagggcuggggaaugucacagcccugcagaguagcuggcaguggggaggugggugugggcuggcccagugcccagggagcccugccugugcaggacucagcccuuuccaugaugagcuggaaacuagcaacugcagcauuugaggcugugaccacaacugggucacccaggggacagugugcaggaaugugacaacugcaggguguguucucugccgugacucagguuuacaaaccagauguaaucuacaagucagaggaagggucaggguccugccugguggagggaaaaucccaagauuccagguguggcaccaucccagcuggggcugagcaacugaggaggaagcaggggaagucccaaagcccagcccagaaaguccagagaggacaccugccccaaguggguuucauccagcaaggggcaggggcccaggcuugcacacccaguguccacacagggcccuggggagguaucaggcugcugccaauucuuguucacauuuuaagaaguuuugucgaucuuuaaaaagaaacaacugggguuuagaaaaagaagaaggacacaauaccugggauucagagccugagagggucuccagccuggcuucucagcagcaggccuggcacuucccugagaugguaaugaggggugcccacgaucugcccucugcuuuuuuuuuuuuuuuuuuuuugagauggagucucacucugucgcccgggcuggagugcucagcucacugcaaccucugccuccuggguucuacccauucucgugccucagccucccaaauagcuaggauuacaggcacccaccaccacaccaggcuaauuuuuguuuuuuuuugagauggagucucgcacuauugccugggcuggagugcaauagugcgaucucggcucauugcaaccuccgccuccuggguuuaagugauucuccugccucagccucccgaguagcugggauuacaggcacacaccaccacacccggauaauuuuucucuauuuuuauuagagauggggguuucacuaaguuggccagacuggucucgaacuccugaccuugugauccucccaccucggccucccaaagugcuaggauaacaggugugagccccacgcccggccuaauuuuuguauucuuaguagagaugggguuucaccauguuggcuaggcuggucucaaacuccugaccucaagugaucugcccgccuuggccucccaaaaugcugggauuacaggcgugagccacugugccuggccugcccucugcuuuuaucagccugagugucugucuucaacuuaccucccuccuccuuuuuauuuuuauuuaacacuuuagaaugcaguuggcuuauuacaaacuuuaagaagaaacaucuauuuugcuuuuuguuuauuaaaaaaaauauuguuguggacauuuugagagauaccaaaacaccuguaaucccagcacuuugggaggccaaggcaggcagaucacaaggucaggagauugagaccauccuggcuaacacagugaaaccccgucuuuacugaaaauacaaaaaaaaaaaauuagcugggcgugguggugggcgccuguagucccagcuacuugggaggcugaggcaggagaauggugugaaccugggagguagaguuugcagugagccaagauggcgccacuacacuccagacugggcgacagagugagacuccaucucaaaaaaaaaaaaaaaaaaaaaaaaaaugaaagaaaagaaagauaccaaaaugcagaaagaaaagaaaaucggccggggaugguggcucaugccuguaaucccagcacuuugggaggcccaggugggcagaucacgaggucaggaguucgagacuagccuggccaacacggugaaacgccaucucuacuaaaaauacaaaaauuagccgggcgugguggugcacaccuguaaccccagcuacucuggaggcugagggaggagaauugcuuaaacccaggaggcggagguuacagugagccaagauuguaccgcugcacuccagccugggcaacagagcaagacucugucuuggaaaaaaaaauaaagcaagaaagaaaaucaccccuggccccagcagccagggacagucaauucauugccauuuugguguauuucuuucuaaucuuuucaugcgccauuuuggaguuuguuuccccacugccccuaguuuugguucuucucuaccugcaauguugugggcccuuucccacuucacugugaggccuugaugaccaucauuuucaaugacagccugacgacgcuuagccggucucccauuguuagaugucugaguugguucugauuucccugcuugguaaaugacacagugauagggggaaacgugucauauuucucuguggaaaagaacagagaagcaaaggguuuggggucccagugaagauaaaacuucaggaagggagaaucccaggggcugacauugcucugccaucuugcugggagugguuuucacagcguggcucccagaaggagacugagggucaaacgguggcugucauagaggcagauuuccugagaaggaguucucaaacugcaggacuggaugugauggguuggcuugcaguggugaguuccccgucacaguaagcauucaaagagagagccuagagagggaguaccuuccuacgcuaguacauaccuacacuaagguggaauugguuuagcucuuaaauccauuucauuucaacucuuagguucuagagcuuugucugaaagcauuacaaauuccuccacuaagggggaaaccucagcuaacggggauuaguggucaacagugacagccuaaaaaggaagaaagaaccuugaacuuggagccaaaagaugugauaggcucuaauuccuucucuuccuuuauuuugggaagccauauuuaauccuuuggagucucaguuuucuugucuguaaaaugaagauaacaauauuugucauuccuaacuuagggagcaccaggaagaaauagaagguccuauacauauagccugugaccuucuacacauaaaagguauuauuauuauuagugaugacagcaguuaugacaaugaggacauaucagugggacagacuacacaugugcccuugcugcccugggccgcacuccuuggucgccagcauuucuucugacuguccaccuagaaccugcacucucacucuugcagaucgaugccaccucguugauugcagccucugugauggcugccccuugugccuuggcccucuccaagcuggucuacccggagguggaggaguccaaguuuaggagggaggaaggagugaaacugaccuaugggugagcacagcaggagguccugcagacaggguagugguacaagguggggggagcaaagcagagggucccguucucucuguccaucacugucuuccacuagccugggcccaucucuccacuuuuccugcucugguuugggcuucauuugcugucuuaguccauuuucuguugcuuauaacagaaauccugaaacuggguacuuuauaaagaauaagaauuuauuucuuacaguuauggaggcugagaaguccaaggucgagggguuguaucuggcgagagccuucuugcugcuggggauucugcagagucccaaguuggcacagggcaucacauggcgagggguugaggggugccaggcagggaacugagcaugcuagcucagaucucucuucuucuucuuaagaagccaccagucaaguccaggugcgaugguucaugccuguaaucccagcacuuugggaggcugaggcaggcaaaucacuuaaggucaggaguucaagaccagccuggccaacauggugaaaccccaucucuauuuaaaauacaaaaguuagccaggcauaaaggcucacgccuguaauuccagcaacuuagggggcugaggcacgagaauugcuugaauccgggagguggagguugcaguaagccuagaucgcaccacuguacuccagccugggcaacagagcgaaacuccgucucaaaaacaaaacaaaaagccaccaguccuacucccaugauaacccauuaucccauuaauccaacauucaggaauggauucauccauucaggagggcagagcccucaugacccaaucaccucuuaaaggccccaccugucaauacugccacauugaggauuaaguuucaaaaugaguuuccgaaggacaaacauucagaccauagcauuugcaaaaaugcgcacuccaguucucacaucuuaauguccagucucugaccagcaggaaacaauggaccaggcaaggcuugggaguguggccugguucuuggucuguggccugguguguguacauguugaggagggucauagaaaggccccaugcccccaucucuaugugccugagcucugacugccagggugucaaccacacauugacaugcugagugccaucuuugauuucacucaccuccuaacaucccgucauagucuuaauaacuguuagguaacuuuuaaaccuuaaacaauguugaaaaggcaccacauuggacacaugugcuugggcacagcggaugaccccaaccucacaacuuucugaggcacuggagcagcgcugucccauggaaauguaaugugaggcgccugucauuuucuaguaguugucuuuuaaaaagugaaaagaaaugggugauuuuaauaaccgauuuuacuuaacccuguauaccccaaaguauugucauuucaacauguaaccaguauaauaauuauugagguauuuugcauuuuuugguacuaaauccucagaaucugcucuguauuuuguacaacacaacucaauucagacagccuccugucauguguggcugauggcuuccaucuuggacaguucagcguuagaaaccuggaucuuaucccggugcuuugaccagccccuuuuucucucugggucucagggaaaauuaggauuucccgcucugaaaugcucuuccaggguuccuauuugagccuauaggauagggacccuugcugguuguggagacaggccaguaaugaucauucuugaucccaacaacagagaugcucagaaccucauagaagcagccagcacuggggccgccaucuccgugaagguggucgccaacaucgcugccaaccugauugcguuccuggcugugcuggacuuuaucaaugcugcccucuccuggcugggagacaugguggacauccaagggcucagcuuccaggugcguuucuggccaccacacucagucuguagagaggauggccccagguggguggugagugguggcuggagaccuagcagagcccaggcccagcccucggugccagccauaccguugugcccucagcucaucugcuccuacauccugcggccuguagccuucuugauggguguggcgugggaggacugcccagugguagcugagcugcuggggaucaagcuguuucugaacgaguuuguggccuaucaagaccucuccaaguacaagcaacgccgccuggcaggggccgaggagugggucggcgacaggaagcaguggaucuccgugagugucccagucccuucccugcagcagggggaugacacggcacagccacuccucagggccccuggcagcugcucucccgcucccugggccuggcugagacacacugaaguggugcuucaccuccuacauccuguaguccugggagacaggacagcuucaggcuucgcugccaucuuucucaaggccuuuuaggaggcugaggugcggggagagagcauuguuugggaugucugaaagcuggcucuagaugggucguuuuucacuguggccuuaggccagccacaguaccuugccucuucuguuggaaaacggggugagaugacugccacaucuacuccaaaggcauacacaugugcacccaaugagcugggagagugagauaaggaggcuucacuaacacccucacuguuuuguuuugguuugguuuuuguuuuuuuuuuuuuuuuuuuuugagacggagucucacucugucgcccaggcuggagugcaguggcucgaucucggcucacugcaagcuccgccucccggguucacgccauucuccugccucagccucuccaaguagcugggacuacaggcgcccaccaccgcgcccggcuaauuuuuuguauuuuuaguagagacgggguuucaucguggucuugaucuccugaccucgugaucugcccaccucggccucccaaagugcugggauuacaagcgugagccacugcgcccggcuguuuugguuugguuugguuugguuugguuuucugagauggagucucccucugucacccaggcuggagugcaguggcacauucuuagcucacugcaacuuccaccucccggguucgagugauucucgugucucagccucccaaguagcugggacuacagaugccugccaccacgcucagcuaauuuuuggauuuuuaguagagacgggguucaccauguuggccagucuggucuugaaauccugaccucaaauaauccacccgccuuggccucccaaagugcugggauuacaggugugagccaccauacccggccaucaccuucacuguuaguauaguggauucagugcagggguuggcucuuucuguuaaaauuuauuuuuaaaaacuauaaaaguucuauaaaauuaaccuuucuaaaagaauaguaacauuauugagaaugaaaaaauuaccuacaaucucaccaucccagauaauaguuauuguuguuucuuacauuuucuuccauucuuuuaagagagaguuuaggucaggugcaauggcucaugccuguauucccagcacuuugggaggucaaggugggaggaucacuugaggccaggaguucaagacuagccugggcaacauaaugagccccugucuuuacuaaaaauuuuaaaaauugcggggugcaguggugcaugccuguagucccagcuacuugggaggcugaggcaggaagauggcuugagcccaggaguuugaggcuguagugagcuaggauugcaucacugcacuccagccugggcaacagagcaagacccugucuuuaaaaaaaaaaaaagggaaagcaagagagaguuuacauaguuucugucguagcagccaaaccgugcuguagccauuuuuguuuuuuuguuuuuuuuuuuacuuaguauuacaacauaagcaucauuuuguauauguguccuaacauauuuacccaauccccugcuguugggccauucagacaauucuauuauuugauuuuuauccacauguugaaaugaguaucuuugugcauauagcucuuccuuccucucagaucauuucugcagcguucccaggugugggcugacugacucccacaugagucuucacguggcugcagcagcugaaaucagcagcaccagcugugccugcgagcauuuauuucgccacacaacuaaacagcaucggguagcuucuuuuuaaaaacaagguucacuacuucaauaagcaaauaauagcucauuguuuucauuugcauuacuugggugacuggaaacuuucaaugggaagcccuuucucuugucuuuuuaauuauguuuuaaauuguaaaggaagggacucuagguuuuuuaaaaaagaaaguuuguggccaggcacgguggcucacaccuguaaucccagcacuuugggaggcugagguggguggaucacuugaggucaggaguuugagaccagccugaccaacauagcgaaaccccuucucuacuaaaaauacaaaaaucagugguuguguuggaaugugucuguagucccaguccuugugcugaggcacgagaauuucuugaaccugggaggaggagguuacagugagacaagauugugccacugcacuccagcuugggcaacagagugagacucugucucaaaaaacaaaacaaaacaaaaaaccaggcaugguggcucacaccuguaaucccagcacuuuuggaggcagagacuggaggaucaccugaggucaggaguuugagaccaaccugaccaacauggagaaaccccgucucuacuaaaacuacaaaaauuagccaggugugguggcaggcgcauguaaucccagcuacucaggaggcuggggcaagagacucucuugaacccaggagggggagguugcagugagccaagauuacaccauuguacuccagccugggcaacaagagugaaacuccaucucaaaaaaaaaaaaaaaagguuucuauagaguaaaaagcacaaguuuccccucacugcuuacugucaccucuggucucacccccuccucagagauuaauagagggcacgccccuuccuguucuuuuuuuuucuuauuuauuuugaauuucugugaguacauaguagguguauagauuuaugggguacaugagguguuuagaugcaggcacacaguguaaaaauauagaaugcuucaugaauuugcacaucauccuugcacaggggccgugcuaaucuucuccguaucguucugauuuuaguauguaugcugccgaagcaagcacuucaugaucuuuuuuuaaugaacuucauuccuucagcaaguauuuguugagaccauuuaggugccaggcauucugcuaggcacuggggauaaaaaggagaauuacacagacauggcucuggucucauggaaccgacauguagugagagacacaggcaaaacacaagaaagcaaaggaacaaaaauuaaaauaaccacaauucgugguaaguucuaugaagaaaacaacaagaaaaaaaaaaacagggcagggucuuccuuggcuggacuggucagaaaaaauaucccugagguguggcauuuaagccaagacuuggagaacggaugagcuaggacaagcugggaaaaacauuccaaaggaagaggcaugugcaaaggcccugagguugaaaagcacuuggugugcuuagagagcagaggcaauggauacagcuagagcaggugguaaucacaggccaaggaacaguuggaaaucacugaagauuugacauuuugaauuuuaagaagaugacuggaggcugggugugguggcucauaccuguaaccccagcacuuugggaggcuaaggcaggaggcucacuuaagaccaggaguucaagaccagcccuggaaacaaagcaagacccuggcuuuacaaaaaauuuaaaaauuagccagguguaguggugcacgccuguggucucagcuacuugggacacugaggcaggaggaucgcuuggacccaggagacuggggcugcagugagcuaugauuuugccacugcacucuagccuaggugacagagugagacccugucugaaaacaaaagacagagagaaggaagcaagaaaggaaagaaggaagggacagagggagggagggaaaaagacagcgagaccgaaggaagggagggagccuggggcugcucuguggaacacaacuguaggugggcaagcagagaugcagguaccuucauauuuuuuccaauaauauuuguaucaaugcuuuauguuauaaaggcauuaacuuuuuucugauauauuuucuacauauacuuuuccuagccuuuucuguuauugcccuuuauguuguauaaggaaauuuauuuuuugguuuuuaaauguagaacgcuucaugaauuugugcgucauccucagguaggggccaugcuaaucuucuuuguaucauugaaguuuuaauauaugugcacaagaagcaagcacaggaauguguuuuuuuuuuaauuaaaaaaauuguauuuacuuagaagcauucagaaugucaacaaaacagcuguaacuuuugagugguauauauguauguauuuauuuauuuauuuuuggagacugggucucacuuugucacccaggcuggagugcaguggugcaaucacagcucacuguagccucugccuccuaggcucaagugauccuccugccucagccccuguguagcugggauuacagacgugugccaccacaccuggcuaacuaaccuucgcauuuuuuguagagacggggucucgccguauugcccaaguuggucucaaacuccugaccucaagcaauccuucugcccuggccuccuaaauugcugggauuacaggcaugagccaccacgcccggcuccagugguguuuaguuaacaaaacagcaacuauuuuguguaagcugcaucagagacaacuaaagaugaaggcacuaccauccacauacauaacuaaugugugcugugugccaacaagagccugcuuuaaauuuccaugccaauuuauaacccccauacugcaccaggcaagguugguggcuauugaaaauaccaccaggacagaguuaucuaaagacacauuggguaguauguaacuaugcaaaaaaaaggacacuguacaguuuaaaaacaaaucuuacauggccuuacauuuuaauuuauuucuuuaaaaggaaugaauuuaguguggggggguuaaauacauuauauacaaaaaaaaagcuacuagaacuagcuuauucaucaucuucaucuuccccaucuuuccuucccccucauccucuuccucuuucucauguuucuccuauucuuucuuuuucuuucuuuuucagccuugacagcucccuuauuuuugcuacaucaggcuuuccuuuagcucgguaugcagcaauaucccuuuuguauuuuucuuccagcuuugcaggugucuuuuucuaaggcugcuuauucuccacagcgguuuuauaaccacaucucuccuacuuucuuugcaacaucaacaacggauaggcugggauguucuccuuugauuuuugggugaugcuuggaauagaacaagaagaggccaaaggaggccucuugggcgcauugggaugcuggaacuucuuuuuuguuuucccuuuaggaaggauguaaguuuucauuucucuuuccuagccagccuuguccgccuuugccacaucuucaaauuuucuuuucuguuuaguugacauggucaucugccucucuggcacuucuuugaaagcucugaggaguugccugaagcaucugggugcuucuucucgugucccucccaacaagcuuggacagggagugcauauaaucacauuuugccucuuggcuucuuagggucucuucugcccauguuuaguuauuuuuccucagugaggcacagagucacccagugccugucagcucucacuugacccagcauuugggauuuguuuuuuuuuuuugagacggagucucgcucuguugccuaggcuggagugcaguggugugaucucggcucacugcaagcucugccuccuggguucacgccauucuccugccucagccucccaaguagcugggacuacaggcacccgccacugugcccggcuaauuuuuuguauuuuuaguagaaaugggguuucaccauguuagccaggauggucucggucuccugaacuugugaucugcccaccuuggcuucccaaagugcugggauuacaggcgugacccacugcacccggccgggauuuguuuuuuuuuuaacauagauuuuauaccaaauauuuucuuuugugauuucuucuguuauuucuaaacuuauaacguuaucuggaaagugcggcugggcacgguggcucaugccuguaauuccaacacuuugggaggccaaggagggugggucacuugaugcccggaguuugagaccagccuggccaacauggcaaacaggaaauagaaaacuuagccaggugugguaacacacaccuguaaucccagcuacuugggaggcugaagcaugagaaucgcuugaacccaggaggcagaaguuuucaaaaaaaggaaagaaagaaaaagaaaguuaucuggaaaguguuaaauucgugaaauaacgugaugagauaauucagaccaugagcuuuggagucagaacugaguucaaauucugauacagcuaccuucuugcugugugaacuuccuuaguuacuuaaccucucugagccucgguuuacuccucuccaaaauaagaguaauaauaguaccuuguaacuauauuuauuauccuauauuuucuaucauucuauacuuaaaauauuaauauuuaucuagaauuaauuuuuauauagugugaggggaggcucuauaccaauuuuuuaaauaauuuuuaauuuuuguggguauauaguagguguaaauauuuaugagguacaugagaugcuuugauacuggcaugcaaugugaaauaagcacaucauggagaaugggguauccauccccucgagcauuuauccuuuguguuacaaacaauccaauuauacucuuaguuauuuuuaaauguacaauuaagucauuacugacuauagucacccuguugugcuauaaaauauuagcucuuauucauuuauucuaacuauuuuuuuguacccauaaaccaauuuuguuuucaaauuauuucauuuuggcucuuaaaacuucuuucugggaaauaggacaguuguuaagaacaaaagcaaauaacuauuguguuugaacacuuacugucugccugguguuucccauacauuauauaauccuuuuuacagcccucccaggcaacuacuauuauuccccuauuccagacaggaaaacugacacugaaagaagugacugacuucucaagcugaucauuggugagacaauccuagaagccaggcuggcugggcuccaaaucccuuacucuuuccugugggccauacucccucucucagccugagagcauucacaggagugcugugaacuggaagcccaggacugcggggucagggaaggggcuguccaccaaauggccccaggacagagcuuaguagggccaaagcgacaggacuaacaaaggcugaaccccauccagaaaggcugguaaugaagauuaaaagguugaaggacaggcugggugugguggcucacaccuguaaucccagcacuuugggaggcugaggugggcagaucaucuaaggucaggaguuugagaccagccugcccaacauggcgaaaccccaucuccgcuaaaaauacaaaaaguuagccgggcgugguggcgggcaccuauaaucccagcuacucgggaggcugaggcaggagaauggcuugaacccaggaggcacagguugcagugggcugagauugugccacugcacuccagccugggugacaagaguaaaacuccgucucaaacaaaaacaaaaacaaaaaaagaaacaaaaaaaguugaaggacagauaagagaggggggcuauguuuuugauguggugcaguuugagccaacuuagaggugggauugcaaggcuggggaagcggcagcacagaggacucaaaggucaauuacauguaagaaguggguaaaauuaaggccagggagccuggguguuauaggggugccccaggcccaucugaggggagccccuccucaugcaucuucuguauuuucaggucagagcugaaguccucacgacguuugcccucuguggauuugccaauuucagcuccauugggaucaugcugggaggcuugagugagucuaaucagggccucaccagugucuaggagagucugggacuugaacuugcucgggacauguaggccucaguugucucauuugucuaaagcaggacccaaacaagauggccauagaggccaggugugguggcucaugccuguaaucccagcacuuugggaggcccagguggguggaucauuugaggccaggaguuugaggccaaccuggccaacauggcaaaacucuaucucuacuaaaaauacaaaaauuagccaggcgugguggugcacgccugugaucccagcuacucaggaagcugaacccaggcacgaggaugagcugagaucgcaccacugcacuccagccugggcuacagagcgagacucugucucaaaaaaaaaaaaagaaaaaagaaaaagauguucauagaguuuccuccuagcccuagaauuccgauucucugcugcugcugguggcccaggaaguuagcaccugggccuugaaggccaagccuggcucaggggugggagguguggugcuugccuguccccaaggcuuuggccugccuguucccacacccacaguggacaggcaggcaggccugguggggccuaaggucgaagggucugcacaguucucaguucuuuacaaauaacauuuccaguccuggcagcuacacugccuggugguauaaucaccccauuuuacaaagaaggaaacugagucuucaugaagugaagugguggcccaagucacucagcuagugaguggcugagcuuguauuuaaucccaggucugccugacuccaaacucacauucuuuuccugcaucugccacucaugguguguagggagauguggggcauugccuagggguccaagccaggccaaagagaacuccugagcucagcaagcugucaggaggacaacaucugucccucuggccaucuauuaauagaagaggaagggaggucagcagaugcagcccgagcugcggaacgcgggcagagagggacacagcuucccaggcccugagcacuucuguccccuugcagccuccauggucccccaacggaagagcgacuucucccagauagugcuccgggcgcucuucacgggagccugugugucccuggugaacgccuguauggcaggugagugcaggccuggcaggcucagaagguggaacccugacuuucuggcuagcccgggggcccugccccacccaccacuuucccucuacagggauccucuacaugcccaggggggcugaaguugacugcaugucccucuugaacacgacccucagcagcaguagcuuugagauuuaccagugcugccgugaggccuuccagaggugagggccugggcugugggaccugcagggcacccacagugauagacagaaugccugagcgcugggggggaugccuuugguaccagggugaggguagaaauguuacggcugcagcuaauggggaggugaaggcucgaggaccaauggaggaaggguggaccagagacuugaaacaguguucccgguguugcacagccuggugguggcccgcagaaccaggccuggagcucccacugcgaucuuugcuuucuuuuuagcgucaauccagaguucagcccagaggcccuggacaacugcugucgguuuuacaaccacacgaucugugcacagugaggacagaacaugcuugugcuucugcgcuucugagggcuguucucccccgggaaccaucuguccccaccuucccuuucccagagcccucuucagggaagccacaggacuuagacccagcucaaucccacaauugggaaggguucauggagugagugugcagagagugagugaggacauaaggaaggacaugucccacuccaucccccuuccugcucccccauuuccuaacucccccagugugaauucucagggucacuucugccuccucccguuuccccuccacauccaaacagcacccugguccucucuauccccccucuccuggggucccucacaugccccuucccuucuguugugggcugcacaccaaagccuccuccccuccccacuuccuaggcacuaggaucucucuguggcuuccccugcuggguggugucaccucuuucucugcuuucagagaaacccuucccgccuuuccucagagugcuucccaaacugaggucccauggcacacuguccugggaggcguucagaggguuccaugauggacuagguuuggaaccacuggguuaaauaaacuuagagagggcuguuua

SEQ ID NO: 191790 - RNA, 3692 nt, Homo sapiens
gcagagggcucuuccggcgccuucccaggcggggaugcugcggcuccgcagcgggcugaggcaccuucgggcaacacccaauacucggggcuccgcucggcuucuuugcgccgagaugccuaagaaggcuggugcgacgaccaaggccaguagcaggucccguggcggcagaggggugggccucagggguacuuguugaagagcgcgggagaagcggggcccgggagugaguggaggcacugccagcggcuugccgucucucaguuccggggcucaggacagccgccgccacccccagagcugcggccugcugccgucgccccgccucaguaggcugcgcugccguccaccuggugauuucugagcgcugggcccggcggcagccgagcucuccuugggcugcgugugcugaccuuuggccuccuacccgcacucccaguccagcaauucauguucccgcagcggcaugaccugcguuuccccaggaggcuguauucugcuuucuccucccuugcuuuggcugaucgcaccccuucugucaagaauacagcacucccauuuccaccaucuuuguuuggccaaccccaguccguuucucagacucagcucaagcacugccuccugcuggcagcauucuccagugccccaaugcugauuugccugugggguaauguucugugccuaucucaucggugcacuuagcacaguguauuauaauuuuguauguucuuucucccucgcagcaguccgagcuccuugagagcaaggaccauguaccuuuucaucuuuacauauccauugccuacauauuuguugaacgaaaguuccuagcacagccccugucccauaacaggccuuuaaauaucaagcacuauuuuuuuuuccucccuuucccgcaacaugcagacauacacacuuucaccaacauuuauuagcuccgacugcaugagauacaaugaugaauaauaaaugaucccugcccccaaggaauuggaaauacaaagcagagggaggagcaagcauuaagguuuagaagccagaguuagguuuucuugcaaggggggaaaaaacacuguuggguugaugggaacccuucgugggaaaauugaguagagccuugaagguugugggaaaagcuuucuagguggccagaagucccuggacaccacugaugagccuaguuugucuguuaagggugaaaggggguaguggaagaaucaaauuaaaugugugggaaaauauuuuguaaccuguaaaguugugugguugucauuuuaggguaaaagccagagcaaggaaccagagagaccacuuccucccuuagguccuguggcaguugauccuaaaggaugcgucaccauagccauccaugcaaaaccuggcuccaaacaaaaugcuguaacagguauaccuggacacuggggugggauucaagugugaaucaggugucuccuacagcccuccuuugcuuugguuagcugaaagcuuauucuaugacaguugauuuuucacaucugcaguuagaggcuucuccauuuuaaaauucuagauucuaauguaaaggugucuuaaagugaauauaucuuuaaaucaugccaaguuacacgaaaaccauuguauauuuuccucuuuaaaaauacaguauuuuagaaaggacaguuauggaaacuuguguguagucuggauuauucuuaguuuguccuguuccaaaacuggagacauuggccagagaaagaagagacauuuuaguguaguuuaaugaucacuggccuaaggagagggagaaaacuugagaucugagacccgugaucaguuccugugcgaauuuguuuuaaaucaaaacaguauaaaacauucauggguccaguuuuuucaucugucagaugagaucguuggacuaaguuagaggcuuucaggcuauucucuggagugcuggaggugccucaggaaucagcuuugggcaaggaggaggccaggcagacagggcuccugacuagcucuguuuacauuuguuuuacauauugggauucuggagaaaauugggggaagggauucuaaaggaaaaaaaguucaaaaaccauugcucuaaauucuuuugaaggucuuuuucaccucuaaagcucuguauuucaaaccauuuuuagauuuugaaaggaaaaccacaacauugacgugcuagaccugguuuaugcugaugaccaaguuaacuuagccauacccuccuuggccagcauuuucuaaguaguggguguggacacugucuacguuggaguauuauguuucauuagaucuaaaaugggaggcuggaugccauggcucauuuguaaaauggagauaauaaugguacuaauaucuucauaaaguuauuauaaggauuaaagaaguuaguauuuguaaagccuuuaacacauuugugugugcuuaaaauugguguauaguaagugcucuguaaauauuuguuaaguaaacauuauuaaauuuuaaaaacacucaagauaugugucacauaagaggugaaccuaguccggggcucucauuuuccuguugaggaaacccugcacaaccuuguacaaucuaguaagcugcccuguccauacacuucuucagugacauugaugaggcugaaggccaucuaugacucccugccuggggcucuucacauaccaagggcaauuuccaguugccuaaauccaggauauuccccagggcucuguaagcccaucuuggucggcaagauugggucaauaacuuuucuucucuggauuuauuuccuguaaugguagggccauuuuuaucauguucauguuccuuaaaugugauuaguuuaaucauucauuucuucauucaacaguuuuuaauugaaaaucugugugccaggcaaaugcaaaaacucuuuuacaaaauguccuugcuucaugaagaaaaagaacuccuuaaggauaaaguccacacuauuuucauuccagauuugacagcagaggcuguaaauguagcuauugcagcaccuccaucagagggagaggcuaaugcugagcucugucgguaucuuuccaagguccuagaacucaggaagagugaugugguuuuggauaagguaggucucgcucucuuuuuuuuuuuuuugagacaaaaucuugcucugucgcccaagcuggagugcaguggcguagucuuggcucacugcaaccuccaccuccuggguucaagcuauucuccugccucagcuuccugaguagcugggauuauaggcgcaugccaccaugccuggcuaauuuuuguauuuuuaauagagacggaguuucaccauguuggucaggcuggucuugaacuccugaccucaaaugauccaccugccuucuccucccgaagcgcugggauuagagguaugagccaccaugcccggaggucucucucuuuuuaaacuucuuuaauuauuuucuuuuuuuuuuugagacggagucucgcucuguuguccagccuggagugcaguggugcaaucuugacgcacugcuaccucucacuccuggauucaagcgauucuccugccucagccuccugaguaguugggauuacaggcacccaccaccaggcccaccuaauuuuuguauuuguaguagagacaggguuucaccauguuggacaggcuggucuugaacgccugaccucaggugauucacccaccccggccuccc

SEQ ID NO: 191791 - RNA, 78826 nt, Homo sapiens
aauaauuagcgggcgggcggggcccgcgcgucagccgcgggagccggccaauccaguggcucuccuccgcggucgcgucauaggccgaacaaccaaacagaaaaguuuaauaaacagcggacggaggggccggcgguggcggagccggagcaagcagggguucggcggcauuaccuguacccauucaccggcggcuaccggcggcggcgcgcagcgugucaggcggagagacccgccgccaggugaggagcgcggcccgcggggcccggcuugcccggcgcugccccucccccgccugcucccuucccccacccggcugcagcuaggcgaggcccgcccccggccccucccggcgcccgagagccggaagcggagggcggccggccggcgcagcagguggugggcccgcgggggccgcgggcgagagggcgaggacucccggcuccgggggugggggccggagaucggcggguucaccucagacggcgcgcgggcgcccgcggccgggggccgcuuccugucaggguggucgcgcuggggucgggagccucaguucuucagggccgcggaggccgcgacgcgcgccgccccgagcggguugcgagcgguuggcuggcgggggucggaagggccccgggcacacuggggcgcgucaguuccccgccuccuccgagucucagguccucuucgggauguuuuuccaccugcggcguuuuucagaaaccagccggaggcagcccggugucuccaacuccugacuggcaccgggaagggaauuggucucuuuuuuuccugcuuggguuuagcuugcuuaggauucuaaauuuuuugucugcuuuuuugaaauaguuauauuuaaguuuuagcuaccuaaaaaaguaugaaagaauauuguguuugaaaucuuuuuaacuugguuuuuaagucacgugcuaacuauccuacacaguugggacgcuaugauuuaccuucacaucucggaaguuguaaccaguugugaggaaguuaggaccuugggguuaccuaaagauaauuuauauuaaguuguugggccauaaaaacugggcagaauuggccacgcgcggugacucaacgccuguaaucccagcacuuugggaggccgacgcggacuaaucacgaggucaggagaucgagaccauccuggccaacauggugaaacccugucuuuacuaaaaauacaaaaauuagcugggugugguggcgggcgccgguagucccagcuacugggaggcugaggcaggagcaucgcuugaacccgggaggcggagguugcagugaaccaagaucgcgcuacugcacuccagccuggcgacagagggagacuccgucucaaaaaaaagccgggcagaauuaaugauuuugaagcuccgagaaacaggauuaaauuccucuuucaaaccgaaaucggaauuugauuuuuuaaaaguguaaaauaccauaaacuuuuaagguuaguuguucgguaaccaugucaccaauuuuaaggcacuuucugaguuguguauaguuucuccagagcccuaggggaaauguuuugcaaaauaugcacguuuagcuuuccaaaacaaguugucuuuuuuauuuuuacuuuuuuacguuuuaaaauguguuuaaagggagacaucacaaaugugcaggagaaaauacaggggucgguggauuuauuaucuuguagugauaacuuuuuggguguaugcauaugucagaacuuacacguuuuacacuucaaauaugugcaguuuauugucaacuauaugucaguaacguuuuuaagaaguaaccaaaauauauuuaauacuaccaaaaaaaaacacgguaaaguauaagcagauaaaaacaucauaaauccuugaugacuccccccaaacccaaaacuggaacauuacuaaaacuugcauuugucuaugaguuucuuaucugugcaguggauuuuguguaugucacuuccuugacuuuuugaaaaauaguuuuaucauauauguuuguaugccgaaacuguguggcauuuaauuuguuuuucuuuugagcuuuauaaaaauaguauguggcuguaguuuauuucauugcuuuaugauauguuaaucugccauaacuuaugggcacuucgaccguguuuuuauuguuuuuuauuuuguuuuguuauaagcagucuugcucugugaacauuucuuguuuccggcucuugguacacaaguacaagaauuucucuagaguaaauacuuaauguggauugcauuagacgguauuagguaaucaggacuagaauagauugaauuacuuagaaauaagaugaaugaaaaacauuaggauucucuauuauguuuaaauagaagauucauagccguagugauugaacuaguucaaccuaguugaacauuugcaugaaaacccaaaauuccuguuaaccuauguguaaugacucucuuacuuugaagucacauuguaaaaagucuggcacuguuugguaucuccuuuucaaugcaaaaauaguauaguagaaaaaacgcuggauuguauguaaaauaaauuauccuuucugcuguuccucuccuccccucuaaucucuagcaaauuacuuaaaaauuucucuugugccuuagcauacucauguaaaagaaacuuguccuaagcuuauccuuccacuuuugcacagacuuuaauuaaggaaaacaccugucaaaugucacacccuuuaagggaaagcauuaggaccaagguguuauucuguggaauuaaauuuuguauccuuuggaacauuuuuggaaaaguuguguggugguucaggauuuguuaacuccauauuuaaauauguuuuagauuagagaaugcccacaagguguguuucccgaggaucuguuucauuaugcuaacaggaacacagcgacaaauuagggaauaguaucuccuuacuauccugaagauagguguguuuuuauguguuucauguuucauucauguauguaagugugaauuuacauguaauuuugaauaaccuuuuuguuugaaggcaugggaguagagaugguuucauuuuuucuauauguagcuugcagacaaauaucaggaugcuuuguuuugguagggcuguauucugcuuuuaaaaaccuuauuuuuuauuuaauuauaaggacaauguguauaugggguuuucccccucaaacuugagaaagaauagaaaguuacuaagaaaagccaccuauaacaccaugauagauaacuauuauuaacauuuugucagguauaccccuggucuuuauguguguauucuuaauauccuaaacuauuaagaguccauucuaaacacucucagccuggcucuuucuuaagaacuuaccgaaauguaaucugccucaccaucuuauuucauauaagaugauaauagaagucaucuguuaccauugcuucaacuuuucuacucuucugcuucauuuaaauguguaaauuuguaaauuacaguaucuuacucucugacucaaaaccucccaguagcuuuucaauauaccaaauaaaauugaaaccucuuacuguggcuuauauaccucagaccagcaaaguccacuagaaauacaacguuagucacaaaugggagcuacauuaaguaauuuaaaauuuucugguagccacauuaugaaaaaaagagaaacuggugaaaauacguuuuauguaacccaaaaacuauuauuucaacauguaaucaguauaagaaauuguugaugggauaguugucuuuuuuuagacugucuuuauaauuugguguguauuuuccacuuaaaguacaucucaauucagacuagcuacauuucuuuuuuuguauuuuuuuugagacagagucuugcucugucucccaggcuggagugcaacggugcgaucucagcucaccgcaaccucugucuccuagguugaagugauucuuguuccucagccucccgaguagcugagacuacagacaugcaccaccacgcccagcuaauuuuuuuuuuuuuuuuugagacggaaucuuacucuguuauacaggcuagagugcaguggcacaaucucggcucacagcaaccuggguucaagcgauucuccugccucagccucuccccaguagcugggacuacaggugcaugccacuacacccagcuaauuuuuguauuuuuaguagagaggggguuucagcauguuggccagccuggucucaaacuccugaccucaggugauccaccugccuaggccucccaaaaugcuaggguuacaggugugagccacugcacccggccuaaauuuuuauguuuuuaguagagaccgcguuucaccauguuggccaggcuggucuugaacuccuggccucaaaugaucugccugccuuggccucccaaagugcugggauuacaggcgugagccaccaugucugacccagacuggccacauuucaagugcucgguagccacauaugacuagugguuacccacauggacaguuccaucuuauaaaaguacuauaaccuaguuaucuguuggguguaacuuaaguuuauuauuuuuuucuuauuauuauaaguagugugauaaauauaagagcuacuacuauguauuugucauuguuucuuucggaucuagucugucuuacaaucacugaaucaaagcauaugaacauuucuuaaagucuuuucauaaauauugccaaauuuuguccuuaaaaguuugacuaacaucaaacuuuaauaucaaauuugacuaaaaauaugacagaauacacauuucuuguauaucuuuaccagcauuaucugucuauccaucuacccuccaucuuuccuucccuuucuauaggaaucaucauauauuucuuuaauuaauuaugaugguaaauaaaccuggauauuggacaucuucuaguuuaucuuuugcccauuuuggcugguguuuuauauuugugauacccuuuuaaacuuuuuauauuuuuaggauuuaggauagcaacucugcuauauacugcaaauauacauauacacacaaauauauauacacauguauacauacacacacacacacacacacacguauguuuggguuuuuuaaaauguuuuuugagacacggucuugcucuaucacccaggauagagggcaguggugcagucaugguucacugaggccucuacuuccugggcugaagugauuaucccgccucagccuccuguguaacugggauuacaggcguuccccaccaugccuggcaauuuuuuguggagaugggguuuuaccauguugcccagaaugguuucaaacuccugggcucaagcaauuuaccugccuuggccucccuaagugcugggauuacagguaugagccacugggccuggcaugcaaauauuuuuccuggcucuucauuuaccuaacaguguugucuuuucucuugcucucucucucucccccuuuuuuuuuuuuuuuuuuuuaacaaaacaaaaaaacaggcaaggguuuuuacuuuuuaagaaaauuagguuaauacuuucuuuuauggcuucuacuuugcuuuuauauuuaaaggcuucuccuacccaguuaaguuuucuucuaguucuuuuacgguuucauauuucacaucugucuuuuucuguucaucugggauuuauuuugacauaugugaagugaaauaaccucccuuauuuuuccuuaaaaauuuuggccccacuaaaaaaaaaaacaacuuguugccuugaaauaaagcugccuuuaucauauguuaaaugcacaucuucuugguucuuuuuagguuuuauugaaauaucaaugauuugguaccaguguacacuuguauacauggggcaugguauuuucauuuuguaaacaaguguguuucuguuauuguuuaagucucccccccaucccccuuuuuugguuguugcuuuguuaguccucagauuuuuuaguuuauucuuuuggggcuucaaauuaguuuugguuuugauuuuuuuuuuuuuuuuuuuuuuuuuggagacagagucuuacucuguugcccaggcuggagugugauggcaugaucuuggcucacugcagccuuugucuccagguucaagugauucucaugccucagccuucugaguaguugggauuacaggggugugccaccacaccuggcuaauuuuuguguuuuuaguagagauaggguuucaucguguuggccaagcuggucucgaaccccugaccucaggugaucuacccaccucggccucccaaagugcugggauuacaggcgugacccacugugccuggccaguuuugaauuuuuuaacuuaaaaaaauugcaacuuuuauaauauuuuauguuuuauaaugaaaaaauguaauccuauugaauguuccucugagcauagcuuuagcuauauuacuuaaauuuugaugaguaauauuuuuauguuuauauauuuaaaaaccccugcaguugcaguuuuuauuuuuucaacaaguauuuaagcaccugcuccaucuagacauucugccaagugcugaggacacaacuauguacaagacaaggucucuugccuucauccaguuacagucugucaauauagacaaaccaacgaauaaagaauuuucagauuucgacaagugucuaggaaguaaauaaauaauagaaggugcuaauuggaugaucugagacugucucucugaggaugucauguuuaaguugauuggugguaccaagguguguaugggaguuucuuuagcuuucccaaucuaucgaaacauaaaaaaaaaaaaaaacggagucucacucuguugcccaggcuggagugcagugguguggucuuggcucgcugcaaccucugccuccuggguucaagcaauucuccugccucagccuccugaguagcugagauuacaggcaugcgccaccaugcccagcuaauuuuuguauuuuuaguagagaugggguuucaccacgguggccaggcuggucacaaauuccugaccucaggugauccacccgccucagccucccaaagugcugggauuacaggcgugagccaccacgcccagccgaaaugacuaaguuuuuuugggaaaauauuuugugaaaauugcuuugcaggccuggcugagaucacuugaugucaagaguucaagaccagccuggccaacguggcgaaaccucaucucuguugaaaauaccaaaauuagcugggcgugguggccgguagcuguaaucccagcuacucgggaggcugaggcaggagaaucacuugaaacuuagaggcggagguugcagugagccgagacugcaccacuacacucuagccugggcgacacagugagacuccaucucccaaaaaaaaaaaaaaaaaauugcaaacaguuugaagccucuuccccaucuuccagcuggauugcugcuccaaagcuuguccuguguagaaaauuuggaacuuugauucugaguucuaaaaucaagaaguugaagguaguuucccaugugaagagaacugcuggcacaaaugguacauaugcaaagugcuugacuugacuuugaauuugacagaagauuagaaugacugguguuuacugagggaggacagugggacaagcuuuguuucaggacuuguuugggagacuuuuauuuuuuauuuccaaaugguagggcugcuuccaccccuccugccuuccuauggaguuuugauuuuguaauccaaaucagucuccuacaaauagcauauauuauuuuaccucuuguuacuuuucuucauuauuucuacuguuuucaguuuucucuacucaagaccuuugcauaugcuuuuguuuugcuuaguugugauuuccuugaggaauccuuccuugaugccacaaaauagguuaggucuuucucuuggcuucaugggcucauuuuauauugggcuuuucuuucauaaacauuuguaacaacuccaguucauuaaguuugugugaauuguuuuagcaucuauuucuucuuccagaaccauagucugguagcuaccauccacuuguggcuauuuaaauaaauuuaaauuuaauuuaauauuaaaaauucaguuccucauuuguauuagucacauucuaggugcucacucaguggccuuauguggcuaguggcgauuguguuggacagcagagagacagucuucugcaauaauagauacuuaucuuaauuuauaguccuguggcuaauggcuaccauauuuuauuuaaauagucacaucugacuauugagauauggcaagucugaacugauguauuaaguuugaaauaggaacuugauuucuaguaccaaacaaugaaaauaucucaauuuuuaaaauauuacauauugaaguagugauauuuuacauguauuguguuaaaauauacuauuacuguuaauuuuauuucuuaauuaaaaaaauuuuuuuuucuugagacggaaucuuacucuguugcccaggcuggagugcaguggcacaaucucggcucacugcaaccucugccuccuggguucaagugauucuccugccucugcuucccaaguagcugggacuacaggcgagcaccaccgcgccuggccuguuuuuuuuuuuuuuguuuguuuguuuguuuguuuuugagacaugguguugccuuugucgcccaggauggagugcagugaugugauguuggcucacuguagucucaaccucccuggcucaagggauccucccaccucagccuccuaaguagcugggacuacaggcgcgccaccaugccuguauaauuuuuaaaaauuuuuaaaauuuuuuguagagaugggguuucacuguguugcccaggcuggucuugaacuuuuuuuuugagauggagucucgcucuguugcccaggcuggaguacaguggcacgaucucggcuaacugcagccuccagcccccggguucaagugauucuccugccucagccuccggaguagcugggauuacaggcgagugccaccacgccuggcuaauuuuuguauuuuaaguagagacuggguuucgccauauuggccaggcuggucucgaacaccugaccucaggugauccgcccacuguggccucccaaagugcugggauuauaggcgugagcuaccgcgcucagccggucuugaacuuuagagcucaaguaaucugucugccuuggccucugaaagucuugggauuacaggcgugagccaccgugcccagccaauuuuuaaauuucaaugugacuacuaggaaauagaaaaccacauguggcucucauuauguuucugugagacagcacuggucugacucgaccauaaguuuguacagugguagggacuauauccauuuuauuuacugugguaucuucagcgcauaacagacguucaaaagauuuggugaaugaauaaacuaacucuguuaacuuuugaauguuauugcauaguuuacagagaauguuaccuauucagcuuuugcuuuucagaauuguuuucuuugugacugauuaaaaugguugagaaaagcucuuucaguaacuauauaaagaaugagucuucgucuuuuauguaauauuuuauuuauuuuuuucugguuuaggccuccaaggagagagagaauuuaaaguuggccagucuauuuucucuuaguuuuucuaugucuagcacuuuuucuuagaugaucuaugauauguuguuuggcacaugaaaauuuaugacuuaaaaucuuaauaguugaguauuauaaaugccuucucuuuuauuuuugucucacuauugugaucccuguuucuuuuuauuuugcauuaaucagugaccuuguuuaucccuugagaccuaaaacaaagcaauguacuguuuuuuuguagaaagauaccuuauccuaucggcuugguuuaugcuugcuuauuuguauguuuccuuaauguuuccuuuguguucaguguuugaccucauaugccauucauucaaacuccccaacuccucauacacaccuuguaaucuuuucccuaaggagucaggagagauacaccaggaauugcaggcucaaauauaucuuacuuuugccagggaaauauuuuuuuuauuuuuuguuauuuauuuauuuauuuauuuauuuagagacagagucuuacucuauagcccaggcuggagugcaaugucugcugcccggguucaagcaauccuccugccucagucucccaaguagcugggauuacaggcaccugccacugcacgaggcuaauuuuuguaguucuaguagagacgggguuucaccaucuuggccaggcuggucuugaacuccugaccuugugauccaccugccucugccuccgaaagugcugggauuuacaggcgugagccaccacaccuggccauauuuuuuuauuuuuuauuccccauugagguguuuuucagaguuuauccuuagugaucccaguuauguuuugcuaaugucaggguggucuuuuuaucaacuacuacaauaaaccaccagucgugccagagaaaaugcccaggauuaauuucuuuuguaggaagagcaguuugaacuauauggaauccuucaaaauucuaagaaaguguuugcccuguucuguauauauucugccaaaaguuguuccuaauagucuagauauugauucuuuauguaaguagggucuuuuuaaucaaaagugaagugggaccaaauuguucaguggcuuguucucuucuaaauuguuuuuagcugauaagauuugggaaacuuucugggcuuccacaaauaauauacaauacaucuuugaauacuugaugcuuaaaaaguguuguuacugcaugcaaucagggagcuccagagcuuuuugcaggcuccuuguuccugagaagcaauauuguuuucauauuaucucgguuauacauuuuaugguugugacauugcuuucuuuuuguuuuugcuguuguuuucugcugcugcugauuuagaaaugaaauaagcuaacucuuaauuuuaaccuguuugcuaccuaaaaugguaaucaucuugauguucuuucaagcaggucccagagaucuuaaaaugauccggaaucacugaguccacaguucucuuuucucuugguuauguauagauggagaguggucuugguguuauauuaguguaugauucguauuuguuucauaauuaacuucgaagugaaaaauugaugcgagagcaaagguuuauuugguuuccauaacuauuuacuaauuuuaugcuugccagauuuuaagauuaaacuguuugccaucucuuuuuuuuuucuucccguaaaaccuuuggccaucuacagucacuuuuccucaaaucuuaugcuguaauucaaacuguauauucuuuuugcugauugcuucuguaccuccucugcuuccaguguucuuuugcaagaguguccacacagugggaagaaaaccugaacuugacucaugaagugcugggcauucaaaacagugaauccuugcaaaggaucuugggaguagaccccugugaauuggcucuuucaauuuguccacuuaaagggcauaauagauuaugcagcuguuugggcuucagcaggguauugcuccauauucaugccuaguugcaauuaugugaauuuucaguuuguuacaaagacuucccuuuguauucaaaacaauuuuguuggcuuuguguucuaauauuugaguuuucucugaggaaaaauaguugcaagauuuugaacuuugaaaacuucaaauuaaaauguuuaaagguuuugucacuuuuuauuuucugaugcaaaccauacauugaaagcauauuuuaagaagaagucacucuaauaagcuuuaauuucgaguuuaugaaucacaggauuuuugguagagguaaaaacuauacuuacaccguaaauuagacauuaaaugccauuuaaucagucagauaaugauuaauguuagaguaauguuugaugggccaagcugcuaaaacauaagcaguucuaauuaaaauauauaaacuuaucacguaaaaauagcaaacuuaguaauguauaaagugacaguaggucuuuuuugcuuaaaaaucagaguuccuguguagugucucuuuaugaucucuguaguaaaaauauuauuuaacguagcuuagugagaaguuuaagaggaguauaccuuuuacuuuagggugcccaugccacuuugaaguuauggagugcaaaguaguuuccacacauuaaaaaaaaaaaaaagaugaaaaagacuuaaacuuuucuaaauuuuauaccugaacaugucauuagaacaugugccuuuugcuuuuagauaucuguuugccaaugguuaagcauuaaccuuggcaaaauacucacaugucagaucuguuaaauguaauaguauuucugcccaguauuuucuucaguuuuaaguagaaauaucaaccuuugaugucacugaaauuucuacucuguugugauacugagaacauaaaugucagugaguuugauagcuuagaagugaaucuuuugcauucaguauuuuagugcuguauauuuucacuuaaguuauaguuuucucuuuaagucuuagaaaaaaacauugguuuguuccucuuagcaacauauuguaauggauuuucuguugccguuuuacaauuuucagguaaaaugugaacucuauuaaaaauaaucugucuuuaaagcauaacuucaccuucauugcuccauaaaaauaaaugauuuagauuaaaagcauuguauuuuaaacaauuggucacagcugcuucugugagauuuucauuuuuguuacuuaguuuauuuuucaccuagacaaggguaagcaaacaguauaugaugggaaaacugaaaccuuauguacuguuucuuuaagaaaccagcuuauccaggagguuuuagugugucuaaccuaaccugcuagcaaggaaaaguucuuuaaaauaauggauauuagccguauccaaucacaauuaucaguuucacuaacagggaggagauuuuacucuucagccacuagaauuggagaagguggagcuugguauucagguuugguugcuuuggaguacagcuucaagugaaguuaaucugaggugaagcaaacagaaaauuguggagguuuuguugguaggauuuuuguucuaaucuuuuuaugauccuuuauuuuauaauuuugcuccuuuaugauucugugugugcuagguuuugucacuguuuuuauuuucugaugcaaacugaacacuaaaauuaagcagggaagcagaacaaaagggcucuuuggacaggaaauagguguucagagaaucaaacuugacuuucuccuaucauuauuuuuaguucagaauaugagugucauuaaaacaucuuagacucaaaaucaucuccaauaacaggauuuuuuuuugaauugguuguuugaacagucaguugucaguuuuuauaaaugacaucuugaggagguucauuugauaugucauuuuccuuaaacuuaaaauguuaaguugcugaaagauaaaugugauaggcuuaaauacgucuuuuuuaguaaauugaaaugccaacuguuuaauuuuuuuaaccccagcacagcaccccuuuuaauuucaguauauuuuaauuuaacaauauguugacauuuuuaauaugcuuauaauuuuuaauaugcucauaauuaaaaaggccauugaugaacaaagugaaacugcuuucuucuuacuucauucaaacucuucauuucuuucaaagguggagauaaguaauuaacauuucgaaacaggaaaugaaaggauuuauauuuuuaaaagcuauagguaggcuacuacaacuuuuuuuuaaaguaucugauucuauuuacauuucuuauuuaugacguaauuguaguguauuucaguacaagaauauuuuuuagagacuguuuucuuuauauuguugcucuuuguucucauagaaauuaagguauaaauugcaauaaucauugcaauaaucagaccaaaagccagcuaagcauuuucagccauuguauuugcuaugcuacuuguuccggaucaugcaaagguuuuuaaauuaaugcuuuucugcuauaucuguuguuuaaacaauaguguaauaauaaugaaaucaagaaaaguuaccuaucuacccaccagcagaucauuguuuggucaucucauuuuuuuccuguucccuucucugucuuauauucuugcaguuuuccaauaauuaugaaucugugcaguuuuauguuuucacuuaacuaucuguugaaauuguuuucauuucaguaacuauguaauucucuuaaauugaugugaccugaauuaaccuaguuuuuugaauugucuacuuuuagguucuaauuuuucgucauuuuuaauaguauugcguugaacacaccuguguguagcuguaaaauauuuuccuuuuuaaaaaagauuucuuuuggaaaaauccuggaguggcuuuaccuagaucaaaggauaaugaacacuucacuggccaaauuguuuuucuaaaaaguuauaccaguuuauaucgacaccagcagaauaugcuucaaaguuuuucugauguguagccccuuaaauguucuguuaaagugugccuauggagcucucugacuuguugauuaguuuuugccuaaaagccuauuuucaacaccacuuuccaagauguagauggauauaaagcaauuuuucuggauauuaaaaucagcugagggaaauuggaaacacuuuuacccacuuaacugagcaauuguaucuaugcuagauauuuuauauacuuaguguauguguugcuauuaguaaguauggggcuuaauguuuuacacuggcuuuguuauucaggcuggcuuuucuuuuucuucugguaagcacauaccagaagaaauauuuucuuucaagaaaauauaucagaaacauuuuuaggaggagacuggaguagugccaguuaacauuaggagacuggaguagugccaguuaacuuuaccugucucaaaaacauguaugaauaaccuuugucauuauuugugcguuucuuaauuuugaguuuuuaaaaauacacuuuggaaacagauaacuuuuaugaauaauuacaggcuuugaaaugguauaucagcaucuuuccaguauuuuauagguuucaguuaaagguaagaacuuaacuuuacacacauauaguggugcuagacauauguuguuucuguuugucuuuaagagcaugcuuuguuggcauugaccacaaauuauguauacuuuuacuagcuugucuguuaaaugaaauaggcauaacuggcuuauaaacuaguugaguaacguucuagaauaaacuuaaguuguguuaaaaucaaagacaauucuaagacaaucauauuuuuucuuacaaauggggaguaaugauaagccauaggcugggcuauaacucauugauggaaccaguaguugagcauguaugguauggaguuagucuagcucauuuugcaauuuaaauaauuuaacuuacuuugugucaacuuuuauuucaauuaacugauaauuuaguaucucugacuuucagagcugaugcugguauguuugucauuguguuuguuucagagggaaguuuuuuuuguuaaugucuacuuuuauuguuugauuuuuuuucagauacuuugguguugaacauuugggauagaagagagaaauuuaaaauuaaaaauuuuccauauuucuaucacaaauauugguaauuugacaacauguaauuugauugucgucuuaauaaaauuuaauguuauugcuaccaaauagagauaaagguaauuguaaauacuguagugaaaguuuagcuguugauuacauuuugcuggguaccccaagguaaagaagugauuuuuuuuagugguuucuguaacuguaauucugcaguacuacugaucuuacauugacagauuuagggaguaucuuuuugguuuccuagggagaguggaaaguaguuuucuacaaggagaagaaaacuuuuaaauugaccuagguauuugggucaagauaugaaaagugaugguugcguuuuauuucaaaaauaauguauucaaagucucuguuguuagaugccauucaagaggaacauagugauuuuuuucccuccaaauaauaugaggaaaaaacuuaaugggcaguaaguugauaaaacuugaaagaaccuagagccauuuuuguuuaaaccuauuaaugcuaauuuuugaacugaugugucuaugaacuuguuugacuaaauuugguuuucuguguuuguaugccaucggagaaaaugaacucgaaacaguuuugucguuaguagugcuuugguagaagagagcagauccaucuaucccuguuuauaccuuuuuuccccuucgcaauauaaauacccugugucaucugcuaccaauagauuuuuguaaguacuagauuucucagcaacauuuagugccauugacuacuuuuccugcuugaaacucuucucauuauuuucaugauacugucugugcuuuccucauuagugaucucugugucuuuugcaaauguuucuccuuuacaaccauuaaguaauagaaguucguagcauuuuguucuuaacucuucucuagacuucccuuuugauaaucuccagucccauaucuuuaauuagcauacuauacauauuaaugguuccaacgucugaaucuaaaauccaaaacuuuuuuuguaccugagacccauauuuauccagcucaccaaaagucacagcaaaugggugauacugccacccaagccagaaucugauugucauucugauucuucuucaucaccaguuagccacaauuagccuauaaauuuuaaauucagugucucuagaaucaaucuuuuuuuuuuuccuucacguguuagcauaaggccacacgguaugauuucuuagaugacuaaacaccccccuaauugaucuucauuuccauuuuaggcucuguauaauacauucuuuacugugcggucauaucuguuuuucucugcuucauauucguuagugaauacuagcuagagugaagaauaacaccagcugauucugugcuaaacauucucucagaugguccccacgcuaaguacuguuagucuuuucgaaccaguaagucaauuuagaaaggcuagcuaauuugucuaaggucuccuuggcugguaagugacuagcauacuuuaaaacugagguuugucagacuggaaguccuuuccuuuacacacugagcugugugcuuuccugagcuuacuucucuauuccuuuuuucccucacaucauuccacuucacucuuuaaccaccagcuauuuguaauuccuucuucuaaggcauagugaaaacuugcugccugucuaaaaaugcuuuaagggaaacaaacauuaaaaaaaaaaaguauuucugacaguuuuuuggaacacuuugauaaaggauauuaaacauuuuagcauccccaggauacaagaagauaaaagaaugaggcacaggcaaaguaaagguaguuuuccuuaugcacauaguuuugaguuucauagcuguugaauuccucacguuuaauaaaagcuugagaccaagcuguguagugggaagauuaggcaaagugcaaaagcacuuuaagcuauuugaaaugcuaacaacuccuuaaauaacuguuggcuuggaccuugugcucauucugcauccggguguauaaagcaccugccugugaacaaaagucaaauaacuuacugaguaacuuauacauaggguagagaggcuacauagauuauuuugcaucaaauauucuaucaucaaaaaaguuaaauaaugcagacaacauuacuuacaaauaaaauugacgugaacagaaaaauaguugauuuggaaucauuuucauuuaaaauauuuucucuuuguccucugugccauucccccucuaacauauuuuaaagcaaaaggaccucuauuggaccaaaaaaagaaaaaguagccuuuuuauucauagcuuugaaagcaacuuggugguaaaggaaaaaggucaaauugaugaaacuuuugaaauacagguaaauauuaccaauguuuguuucuuugaagggaucaaauuauuaacuauaguugggaauuaaagguaauuauaagcauaguaaaaauccaugaauuacccauuguaagaauaggagugaguuuucuuucuuuuuuuuuuuuuuuuuuuggagacagagucucgcucugucacccaggcuggagcacaguggcgugaucucaguucacugcaaccuccaccucccugguucaagcgauucuccugucucagccucccaaggagcugggacuacaggugucugccaccacgcccggcuaauuuuuguauuuuuaguagagaugggguuucaccauauuggccaggcuggucucgaacuccugacccuugugauccacccgccucggccucccaaagugcugggauuacaggugugagccaccgcgcccggcuuucaaaacuuuuaauguggcauuauuuacuauccauaauagucuuuugcuauauuuuauuuuuucaacuuuuauuuuagguucagggguacauguguagguuuguuacauggguaaauugcaugucacugugguuugauguacaaacaaucccgucacucagugaccauaguaccugauagguguuaauaguuuuucaacacucgccucuccccagcccuuuccucuaauugucuccaguguuuauuguucucaucuuuauguccuuguguacucagugcuuaguucccauuuauaagugacaacgugguauuugguuuucuguccugcauuaauucacuuaggauaauggccuccagccccauccauguugcuacaaagaacaugauuuuguucuuuuuuauggcugcacaguaucccauaauguauauguaccacauuuucuuuauguaguccacuguugaugggcaccuagguuaauucuaugucuuugcucuugugaauagugcugugaugaacauaaacgagugcaugugucuuuuugguaaaaugauuuauuuucuuuugaguauauacccaguaaugggauugcugggucuaaugguaguuguguuuuaaguucuuugggaaaucuccaaauuguuuuccacaguggcuggacuaauugacauuaacaccaacaguguauaagcauuccauuuucugggaaacuucaccaacaucugucauuuuuuugacuuuuuaauaauagccauucugacuggcuugagaugauauuuugauuuugauuugcauuucucuaaugauuagugaugguaauguugagcauuuuuucauguauuuguuggcuguauuuaugucuucuuuuuuuuuucauuugcucaauuauuuuauuuuauuauuauuauacuuuaaguuuuaggguacaugugcacagugugcggguuaguuacauauguauacaugugccaugcuggugugcugcacccauuaauuugucauuuagcauuagguauaucuccuaaugcuaucccuccccccucccgccaccccacaacaguccccagagugugucuucuuuugagaaguauguguucuuuugcucguuuuuuaaugggauuauuuguuucuugcuuguugaauucuggauauuagaccuuugucagaggugcaguuugugaguauuuucuccuauucuguagauuaucuguuuacucuguucuuucuuuccuuuuuuuuuggagacggagucucgcucugucgcccaggcuggagugcaguggcgcgaucucggcucacugcaagcuccgccuccuggguucacgccauucuccugccucagccucccaaguagcugggaccacaggcacccgccaccacgcuuggcuaauuuuuuggauuuuuaguagagacgggguuucaccguguuagccaggauggucucgaucuccugaccucaugauccgcccaccucggccucccaaagugcugggauuacaggcgugagccaccgcacccggccuacucuguucuuucuuuugcuguucuuuugguauacauuaaauaauaaaaauguaaaauaaugacaauagauuuugaauguuauaauagauuuaugugauauauaauuugaaaagaauguuuuccuuagcuuuuuuuuuuuuuuuuuugaaauggagucucgcugugucgcccaggcuggagugcaguggcgcaaacuuggcucacugcaagcucugccucccagguucaugccauccuccugccuuagccuccccgaguagcugggacuacaggcgcccgccaccacgcccagcuagcuaauuuuuuguauuuuuaguagagucgggguuucaccguagccaggauggucucgaucuccugaccuugugauccaccugccucggccucccaaaaugcuggauuacaggcaugagccaccacgccuggcccuuagcuuugagaaacagaauacacaaccguuuuucuguuuuuuuucccuuucuuuuuuuuuucuuugagauagagucuugcucacccacccaggcuggagugcaguggugcaaucuccagucacugcaaccaccaucuccaggguucaagcaguucucccgucucagccuccgaguagcugggauuacaggcacccaccaucaugaccagcuaauuuuuguauuuuaguagcuacgggguuucaccauguuggccaggcuggucuugaauuccugaccucgggugauccacccacuucggccucccaaagggcuaggguuacaggcaugagccacugcacccggccuacacaaccaguuuucuuaaauuuuguagauaauuguuuaaaauuauauauacaguaguugccccuuauucaugggagauauguuugaagacccacuguggauaguaccaaaccuauauuugcuguguuuuguccuauacauaaauaccuaugacauaguuuuauaaauuagacauaguaagacauuaacaauaauagaauaauuauacuguaauaaaaguuaugugauaucaucucccucccucuuucucucaaaauaucuuaguaucuucaggcugugguugaucucagguaacugaaacagccgacaaugaaaucuuggauguguuaggucauucuugcauuacuauacagaaauacgugagacugaguauaaaaagagguuuaauuggcucaugguucuucaggcugugcaggagacauggcaccagagaucugcucagcuugugaucaugccucaggaagcuuacaaucacugcggaagcaaagagggagcuggugcaucacaugacaaaagccaggagcuaaagagaguggggugcggagagguaccacacacuuuuaagcagccagaucuugugaaaacuaucucaaggacagcaccaaggggaugguguuaagcuauucaugagaacuccuccauccccaucauccagucaccucccaucaggccccaccuccgauacuggggauuacaguucaccaugagauuugaguggggacaaauacacaaacuuuaucaguugauaaggguggacuacuguaagguuaucuuuucucugaaugaauacuaagucucaguagcuguaggaauuuaaaaaauacauuuacuuuuuguagaaaaaauuuauucuuugcagacuuucaaaugaaaaccuacacugaaaaggugacauugauugccuaaaauaauuguuucaguaacaaauuuuuauugaguugugugcauacagccuagucagauagucagacuaguuacacagucagaugagcuuguaaaguacuguaaaaugguccuuuucuggaggaaacucacauacuguuugauaaaaguaggggauaugaguauuuccuaucugauaagucaguguuaaagacuuuagacaaauuuaauggaauuuaauugagcaaaaagcgauucaagaaccaagcagcucccagaaccagaacaguucaggaggacugcagaguaccguauugucaaauaacauauugucagauaacauuuauggucaagaaaagggaagugacaugcauacagcaaagggaagugagguacaguaacagcuagauuaguuacagcucagccuuugccucaucugaacacaauuugaacaguuggccaccuaugauuggcugaaacucagcuacugugauuggcugagacuuggcuacuuauuacaagaguagguuacagucugcuuacauaucaaguuaacuuuauagugcacuauguagagagaaacuuugggccaaaccuaaaauauggauggaggcagccucgggccagacuuaauuuaguuuaaugucaggaucauauauuacugagugcaaacuuguguuuguuauagaugauugcuguagaaguucaagugggaagaaagauaagccaagauaauaagaaaauuagaaaaaguaaaaucugagacauuccuugaagauuuguuagauagguuugagacuggauguacacuaaaagcuuuauuuacccggaaagaggcaauccuggaauggcaaaauggagggaguaauagauucuggauaugccaaccaaaauuuugcugguuuagcaggugccauuuaauuucucauuuuuccaguaagcccagguggggaagagguauggaguauacauaggauaugggaauggugugacugugagcaguggugaauuaugaaggcuucuaugcaaauaagugguaaaaacaggguuuggaauauuaauuuaauugcaacucauauuggacacuaucagacacauuaacuuuaaguucucacaauaucaugagauggguauuauuguugugccuauuucgcagaugauaaugcuaaguuuauagagagauaggaaaaauugacaaagguuaaacagguuuauagacagauaggacaaauugacaaagguuauguggcagagccuagauugaaauugggaaggcugauaccagagcaugaucuugcuauucagguuuacuuagagagggaagguuuacuuagggagaggaauucaaggcagggagacuaccaguuguuguuuuugaaguucugugguaaugugaguaauuuuacuaauguuccuaaaccuuuggguuugguaucucaauaucacugucaagugacuuucugggaaagguaggaaagauugacagauggauauagcagggauuauucauucuuauuuuagugagugucaaaggauggaaacugguaagaguuccagauauuuaaggaguuuauuaugaggauuggaccaugcuucccuccuuguuuugcugaguuuauaucuucugguucuuugauuuccuaugaacuaaaaaucagaauuccaucuuagaaauuuauuauucaauugaacugcccucaccucccuuaauuuucuuuuauaaaguuuucucugagguggauaugggauagaaaaaaugaugguggacugagcaccuacuauguauccuauacauauauacauauguuauuuuauuuauuuauuuauuuugaaauggagucucacucugucgcccaggcuggagugcaguggcgcgaucuuggcucacugcaagcuccgccuccuggguucacgccauucuccugccucagccucccgaguagcugggacuacaggcaccugccaccacgccuggcuaauuuuuguauuuuuuaguagagacgggguuucaccguguuagcugggauggucucaaucuccugaccucgugauccgcccgcuucggccucccaaagugcugggauuacaagcaugagccaccgcaccuggccuauacauacguuauuuuaaaccucccagcccugugaauugguggugguauuauccauaauaauaaauucugcacagguuucuuaagcaacuacugggugcuaugcuaagaacuuaugauauguuggggaaacaugcagagaauuuauauuaaaugauaaugagggagaaaagagaccagauuaucauuggagcagagucagagaagacuguaaaguggcugugcuaagacuuagaaaauaaauaaaaguuaaccagagugagugaaagggauguuagguaagccuuguaacuuuagagaaaagcguguucauggagaugauuaagcauggaaguuaggcugggcacaguggcucaugccuguaaucccagcacuucaggaagccaaugucaggaguuugagacuagccuggccaacguggugaaaccguguaucuacuaaaaauauaaaaaucagcugggcaugguggugagcaucuguaaucccagcuacucaggaggcugaggagguugcggugagcucagaucaugccauugcacuccagccugggcaacagagcgaaauuccuucucaaaagcauggaaguugagagcuuuagggcccaggaggaaaaauggcaggagaaugaggcuucauagacaagaugagcuaaaccuauucucuuagugauggaaaaccuuugaauuacugauuuggggcguggucugaucacccugagaggauuuaaauauccucuuaggcaguaaaguggcauggguucaagauugugcagcuaagaagaaacagcucagaucugaauccaggccuugucucaguauuauagcacucugcuucuuaugaagucuguuuaagccuagaucaggguuaggcaugauuacagcacacacauaguugcugcaaaucaguucagagaggcaagagauuaagugagauuuacgaaguguaggucgaucaucccaaauucgaaauuugaaauacuccaagauuggaaauuuucugagugcagacacgaugcugaaagaaaauguucauuggagcauuucagauuuuggauuuucagauuagggaugcucaacuguuaaguauauaaugcaaauauuccaaaauacaaaaaaauuugaaaucugaaacucuucuggucccagacauuuuggaaaaaggauauacuuccuaauaacugaggccuaacuggccaagaagugggagggaggagggccuaaaccagauguaauggcauaaaaggguuagaugaggaguauugauuuaauuacuaauuuacgugggggcagugugucagaaaugaccaaggcguuaagccggguuggcagagagaugauaguuuccuugaaaacaauacuaaguuaggcaaagcuauuucuuggagcaaguuccugagcuauguugaauuuugagauuuaggauuuucucuucaagucauugaagguuuuugcuuuuacuaaccugcagauuugacucuguauuagacucugaggauacagagauaaauaauacaugcugucccagcaucugaggaccaggugagugucauccugcaucaucaagccucagaaugucuccuaagcugcagucugaaccuaauuaagaauuuuuaagucgguuaauccugccaugcccccuugguuccuauaccaaauacaguucacuacucauuccuuuugcucuagagcucuauucuguaaugaacaagauacuuaacuccucacagaaucuuuguuuccugcccuaacugaagcuuucaucuuucaaaggacgccacuuuccuccugguccucaaguguuggcugcugauucuuccauacgucauaccaggagguuaaaaggggagugaguucuguguuuucagaccauuacucuucugucaaguaucaaggcuacuccuguucauuaucucuuuuucuuuucuccaucguucuuucacguucauuuagaauuuuuguacgugguuuaaguucuucacucuguucaagugacuuuccacuacugugaaugcugggauuugggucuguuuuauucguuacuguauccucagauccuagaaccguagcuggcacauaggaaaugcuuaauuuuuauugaauacauaaauucauuuaaauuucaaaguaaauuaauuuuuuaaacuccuaugaccuuugucuccagagcuuucguaaucaacucccaaaaucacgaccuuaaucauugcuuaaaacaguuccacuucugaacuuuucuggucauacaauugaaauacauauuaauuauggaaaauuuggcaaauggauaggcaaaaacaaaaaacacucaucaucuaacuaguuagcaauaaaaauggauaaaaauaucuguauauuuuucuagccuuuuuucuguaaacaugcauaccuagguuuaauuuuuuuaauggggaucauauuguacauacuguuuuuaaaauuccugguguguuuuguguguguguguuuaacuuuaggauauuuugugaaaucuuuacauguauagucaugugccacauaaugacauguuggucagugauggacugcauauagacuguggucauguguguuuauaauacuguauuuuuacuguaccuuuuuuauguuuagauacacagauacuuaccauuguguauuacucucuucgucuccagaccuauaaaaaaagguaguuuaucugcacccauaccaguagacguauuaauuuuuuuuaguuauuggcaauucauuggugaaaaaaauuuuauuuuauuuauuuauuuguuuuugagauggaguuucaaccucuuguugcccaggcuggagugcaauggcgcgaucucagcccacugcaaccuccgucugccggguucgagugauucuccugccucagccucccaaguagcugggauuacaggcaugcaccaccacacccagcuaauuuuguauuuuuaguagagaugggauuucuccauguuggucaggcuggucucaaacucccgaccucaggugaucugccugccucagccucccaaaguacugggauuacaggcaugagccacuugcacccggccuaaaacuuuuuauauugagguauaauuuacauaccacaaaauucaccuguuucauaaguguucaguauuuuuuaguaaauuuauaaaguuauguuguuacuaccacaauccacuuuuagaacauuucugucacccaaaauauuccuugaaccaauuuguaaacaauccccuuuccuaccacccauuauggguaaccaguaaccuauagauuugcccuuucuugacauuucauauaaauggaauaauaacaaaaaugaccuuaaaauguuauugagguacauucauguugcacuaccugucauuagcuuaaucuuuuauugugauaaaauauacauaaaauuuaccauuuaaacuguuuuuaaauagaccauucaguaccauuaaauacauucacauuguuguauaacuauuaccacuuuccaucucuagaacuauaaaaauugucccaaacugaaacuguacccauuaaacuauaacucccaaucacgucucccccagucagugguaaccaacauuguuucugucacugugaguuugaccauuccaaguauuucacguaaguggaaucauacaauaucuguccuuuuguaguguggcuuauuuaauuuagcauaaugucuucaggguucauccagauuguaguauguaucagaauuucauuccuuuuaaagguggaauaauacucucuauauauacauaccacauuuuguuuauccauucauccauguauggacacuuggcugcuuuuaugcuuugucuguugugaauaaugccacugugaacauuugcguacaaguguguggcauauguuuuuguucuuuguggguagaaaccuaggaguggaauuucuaggucuuaggauaauugcauguuuaacuucauacgaaauggucaaacuguuuucccaaguggcuguaguuuuuuacaugcccacuagucgugcuugggaauucuguuucucuucacccucaucaaaaaucgguguggucagucuuuuaaauuuuaaccauuuuaguggauguggagugguauucuauugugggauuaauuugcauuuccuaaaugacuaauaacaacucugauuuggaaugcuuaauauccuacuuuucugacuguagccuccugucauuccaaugcucauucuccuuuucccagcacguuuauucuuaagcuuuaagcuuuaucaagauuucuggucccagcaccucuuguuucauucucuccucuagcuucaguucccucuucaaucacuuuucuuccaguauucuuagcuuugaaucuuugcccaguuuugccaucuacucugcuucuaagugcuaucagaggaaaucauauaguuuuguuuugacacuacuaugaauuuuuuuguaacuuuuaauuuauauuuauuuucaaacuuuuacauaguuauugcauguacaguacaaggagcuuucauacaucguuuuucuagauucccaauuguuauacuguguccuguuugcuuuaucauauucuuacuuuccuuggggguguauuaugcaugcauauauaaaaauuaaauuaguaugcacauacuauauaugcauuguauauauaauacauaugcaugcuauguuuuucugaaucauuugagcauaagcuggagacuuuuaccccuacauacuucaguauauauuuccauagagcaagaauauucucuuacacagugugauuaaguuaucaaaaucaggaauuuuaacuuuuaugcaauaauauuauuuaauauacuguccuuauuuaguuuugucaguugucucaacaauacccuuuauagcuuuuuguuuugguuugcuuuguuuuuuuaagcuuuacuacaaacuuuauacuuuacaacuccagcuuggacuuguccauccuuuuugauccuaacccucuaccauuuuucugugugcuuaucuuaaaccuucucuauucuuuaagacuuuggccgagcacagugugguucaugccuguaaucccagcacuuuuagggccaagguggguggauuaccugaggucaggaguuccagaccagcuugaccaacauggugaaacccugucucuacuaaaaauacaaaauuagggggugugguggugcacgccuguaaucccagcuacucaggaggccgaagcaggagaauugcuugaacccgggagacggagguugcagugagccgagauugugccacugcacuccagccugggcgauaagagcgaaacucugucucaaaagaaaaaaacgacuucguccucacucuuuccuuaugcuuuauuguuaccauugacauaauuuugugaguuuucucaauuuccugccccuucuuuuccuuaauuuacaaauaccuguaucuucauuuacccucuuuucuuuauggaagauaaauucuuucuggauaagaaaauucuguuacgugugcuguagaucauugcugucuaauaugguaguuaguaguggcuauuuaaauuuauuaaaacuuagcuccuuaguugcacuagcuccauuccaagugcuccguaguuccacagggcugguggcuacuuaauauauuggguagcaccuuucuagauucccuucuuucccaacauuugagggauuuuucuuuaucucaucuuuauccauaauagacccaccauaaucuugcccuugcuuaucucaguauccucaucucaacguguacuguacuucagucacaguaaacuaccagcauuuucucuaaauacauuguuucgggcccuuuucacuuuuacagcuguuaucuucccacaucuuccugaaagaccuacucauaauugacaacuccuucuguucuucacugaucacaccagauugcaauaauucaacauauuugccucuuguaccaaagcugugagauccuuugugaguaggggccauauucugucuucgugugugaguguguguguuuuuuuuuuuuuuuuuuuuuuuuugagacagagucucugucacccaggcuggagcaguggcacgaucuccucacuguagccuccaccucccugguucaagcaauucuccugucugagccucccgaguagcugggauuacaggcugugccaccaccuggcuaauuuuuguauucuuaguagagaugggguuuugccauguuugccaggcugauguugaacuccugggcucaagugaucugccugccucagccucccaaaguggugggauuacaggugugagccaccacucccagccuagccuuuguguucucuugaccuagcauucaacuauauguugaauugaaaugaauauguaaucucugccuucuagcugcuuaccauaggcugauugaugaucacuuguauagacuccauugccuguggaaauggaauagcuuuccuuguaauacugccugagcucugcuuuccacccaguccguuuuagccuacuugagcccuggaccuugacugcugucuggaugcuugaacuauguuuuccuuuuuauuuuucuaaucaucuagaauccagccuaacucuccacccuucuagguauuuauauuuuaagaguaucagucuacuugugacucuugagugcacuauguagaaucaugguaucauguuuuauuuagucuguaauauccuucauccucauucaaaauauuaaggugagucucccaccauaaaccaaaacaauccuuucccuauaacgaagcuaaucacuguauaacuucucuuccuuguuucuauuuguguuguuucauauuauauugugacuuguuaauuugucuguuuuccugaguagcagccauuccuuauucaaaucauacugcucagaaacuuuuucauuucagcuuacguagcuauuaaguaguaaagcaagaauuugaagccagauguacauuuuuuucuguauccucaguaucugauaguaccuaaguacucaagaaaugccucuugaauugaccagugaccacaacucugucagaaucugcauuucauucuuuuugaugucuuagcauguucaggugcuugagcuuuggagucagacucucuggguucaaauccuugcuuuacugcuuaccagcuguuugaccugagcaaguuccauaaucucuguaggccucaguuuccucauucuaaauaguuacuacuaccuuuaagggauauugugaagaugaaaggagacaaugcagauaaaacauuuaucaugggaccccucaauucuguucuuacuauuuguccugcaauucugacuuaccuacuagcucuuaguuaauccugcuccaugcucaucccauguuuuuguuuguuuuuuuaacuggcagagccaaugagacaucuaagugaauuucuaguaggcaguuagcaaaaacaacccuggagaauggucugagaaagagucauauuugggggagauuugcucagaacuccuauuuagaacuuugaaaccugagcuaauguauauaaaaagacaaauagcaggugaugggauuuugagauaccauucuaggagccauguaucuucaggcaacccaguuuucaaauauuuuuuauuggucuucuaaauuuuuggaauauuuuagaaauaauaacuuuuugacacccuuaaaauacagagucacacauuuggaaguagcacaaaaauuugaacugccucuuugccgcaacccacuagagguuuauguuuuucuacugaaauauucuaucuuguugaaucacacauccuagguuuugauuuagaagauauggucaccauagguguuacuugacuuggccacuaggaggaagagaaguugccaaaggaaauucuugcaaagaaagauuucauuaguaucauauuuucuauuuaguuguuaaggggugugugugugugugugugugugugucgggcacacgugcacauguguaguuucucacccuauuaggugauuuuauaucagaauggggugagaaggaaggaggaggauguacgugaaaaucuagagguguuauugagaagacugaguaccacaaaaagcucugaaucuggaugccuaauggaugguuuguaugugauuaaacuccaagccauacuucauucuucuaaucauuuugguaguuuucucagaauaaucaaauguucuuuugaaagaaaagguaaccaggaccuuucguucauuugcuuucgcagaguuccguuuagauaaaaugguuaauuuuuauaauguuaugaaaacuaaaaagugaacuauuuuagagaaaaguaacacugaagauugccaguuugccaucgguauccuugauuugcucuucuucaucucuaauaacagauacaaauuuuuaauauauuuacuauuaaaaaaaaaacuuuuuuuaagagacaggaucuugcucuugucaccccagcuggagugcagacgcacaaucauagcucacuguaaccucaaacuccaggacugaagcaguccucuugccucagccucuugaguagcuagcacuacaggcacgugacgccaugccuggcuaauuuuaaaauuuuuuguagaggcagaaucuugccguauugcccaggcuggucuugaacuccugaccucaagcgauccucucaccucagccucccaaagugcugagauuacaaacaugagccuccguaccuggccaauccauauauuuaauaucucacuuugacuguuaauguuaauagcugauaacauucuugaagguagacauuugcucccugauaaugaagaaaugcuuuguuucugaguagaggugauguuuuuguauuuaguuuucuccacauauaucugucccacuugcaauggauaguauuuaucugcaaaacaacuguuaacuggaaugaauuaucaaagaagauuuauagaaaaaauuugguuuguuggugguugggaaaaaaaaaaucaacuggccagcaugguggcuuccaccuguaaucccagcacuucagggaucaagguggguggaucacuugaucccaggaguucgagacaagccugggcaacauggcaaaaacccaucucuacaggaaaaaaaaaaaaaaaaaaaggauugcuugaggacgggaggcggagguugcagugagccaagaucgugccacugcacucuaguccgggcgacagagugagacucugucucaaaaaacaaaacaacugcguauccucauuaaacaguauaauaaacugaaugugcuauuuaaaacauaucaguuauucauuguuaacauguuuuauuagagggguaguaacguuuuaauuuauucaaaguucuaaaugguaagagagaggggggaaaguucuugucucaucauucaggcugaauuagugucuuacauuuuguaucccucaaggcugugcacguaaucaguggugggugaauggguucauugacgguguuacccuggaauguuuuaccuuggcaacauugacacacuauaauaccaauagaauuuuuaaaaauuguuuaaauuugaaggcuacucuuaaaaauagcuauuauuuugagcauuuuaauuuugugguaaagaagcaaaaauguuucaaaugaauuauauuaaaauacuuuuauauuuagcucucugaagaagucuuuuggucucaaaauacccaauuuacuguaaguuaauauuuaggcuuuauguuuaaauauuggcuacuacaauuuuuuuuuuuuuuugagacagagugucgcucucucacccaggcuggaaugcaguggcacgaucucagcucacugcaaccucugccuccucgguucaagcaauucuccugccucagccucccgaguagcugggauuacagaugugcgcuaccaugcccagcuaauuuuuguguguguguguguguuuuuaguagagucgggguuucaccaugcugaccaggcugguuucgaacuccugaccucgugauccgccugccucggccucccaaaguacugggauuacuagcgugagccaccaugcccaggcaggacuuucuuuuuuuuaaauauacaaguuuuugucuagaaaaggaacucuuuaggaacuugaauuauuuuguaauauaaauguaauagaugagcaagaagguuguauuugagguguggggagggagguugcuuucucuauauucuuucaaauaaucggaaaacaugaagaagugauuccuggcugggcgcgguggcucacgccuguaaucccagcacuuugggaggccgagacgggcggagcaccgaggucaggaguuugagaccagccugaccaacauggugaaacuccgucucuacuaaaauacaaaauuagucgggcaugguggcgcaugccuguaaucccagcuacucaggagacugaggcaggagaaucgcuuaaacccagaaggcggagguugcagugagccgagaucgcgccauugcacuccagccugggcaacaagagaaaaacuuuguuucaaaauaaauaaauaguuagauagauaacuuaauuuggaguuuuuagcaaggagacacacuugcuacugccuucucaauggaagaauagcagagcuuuacuggagaagucuugucucuguucuuuaauuccaguguaguuucgggaagggugcaguagaauaauaagauugggaggagguagacauucaccugacuuagaucugugagucauaccuuaucaucaguggaaagguuuaugucauuuggcacuuacauuugguauuuuaaacuggagcacuauuuauuauaacucagucaucauaaaucaguuuaaacugcuguuggauuggauggaguuuguguguggaaacaagauaaggaaucugguucuuuuagcuauuuagaauccuuggaacaugagguucagaugcuuaccagguuuuauuuugcaauaauucaaauuuauggaagguuaaaauagacauguauuuccuaucccagucccugggcuggcaacugaacuaggccugguacuagucuguggccuguuagaaaccuggcugcacagcaggggagcgcgugggagcuggcauuaccacuugagcuccgccuccugucagaucagcaacacuggauucucauaggagugcgaacccucuugagaacugcucaugagagggaucuagguuacacacugcuuaugagaaccuaaggccugaugaucugagguggaacaguuucacccugaaaucaucccgcccaccccuacccccuaccccaaaaacacacacggaaaauuugucuuccacgaaacuggucccuggaccucuuaguaagauuaacccauuguuaacauuuugugcuauuuacuuauucauucucugucauauuauuuuuuucugaaucuuuugggauuaaguugcuuacaucauguuccuucaccauguaauauuucaauguauaguuuuaacaacaaggaccuucucuuguauaacugcauuacaguuauuaaauuaaggaaauaugcaguuaucuaauacacaguccacauucacauuuuacuaguuuucccauuaauguuuuuuuucuuuugugugugagacgggguuuugcucuuguaucccaggcuggagugcaauggcucacugcaaccucugccucccagguucaaaugauucuccugccucagucucccaaguagcaaggauuacaagagugccaucacgcccggcucguuuuuguauuuuuaguagagaugggguuucaccauguuggccaggcuggucucgagcuccugaccucagguaauccaccugccucggccucccagauugcugggauuauaggcgugagcccaauaaucauucuuuagggauuuuuuuuuuccuguccagaauccaacccauaaucauucauugcauuuaguugccacaucucuuuauucuccuuuaaucaggaacauuucuucagccuuucuuugccuuuaaugacacugacauuuuugaagagagugacagaccauuuauuuguagaaucucccuuaauuugaguguaucuaauguguucucaugauaaaauuuaggaaugugguuuuggcaggaauguuacacuugugugcuuuucagugcaucacauuaggaggcacauguccacuuguuuccuuaucagugauacuuacuuagaucuuuagguuaaugugauaccugccagguuccucuacuuaaguuaauauuucuccuucuguaauacauaauuugugggaagacacuauuagacucaauauauaccaguccucaucaaacuuucauucacaaagaguuuuaacauucuuugguaacuuugucuaaaucaaauuauuacuagaugguaauaauucagauauuuaauggauuuagauauuuaaccggguuuagguauuuaauuguaggagcucaguaccauaguaggaaccgcuuugagcuguuggauucuuuagcauuauaaagugcuuuguguugaacaagaaugucuccugagacuucuauacacuguuucaaguucuguacucuguaccacgugagaugagccugcuuuauuugugucucucuaacugcccuucaaaauguguucuuuuuugucuuuucgauagguuacuugcuuuaauuucauauagucacuucuuguaagagaugacuuuccugaauuuauaaccauccuguugguuuucugauaacauucauucaucaguaucacacuuaacauaugguauccaaaucuggauacuaauuccagauacaguuugaucuaucaguacaauggaucacuguuugccuguaaucuagcuuuaugcucaagagcaccagguuuuggagacaaauagauuuggcuucagguccuagcucugccacuuaacuagcucugugaucuugaaccaguuccuaacaucuccaaaccuguuuugucaucuguaaagaguugguaauaauagcaccugacuuuuaaggauggaaugaagauuaagcgugcauguaaaacucucaguggugucuguuauaucguaaacaccuauaaaauguaaauuauuuuuaugcagaaagcaugcuucuguuuuauugcccaagauugguacaguuuauguuuuagcccuuguacugcagacucauuuaagccugcggugaaaucagaguuuuaaucaguucuacugaagcaaaguuagacacuuggacaaauauuuuaacuuauuaugauagaauaccuuucauauaacucuuaugagauuuugaauuauuuuuaaaauauucauauguaccauauaagucgauuauagagaaacauuugaguuacuuugaauaaacccuaaaacaucaagucaucucuuacagcauagcaaauguuaaauauuucagcauuaauuaauaguuuuaaaauuagucuaugaaauuggaguguuugggugcuauuucucaugguguuuuugaauuauguugcuaauauaaacaguacauuuacuauguucaugacaucuuuaaguuuuuccuaaaauuuacuauagaaauuuagaccaauauacauauuagcccaguguacauauaggggaaagguauagcccaguguacauauaggggaaagguaguuaucucaguauucuaggauguuuuaauugaaguguacauauuuugcuugaaguuuacuuacaguuguauuaaaaaaugcaggugaauaggaaaugcauugaaacaucaaagccuagaaucuuucucuguauuguggcuuucugauacuguuauacauuaaaguuuagauauaauguguuagauuuuuuuuuuuuuuuuuugagacgguguuucccucuguugcccaggcuggagugcaguggcaugaucucagcacacugcaaccuccaccucccagguucaagugauccuccugccucagccccucuaguagcugggauuacaggcaugugccaccaugcccugcuaauuuuuguguuauuuguagagacgggguuucaccauguuggccaggcuggucaugaacuccugaccucuggugaucugccugccucagccucccaaagugcugggauuauaggugugagccacugcguccggcaugugucagauuuuuaaauggcacuuuuuauguagcaauauaaauuuuuuuaaaaauuaaaucuuuuggccuggugcaguggcucaugccuguaaucccaacacuuugggaagccaaggcagguggaucaccugaggucaggaauuugagaccagcccugccgauauggugaaacucuguuucuacaaaaaauacaaaaauuagccaggcgugaugguugggugccuguagucccagcuacucaggugacugaggcaggagaaucucuugaaccugggaggcagagguugcagugagccaagaucgcaccauugcaugcacuccagccugggcaacaagaacgaaacugucucaaauaaauaaauaaauaaauaaauacauacauuuauuuuugcagugcaaacugucauuaugacugccuauguaauacauauuugcuaaugggauggagaaacaaagauuuuuaucuuguaauuguaguucuuaauuuacagacuuucuguauuuuugguauuuugaaaguucaguuuaguagaauaguuuuuuuuuuuuaugggaacaagguuuuauuuucuaggcaaggcuucuaacacuugauuaaccuguaguaauaaugguacuguagaaauuuuaaucugucaagaaaugugcuauaaaccauagaaaaugucagcaacauggcuccuccugcugucacaaaacaaucucauucucccuaguccggugcuaugacauguauacuugagacucuaaaggcauuccacugacuguugguaaaaguguucuuuaguugguagcuguuuauucuaaauaaauuagcuagacuuaaggaaaacagaaaaauaccuacuuuugcuuacuuuggauaaaaugauuauauaaaguaauccuuacucaccuagucuguggccagguauagaaaaucuauggauuaguuauaugcauauuguuaauaaugucaaauaccaauuggaauguuuuuauuuuucacuuuuucuucagccacccuuuuaaccuagcuauaauagcgaaagcacuccuuaaaauuuuaggugguuaaaaugugguacguaaauuuuauaugucucaacucuguuucauguuaaauguguuacaggaaugaaucugaagucugcugcaguaaaacacagaaggcuuuaaaauguuuucuugcauaaaauucaaaacuuuuaaguagcugcuuaugagaauagggaaggcagaaagcuaaugucugucucaagauacaggacagcuguuugcucaucaaccucaacugugugaguagagacuuaagccuguaacccuauguaauugggcauaguaacuuaauuuuuuuuuuaauuuaaaaugcuugaagauagaccuaagucaucaugaugagacauuuuuaggguguauuuuuucugguggguaggauacugaggguggagugggugguagauuuuuauuuauaaaauaauuugugcaauaacauuuauaacuaauguuauuagugacuacacaucuuuuuucagaauuauuauaagcauuggaaucugcauuacuaauuuauuauugugaagcaaaagauuguaauucuuuagauugcuguuuauuuugcauugauuucagccauuuaaaguuaauauuuugaccaaacaaccauaaaaaaauuacuugggauuaugauguuugauauuaauagagaaaauugcuucuggaaauaauaauuuaaauuauaauaauuuuaaaagcuaauauuuuaaaaaauaacuucauuuagucaaagaguauaucaaaauacaagcacccuuguucccuaaaugcaguugaaaguuuuuuaaauucgccaauuuuauuuuuuaaaguacuuugaauaauagaaaugccuauggaagaaaaaaaaucuccuuuucuuuccuuuaagguguuaaaguuaacaccuuaagaaucuaugguaggguggugucugguuuuuuucuacccuccuccccccgacuuuuucuuuauggauuuaggagugagacucuuaauuggauguuuuuucucucucuuuagaagaaugcauuguuuguacagauggagugauuaaaauguacagcauuguauugagcaaaaugaugagcauguagacagagacuuauaaaaucuuguuaacuguucacugaggcauggaguagaaggaauguuaugcaguguaugcacuaaaaugaaauuacuuucucuuucauaacacaaauguguugacugaaggaaaauaaaaauggacuaucuuuagaaucagugaaugagaaaacauuuagaaaacgugaagaauacacacugaauauggauauccuuuuuuuuuuuuuuuucgagacggagucucacucugucgcccaggcuggaggcaguggcacaauuucugcucacugcauccucugccuaccaaguucaaguaauucuccugucucagccuccugagcagcugggacuacaggcaugcgccaccaugcccggcuaauuuuuguacuuuacaaagaggugggguuucaccauguuggccagucuggucucaaacuccugaccuccagugaucugccugccuuggccucccaaagugcugagaugaccagcgugagccaccuugcgcggccgaauauggauauucauaaugaaaguggucaaaggauauguggcagaaauggagggacacauguugcugcauucaaaacuagugaaaaacccaaagguuucacuuugccccauuauuuucuuuucuauauuggucaguagauacauaacacuguguaaaucuccagagguuaucuaguuccuaaucuuucaguauuucuagagaauaaauauuuauaaucuuguuuaaugauuacaaggcucacuuuaaugcaguuuuagggucuguaaaacgaaauuuaauucuuaauuuacugccauuuggcauuucccuugaaaagccaaguuuaauuuggugcugcuauucugugaacaguacuucaacacccuucccuccucuuuuuuaauuaguguuaaaaauaaggaaaauucaaggugagagaggccuuuggaacauacuaaugaaacuuugauuuuuaaaaugagauuaggagagaacacacaauagggaagagaguugcuuuuaucacuguagaggguuuagggggaaauuguaugauaguaaauuggucccaaauuucuuuuuaucucucugagaugauucucuguguucuguucuauauuacucuucucucaaggggauaaaguuagaagcuaauuaacuuuccuaggauagaaaguacauguaggaauaugugagcaacauauauaaaacucaucuacuuuauucccucuuccuugcucuacccuuuaccuuaccacaauaguguaggcuucucauugauccuguacgaaauucugucauuugguuuugcuuagauuuuuaaauguauuugagcuuguuuuacuguuguauaaugcaguauauuaaaaugaaguuuuugggcuauauaaggccauguaacauggucauguacacaggcuauagagucuggcugccugaguucagauccuagcugucccuucuaacaucucugugauacugagcaaauuucuuaaaccuuccugggccucaguuguguaaucuguaaaauagauacaguaauaauuugcuaccuggugggauauugugagguugagugaaucaucagugcuugcaaauuauuaucauuauuaaaccuguuuguucuuugagaggaggaauacuagguagcauauuauaaaugcucaaaauaauagauuuuaaggcuuuaggauuaagaauuugaacauuacaaaguaggauauuuucaauuaagguaucauaagaaacaucucaagaagaguagaauagaaaucuuuacucccggcugggcgugguggcucacgccuguaaucccagcacuuugggaggccaaggcggauggaucacaaggucaggaguucaagaccagccuggccaacauaaugaaaccuccgucucuacuaaagauacaaaaaauuagccgggcaugguggcuggcacuugucaucaaagcuacucgggaggcugaggcaggagaaucgcuugaacccgggaggcagagguugcacugaguggaaauugcgccauugcacuccagccugggcgacaaggcaagacuccaucucaaagaaaaaaaaagaaaaaaucuuuacuccccugccuuccugucucaaucugcugugugcauuagccccauuucacauucucaguagcuacaugugacugauggcuacuguguuggacaacacuguucuagauaguugguuucacuagguaauguauuugcauuaaacaugacauuuauugaugacacaauucucuuugucuggaacaugaaagauugguucuuguaucagauauaacuccaccaagaaagagaagaggaagcaaaaaauauuucuucaagaaucuuggugaagguuagguguauuuucucuggguuuuauguaaaguguuuuuuuuuuuuuuuuuuugagacggagucuugcucuguggcccaggcuggagugcaguggugcgaucucggcucacugcaagcucugccuccuggguucaugcccuucuccugccuuagcuuccggaguagcugggacuacaggcuccugccaccacgccuggcuaauuuuuuguauuuuuuaguagagaacgggguuuuuuagcauguuagccaggauggucuugaucuccugaccucgugauccgccuguuucggccucccaaagugcugggauuauaagcaugagccaccacgcccggccauaaagugauuuuuaaacaauuuauaaaauuuauuauaguguaguuauuuuuauuuuucauuuuuauuuuugagauggaguuucacucuuguugccgaggcuggagugcaguggcaugauucuccugccucacccucccauguagcugggauuacagacgugugccaccacacccaacuaauuuugcacuuuuaguagagacaaaguuuuaccauguuggucaggcuggucucgaacuccugaccucaggugauccacccgccucccacucggccucccaaagugcuaggauuacaggugugagcccccgcgcccagccuugcaguuacuuuugaauaaagguauugacaguugagucaagcaguguugcaaguauugaagucugucagugacugcuucucagauuaaagugagccaucuguuuauaugugauauggagaugaaaacugauuuuuacauuuaaaugcuaguagauuucuuaucuagaagcaccuuugaagacuagcaauguuauggguggcacauuaauuuagagucuuucaggaaggacuagguuucaguuagugguuuuauugugagauaaauuuaucuguuugagaugauuccacuaaagguuaaaaguagucuggauuucagcacugauaaucacuuuuacuuugugcuuagaaauaguguagguguuaggggagauaccaaaggauaggaacaagcuauuaauguuauguucuaaaagaaaucacuguuuacuggauucuagucagggaccagaacacauggaaauagaaauccauucuaccuaaggaaagaaaaaaggauuauuuuaaaaaucuuuggaaaaucauauguaauugaauugcaaguauauagccuugguacuuuuuaugugugugcuauucugucuccuccccaccuccauccaugacuuuagauagguucaucgggucaguguucauccaggucuaaucaccuugucuggaggguuuaucccaugguacuaaaaggucagcaagagcugauuuauagguauacagauugucuuagaagggaauguuaguagggaggcagugaauggcauguguaacuucaguuucuucaacugauuacaaaggaacgugugugagaauguuaccuuccuuauacagauuuggugaggccuaagucagauaaucuauauaaagugcuuagcccagggccuaguacauaauagugaguagacauuuucagugagcacuuacucuaauacauaccuaauuguguaguuuccuuaccugguuuuuuuaauuuagggaaaaaauuuggagaauuuggugggauuaauugguaacuuguggauauucacucagaacaucucaauucaaagugccugacugaaauuuaacucuuguaacuagcggccuagauaugcucugaaguguucaugguauaguauaucagcccgaccucagauuggcuuacuguugagcauuguugaguuugcucuuaaucaagaacuuaaaguguccaaauuuuuuagccaucugagccccuuuauuuaauugaaaucuuuugcagaaaccagguaugugaaaacaccaaaaaugaacuauucuauuugaagcagaaauuuguaacccauucugccuucucagucugcuuucucccuacccuuuuccucugccucagcaaucuuugauagaacaaaagcagacacuuaggagaaauaaacuuuaugaaggauugccuaaaugauaagccugaaugauaaguucauuauuauuauuguuuuuuuaagaaacaagagucuugcucugucaccuaugcagggguguaguggugugaucucagcucacugcagccucaauuuccuaggcucagacgguucucccaccauaggcuccugaguagcugggaccacagcugugcaccaccacacccagauaauuuucuuauucuuuguagagacggggaucucacuguguuguccaggcuggucuugaacucaagcaauccucucgccuuggucucccagaauguugggauuacacacgugagccaccgccccuggccggauuuuauuuuuaacucuggcuccacuccaugaagacuggcuguuaacugaagguggccaugagacuauugauuuauauuagaacuaaauagccagaggcugggugggcgguucacgccuuauaaucccagcacuuugggaggcugaggcaaguggaucauuugaggucaggaguucaagaccagccuuggccaguauggugaaaccccgucucuucuaaaaauacaaaaauuagguaugguggugugugccuguaaucccagcuacuugggaagcugaggcaggagaaucgcuugauccugggagguagagguugcagugagccgagaucgcaccacugcacuccagccugggcgacagagugagacccugucucaaaucagucagucagucaauccauccauccauccauccauccaucccagaaacuuacauuuuacuuuucagguauuauugaccauaucauuuuguguuuuacuuguuguaaacuauagaugaaauccucuuauguuaucugggguaauauuucauuguacuuuucuugagucgcugauuuuguuuuucuuaaguagucauauucuucuuugcauuagcuccuugaaagaauagaguugaauggcuuccaauuagcaaauaggccuuuaugggcauacauuuuauuuauugacaguauuucuaacuuauuuuuuuuuaaccauuuuuacuuggauugacuauuuuugccuacuuuugauaucauacagcaugcauuuuuaaagucaccuagaauucuuuucagagcaauuuaaaguauauaaaaaacaguaauauuuagugaacagcacuuguucuaaaaagcuccccuuuucauucuaagguggugggauucccuguugcuuguggguuuaaguucagacuccuuaucauggaaacacagauuuugugauguggccuuauucuaagaucauuucccacuauccuguagucuaggcacacagaagucuccccugguagaccacauacuugcuuuuauccuuccuuuacaguuauaaauauugagcguaagcacauaguaaauuuuuguugccaguuauccagaguaauugauacaucauuuuauaaacuuuugagaggaggauguuagaaaccauuccaucacacuuuuaauaaaaaacgguaucaucucagguggaagugaggccuauucacagaucuccuaacaggugauuacugucucuguggcaaggagaacuuuuaugaaccugcccuuugugagcuauggguaaauaaggagucuuggauuuaugacugcagcuacuauuaaauaguggacaguuugaaccucucucucucaugaugaacugcagauaugugacuuaaauaagccacccaauucugaacugagcuuuauauugcaacuuacggguuaaaguauuuucacaaucaccgucccaguugacccccucaaaauucuaugaguuagaaaggacaggcaucauaacuaucuuaaaugaaguacuucaggcuaagcacuuaucuaaguaggaaguuuauauucacaaccaacuugaagaugagucaguucuuuuuucuuuuuacuacauaucaaguugucccuguauauauaacaguuguuuugcagugauuuguaguuaaacuuccuuucaugaugcauuuguuagucaucccuacaagguguguuacguuuuaacugaaagaaaaucaguuucugaaguaucuugcaaucauuucuggcauccauuuuuauauaccucuaugaagugagagugguguauucuaaaacuuugugguuuugauacuuaacauuuugugguuuuguggcuaauaaaguuguaauuuuggaguuagaugugauguuugugcagauacgugaaaaucagacauuaguauuucuguucuuguaccuacauugaugagagcagaacuguguguccuaaauaucuuuuacaguguuuaauagcuagcggagugauagguacgauaaguuuaucaagauauccuugaacaaagagcuaugacaaaagaaaguacuugcuuauagucauggaauuuugcuaugucuuuccugauaauaucucuaaccaaaauaguugugaaaucauuuauucauccagcauguauuugaguaccuccuaugugccuggcauuaaucuagagcgggaauuggccaacuaugacccacucaccaaauccauucuagucaccccuuauuguaaauaaaaguuuuauugaaacacagccauuccuauucauuuacuuauugucuguggcuucuuuuuuacuguaaaggcgaaauugagcaguuaugacagacucuauggcccacaaagccuagaauaauugcucucuggugcuuuagagaaaaaauuugccagcccuaaucuagagugcugggaauauaacucugaaaaaaccaaauaauuuuuucaguauguuaaauuuguuuuuuuuuuuuuugcuuccauauuauaggcucuuugugccuagaaacuuauuauuugcucauuaugcauauuuuaauucauguugaaggacaguguuauuacaaguaaguuguuuuccucugaauuuguguagguaucuuuuuccucaguaacccuuuucccugaaaugggagacuaauuaagaacugugugccaaaaaccucugcaaggauagagacuucaguuuccaguauguggauaagaaacuagauugaggaaggcuuuacucuggggugacguaucucaaaauaggugaaagaggaaaaauacaaugaaguguaaucagaaucaagauuuaauaaaagggccgggcgcaguggcucacgccuguaaucucagcacuuugggaggcugagguggguggaucaccugaggucaggaguucaagaccagccugaugaacauggugaaaccccgucucuacuaaaaauacaaaaaaaucagccaggcaugguggcggacgccaguaaucucagcuagucgggaggcugagguaggagaaucacuugaacccaggaggcaaagguugcagggagccaagauugcgccacugcgcuccagccugugcaacaagagcaaaauuccgugucaaaaaaaaaauagauuuaguaaaaauaauuuguuucaucaggaauacucagcaagugaaacugguuuuuuguuuuuuaacugugagaguauggugaugaauauaaugacuacuauuagguagucauuacauaaugacaucaccauauuaugugacaucuccuugucauauaacgacaacuguacuauuauaguaugguuuggugccgcugucuugauggcauguuaaagcucuagcuguuuuacccuucauugcuuuuacacugccaaugcaaaugucaacacagugaauaagacgaauaacaaguucuuguuauuaugaaaauaggggcugggcgcaguguuucaugccuguaaucccagcucuuugggaggcugaagcgggugggucaccugaggucaggaguucaagaccagucuggccaacauggugaaacccugucucuccuaaaaacacaaaaagucaugaugauaggcaccuguaaaucccagcuacucaggaggcugaagcaggggaaucacuugaaccugggaggcggagguugcagugagccaagaucgugccacugcacuccagccugggcaacaagagcaaaacucugucgaaaagaggagaggagaggggagaggggaagggaggggagaagaugggguugggagggcagcggggagggggaaggaccucugaaaggaucucaagaauccccaggaguccacagauacgcuuugggaacuacugauuuagaguguggacuccagccaacugcuuggguugaaucccagcuccucacuuacuagcuguguguccuugaacaguuuauuucucuguaaaaugagagugcuaauaguaccuacuuaauaggacuauuaugaggauuaaagggauugguauuuauaagugcuuggcacauaaaguucuauauaaguauugcucaguaaaugguaaagcaaguuuucuucuguaaaaaaugugcaguuucaugagcagaaaagauauaaauuuagagaaugaccauauauuaaacuuuaaaauuagggaaggacauucauuuacaauugaagauuuaccuuagggggagaagagauuuuuuaaaagguuuuggguggagggguuggggggaaguacaaagucuacauaguugaauuaaaagcuuuaagggcaaagagggaauaaaaagccauagauagaucgaucaaucugugguaaucgugagaagaaagagaaugaauguccaugaauguggaagccagugggaaaauuugaacggguuccucuuuuugcaaauaagaauauuggguggccuugugcugguaaaaacugugccuuguucuuuaagguaugugauaugaaaccuaggucaguuugagaauaugaaauucacugcaacuuaauuuuacuaauagaauuacuguuugguaugcuaaauuagucacauugcuaaaugaaccucuuucugaguaggcugaauggaaaagaugcccaaaagcuuggagcaugaggccaggcauccuuguuuuuuuguuuuuuuucuuuuuuuuuggagucucacucuguugcccaggcuggagugcaguggugcaaucauggcucacugcagccuccgccuccuggguucaagcacuucugccuuagccuccagaguagcugggauuacagacgccugccaccacgccuggcuaauuuuuguauuuuuaguagagacaggauuucaccauguugacuaggcuggucuugaacuccugaccucaagugaucugccugucucggccucccaaagugcugggauuacaggugugagccaccgcgccugcaggcaucuuuguucagugcaugaacuguauagucauagguggcacaccuugcugacagaucuagaucucuucuuaaacagcaaauucaauuucuuuaaaaggagccuuucucguuuuuugccuugggauaaauccuuggcuacuagugguggugugcagguaagguggcagggcaguuucauucauacauucaaucaauauugaaugccugccauuuaccaagcauuauucaaagcaucagugaacaaaauggacaaaaucccugccauuagggagguaacauuuuagcaaaggggagacacaauauaauaguaaauuaagauuaggauaaggacguugaagaaaaauaaaaccggaauugaugcuggggacaauuuuaaauaaguggcaagggaauuccuccuugaaaaagguaacauuugagcagagaccugaaggaggugaagaaccuagucauaaggauuucuggaaaguagaaggaauagcaaguacaaaggccucagacaggaaaauaccugucauacccagcaacguguaugguaggaaggggaguaaaagaggaagucauguaaugggggaccagaucaugaagagccuuuaagucaagguaaagaauuugucuuuuaacgcuuuguaaguugggaagccacuggaagauuuugaguaagcaggcagugugauugauuuagauuuuaauaggaucacuggcugcuguguugaaaauaaaguauagcggggcaagaagcagggagauauauauaccagaagcuguguuaucaauugcugcauaagaaacuaacccaaaauucacuggcuuaaacaacaaauauuuauuaucucacacaguuucuguugggaauauagaagggccucagcuguaugguuuuggcccagaguguuucaugagguugcaguucacaugucagcuaaggcugcagucauucaaagauuugaucagggcuagagaagaucggcuuccugguucacucauauagcuguuggccagagaccucagcuacucgucacaugagccuuucucugugaaauggcccucagcuucuccagagugaguuaccaagagagaaagcaaagcagaaaccacagugucucuuaugcccuagacuuggaagauaugccauuacuuccaugguauucuguugaucucccagaccaacacugauaaaaugugggaaggaacugcaugaggccugacuaccaggaggcucagggaauuggggcagaccaccuaggaggcuggaacaaacagacagaaaaugacauuuaaaaauaagauacaccauuuauaguagauuuuaaacaaauaccuaggaauauccaaaagauaugcaagaccucaucacagaacacuauaaaacauuaugaaucuaaaggagaacuaaauaaacugagagauauacaguaguauuagcacaucuguagauucaacacaauuccaauaaaaauccuauugguuuuuacuuuuuaaguggaaauugacaaacugaaucuaaaauuuauguggaaaugcaaagagccaagaauagccaacacaaucaugaggaagauuaaaacugauacuagauaucaaaaaaaacuguauaauuuagaauaggauagagaaauaaaccaguagaauagaauagagagccuaggaaaagacccauacauguaugaggccuaaugugugggcaaagaugagacuguagggaaaagaugaucauuuuaguaaaugguuugggguuaauuagauauccauauggagaaaagcauuaaucuuaacucuuaaccucauuccauaccaagaaaaucaacucuagauggauugcagaucuaaaagugaaaggcuuagcuucucacaugcccagccuuggcucagguauucagcccugagacaggccuggcccugggaugggaggggucaggccuacccaagcaaaugaaauggucuuccugcaagaaauagauguucuauuaucuaaaagagcaaggaaagaaaacauaguaggcagauugaagcugucagcuucaguaauacagauacccuucagauucaauuguugaguaauuucauaauuaagacaccacagauauauuuagcuugguguucuaaguggagaugggauuguaccaaaaguguuacuaucauuuaucacaucaugguuauaacuccauauaaaucaugucuggggauacacauuuggaugagacauauauugccuuucuaauccuuucccuucauugggugaugaacauauaucagucaucccucaguaucugcagguauugguuccaggaccccccucaucccaccccugcagacaccagaauuuguggguucuuaacucuugcagucaacccugccaaucauuuggguaugaaaagucagucuuccuuauugacagguuucacauccugggaauacuguauuuucaaucugagguugguggagucgccgguagccaccuaagauaggaaugucaaucagaaguuuucuagaaucuaucuucagaugcaaacaauacaguggccucuuggugagauuuauuuuaccaguauaacuauauagcaauauaggauaaguauauagugauauauugcuauaaggaaauuuuucucauaaguuuuuaauaaaguuuucuuauaagugggaggggcucaucuuaccacuuugugcugugguacuaguucaaaguuuaaugugcauucuuauuuaacuaaacguguauuuuuucuucucuugaaacuaauagugaagauucccaaauugaaaaggccaaagauugcuuauaagaucagucagguagcuaaaauugaagguggucuugaaucggagaguacaggcucugccuaauagggccuuagcugauggguuuuaauuuggggaacaugaguccaguauugucagaucuuccuauuuuucaacagaagaaaucuggaaaaaacugcuguauaggccaggcauggugacucacaccuguaaucucagcacuuagggaggccgagggaggugaaucaccugaggucagcaguucgagaccagccuggccaacauggugaaacccccaucucuacuaaaaauaaagaauuagcugggcaugguggcacaugccuguauucccagcuacaugggaggcugagguaggagaauugcuugaaccugggaggcagagguugcagugagccgagacugcgccacugcgcuccagccugggcaacaagagcgaaacuccaucucaaaaaacugcuaugcagagaaacuacaaagcacagucaguacaguaguccaaaaucccuauacuuuuaucagagugacuagcauucaucccaaguguuuuguaucaagucauacuuucugaucuguuggcuuuaugagcauuccuggauuuuuuugagacagagucuugcucuguugcccaggcuggauugcaguggcgugaucuuggcucacugcaaccuccgccucuuggguucaaacaaugcuccugccucagucuccugaguagcugggauuacaggcaugugccaccacgcccagcugauuuuuguauuuuuaguagagauaagguuucaccauguuggucaggcuggucucaaacuccugaccuugggagcugccugccuuggccacccaaagugcugggauuacaggcgugagccccugcaccuggccagauuuuuuuuaucaucucugcaaaaagguuacugcugcuccuuaccaucccucaugucucuuuauuacccaugugauaguuggagauccaaaggcucagaacucggaauuacuguaugcaacaggaaacacuaaucucaagcaccuaugccaaguuagguaauuccucuuuuggucaguuaauaagaaaaaauuagaguguaccacaaauccuauuuugcacucuucugggauccauuugauacaauugcaaagagaauucacccauucugagcaguuaguuuuccagugauuugaaaaaaggcggagugugacaggagcucgucuuaccuuuguguaacacuuuguguugcggugucguacuaguucaaagcuuaaugugcauucuuauuuaaccagacauauuauguguauuuuuuucuuuucuugaaauuauuagugaaggucccaaaaugaaaaggccaaagauaacuuauaagaucagucagauaacuaaaauugaagguggucuugaauuggagaguacaggcucugcccaguagggcccuagcugauggguuuuaauuugaggaacaugaguccaauauugucagaucuuccuauuuuucaacagaagaaaucuggaauuacgugacauuccccaauuuuugaaugcuagcaacuaauuuuuuuaaaaaauaauagguacuggccaaucaaauauggcuaugggucagauuuaacugagguuugcuaguucacaacuucuuuggacuaauucaucauuauaaauuauauuuucucccuauuuuuuucgggaggagggagaaaaagaaugaagugaaaaaaaguaugcauuuuauaacugccuugggcuguuggucauucuugcugaauaacuguuucauuuuauaaauuaugaauauugcagugugaaacauucuacaucaguuuucuccccuuuucaacagaauauagccguuuuuugccugacaugaauacuugugacaauaaugaaguguguuuacucaacaaaauauuuugugggguucauguuaggcauaaagaggguuugaagaagaaacuuagaguuuagcugggaacagaguuguauaccagugagaagaaacuuagaguuuagcugggaacagaguuguauaccagugaaguauuugaguaaugguacaauuaagugccccaaaagagugguacaagcagcuuccuuaggaauauagaguagaagaggcuugagguggucagaaaggggcccagaagaaauagaauuuaagcugauuuccugaaguagauaggauuauuacaagcagaguacaaagguagaugggauauacuaaaaaaggcgcaauaugagcuagaagcuuguuuccaagagugagcaugauuuguuucaaucagauggaagcaaaagacccucugcuuuuaggaagaauagaguaagaacaguuauugaaauuuugcuaugugccacacacuauuuggaugcuuuucauaugcauuauuuaaucugguuagauaagugauguaagugcccucuuaguugaaaccagggaaauuuaguaacaaguccaagcuuuuacagguaauaaaauggcaaagcugggauuccagcugcugccgaccugacuccaagcccauucuguuuacauacagcauaguuucuagggaaauuaggcugcucggguuaaauuaugugaaggacgaaugcuagguugaguacuccucucugggacaauuauuauacaaacuaaaaccgaaguaauaugaugagaacuggguguuuuaggagaauuucaauaaauguauuaggaggaggggcaguaaacuguuaaaaauaacccagguaugaaaagcaaugagaaccacaguugggauggaaaauaaaagagggugaagcauuucaaaauaaaaauuauuggaacauggugacuuaccuuuagggaaggaagcacaggaaaguagguuuaaaugacaugugugugcuguuauaauugaguuuauguugccaucauuacuauucuuuugucagaauuuuaauaauugguaaugaauuuucuuuacagucuuaaagcauuuaaucuugaauuuuuaauccugcuaagaacuuccuagguaaaaagacauaaaggaaaaacaaauuuuuucaagagcaugguuuuagcuaauuaaagcugcauaauauguuaacauugaauaaauaaauggaauuuaaaagguauacuuaaaugaaacuaauaagaauuaaugaaugcucagaaaauuauagguuuucagggauaugauggacuuugacaguucucuuuuuuguuguugguuuuguuuuguuuuguuuuuuagaucaaaagacacugacuuagcugcuuaccagaaggggaacuugggcaaguuacuaagucuuuuugaguaucauuuuuuuuuguuuuuaaaauagggauaucaacagcaccaacaucauaguguucuugagaggauuaaaugagauauaaauaaacaauaaaaagaguuccuggcacauaguaaacucugaauaacuguuaaguauugucugggauguuagagggaguaauagguuggggauuugacuacgaauguuaugaacagucaaaagucacauuuuaugaauucucuucaauucauaggcuuuuguuuauuauaccaugcuaaucauuuuuaaaguaucugguagagugaucuuacucucugucucuggauuugugguuuuauaauuccacagugcagcaguuaaggaauuguucugccuuuucuccccuuaucccuuuuccucccugaucauuugaaugccagacugauugccccaaaaagguauaguagcaaagggagggaggcaggacuuccaguuucuucauagcuaccccaucuaugccauuacacauucagauaaacuaaauuacucuuuaugguuuuuugucuuuuucagucuuucugacucuucauguaaagguacauuuuauggccuaacgauuaauaaauaagacugauucuuuuuuuuuuuuaagaauccugugagaaacccuuugugccucuugaguuaugaaaaucauuguuaauuugaugccgugcaggcaguuugacuugggaaaauugguaguguuacaaguuuucaaacuuuaaucuuaauguuuugaaguaauuguaaugaaaagcuuaguggucauauuguacuuucaucuaugacuuuuuacuugaguuuuuauggaaauauauuuauccuuuuacuguuugguugcuagccauauauuuaccaguaucauugggagaguuccuuuaauuccucucuuacacuuuaauguuguuaauaagcaguauagcauaguuggugguuuagacccgaguuccucagucuuuuuucucuauuuuuucccuaaggagccuuuuuagguuuuuuuuuuguuuuuuuuuuucuuaaguggcccccaccuccagaagauuuuaacuccagagagauauugcaggucuguuuauguauuuuauguauaucuguguuuuauacaagaguaaggguuuuugugacccuuuccuccaaaaaucaguguuuucucccuugaggggcaaacugucuauacugagagugcacguuuuauaagcaguggauucucaaaauuuugguguaaauaucccgaagggcuuuugugugugagaguuauaucuagugaaaucauauuaaaaauuaaagcugagaaaauguuuuaaguacuaguuuauuuuaaaauauuuuaggaaaauaaccacuuuccucucccccacacuuguuaaugagaagaguggcauuguuaacacauuuuugcagauuuuuuaaaaagucugccuuaauaacaacauucuaguaguugcuuuggcauucaaucuguuauaguguuauaaagaaaaucugggcucauauguauuuggaaagaauauuuuaauaacauuaucagauaauagagguucuuugauauuacacuaaaacuugacgauaguuucuuaaaggauaguugcagugugaaauugaaaccauacaagacaagcuuguucaaucuguggcccaacacaaauucauaaacuuucuuaaagcauuauuuauauauuuauuuauuuuaguucauccacugucguuaguauuaauguauuuuauauguggccuaagacaauuauucuuccacuguggcccagggaagccaaaagauuggauacccugauauaaaacuuuuuguccuguuacauuaaaauucauuggcuuuucacuuugaauggaucuucuguucaugaguaauuucuuacuauuucuugcuaagcaaccaacauugguugcuuagaaaauacugauucagugucuuaggaugauauuucaaauauugauauaguagcaacuaaucacauuuaauuaauaucaccaugaaucuuaucagaaacucucagaauauuggagaugcuugucaagguuuuuuucacuugacuguugucuuugauaacagauacuauuagauguuugaagugaugagugcacuuuguucauuuacaaaaauaucuacugaauacucuuuuuuuuuuuuugagacggagucucgcucuguugcccaggcuggagugcaguggcacgaucuuggcucacugcaagcuccgcccccuggcuucaugccauucuccugccucagccuccugaggagcugggauuacaggcuccugccgcuaugccuggcugauuuuuuguauuuuuaguagagacgggguuucaaugucuuagccaggauggccucuaucuccagaccucgugauccuccugacuuggccucccaaagugcugggauuacaggcaugagccaccgugcccagccugaauacucaggucuuaauaaccaguuuauuagucauucuuucaaauaagaaacguguuccaugaaaaaggcaguucagucagcucacaacucaaacaauugcacagugcuuuuucuucagucuucauacuucuuuacacaacaggagugcuucaugcaugcuucccgguuugucauguaaaauguuaagauguguauucagggucaagauuuaguaaaauuaauaauuuuuacugugagagcauggugaugaagaguugacuacuaguacaguugggugccacugcuuugauuuggccccuugauaaggcuucaucuauuuuuuucccccacaauugcuauagcagcauuuguccauauggugaaaaaggcaaauaacucacuaguauuauuaugaaaacaauuuugaccucuauagggguaugugaaccauacuuugagaaucauugacgacuuaauaagugauggagcugggauucaauccagguauugaauuguguguguguguguguguauauguauguauauacauauauguauacauauguauacauacuauauauacacacauuauacauagaaucccagcuccaucacuuauuuuauuuauuuauuuuugagacagagucuugcucuguugcccaggcuggaguguaguggugcgaucccggcucacugcaaccuccgccuucccagguucaagcgauccuccugccucagccucccaaguagcugggacuacaggcacacgccgccacacccggcuaguuuuuuuguauuuuuaguagagaugggguuucaccauguuagccaggauggcucuagcuccugaccucgugagccaccgugcccggccuccaucacuuauuaauuagcuacaggaccuugagcaauuacucugauaccaaaaucagauaaacauaaagaaagcugcagaccaguauucuucauaaaauaggcaaaaaaggggaaaaaccccaaaauauuugacauuagcauuucuauacugugcuuguuauuuuuuaaugugauauguguguguauguauguauauauacauauguauauauuuuacagggcuguagaagaaagaggguucuaaaguagcauuuauaaaaagaaagguggcaaaggugggauucugaaaugacuugucaucauggaauaagaaagaugcuugccaaaaucccaaauuguguucauaggcuaaagguuuaacuauccucaacaguuuuaggacuuuuuuuuuuuaaaggcagcugcuaagccugcaucauaauucagucaagugcauuauugcucuugguucugaaauacguauaaauccucacuacccaucaacagucuucagauaauguagaggaagagaaaucuaguuggugacaguaaacugugaaugcuuuucuuggguguuuaccaguucaaggaaauuucaguggcaaaacauuuuccuucuuugguuagucucauucuucaugaucuuugaaauagacucaucuguaauacauauacacccauuucggaguaaccuucacuuaggagauuguuguuuuuuaauaagaaagagagcccguuaguacuucugucauguuauucaugccaaagaaccaguugcuuuaugggagaaauggcacaugggguucuuccaucugcuguaauugauuauugcuuucaugugguucccaaacaauucccucagucccagcaucacuugccugucugacuaaugccucuguccuguuaguuuuuaguauuuuuuaguuauaaauacuuaaaaaaauaaaaauuuccaccaauuaugcaaguaauaucuucauuuuagaaaauuuaaaaaguaaagguacaaaucagggaaaaacacuagcuucaccauccugggauaugcucauuacuguccuuuuugaugauuaaugggugcuccuuuuuuccuaauuggcaaaauauaguauacgcauuucauauugugccuuuucauuuauuaucgguauuucccucaaucaaaaaauauucuaaaauauuuuuaaugacugcauaacuuuugucauuuauauaucaugcuuuuuuaaaaaaaaacugcauacauucuaauguuauugucuguuuauaaaaauuauaaauaacgcugugaagcacaucccuuauauuuuauuauucuuuuucugauuauacucuagucauuuuguugaagacccuuaaaggggaaugacugguucagauagcaauauuuguuuuuuacaggguucuugaagugaauugcuaacuugcuuuccaaaaagauugaaccaauuuauuaucauuuuacaagcauucagcccaguucuccauaucuucaccagaaaugauacuaugugaaaugcuuuugaaacagaauaaauaacacacauuagcacaugaacuuccagcaaaaguuuaaaugcuuagauauuagauaauauaacauacaucaaaacuuauaauguauaucucuuauuacuaggaggguccaaacugagcuagacuuaauaaguuauccuugaccuucuggggguagagucuucaaaacagauuucuuucucuaggaguucuuuauacuuucugagccuguacagacuuggcuuauguagaguggguuggagauaaaaaguucaauguguguccuuuugguuuuuauauuuuucucuccuuuuuagcccuaugucuugggacaguuauguagaauaguuugauauaugugggcuuuuuucuuuaucauauaaaagcaguuuuggauaaugugugauuggaaguuacgugucugaguucuuugcuaauuuuauguaauuuucaggugugcaacugaggaacauggcucaagaaacuaaucacagccaagugccuaugcuuuguuccacuggcuguggauuuuauggaaacccucguacaaauggcauguguucaguaugcuauaaagaacaucuucaaagacagaauaguaguaaugguagaauaagcccaccugguaaguaauucuagugaaacccgucuauauucauaauugaaauacaaguggauauuucgguauacccaauaccuuuuucugcucucacauuauauuuauauuaccauauucauaucaguaaaauuucucauuacacauugugauuauaaucaguagugaggaguuaggaaugaguaucaucacucauugaaaauacuguaaauucauaccauaaucuuauuucuguggcuguggaauucuguuacuuuauuuagaggggacaccucaagugucuuggaaaguaagggaagagagugauaaaagaaccuuuguucuuuuaucuggugugacuuacagcucaaguaguuguugaaggaaggaguggauuauugauaaccacagcucaguggacuugagaggaagcuuuacuccauuaggaaggaggaguaucguggauuaacucauaguaagggauguucaaccccaguucacuaggguuuuuuaugccuuuuugugucaaaggauauucuuggaauugagguggucuuuuguuucaguaguuguauaagaaggaucaugcggauuccaaguauaagcuuugcaaaaaggaaaguguuuaguguauucauuuaggauagaucucauguagguuaaugccugcauguauagauuuuugugguuaaugaaaguguaggcuauuacuuaguucauuuaauauugugugugagaucuugucuguuuuuguucaagccaaaaccuacaaccauuuaaccaaaacuccaaauuugcuuaaggcuaagaucaaaugaguauaaauuguuuuaaaauuaagucaucaucuacauuuauaaccuaauguacugagcauagauuuuaauucugaaccuauauucuucacugcuaugucaucuuauuuaaauaucucauuuguucucuaguacuuggaagauguuuuugaauuaaagcauuugggcuugggugcuauucaguccuaagaaauaggaguuuauuaauguauacaauuugcagaugguuuccuucuugguuuaaaauuaacauauuuuucacuggcaaaccguugaaaaauuuuuuaaaaauaaugaaccaacauacuacauauuaaaagaaaaccucuauacuguguucuguggaaaauggauuuugauuuuuuuagauaaggucuuagacugcugagcauauagaaucacuaauacgcaaugugguacuguuacagcaaccucugucaguagucugucugaaucuuuaccaguucaaugcacagauggcagugugccagaagcccagucagcauuagacucuacaucuucaucuaugcagcccagguaagauguacucucugaauucuaaugagaaugcuaauaaaaacuaaagaguauauucuguguuugauuaauaaggaaaacuacguaaagcuacuuuuagauuaacuggccuaaaauuuuaucgucugauuauaacuaguuagaaaaagcgauuucuugcuuuuaccuugagggaucggggguuaucguuuaagucuuagauuucuuuuucaggcaucuuuuucuuucucauaauauauccugaccuacuccugaaguccuuuggaagcauguuaagugaaauguuagucuuauucugcaaguauuacuaccguguauuaaaaaaauacagucuugucacacauuaucuuuguuuaauaucaugauguaguacucauauuuguuuauauuguaauguguauauauauauuuuuuaacucugaagucacaucauuuagaagccugcauacagcaauacugguuucauuuuuauucugcuuuuaggaaccaauauauuaaguuccuacacugggguuccuuuuuuccaguucaugauaagauauguucaguuuugcuaugccagaauaucauuuacagcuuugucuuaggguucuuuaagcaugucuuuaucaugcuaguuuucauuuagugaauucaugugguacuugaaauacacaaaggacauauacacuguugcuuuguuuccaaggcaguaaaauucugguccaaauuagucucuaguuuuaaagcucuaugauuauguuuaaguuauuaaaaaaaaguaugucuguguucucaucuuaauuaucuacuuagauauguugaacucuuacugugucacauuaguuaauauucauguguagagaucaccuuuuaaaaugaaauauuuugcuuuucuagcccuguaucaaaucagucacuuuuaucagaaucuguagcaucuucucaauuggacaguacaucuguggacaaagcaguaccugaaacagaagaugugcaggguuuguauaugaacuagcauguauuuuguuauuugaguauuauaggccagacacuauccuaggugcauguauaaaaaaauugccagcuuaaaauacauguuuuucuguuuucccuaugaacacaauacuuuauaucuuuaaguauuuaauuaacauguuggggagccauuucacacuuacauguaauuuuaucaucagcauaaauguugcaaauucaaaauuuguuuaguuuggaaaauauaauuaaaugaauguguggcaguguuacacuguucucuuuuacuauuuuggccguuucagucuauauacuacucuguaagaaaacuggggcugcugguuugaggggcaucucuuucuuuuguguuuugacucauuaucugagagacuguguccaucgugccuggcaguucuccuuuuuucuuccccaugugugcaauagucacauucaguugcucguauucacagcaugguaucuaucgugucuugcccaugcucuucauauccccauuaugaagcucaaagugaucuaggaagacuugaaaauuuguaugaaggcuuucguaguagggagagagaaugcggaguaggccauuuuggaggcuauuaaauaaucucugcuuaauuaguuguauucuagcaguguguggaaauaacaugguaacaaggaaggaucucuggaaagauaagccuaaugaagagcagugugucauucugccugugagaugauuuaccagugaaacuucauugcacaugguguucacaugaugguaacagauacaucugccaauccuaguuuaagauggcuaaauuuuuaauuuaggccaggcacuguggcuugugccuauaaucccuaccuacuugagaggcuaaggcaggaggaucgcuugagucugggaguuugagacuagccuggacaacaaaaaauuagccaggugaggcggcacauaccuguagucacaacuacucaggaagcugacgugggaggauugcuugagcccaggaauucaggcugcggugagcuaugaucgugccacugcacuccagccugggugggcaccagagcaauucccccacacccggucucaagaauuaaauaaacaaauuuaaauaagcuagguaguuccucuugcuuuuuuuucauacccagcaaauacuugaaccaguuugcuuguuuguguagauuuugccguaacaaaagaauauucuguguggucaacguaaauauucuagucccaucuagcauauugugauaaauucuuaaauguuuuaagugaauaauucuuauuucuuaguuacaucaaaaaauuuaaggaagggcagaaaugaggaaucuuuaaagaaauaaggaaaagacugggcgcgguggcucacgccuguaaucccagcacuuugggaggcugaagcggguggaucacgaggucaggagaucgagaccauccuggcuaacacggugaaacccugucucuacuaaaaauacaaaaaauuagcugggcgugguggcgggcaucuguaguccuagcuacuggggaggcugaggcaggagaauggcaugaaccugggaggcggagcuugcggugagccgagauggcgccacugcacuccagccugggcaacagagcgagacuccgucucaaaaaaaaaaaaaauuuagaauguuggcagugaaaaaaauguauaaagcuuaagaauacaauaguauuuacagaaguuugacaaagaauaaaggucauagauuggugaacuaucauaacacauaggaaguguuuuuauaccauuuauuuauaaaaguguuuuuauuuccauuugugguguauggaaaacaauaccguuuucuccacuuagcccugaguauaucacuucaaaaggugguccugaugccauauuaggagaaauuguauaggccccauuuuucauacaugauuugaaugacuuuuagguuaaaccaguauuaacuuguaaguaccuuuaaaaaacuuagcauucguaauaucagcagcaaaucuuugauaaauuagguauaaguuucaucucaguuuuaagagaggaggguuagguuccaguauguaaaaucucuuaacaaccuaguuuuuaaaaaaaauuuaacauauuauugaauuaagaauacccuuuuuauuauaaacauacacaaauauaaacauguauguuuguauauauguacguguauauucuguaugugcacacacucauacacuuacaugcaauuacgauuucccuauugaucaaauucaaauaacuuuuuuuccauuuauuuaauagauggaugaaaagagacagaaaaagucucuuugagucagucauauggucauaaaagcuggaacuggaauccagggaccuaacucauagaggccaguauucuuaugauuagacaguuguggagcuuguuggacuaggauguggauauguguauuccuguuaacacauacaucucccucaguucucaggguaggaucaacucguuuagcaaacuacccagguaucaguuuucuucuuccucacuccauaugcuucccucaagggaaauuuauauagauaggaaaaccaucccaaauggaagaagguauaugaguagcagcuauaugucuaagccagaaguuuguaacauuuuguaauuggaacauucagaacaacuuuuucucuacauguauucugcuuauaauuaggauaugcugccaccagguuggugguacugcuuucauauuggccacauggcucugaagaauuuuuauguuucauugagaauuuagcauauugaagcauguuucuuaguuguucuuuuugauuuaaaaauauagcaguaccuuacuuacauagugucacucaggaguauaagucaaauuuccaguucacaaaugcuagcuuuuaaaagaacuacuuuaagcauuuugguacacucuaaaacuguugaagaauaugcuuaaauuuggucaaccucuuagucccucagaucuugggucauaguagaaaaauacugaauuuggauucauaaguucuauuuuccuaucuugguaugccugcuuaacuucacugagccuuacuuucauuacucuuaaaagagaauaagaaugucccucuuacaggguauuaaaagauacugagauaauggagguuggaugagcuuuguaagcugcagaagauauucuuuauauugcccaagugauuugggaguuguaggaggccuagaguaagagagaauuuugaagcuuuccaacacucgaaugaugucauauguuaagaugguaaggucuacaucacugaagcauucuaggaaagaugaguugauguuagagaccauauagagagaggaaugcugugcuuagugacaggaugaacuagaauucucaggcucuuuccuacucugaggguuucugacuuuauacaaaguugaauugucaaaucauugguucagaaaaaucagagggggacagucucuuuggacugauuuaggaaagcuguauggguuuuaaaaaucaggcauuucuucugauucuaaagaaugagugagaauagccaaagguaucuugaaaaauaacaaaguuggaggacuaacaauuccuggcuucaaaauugaguacaagcuacaguaaucaagacuguguuguaccggcaugaggauagucaugaagguaaguggaauaaaaaauugagaguccagaaauaaacucuuauuauauuuaugggccauugacuuucaacaauggugccaaaaucauuugaugggaaaagaguaaucuuuuaaacaaaugaugcaggaacaacuucauauccacauucgaaagaaugaauuggacuccuaugucauaccauaugcaaaaauucacccgaaauacaucaaagaccuaaaacgaauauaagagaacuauaaaacucuuaaagcagguauacauuuuugugaucuugguuuaggcagugguuucuuagauaugacaccuuaaccacaagcagccaaagaaauuauagauaaauugagcuacaucaaaauaaagauuuuugcuuaaaagaguggaaaaacagccaggugcagugacuuaugccuguaaucccagcacuuugggaggccaaggugggcagaucacuugagcucaagaguuugaaaccagccugggcaacauggcaaaaccccaucuguacaaaaaauagccgagugugguggcgcacgcuuguagucccagcuacuggguagggaggcugaggugggaggaucacuugaacuugggauguugaggcugcagugagccauuaacgcaccacugcacuucagccugggucacagaaugagacccucucucaaaaaauaaaagaguggaaaaccagccuacagaaugagagaaaaaauacuuugaaaucauauaugugauaaggauauauaaauaauuacaauucaacaauagaaaacccauuuuaaaaauaagcaaaggauuugaguggacauuucuccagaaaagauauacaaguuuccaauaaacacaugaaaagaugcucaacagggccgggugcggugguucacaucuguaaucccagcacuuugggaggcugaggcgggcggaucaccuuaagucaggaguuggagaccagcuuggccaacauggugaaaccccaucucuacuaaaaauaugaaacuuagcuggcugugaugucaugcgccuguagucucagauacucgugaggcugaggcagaggagaauugcuugaacuugggagguggagguugcagugagcugagauugugccacugcacuccagccugggcaaaagggcaaaacuccaucucaaaaaaaaaaaaaaaaaaaaaaaaaaccaugcucaacuucauuagauaugagggaaauggaagucaugggacaccacuucguauccacuaggauggcucuaaucaauaacaaaguauugucaaggauguaaaaaaauuggagcccuccugccuuggugggaguguaauauggugccagauacucuggaaaacaaucuccuagcuccacaaaaaauuaaaaagaauugucauaugacccagcauuuuucuccugauugccaggagaauugaaaacauacguccacacaaaaacguguacacaaguguucguagcaguauuaucuauaauaaaaaauagaaacuacugagauggcuguaaauagaucauuggauaaaaaaaaaugugguauauccguacaguagaauauucagucacaaagaggaaggaaauucugauacaugccacaguaugagugauccuugaaaauaugcugaauaaaagaaguuagguacaaaaggcuacauguuguaugauuuuauuuauauagaaugucuaaaacaggcuagucauacagaaagauuagugguugccagaaaccgugggaaguggggaguaauugcuaaugaguacagaguuuucccuuaaugugacuuaaauguucugaaaguagauagugguaauaguuuuauaaccuugugaauauaauaaaaaccacugaauuguauacuuuaaagagugaauuuuaugguaugugaaaucuccccaccaccccaagacagugaagagggcuuuugcuggaggaugacuugugagugcaaacgcauacagguaggaaaaaugaaauuugagaaagagugaaaagacuguuugcugaagugaucaguucaggcaguuauauguugaaacuaaagcuagaaagguuguuuggaaguugauaagguauuccuuggucuuaaaacucacauaaaaacugaggaaacaggaugauuucugggaaucauagacuuuuaaaaauaguacuauaucaucuuguccgugaauucauuuggugacuguugaaauucagguugucagcuauuaguuucaaguaagcugagguuaccuuagccucauggguauauaaucgacauuuauuggucccacauuugaguuauagcauauaagcuuuuagauagccuucugauccuucacuuuaaagacugcauuugccucaguuaaaaagaaaccauuggccuucuuuggggcuuuaggguuaauacugugaaaugucuuuugagauaugcaguaguauuuguaugcauagaagauagauguauuuucacucuucuccauuuccagaucccauucaaauuugugucucaguaguuagaccaguuuuguuaaaaacuauaaucuugugauaauguuacugccauuaaauggguuuuuuugaauuuuucuggagaacagguuagauauggcuuacagguuucaaaaccaauaaauacuguagguucauuucugauugcaagguaagcuguuuuugaguccauaugcauagccagauaggcuuaucugauacuguucuaggagcuggagauaaacaguaaacaagacauucagccccugcccucuuggagcuuacauucuagggauauuuauucauugaaaauaaaagguuugaugugucuauauucuguuucaaaaauaguauguucacaguauuauuaauagaacuguccccugucugguuucagcaugucugaguggaguaacaugcuauagaguuugucauuagcacauauuuacuuguuuguggcauucugccuuuugucaucuuuuguuaaaauaugagauaaugaugguagcauaagcagguuagaaucacagcaaaugucugagcauguauuacaauguguaguucacugugauaggacuggagguucagauggggaauaagguaaccauccuucucaauggccuuacgguguaguuggggaaaugaggcacauaaauaaaauagguaaguaauucaauucaacagauacuuauugucgaaugucugcuaugugguuggagacacugggauaggcacugauaaugggauaaauaggaccgaugucuccccucaaagaauucaaaguuaaaccaaguuaagccaaugagggaauuuuaauaugaaaagugcuauacacaggguuucccaccccaagguuguuggagaggcaguggaggaagagcugauuauauaagcuuaaacaagaaaaacaaguuagaguuagccugauaaaaagagggacaggaggggcauagaaagaguauuuuguauggaaagcacaacuuauacaagagcccagaggcaaaagagaguuugauauguccagggaaacugcaaguccuucaguauggcugaaucauggaguacuguugaggaauagugagagaugaggcuagagaaagaaggaugaagaaaaucaugaaggaccucugggcuuuauccugggggguaguugggagccauugaggaauucuaaacaucagagggaacaccauuagauuuucacuuaaggcagaugauuggaugcaaugugugaagcauggauuguagagggaacucaugaggugcccaguauuuggaaaagguguuaaggaaaaucagagugagaagcuacagagaauugagacaaggaaaggguauuugaccuuggucuugaaaaagaggaggaccuagaucaaauggggaaaaaggaaacccuuuggaauagauucuaagaagugugagcaaagguacauggcauauucccaguguagauuaauggagcaguggaucccuggggaaagucuaguuggggauaaaacuggagagguuaagaauuugauccaugggaaauuccaccauuuuagagcaaaaugucacgucugcaaggucauauuauaugauucugacucuggcgacagcauucaugagggcuagaguaguuagcaacuggagggaggcauguuaagauuucagaguaguaauuuaacccgaaucuugguaaaucuggcuuugguuuccauacauaaaugcaucaacuuauuaucuuacaacauuuuaaagcuucuuugcuucaauuugccuuauuucuaacauuuaaagugcuuuuaugugaaacauucugggaacuuuaaacauacuuaauauuccacagaaucuugguuucaccuuuucccuccucguucucugagagaccuaugucauucugaccccgaacaauauuaagaacuaugcauauggcuauugucuugcacacucccuuagaauauucaaguaguauuuguuuaugugccuuuuauugauuaaauuuguaguuacuagaaaaauuagaaaguacaguuaaaaccuaaagaaagucuauaaaaccacuguuaacauaucauuacauauucuagauuauuuucuacaugcauauauacauacauuuaacaaaaaggggucauauuuuuguaaacaacuuuguaauuuaaugacuaguuuucugugcuaauaaauuccucaguauccucugaauaauagacuagggagggugggaugaggaauagcaaaaucuuacagaauaauuaaauuuugccaccuucguauuuuuguuagcuucaguaucagacacagcacagcagccaucugaagagcaaagcaagucucuugaaaaaccgaaacaaaaaaagaaucgcuguuucaugugcaggaagaaagugggacuuacugguaaggaccuaaaucaaauguuuaaaauuaaaaugauguuuuauaauaaugcauagcuuacuguuguugacuucaauuaagauuguuccuguucccuugagaguuaauauuggauauacuucaccuucugaauuuucuuaaggaaauaaaaauagcuuugauuauacaccuaaaagugaaaugaauagcuuuuuuaaaaaaaguuuuauuucaguugaauuuagaaguauuagacaaauaagguuagugugccagauucugugaaaggucaaagauguggcuccugcuuuuaaggagagaauauuuugaaguacuugguaaacuggaaguacuuucuauauauaaaauagggcuaaucauacguuguuguguggguucagugaguuaagacauguaagcaguuagcccagugcugccacacaguaaguaauuaauauauguuggcuacuguaacauagcuaucagaugcagaugguggugggagggagaaagaaauguucaaaagcauuuagcaaagaaaguacaugaagugcagucagauugcucugggaauucagggaugagaguaacuaauuuacauuuuaaaaugguaguucuuagaggcccagcaaggaaaggaccaugaaggcagaauguuucagugugucuugaacagugaguaggacuuauaacugauggaaauaggggcauuucaggcagaaagaauaacuugaagaaaaugaauagggcaugugcagggaccaugaauaggggaaugucgcuguguagcacauaauacgugaacaagacuguuguguacugcaguccaacaggaauaaagaaauaagacuaaaaacuuauacaguugacucuugaacaacaugggacuguagggguccacuuagaguuuuuucuaauacauuggaaaauuuuuuggagauuugcagcaauuggaaaaaacucacagaugaacuguauagccuagaaauauauuuuuuuaauuaagaagaguuaggcaugucuugaauguguaaaacauguguagauacuuguguauuuuaucauuuacuaccacagaauaugcacaaaucuauuauaaaaaauuaaaauuuuaucaaaacuugccuauacaauaugcagaucauacaugaagccauucauagucaagagaaauguaaacaaauguaaagaugcaguauuaagugagaguggcaaaaaguuacugugguauauacuauacuucucuaauaauuucauagccaccuccuauugcuauugcagugaguucaggugcugcaaguauccacuuaaaaugccacacauuuuaaucggcacugaucaccucuguuucagcaguuugucucuguaguaaauugccuaccacaguaaaagguaaucucuugugguucucauguauuuuucaucguguuuaaugcaauacuguaaacuuugaauaauaccauaagacucguauaaagugaugccacuagcacuagugauacuggaagugcucccaagaagaagagaaaagucugacauuacaagaaaaaguugaauugcuugguauguaccauagauuaaugucugcagcugcuauucugccauuucaagaaaaaugaaugaugucugccauuucaggauaaaugaauucaguguaaggacuauuguuaaaaaaaaaaaaaaggaaauuugugaagccaucucugcagcuaugccagcaggcacaacaacuuuguacuuuuuuaugaaauaccuuuuuauuuuguauugacaaugcagcuuuuaugugggugcaggauugcuauaaaaaaaggcauacuaugauucaagaaaaagugaagucauuauaucacagcuuuuagauucuaaagcuggagacuuuaaugccagcaaaggaugguguuuuuuuuuguuuguuuguuuuuuguuuuuuuuuuugaaauggagucuugcucugucauccagacuggaguacaguggcacuaucucggcucacuguaaccuccgccuccuggguucaagcaauucuccugccccagccucccaaguaguugugauuacaggugugugccaccaugcccggcuaauuuuuguauuucuuuaguagagaugggguuucaccacguuggccaggcugcucucaaacuccugaccucaggugauccacccaccucagccucccaaagugcugggauuauagaguggaaccgccacaccuggccgguuugguaauuuuagaaaaagguuuggcuuugaaaaagucaagauaacaggagaaacagcuucugccagaaaagaggcaguagguucccaaacuacauuaagaaaguucccaaacuauauuaaguuguuggagaaagaguaucugccugaacaaguuuuuaaugcagacaaaagugcccuauucuggaagaaaaaggucacaaagaucuaaggaagaaaagugaauacuaggacuuaaggcaggaggagaucgucuaacuuuacuguuuugcgcaaaugcaguuggguuuaugaucagaacugccauuaccuauaaagcugcuaacccgagucuugaagggaaaaagauaaacaccagcugccagucuuuugguuguacaacaggaacgcuuaaacaauaugaacccuuuuucgugaucgguuacauuaaugcuuugucccugaaaucagaaaguaucuugcuaguaagggacugccuuuuaaaguuguuggguuuuuuuuuuuuuuuugagauggaguuucacucuuuucgccuaggcuggagugcaguggcgcacucuccacucacugcaaccuccuccuccuggguucuagcgauucuccugccucagccucccuaguagcugggauuacaggcguacuccaccaugcccaacuaauuucuuuguaucuuuaguagagacgggguuucgcccuguuggccaagcuggucccaaacuccugaucgcaggugauccguccaccucagccucccaaagugcugggauuacaggcacgagccacagcuccuggccuaaaguuguuuugauauuggacaaugccccuggccacccagaaccucaugaguucagcacugaaggcgucgaagugauaaaugcuugcucccagagaagcaucucuaauucagccucuaggucaggggucguaaagaccuuucaggcucauuacacaugguacucuuuggaaaagauugucagugcuauggaagagaaccccaauagagggaacaucauaucauugaagauaccauuauuguuuagaaaaagaugugaaagcucucaagccugaaacaacaaauuuuugcaggagaaaacuccagauguugugugacuucacaggauggaaaucaugauagagauuguggauauggcaagaaagguuggggguuaaggauuucaagauagggaucuuggagauauucaggagcuaauagacaccaaaccagaagaauuaacagaagaugacuugauggagaugacugcuuccaaaccacugccagacagugaggaagaagacauagaaaaagagaaaaagcgugcaagaaaacagauugacacuagacagucugacagaaggggucugauuauucaagacugcuuuucacuucguuugcaacguggaccguuuggugauaugagaacugaaacuaaagcaaaugguggaagaaggauugguaccauauggaaacaauuuagagaacaaaaaagcagaaaagucagaaauuacauuguauuuccauaaaguuacaccaaguaugccugccucuccagccuccccuuuuaccuucuccaccucugcuaacccugagacagcaagaccaaccccucuucuaccuauucaauguaaagacaaggaugaagacuuuuaugaugaucgacuuucacuuaaugaauaguaaauauauuuucucuuccuugugauuuucugaauaacauuuccuuuucucuagcuuacuuuauuauaagaauacauuauauauuaauaauauacaaacauacaacacaaaauauguguuagucgacuauguuaccaguaaagcuucugguuaauaagcuauuaauagcucaaauuuugagggaacauaaaauuauacauggauuuuugacuuguagaggggucugcaugccuaaaucuggcauccuuuaagagucaacuguacugugguuaguuggaaaguaguugcagcuauagauagucaaaauguauuguuuaccaugugccaggcacugugcugaacacugcauaaaaauuggacuuacagaaaagaguagauaagauuuugagcagagcuuugcuuuaggaagauuauuucugguuaaggaaugguuuggagaugaaaaagaaaggaaguuagaguuuaauaucaaagaugcuucaagaucagguaugguggcucacaccuauaaucccagcacuugggaggccaaggugggaggauugcuucaggccaggaauucgggaccagccugggcaacauaaugagaccucaucuuuaaaagagaaaauuuaaaaagauguuucagauuugcccauaccuuagcacauguacauuuaaagaauacaaacauggcccagugcagugucucacaccuguauucccagcacugggaggccaaggugggaggaucaccugaggccaggaguugaagaccaaccuggacuacauagugagacucagucuguacaaaaaaauuuuuaaaauuagcugaucaugauggcaugugccuguagucccagcuacucagaaggcugagguggaaggauugcuugagcccaggaggucaaggcugcagugagcuaugauugcaccacuucauaccagccugagugacagugagacccugugucaaaaaaaaaaaaaaagacauuuuaaaauauacauauuuaauauuaaagauagccuuucuagggcugggcaugguggcucaugccuguagucccagcacuucgggaggccuaggcaggcagaucacaaggucaggagaucuagaccauccuggccaacauggugaaacucagucucuacuaaaaauacaaaaauuagcugggugugguggcgugcaccuguaaucccagcuacucgggagacugaggcaggagaauggcuugaacgcaggaggcggagauuguggugagccgagaucaugccacugcacugcagccuggugacaaagugagacuccgugucaaaaaaaaaaaggaaaaaagauagccuuucuaaaucucacaaacccucagacuucaagauuagaagggugagauuuaauaauuuucaucuuguccagucugucuaauacagugcuguuugcuucauuuuucauucauuauuaugaaguuacaaauaugucuuugaaguuaaaaauguggcaauggagguuaacaucaaauauuaauguuuaaaauauugauuccugugcuccauuucuaacaauuguaucauaccauaaaauucuaauuugggggagcaggaccaguuuuauuuaaagacuggcugcacccauuacaucucgauuuugguuuuaacuccaggcauuuucuuaaaauuaaguagcauuuauuguguguuuuaccauauguucagaauuaaauuccuuccucauuuaauccuuacuuauuauuauuccaaaauuacagaugcagaaacucaagcucagagaggcuaauuugccuucauuaguaaguagauugacacugaggcaggcaggcucuagaucccgugcucuucaccucucaacugcaguacaguucacaucuccaugggagguuagcagagaaaagcaaauaucgaagcuguguucuuuguuaacaguucuuucagagguauuauuugaucuuucuuaaauaaaugccaagacugccuucugacaguaggcuuauucucacaucguaguguuuggauuugaaaaauguuuuacauuuucaaccuagcaacuguguuuuuguuaagaaguaauuguugccauaucacaggugaagaaacaagcucagaggacuuucucuagggcaaaccugcguuuguagauaggaauaagaaaugaagcucucagguagugaauaagaauguaguuugugagacaguguauuuagaaugauucuuuaguuuacauugcugcccuaaauauauugugcuguucaguauuaauuaugccaaagaccuuaauauuucauccuucaacucauguauguguauuacuccauuuccaggguuugaaugccgguguggaaauguuuacugugguguacaccguuacucagauguacacaauugcucuuacaauuacaaagccgaugcugcugagaaaaucagaaaagaaaauccaguaguuguuggugaaaagauccaaaagauuugaacuccugcuggaauacaaaauucuugagcaucugcaaacuaaaaauugacuugagguuuuuuuuuuccuagucauugggaauguagagcaguguaucuugcaugucaucggaagaauagauuuuuguuuugguuuuguuuugaaaaugacucugaacauuuauuuccauugcaauuucuguggcugaggagacuuaaacuuuacaaguauuauccuuuuaagaucauuuuaauuuuaguugagugcagagggcuuuuauaacaaacgugcagaaauuuuggagggcugugauuuuuccaguauuaaacaugcaugcauuaaucuugcaguuuauuuucucauuguguauguauauaucgcuuuucucugcagcacgauuucucuuuugauaaugcccuuuagggcacaacuaguuaucaguaacugaauguaucuuaaucauuauggcugcuucuguuuuuucauuaacaaagguuauucauauguuagcauauaguuucuuugcacccacuauuuaugucugaaucauuugucacaagagagugugugcugaugagauuguaaguuuguguguuuaaacuuuuuuuugagcgagggaagaaaaagcuguaugcauuucauugcugucuacagguuucuuucagauuauguucauggguuuguguguauacaauaugaagaaugaucugaaguaauugugcuguauuuauguuuauucaccagucuuugauuaaauaaaaaggaaaaccagaaugcucccuugua

SEQ ID NO: 191792 - RNA, 11873 nt, Homo sapiens
uagcuuuuauggaauuucaauuaauuacguuuaucaaaacuacgcaucaugcccauuuguggguauuggaugaaaagauaaaucuuuccagaaggggcaggggagggagaggcaauucugguuggggaaguugggagaaaagaaaaucaguaucuccuagucuucgcccaguuuggcucguuugggguacuccucgaccccgcguuaccaggcccgugaaucccacucccaccagagaauuagcgcgggcggacgagcaaagugaaacuuaguagcccggaacuucgcgugccggguucccgcagcaacacguaccgggaagcguuugggcgcugcaccgcgcugcgccgugcccgugaguccggcgcgcagaggaggaggagaaagcugaccgcuuaggccgggguaguggucgucgugguuuuccuuguaguucguggucugagaccaggccucaaguggaaacggcgucaccaugaucgcacggcggaacccagaacccuuacgguuucugccggaugaggcccggagccugcccccgcccaagcugaccgacccgcggcuccucuacaucggcuucuugggcuacugcuccggccugauugauaaccuaauccggcggaggccgaucgcgacggcuggugagugcugcgcggccgggaucggcugggaggagaaggggucguagggcugcagacuggcccggccguaggccccccugaggugcucugcuuuuccgugccuuuuugccuagcuggccccaucucgccuuuccggggaguccgcgccccauuagcucuuuagaaucaagcagagccagagugucauuuggcacuugaagaaacugaggugcagugaagcaggaacugagucugugaaggacccgaaacuacucuccucaguucguguugugcugugugcgcaaaugagccaugacuccaugccaugcacuacucacacugugggcauuauugauagcauuucggccuuaaaacacuuuuagggauguauuauucacaacgaggaaaccgagccuaacagauuaacagcagcuugcccaaggucauauggcuauuaaguagcagagcuugguuuuuuuuuuuuuugaccucugaauggauaugggacaccagugcuucucaaacuuaaugugcauacgaauagcauaggugucuuguuaaaauucggauucugggcugcgcgagguggcucacaccuguaaucccagcgccuugggaggccguggcgggcggaucgccugagcucaggaauucgauaccaguaugggcaauagggcgaaaacccgucccuacaaaaaaauacaaaaguuagccgggcgugguggugcacgccuguggucccaggcugagggaggcugaggcaggagggucguuugagccuggaaggcagagguugcaguaagccgagauugcaccauugcacuccaaccugugcaacaaagugagacccugucucaaaaaaaaaaaaaaagcggauccugauucaugaggucuggggaggaacuugauguuaacaacaagcgcucaaacacugcugcugcuggucugaggaccacgguuugaauaggaggcucuaaaccagugugcuguacuucccaguaguaugucacuggcuuccuaucagagacacugacuauucugauaauaaccaccacaguagcuuugcuaagcucuauggauuuccagagggaaaagaggagaggaacuuuggaagaggggucuuugaaguuaacuuugauuaucaggcaggacugagagacagacagcuuucuaggcccguggggcuagugggagcuaaugggggcaaggaccucugaauggaggguguuugaugauugagugaguguucagguuuagauaaaacugcaagggagauuuuagcagagcauggcaauuuauuuucuaggcagucaggaacuuuguaagcuuuugagagcugcaagggugcagugaugagcucuguauuuuaaaaagucaucuuugucagcaaugugaggcguugauuggagccaagaagcacaaucaggaaaaaagcucaggcaaugguucaggcaauuaggagucaccacacuuguaccucuuuugccuucuuacagcuguaugucaugccugaaggucagcucccaacccaucaaaucccacauuuccagugcucaaauaguauugaaguccuaucucccuuggacauaacuccucacuucagaaaggagucaucuuuguccguuuaugccucugaggacucgagguuuucccuuuucaucaccacuucauauuugcccaagacugucacuugguguaaugaaaagagcuccacuuuggaacuaaacaaacuugcucacuaggcacaggcacugugguucacaccuguaaucccagcacuuugggagaccaaggcaggaacaucucuugaggccaggaguucaagaccagccugggcaacauagugagacccugucucuacaaaaaaauuuaaaaaauuagccaggcauggugaugugcacuuguagucccagguacucaggaagcuaagggaggagaaucacuugagcccaggagguugaggcugcagcgagccacgauugcaccacugcacuccagccugggcaacaaaguugagaccuugucuccaauaaauaaauaaauaaacagacuugcucugcugcuuuccagcugugucacuuugggcaaguuacauggucaggucgaucagagccaaaguuuccucaucuauaaaauaagaauaauuaauuuuugcauauuuguugugagaauugagugagauucuguagguaaaaugucugacaugcaaaaggugcuggacagaguuccccuuccuuagcucuuguuaugcaaacaguuuaccauauauuuguaaauuguucauuuacagaacccuuuuuuuuuuuuugagacagggucucacucugucacccaggcuagagggcaguggugcacucauggcucacugcagccucgaccuccugggcucaggcgauccuccuauccuagccuuccaaguagcugggacuacagguacauaccaccaggccuggccaauuuuaaaauuuuuuguagagauggggucuugccaucuuggccaggcuggucucaaacuucuggccucaagugauccugccaccucggccucccagagugcugggguuauaggugugagccacugugccuggccuuacuuaacuguuucucuguuaugugcccuauggagcuccuagugaaaucagggagacaaacagguaaacagccuguugcugaucuugguaugauagauacauguuuugauagaggugggugagcagaaagcacuuuaggagcacaaaggagauacaguugggagggagaaugcucuagaggaaguaaagguuggcugaaaugugacguauguaccacuuaaucucguuguuaguuuagccguuugugccuuucugggagacagaagaguauagcaguuaagagcauaugcuuugggguuugacaucaccuccacccuacuaguaauuugauucugaggaaguuaccuaucucugaggacuggaugagauaaugaauauaaacugcuuagcccaggaguagggaucagacuuccugaguucccagagcuucccuaaauugcuuuggaagauuuagguccuaggacuuuguugaaaugguuguccucaacagcauuuacugaaugcauauuguguuuaucuagcucagugucuaauaucuauaguagguguucaguaaguauugagugaggucacgugugguggcucaugccuguaaucccaacauuuugggaggcugaggcggguggaucaccugaagucaagaguucaagaccagccugaccaacauggugaaacccugucuuuacuaaaaauacaaaaauuagccaggcgugauggcacaugccuguaaucccagcuacucgggaggcagaggcuggagaauugcuugaaccugggagguggagauuucagugagccgagauugugccauugcacuccagccugggcgacagacugagacucugucuuuaaaaaaaaaaaaaaguaguauugagugaauaaguauauguagauuacaaggaauauaaaacauggucccaauccuccaaagguuuacagaccagauggccauauccauuaaaaagacaaauugugguacaagauugugcauauagagugaaggugugugucacauaaaugauguuucuaagacaguuggaggagugguggaagagauaugguagauuuucaaacuacagcccuggcgaguaccuggcauucugugaguaaugggauauucuggccggacaccguggcucacaccuguaaucccaacacuuuggaaggcugaggugggaggauugcuugagcccagguuucaagaccagccugggaaacacagggaaacuuugucucuacaaaagaaauuuuuuuaagcuaucuggacgugguggcaugcaccugugaucccagcuacuugggagacugaaguaagaggaucacuugagccugggugguugaggcugcagugagugugaucaugccucuguauucuagccuaagugacagagcaagauucugucucauaauaaugaauaugucucauaauaaugaauuucuaucaaugaaauaaaauuguguagcucuuuuucaaauuagcaggaaauguuaaaauaauuccuuaagaauaagacuuuaaaaauaaguuguacguauuuuggggguacaugugguauuuugauacaugcauacaauguguaauguugaaacuggggcaaaugggacauccaucaccccaaacauucaccccuucuuuauguugggaacauucaaauuccucuccuucagcaauuuugaacuauacaacaaauuauuauuaacuguagucacccuacuguacuaucaauaaauagaauuuuuuuauaaguuuuucucucaucaucuguuuuuuaaaacuuaaccuucuugcugguuaccacuuaaugugcccgaaauuuagaguuaguugguaugcuaaguauagcccacaaaauuaaauauuuauugaucucuaguuuaucaguaauuuaugauguucuucaaagagcacaauagcugccgggguuagacucacugaguaaacaaugggaaaaugauuguagauggggugugcagguagugagaggucgaccacuaagagagaaugaggagagagguuaggaaaauggggccuuggcaagaggccaagccaugccuuuagggcuaggaugcugacaucaucaucucgaacgcuuauggagucuuucugugaggaacaugggucagcguagagagagucugguucugugugucucugcaguccaguggcacaugggagaacaugcacucuuugguuugcuauauggcggguagcccauuauggaaagcaguggcuguuugggguaagagagagugcucuguccaguucuagaacauaggaauauuuuucauuuuuauuguuuuauacauuuucggaaauacuuuuauaugcauaugucuuguuuuauaugcuacuacugugagaaagauaggauaggucuuuuuuuguuuuuuuuuuugagacagagucucauucugucgcccaggcuagaguucaguggugugaucuuggcucacugcaaucuccaccuccuggcuucaagcgauucuccagccucagccuccugaguagcugggacuacaggugcgugcuaccacgcccggcuaauuuuuguauuuuuaguagagacggaguuucaccauguuggccaggcuggucuugaacuccugaccucaggugauccacccaccucggccucccaaagugcugggauuacaguugugagccaccacgcccagccaggauaggucuugucuauguuuuagagguaguaaauugaauugcccaaggcuguucauucauuuauuaaauaaauauuaagugcuauaugcuaaaauauacauugcauguaauauuuuagauuuguuaaccuuuaaagaagugauaaugugggccgagugugguggcucauuccuguaauccuaacacuuugggaggcugaggcagggggaucgcuugagcccaggaguucaagaccagucugggaaacauagcaagaccccucuuaaaaaaaaaagaaagaaagaaagaaagaaaaaaggcaugguggugcacgcuuuuggucccagcuacuugggaagcugaggugagaggauugcuugagccuaggagguugaggcugcagugagcugugauugugccacugcacgccagccugggcgacagagcuagacccugucucaaaaaaaaaaaagaauauguagggugucucaaagucagggaucaaggcgguuuguucagaauagcuuuuuuuuuuuuuuuuuuuuuuugagacagagccucacuccgucccccaggcuggagugcaacggcgcgaucucggcucacugcaaccucugccucccggguucuaacaauucuccugccucagccacccaaguaguugggauuacaggugcccaccaccacaucuggcugauuuuuguauuuuuaguagagacaggguuucaccaugugaacuggucuuguacuccugaccucaggugauccaccugccucagccucccaaagugcugguauuacaggcgugagccacugagcccagugcuuuuuuuauuuuuauuuuuuuaagaaaugccauaacaggccaggcgcuuugucacccaggcuggagugcaauggcgcaauaucagcuuacugcaaccucugccucccagguuccaaugauucgccugccucagccucccaaguagcugagacuacaggcacccgccaccacccccagccaaauuuuguauuuuuaguagagacaggguuucaccauguuggccaggcuggucucgaacuccugaccucaggugauccaccugucuuggccucccaaagugcugggauuacaggugugagccacugcguccagccaaaaauguaacucuuaauacacauggacuaauuuuugcuuucuuugggauuugucauuugaauuucagguuugcaucgccagcuucuauauauuacggccuuuuuuuuugcuggauauuaucuuguaaaacgugaagacuaccuguaugcugugagggaccgugaaauguuuggauauaugaaauuacauccagaggauuuuccugaagaagguauuucaaguuaauuuuagauaaucuguguuuacuguauuauuauuuucccugguuaaucuuauccauguguauggcuuuagauaccuucuaaauucuguugacucccacaucuuagucuauagaccaaaauucucuugaauuaauauauccaguuucugacuaccuccguguccuuuggacagcaaacaaaacucauauccccucugccuucccaaaccuccugcuccucuguguccugcuucagagaauggcacuacuguccaccuggacacucaagccagaagccugagaaucaucaagucuuucucuuucacuucccauuagucaucaggucuuaucaguucuacuuccuaaauauuucuuaacuuugaacucuccucucccacuaccacuacccugguucaggccuuguuaaucucuugcuuggacuguugcacuugccucuuaacucaccacuugcuuuggucuuauuuccaaugacagcaaaucugaucacaucuguuuaaaauagucauccggcuggucgcaguggcucacgccuguaaucccagcacuuuggggggccgagcggggcagaucaccugaggucaggaguuugagaccagccuggccaacauggcgaaacccugucucuauuagaaauacaaaaauuagccgggcaugauggcgggugccuguaagcccagcuacuugggaggcugaggcaggagaaucgcuugaaccugggaggcggagguugcagugagcugagaucgcgccauugcacuccagccugggugucacagcaagacugugucucaaaaaauaaaauaaaauuaaaauaaaauaaauaagucauccauugccuaguggauaaaauccagacuccuuaggauggcucauuuacuccagguuagcuaauugccuguccucugguagaaacacuuuacccacauucuuaucuaccauaugauauacacauguguguguucuucauggauuguagcuucgucuuuguuuccccagccucuuguauagagccuacacauagcaggcacuuacuuaugcauaauaguggauaugaaccguauggaauacuuccucauuccucaucacucaucauuugccuggugaaaugcuuugucccgaaccugcccuauauuacuuuauacauguuguaccuucuuccugcuauguuauucuuccucuugccccuguuuccaccccauccaccuagcaaauuucugcuuuuauuaucucagugaagcuuucacccagcuacagucaggcauucccucagggugcucuaucucuagucugcuaugaaucuauuaauaguuguaauauaacuuuucucaccuguguuuuacacacauauacacaacacagaugugcacauauaugaguaucuguaggcugggaguuuaacuacuacgacaguuuuuuuugguuuccccagggguuuggcacacauagccuuauuaaauguguaaaugaaugaguauagaaaaaauuugaacuuguaaacauaaauagauuuuccccagucucggcaacauagugagaccucaucucuacagaaaauuaaaaaauuagcugggugagguggcacaugccuauagacccauugacuugggaggcugaggcaggaggauuacuugagccugggaggacaaggugccgugagccgugaucacaccacugcauuccagccuaggugacagagcgagacccugucucaaaaaaaaaaaaaaaaaaaaauucuucuguuaauguaaaugcgugauauaaaacauuuaaauuucauuacacugaaugaucucuaaggucuuauuuagcucuaaaauuuuauuacucuuuaauauucccacagccuucagucacauauaugauauuuaugguggaucagaaagauacaguuucuuuuuuugccaaagaagagcuuaaagacuagcacaaagccaugaauaguggauguaucgggaaugcauaauacccagaaccguuaaauguuagagcuggaagucaucuuggauauauugauuacuaggagugaggcccaguggcuugaggagucuucagucucagaccucuggcucuuugccuagacauaguuccaugaguucccugugucugcaggaguguguauagcuucagggcucauucucuuucugagcugcagauuaguggcaguugugccaagagccucaugcacagacagugggagcccggagagcuugaccacauuggcuguuggccucuccuagcugaccugugccccucuguguuuauuucuuccuucaccucuucagucaggauacuccuggcagcaccuugucccucuuggcagucauuugguugucaucacagauuccuccaaaguuauucuucagucaaugaaagaaaauccuucagugauuaccaagccauagucaaggacaagaaaauaaggaaauucuuagggguuugucuuaguccguuuggccuacuauaacaaaaugccuuaaacuggguaauuaaaaaaaauuuuuuaacuuuguuuuucuuaccaccuguauaauugcagaauagacuggguaauauauaaguaauagaaauuuauugcuugcaauucuggaggcugggaaguccaagaucaggguaccagcacaguuggugucugcugagggcccacucugcuucauagaugaugccaucuugcuguguccucacaugguagaagaggcaaacaagguccccuaagccgaucccccucaugaggacagagccuuugugaccuaaucaccucccaaaguccuaaccucuuaauaucguuaucuuggggguuacauuucaauuuaugaacuuuggggggacaugaacauucagaccacagcaggauuucaaucauaagauuagugaguguuaauuuucguuuaggaaauacaauuuuuaaaacauauuuuuaaaauaaaucuuuuaugaucuuuccuuuuauagauaagaaaacauauggugaaauuuuugaaaaauuccauccaauacguugaagucuucaaaaugcuugcuccaguuucacugauaccugcuguuucugaauuugauggaacauguuucuuaugacaguugaagcuuaugcuaaucuguauguugacaccuuguaauuaaaauacguaccaugaguacucugacucuuuauuguuguaagaaaaauaguucaucaucagagaauggucaguuuccauucacccaucugaaagauuuuaagaugagguugaauucuaguuuagaguuagcagacuacccaaaucuggcccacugccaauaaagucucauuggaacacagccaugcucauuuguuuacauguuguuuauggcgacugccaugcugcaagagcagaauugaguaguugugauagagaccuauggccugcaaagccuaauuaauauguagcccuuucagaaaagguuugccugccccuguccuagugcaaagugaauuuagagugagccagauuauggaggauucugugacucuugccaaauaauuuugacuucauccuguagguauuaagucauuaaggcguuuuaaaucauacagucagguuuguauuucugagcugucuauaaugaaugauauagaaggugguuucgaaggaggagacuccagacaaggaaaacagaaaucuuauguugccaaguugucuuugcucuuagguggguuauccuggagaaaauggacucaggagcuaauacugucuacaguggagcuuggugcaauuagaagcaaaagacuguaccuaacuggaaugagguuacuuuuuauggcuuaucaaaugcuuguccuggcccgaugcaguggcucaugccuguaaucccagcacuuugagaggcugaggcagggcagauugcaugagcccaggaguucgagaccaacuugggcaacauggugaaacacugucucuacauaaaauacaaaaauuagcugggcgugguggcacguuccugcaaucccagcuacucauaaggcugaggugggaggaucuauugagcccuggaauucgaggaugcaauuaauugugguugugucacaguucacugcagccugggugacacuccagccugggugacaaaggagaccccgucaaaaaaaaaaguacuugucccaaaaguuuuuguuuccuagcuuagaauuuauaaucagauuagguuuuggagauaaaguauaugugguauuuuuuuuuuuuuuuuugagacgacagucuugcucugucaucaggcuggagugcaguggcgcaauuucggcucacugcaaccuccaccuccuggguucaagcaauucuccugccucagccucccgaguagcugggacuacaggugcaugccacgacgcccagcugauuuuuguguuuuuaguagagacgggguuucaccauguuggccaagauggucucaaucucuugaccuugugauccaccugccuuggccuuccaaaguguuggaauuacaggcgugagccaccgcgccuggucuauaugugauuucaaauuagguggccuuauaaauauaagcagaugguuucugggcaaaaucaaaugauuucugucucuauuuucuugaguaccaauuguaaaaacugaaauuagguugaggaaagugcuuuagaaauaauaaagauguacaaauacaa

SEQ ID NO: 191793 - RNA, 152049 nt, Homo sapiens
ugcccucccgcggcugcagccggagccgaaggugguggcugcacaguagacgcccccucacggcuucccccacacgcucccgcccccucgcucgcccaucgcgcuucccucacaggcucugcaguccucccccacagacgccuucccccuuggacucucauucccuuuuccacggagccccgcgcuuucgugagcccccucgaggaaccuggucuccgcauccaguuaccaccuccugccucagaggccaucugagcccuucgcaccucgccccucaguccccccuuccccccccgcccgcgucgccucgcucccucccgcccccccaucaucccuucccucgcaguuccccuguccugaggggagccccgccacgggcagcgcggcggcggcggcaggagggagaaagugaagcgguagcucgcgcacacucgcgcccucacucccggcuaggcggcacccaccgccgggaggaggaggaggagccgagaggagcugagcgagcgcggaaggugagagcgggccuaccgcccaguaccccucgcgucccgggcugccagggcuggggcgcggggguggggacggguggagugggggucugggcccauuuauuucgcguugcggggccgggcgccugggcgggaggaggcgccagguaaggugaggcgggcggcgccccgcgaggcccgcucccgucgggccaacaaaggcccccugugcgcguaccggcggggucgcgggucucagacgccgggcgauucgagagaccugggagagggaaggggcggggcggggccaggccaggcuggagccgggaggccacacgaguaccgguccgggaccgaguccgucccgaacuucgcaguccugcggcgcucacccugucccgcuacgaggaggcacagcaaagcggcgcccaguuccuucugcauggaauaaaugaccccuuccaggcuuggacagucaccuuuaggguucuacucccugaaaaauaagggcugguaggacuugacuuacgcagccccucccccaccccggaauauucuguaacuugggaagugaaaaacaaccggggaaggagauuuauaguuauuuuauguucauuauuacguuugaaaagacaugauuguuguagccuucgcuauccuauuucagcaguacacauuacugggaguguuuuggaagaauacuugagaaguaguggguguggcguugugagcaacguccuugguuuuuaaaccccuuggauaauuguucuacuguuacaaaaacugugaacagugaagggaaggguuaguuccgugguuacuaauaaaaauucagauucauuagucuugacuuuaagaauuguuccugagaacaaucuuuaauuuugccuccuacauuuuuggguucucuuucaacucugucaggagaaaguaggaauuaucaguacagauaccucaucucucuuacccuguggcuucaucuacuucuugugugaccuugagcaggucacuuccagccuuaaaagcuccagaaguuugguuuuaugccccaaaacgggcaaguagcaagcaccggacucagcuuucaagaguccacugaagaauucccacacugugaagucuuugcuggccuccauccugucucuccucuuacagacagagcugauuucuucccauuggcccggugggauuucuaccacagcacuuacaacauuuugguuccuauuuggaaaauucuaagucaggugcauauaaaaacuccccaccucaacuagaaacuaugccuuucaaaaaggguuuugggaacauugacccugaaaacuucccauacuuucccugaagcuuauccauacucuuuaacuacaugagcucaugggucuaccuugguaaauuugcuuauucagucaauucguuuauccaacauuacuggaguucggagagcuacuauguuucaggccucuugcuaaggcuauggggauucagucuauuaagauauucccugucuucaaagagcucaaagucuaaugggugagguagacaaguaaacaaugaaggucugcccuaaucucugggggacuccaguuguacagguaguagugugcaauaauugaggcugcuggaccuguuuuacaagucuucucuuggccaaagugaguccugcagggaaggugaccugccucauccauaacagggcauuugguaaaaagcuuguucaguucaauucaauauacauuuacuaagcacauguuuugagucccugugcuagguuugaaggaagcagugccucaaaggaagguacugugcauccagaaagauuucuguaaaacaaaaccuuaccacaucagcgcccccuaccccugacucuucauauucugaagauaaauuucagaguaacauggaauaaaaagcucucagggaucagaccacugccugccuuugcagucucacuuucuguggcuccccugccacucucaucuucacucuugcauguucuguuuucuuccuggaaugcuucccuuccaccccuuaccugccuguggagaugaccuuguugggccucugggaugcagucccuuagucucuccuuuuccugcauagaaugaguugcucuuccauccucuggcucauguacauaccacuuuuauggccuucuguagcgcucuguugcaauuacuugaguuugugccugucuuuuuuugguagccugugaauuucuuuucuuuaauaagcccuuuaaaugauucugaugcuugcuaaaguuugagaaccacuggguuaaaagaucugcucuuaauaaaaaccagcacccugccagcuccugcugucccguuuuucuuccguagcacuuaacugcgugacaucccaucccaucccaucccaucccucucuugccaauagaaugaaagcuuccugagacugggaaguuuugucaguuuggucauugcuuuaauccuagugccuagaauagugacugcauauagcaggcacucaaguauuuguugaaugaauaauguaagaugauuuaauucuauguauugccagcugcgacauugggguuuuacucaagaaccguucucagaaugaauaggaaucaugguccaaugugcaaauccaaggggauccuaacauuuuugggggauucauuuuagguugagcuuuucccuuuaugugucuccaaccaaagccugcaagaauuuuuagccuagucuuuuguucguuuguuuguuuuaaccaccaccugaaaacugcuguugcaauauuccaagccaggauuguuucuuuugaauuugcaaguugguuuugcaagucuaaauaagcacucuuaacuuuugagucuuuuaacuuaaaacugucucuuccuggucuccugugguuuuugucuuucucuggugauacuuaaagcuauauagggccuguuugacuccacacaaagguuucucuuccuugucaagcucuuaaaaugcuuuguuucuuucacuuucuuauuagcccuaagauaccaugcccaguuuucuccuuuccuagcuuccuucugggagaguggcuucaauuauucauccguuuacuauaaaauuaugaguccuucuccaccaugugccagacccugugcugggcaggauguucagcuauauacaagagugcagcccaagucuuuaaggagcuagagauaauaugacaugauaagugcugaaaugaagagaugaaauagagggaugaaaaaaggugguauaugaucauaaagggggggagaaagcugccuuucuauuuguuucccucaguuuaggaauaauuugucaaacaagcaucauuuugacaggcagacuuuuaaaaaauuuuaagaggucaugggcuuuguuggggaaaacuaaaacaaaaaucaagguggaaucagcaguugccaauuugagacauuaauucuguuguugcugguuuuaaugaauuuucugaucccucuccauguuauuuuucuaaauaauaaccagaaagugggagaaaaauauuucuuuuuggcauaguaaagagacaaguuuaagguuaucaaaagaauacaucucacuacaguuuauuguuuauuuuugaaaagcgauaaacaauaugcaucuaaaaacgaggcuuuugacuguuuaugauaaagaaaugauaaauguuuggagugaugaauaugcuaauuauccugauuugauuauuacgaauuauauacaucucaaaauaucauaaauauguacaauuauuacauaucaacuaaaaauaaaaggaaaaaugcauugauucaaaauuaauagucaguauauucaaacuugaaaauaaaaaauuuaaaaacauucucccacaccaguguuugcuccuucugggucauuuucuaugcccauuauuaaaaaaaaaaaaaaagucucuucacagauguuuuaauuucuaagggguaauguuguaauuuguagugggugaaaaugaaacccuggaaaaguuaggagaccuucuuuagugucuauguuacugcaugaccuuguagaaguaauuuuuaucucuguguuuugucccaacuguaaaauggggauaguaauaguugcuacgacuaguuuacaggaucaugaagcaauuaaaauaaugacuauaaaggaaucuuugaaaaguauaauuugcuuguuaguuguuagguggugguaagcuuacuaaaaauggcuuauguuacugaauaccuguucuguaccaggcccuauaugagauguuuaacauguucuuuuuaacccucagaauaaccuuaugagaugauugcugguaucucuguaucauaggugaggaaaccugagagucauacuaguaaagggagcuuauuuaagguuuugcugcaaguaaguggcagaccaacaauucuaguccaugugcaccugacuccagcagcuaugugcuauuuucaguacagaggcugcuuuuaauguuucugcacagaggauauaggaauguuuugcaaguaaauauauugcagugagaguuaaaguuuccauuugguauguuuuuuuuguguguguauuagaaggcuuggugaagacagauuuacauucguuuacauuuaucauucauacaggaaaaauaacaucuuuccuggauguuauuuuguucaaucuucguaacagcccuaugagauagguauucccauuuuacgaguuagcaggcugaggaucauauuaauagaagucuuggcuugcucagaggcacaucauuaaugaaugccugaauauugauuuuaaaccacauuuuaaaauucuaaguguaguacuuuacuuugccacuauaacauauugccuuuuaaacucuaucaaacuaaauuuuggggcacuagacacauucuuuuaaauugguuccuaaucucuuuagcuucuucucccuaagaaaacccugacugaaguccacaguuugaacuagaaaggauaauugcugauaaaacucuaugucagauggucaugauguugcagacuuagaagauaauaccucuuuacugaagcugccagaucaggcuuuauccaguauuuggaaucacuugugccugaauauuucccugugccaucguaaauuuauuaacuuaaugugcuacauuuuucuacccuuuuuguaagccuuuucuuucaugaauaucuuccucuucucucccauucuuuuaguuuuugagauggggaaagucauguauaugcuaggcuucuccggauuaucccuucuugaggaauaguguaguaguaagucuagaaagaaccagagguucauucaucccucaugaguuuucgugguauugauugacuguagaauucaucuaauucuuaaguccauuaugucuuggcuuuuguuccuggagucagaguuagguaauuugcaugcaggauugggaaauccauucuuguuuaugggcugcuuucuuuuauuacuuuucuacuuccagccuucuccaauaucccuuucccuuucagacuguuaaguacuaacugaggcuggcaagagcauuuucuaauuuauagaaucugccuuuugaaucuuuugggauggcaaaugacaaugacaguauaugcauggcuuccacccucaucugccugccuauaucuuuaagguccagcuuuccuuauuuccuccuggauucccacaaagcuaagauugaugucuuccucacugguggaacccuugauuuguguauuacugcacuuaccaagggaggguuuaaggaagagcacaaaauuugaaguuagacaaagagcuacuuggacacuuauuuaaaucucuauuuguucauuugaaagaaauaauaccuaacuuacagaauucuugugaagauuaauaauauauguaaaagugaauuguaagauacugagcuauauagauguuagguagaguaguuuguaauuuuaugacuaugauuguguguagcagugguuuuaauuucggcuaugcacuugaauuacuugugaagauguaaagaguugccuuggcaucucuauuuugaaagguuuauaggugauucugauaugcaaaguugagaagcacugccuuauauuaacaauguuuugcauaaaugucuuauguaaguauuauaugaaaaguaauauuuuauugccauuuaaaguucauucauuugcuaaauacauauuaugcaucaggcauugucauagguucugaauaaacagaugaaucauagccucuacccuuggguuuauaguuuccgggagaaacagacaugugcauagacaauuacacuacauugagacaaaaaaugacaaaaauauggagauaagugcaagugccaugugaacacagaggaagggcaucugcugcacuugaaauggggguggccuggcaagcauucuuaaaggaggugacaucuaagauggguucugaaaaaugaucagggguuaacgaagcacagucagggaggggugagaagaaaggggagaugauggacccucuugaaagagagagcaauaugugagcagaagauuugagagccuguuuggggagcccuguguaguuuaguaugcuuagaagauaggguguaaaguggggaggcgugagagcagagaggaggcagggcccagaugaugaagggccuuuuguauaauguacaaaauacuuuuacugauauuaucugacuuuauucuuuggacaauccccuggguuagcuaggacagguguuguuuuauauucauuugauagaagaaaacacaaagagguuaauugacuugcugaggcuauacagcacagcuaagaucugaagccagguucuuaugauuguuuaguucaucaugcuuuuucuauuacaccauagccgucuuagacuuuugcggugugguagggaaucagguaagcucuguggauauaugcacaacaauuuggaagcuguaaugugcuagacugauguuggcuaacucauuuuacagaugaggaaauuuaggagcagagacaucaagcugucauuugaagacuuuuuuuuuuuuuugagauggagucuugcucugucgcccaggcuggagugcagugaugcgaugucggcucaccgcaagcucugccucccggguucacgccauuccccugccucagccucccaaguagcugggaccacaggugcgugccaccaugcccggcuaauuuuuuguauuuuuaguagagacaggguuucaccguguuagccaggauggucucaaucuccugaccuugugaucugcccgcuucugccucccaaagugcugggauuacaggcgugagccaccucgcccggccuugaagacauuuuuaaaaauuauuacuguguaaccacagcaagucacuuaaccguccugagacucaguuuuccuuagcugucauauaaauguguugaauuugaugccaacuucuuugcuugaauauuucgacagugauucuuaaccuucucaccuacucccugcccucacccuuucucugugauacacugggauguaguccaucaguaacaguauuucacuauggaaauaguucccaaugggcuacaggaacaaaauguaaauugccaguuuuggggauggguaaagagggacuugguauaguuggaggggcucuugguucuccaauuaccuguuagagaauuacuauuaauauuuuauuuauuuauuuuuuugagacagggucuugcucugucauccagguuggaguacaguagcuccaucauagcucacugcagugcugcccucccgggcucaagcaaucgucucacuuuagucuccgaguagcugggaccacaggggcaugcuacuaagcccagcuaauuuuuguauuuuuuguagagacaggguuuugccguguugcccaggcuggacucaagugaacugcccgccucagccucccaacgugcuggaauuacaggcaugagccacuuugcccggccaagaauuacuauuuuauaacauucccucccacuuauuuucucauauggaauuaucucaccaguccagagucugagauuuuuuugguauccaggauagauuuugcuuaauuuaauaaauuacauauguaauuuguaaaguaacuuaaaaaaaaauaaagaaccaggugagcaaaaugagaaagcccauugugauagacuugaaaaguccaaguuuccuggacuuucuagagauuauauauaggauuauauauauaauuuuugugcuuuacuguuuucaaaacccuuuuauauagagucucauuuaacuuaauucuguucuuuagccaucauauuuuuauaaaugaacagaaguuaaguggcaugauuauguagcugggaaguuacaaacuggaaucuuuaauucauauuuucugucuccaaaucuggucaccuguuccugaucauuugggugcugcccugaccaguggcacuuuuuaaaaaauuguagguuccuaggagaaugguaaaauauauuuauaguucccucuaacucuuucaaaaaaucguuuuuuuacuauccauugccacuugccggauaauugacuuaguugacuaugugguaaagguuccaggacaguuaggaauggcugcugaguauauucuucacacacacacagacacacacacagacacacacacacacacacacacacucuuucauguauguaccaauccaauacagcuggucccugacuuacagggguucaacuuaaugauuuuucgacuuuaugaugguguaaaagcaauaugcauucaguagaaaccauacuuggaauacccauccaaucacuuucagugcaguauugaauaaauuacaugagauauucaucacuuuauuaaaaaauagacucuguguuagaugauuuugcauaacuguaggugaacguaaguguucugaguauguuuaagguuggguaggcugagcuacgauguuugguauguuagguguauuaaaugcauuuuugacuuaaaguauuucaguguaaguuggguuuaucaggucguaaccuaaucauaagucaaggagcaucuguacagcucuauagugcuucuauuuauuccuuaauuagacuacacauauuuauugauuucuuccugugugccaagcauuguacuuaguacuaaggauacacucauaaauaauacagacaugguccuuguccuugcucuuacaaagauuacauuccagaggguaauacagagaaaaguaaguagauauacaaguggacaguugcagauuuugauaaguccuacaaaagagauaaaggacuaauguagagaauuuuggagugauaaggaaaagaccucauugaggaaaugaugcuuuuaaacugagaugugcaugauaaauagauuuuagucaugcagaacacugagggggaaaaagcaugucaggcagagggaacauuuuaaaugcacaaaggcccugagaguagguaaaaguuuagagaugugcugcucaauaugguagcuacuuagccaguguggcuguugagcacacugacugauucacauagagaugcacuguaaguguaaauaaaauacauaccagaguuugaagacaauacugaaaaaauaauguaaaauaacucauuaacuuuuuauauugguuauauguugaauuguuaauauuuugaauauauuggguuaaauguauuuuaaaauuaauuucaccucuuuacaaacuuuaaaauauggcuacuagaaaauuugagauuacauauguggcuuuucuuuaaggcuaaccguaucuuucaguuggauaaugcugguuuaccucaacauagaggaacuaaaaaaaauuauggcuguuguauaggaagcaagaguaaaugguaugagaugaaguuggagugggaggaagagaccuuucaaaacgcuacccuguguaauauccuaguuaauccgaagggacugagaggggauuaucaagucugauuuuauagauggagacaguaauugccaaagucucucuucuccucucuagagugcuagaaugaggagaugaacaagcacuuuuagcauaguaucuugggaguagaaugcucuauuucauuguuagcuaaaacaaacaaguaaauaaauauugaugaagaauaaauugauuaauacaaguuuccaaguggucuugagacugccucuggcuaucugugguagguggacccucucaaagacugaauuuuucauaaaaauuuuccuguaggcugacucuucuugaaacuguuucauuuuauacuauauuucuuuaauuuuauguacguuaaaaauuuuuuuuaaauaaaacauuggcaggggaguaugugcagugaacacccauauacccauuauuuagauucugugguauuuugcuguguuuucuuuaucgcaugucuguguaucccuugauccauucauuaaccugucuuauuuugaagcauuucaaaauaaguugcagauaucaguacacccguaaacacuuuagcauucauaucauuauuugcuuacaugaaacuauacucuuacuugauacucuguggcauuauuugaugaauaucugucuacccuacuagacccuaaguuccagagaaucauuucucuuuaaggcuuggcaccuucaagagaaugaguuuuaacauaguacccuuuuuccuaaaagcccccccaccccacccccacccaccuuuuuuuuuuuuuucucacuguuguaucccccagugccuaaccuauaguaggcacuuugauugagugagugaaaguggagccagcauucaaacugugguccacaugacuucuuuuuuuuuuuuugagacacaugacuuuuuuuuuuuuuuggagauggagggucgcucuguugcccaggcuggagugcaguggcacggucucggcucacugcaaccucuuccuuccggauuuaagcaauucuccugccucagccucccaaguagcugggauuauaggugcaaggcaccaugccuggcuaauuuugguguuuuuaguagagauaggguuucaccauguuggccaggcuggucucagacaccugaccucaagugaucugccagccuugggcucccaaagugcugggauuacaugugugagacacugugccuggcccacaugacuucuuuacuaagaacuguuauuugauuuucuuaaguucaaagaacauaaaaaaaaaaauccuuucaaugucugguauuaggagaagagaggagagaagaaaccuuacugugcuaaauguguagcugcccagugcaaaugccucugaccugaguaaaaguugaaaguauguccugaugcuaucuaaggaugcggaacauuuuuuuuuuuuuugagacggagucucacucuguugcccaggcuggagugcaguggagcaaucucggcucacugcaagcuccgccucccggguucacgccauucuccugccucagccuccccaguagcugggacuacaggugcccgccaccacgccuggcuaauuuuuuuuuuuguauuuuuaguagagaagggguuucaccguguuagccaggauggucucgaucuccugaccuugugauccacccgcuucggccucccaaagugcugggauuacaggcgugagccacagcgcccggcgaaaagauguggaaaauucuuaaagcugaucagcagcuacuuugcuacucuggaucuuucuucauuuccuuuaagcugaggaauugcauguuacugaaaaauggcauuggacugagacccuugaaggccuauuugucuucuagugggucagcucuuuuuaguauuaucgaaggcaauguuucaaaauucgcaguuuucuuuuggauuaguauggguuucuuuaaagugccacacuauucuaauaaagcuuaacaugaauaaugugacuuuguuccauuaaaaauaacagggcuuuguuucacaaacuuuugaaucaauuuaaaauuuaguuaugaugccauccugacaacccuuuucuguuuccuuuuuugguguauguaaacauacauaaacauacauguaguuguaaucauaauguagaccuaaguuuguuguuugcccuuuuuucuugacuuauacacauucccgcauguuacucuuuagucuucauuguaaaauuuaagaugauguuccauaauuuacccgaaacuauugugucagucaauguucuacuggagaaacagaaccaguagaauaauucuuucuuagagaaacuucaguuuugcucuuaaagccuuucaacugauuagaugaaguccauccagauuauggaggauaauauucuuuacuuaacgucagcugauuguagauguuaaccacaucugcaaaauaccuucccagcaacaucuacauuaauguuuaauugaauaacuggggacuauagccuagccaaguugacacauaaaacuaucagguguagguuuuuagguuuuucuuuuccuauuauaaauuauacuguaauuuuacccaauagcacugcauauagcuuucuccuuucaaagauuacuucuuuagaauaaauuucuauaggugggauuacuggaucaaaggguagaagaccuaaugggcucuugacaggauuugacauuugcaaacugaaaaaaccacuacagccuuucuuuugaugauuucuucaggaauuggccuauucaacugacucauuuaccuuuuccacaagccuaguuuucugccuguguuuucuaucucuggaaauaauugcaugcuuuuccucagaauugucuucaguuuuacucuuauucuccuucugccacuuuuuuucugcccuuuaccucucugcccccacccuccagacuuugccucauauaucacagaugaaauagaagcuucauauuccuacuuagaauuuacuuggauuuguacccauuccuuccuuugccccuucuuuuacaaugaaagaagucauucuguucucuugccucaucucuucuucgcuugcuccuccacauguuuuuagauuguuucccauggucccauuuuagaaaucucgcuuuauggcaucuuuaaauuuugccuucuacugaguuacccuaagcaucauucaaacauucuacuuaaaggaaaauaauuuuccuuuucuucaccaaaaaaaaaaagugcuccugggaucccaugucagcuucuagauaaacccuaucucugcuuuccuucaaagcuagucuuuuuaaaauagcuauuuacaacuucuacuucgaguaccuuaccuccuauuuauucugcagccuacuccccuccugucuccacaaccucaucauaacugcucuugcuaaggccauuaaugauguucauggugccaaacuuaacuuuaaaaaaaaaaaaaaaaaagcaaacaaaaaaccuuauagccacagauguacccaauaauccuguaccucaauggcuggcuggcuggcugacucccucccucccuuccucccuuccuucuuuuuuuucuuuccuucuuucuuuuucucucucccuuuuuccuuuucaucccuuuuuuuuuuuuucuauucuacagaguuugagaaagucugucucuccucagggccuucacaccuguucuuuaccccugguuugcuguucgcaauucuggcuucuccuucucauucaguaaacaaauacucauugucuacuguaaaccaggaccuuucuaaucuaaagaagagccccacgccgggcgcgguggcucacgccuguaaucccagcacuuugggaggccuaggcaggcggaucacgaggucaggagaucgagaccauccuggcuaacacggugaaaccccgucucuacuaaaaacacaaaaaauuagccaggcgcgguggcgggcgccuguagucccagcugcucgcggggguggcucaggcaggagaauggcgugaacccgggaggcggagcuugcagugagcugagaucgcgccacugcaguccggccugggugaaagagcgagacuccgucucaaaaaaaaaaaaaaaaaaaagaagaagaagagccccucuguuuuccucuuacagcacuuuguuauuuucugcgauggcauuuauaaugauuugugauucuguauuuauuugacucuugguuaugucuagacuuucaacuccauggagucaaaggucaugucuuuuggucaccauuguaccucaucacuuaguacaaugcuuggaacacagugaggcuuguaaauauuugcagaaugaauaagcucuugcuaucaguccaauggauuaucaagccuuguuaguuuuaucucuguaguuuuuuuuaccaguuuauuuuuauuucucuauccuuucugcucugauuuagacuguaaucaucucuucccuugacuuuuaguaaccuauuaacuagugucguggcaaccagucuuugugcccucuuauuuauucauuauucugccuggaguaauuuuucugauccugucacuguucuucccaaaagccaucagugugucuccauuguuuauaggauaauauguaaauuaguuauucagggaacuuaauaauuugaccucaccuaccucuucagcaucaucucuucuaacccuacucuaucucucuaaauagacaguuucaguuucauuccauuucauaucauauuacccuguucccucagccuggaauucuguuuuccucuaugcuuuuaaaacucuuuauuccucaagaugcaacuuggaugccaguucuuccauguaggcuuccccaguuuucauccucccauuuaugauuuuaaguuccuagaggguaguacuuuguuuuguucuuugcuguaucuucaguaucuugaucagugccuggcauguaguaggcucuuaauacauauuuguugaaagacugaauaaaauaauuuacuuuugcacucccucgacauauauucaucaaacuuucuugaauuuucguaguacucucuccguccuuugcacuauaauuaguauugaaguucauuuguuaucuauagggacuuauaaaauuagcccccacucaaacauuccucccugcucaccaguaaggucuguacauucaccccucuuugucaguaagugcuuuucuaaugguaggauuauuaacauugaacaauguaaugcaaguggauucuaaaaugaauguugaaaaaauuuaggaaguugaaauaaggcaauauuggauaauggccugaaucacacgcacaaaaaucacugacaaaugaggauuagguaaauuuagaccaauuuaaaauugaagggagaauuaauguggguaaugacauaacaggacauucggaggacaaugauuugaguaacaaaggauuaaaagagacccuugggaaaaauugaugaagcucuugaauauuuuuauaaaauugauccucuuaucgauauguuuugaaagccaaaugugaagugacggauguucuuuguucuaagaauuaacuuugugggcaauauaacaaguuuuauuaaauuaggaauuauaaacauuuuaaaauguuugucuugauaaauuaaaggccccaucaacauuuuaaaaaaauuuacuaagaaauuuuggucccuugucaguuaacuuuaagugguauuuuuggauaguaguuauccucacauaacaagaauccccucuauguaugcuuauuccuccauuagauuuaguucccugagauugggauuguguuuuuuaaauuauauuccuaugauggcuaccucagagucugguacaucagagaugccuaauaaaugcauagagauaagaagugaauaauaauugaagggacuugguaaggguccuugaaagguccugucugguacagagcuuauacagcagguauaugguagcauuugacugucaugcuuuguuaagaccaaaaggaaaaccugucuuauucuuccuuuucccagcuccugccuaguguguauuuuaauauucagaaucuguucucugccucaguagcuguuauucucauuguaauucuuccuggagauugagauggaaaugagaaaggcuuugggcugccgacuggguguccacauucaugagaacuuagaaaugaagagggaccaaaugccaugccugaccuagacagcuucaggucagccaauuguugcuuuccugccucucccuuuguucucugugccucuagccuccuaucugcuggagguuugugcuacagcuguuuaugccaauuaauguaaugcuaaugcgccccuuaaugaacccauggaagcacacggucccagccagugaauaagaacugcagagccgcagccuucaaagcaccuuuuuacuaacaauuggaccaggcaccugaauaucuuuucacauuguuuuugaaaccauggaaacagaaguugaacacgaccuuaguuuuggaagucuaacagcucacuuuauagaauaaggaaaaauaaugacagagaugaugaaguucaugcccaauuaauaauuccaaaccucacauuucaacaaggcuguaacauguaaauauaauuuucucuucucuguguauuguguagcuguuaaaaucucugcuacugaccuaacauugaauccuguggcccugccauuuccugacugugaucuggccagaguaguuuuaguuaaccucugugguuuugguuuccuuauacgugaaaugguacuaauaauaguaccugcuuuggcugggugcggcaguucaugccuguaaucccagcacuuugggaggccgaggcgggcggaucacaaggucaggagauugagaccauucuggcuaacacggagaaacccugucucuacuaaaaauacgaaaaauuagccgggcgugguggugcacgccuguagucccagguacucgagaggcugaggcagaaaaacggcaugaaccugggagguggagcuugcagugagcugagauuacgccacugcaccccagucuggguggcagugcgagacuccgucugaaaaaaaaaaacaaaaaaccaaauaauaauaauuguaccugcauccuauguuuguuauuaggauuacaugagguaguaguuguaaagcacuuagcaaauuuuggcacauaagaaguccuuaacaaaugucggcuaucauuaucauuacaggauagagaagcuaaaaugauuuuaaaugacuucugcuuuaauuuauagcccugcccucaaaaccuuuguuccuaauucuucaauuagaauauaagccuugugaaaacaaagaccuucucugcuugcuucuuuguuguccucagcaccuagaccaauuuuuagcacauaguagauaccuaauaaauauuuggugaauuaaugaauucuagggacauuuucucugaauaacaucuagguuuagauacuugaaucuuuuuuuuuccuuuacuguuguuuauaugaauaugcacuuaaaaaauaguuuuuauguugugucuuugaucuuuguggguauccuuguuuccuucuacguuguaaggcuccaagagugggagagugugaugucuacuaugggaaucucccuauagcuucuaguaugguauuuuuuuuaaaauacaguuauuagugcuuaguaauuacugacaacugacuauaaaauucacuuguauucaacauuaauuuuuugagcaaaaacuaguaugugcagugguaucauuuccaacucuuuaagaaguugugaauuuguaggugcaggugcagucuuugguggcaagagacaccuuauuacuauuguaaauguugaucuuugcacuugaaauagcccucuccuuccucucugucccuuucuaccagaugacauaccccucauucuucagagcucagucuccugucaagucuuucuuccuuuauguaagucuuucuuccucuuuuuguaaaucucuucauggagguaguggauaacuuuugcaaaugggguuauuuugagggaggacauuccacacugauagaagagcugaugcaaagacaugguaggaaagggccaggugucaugggaauaugauaguaaauauuauaugcuaucuuauuugucauggcucuuauuaauaggggcaaacaggagaguccauucuagcaaguuuaagcaaaaaagauuuauuaaaggauaucagagagauuuaggaaucuuugggagaguuaaagaaauggacccggcugggcuuccaggaacaaacuccccaaacuacauugaauaacugaguccccaaggaugcugcucuuugccagaaucaggaaccuguugcuacaguugcuagauagagaacuaugcugccucugcugcaguuuguuccagcaaaagggauguccugugcuagucucucccaucauccaauuuaguucuaaucaguaucuagucugagagcaucugaaugguggaaccuaaaucacauuuagaaggaaaucugagaaguaauguuuuuuuuuuuuuucaaccucuguagugccuacuaggcuagaaaggaguuggaauagguguugagcaaagcaguguauacauuaugcccuagagaauauucagguggcuguacccucuucuaguaccaaauuguguaucauuuggaauucgguaaacagaaauucugacucaaauuuggcuuaaaucauguugacguuuuuaucaugcuuguguuaccuuuauccacaagccggcuuccaucaugguaguaaauuggcugacaagaccagcuggggagauaagcuucuuuauucaccaguggaugagagagacagagagagagagagaaagggagagagacugacugauuuuauuucagaaaauggacaaaaauuucuucuccucagugaaauugaaccaguagagaccaccugcccaucccugaacuacaagaauuucuagggacaugccagguacugauugaguaaaccuaaaucugauucaagaacuaaucacuggcaaggagaauggaauuaccauguuugguuuggauguacaaucagggccugcucuuggagcuaggaauggggucagcuuucucugagaacagugcuucucaaaguguuguguucugggaacuugcuaaaaaugcaaauucuggagccacaucucagacuuaugaaucaaaaacucuggguguggggcccaggaaucuguguuuuaacaagcccgccagaugauuuugauuucaugcuaaaauuugagaacugccuuagaaacuguuugaugagggaugaauaccugauaaaaaaaaaagucugggcucuguuagggagaagaagggaauggaugcuggguaggcagccaacagcauccauuucaaaacuggaaagacggauagggaccaguucaugaggaaucuugaaugucuagcucacaaggugguggugguugugagauauaaaaccggauaaugugugucugagggacuuguacaaugaaggagauagguuauaauagggacagaguauauugaacuuggagccagaguuuggauucucauccuggucuuuuuaccucauugagcuucgggcuccccuucuguaaaauagggaauauaaccacugggguguugagacaauuaaauggacaaauauauguggaagugccuaguacguaauuuagcauauuaauagguaaagagcuacagaauaugaaugaugauacuuggcuaagguaguaugaauuuuauuuauuuguuuauuuauuuuucaagacaaggucucgcucugucaccuaggcuggaguacaguggccugaucauaguucacugcagcuucaaccuccuacuucagccugccaaguagcuggggcuacaggcacgugccaccauacccaguuaauuuuuuuguauuuuuuuguagagaugggguuucgccauauugccagacuggucuugaaguccugaguucaagcaauccuccugccucagccucccaaagugcuaagauuacaggugugagccaccgcacccagccugguguuggaucuuugaucauauucagaucagcucugguuuaacugcaugaacauggguucugcucugcagucuuacccuggggcauuauaugaauuauuuggcuguuacagggauagugcaguuccuuuugcucuuauaacuaauauguauucagcuugcugugaccauacauauuuuauguucuucccuggcacuauaauucauuccuuuuuauuuucuccugugagguaauuaaaauuuguaauaccaugcccuuuucccccuuguuuuuuuuuuuuuuaauauaucucacauuuucuaaauauagaauacuuacaaguucauguuaaguuucagugggaaagguguuuagaaucaguuuggacucucuccuuugcuuuauauauaaagaaacuaggacagacagggaaauaauuuuuccaaaaaaauuuuuuuuuuuccugagacugaguuuugcucuuuucgcccaggcuggagugcaauggcgcgaucucggcucacugaaaccucugcugccuggguucaagcgauucuucugccucagccuccugaguagcugggacuauaggcgugcgccauacaccuggcuaauuuuuguauuuuuaguagagacgggguuuugccauauuggccaggcugaucuugaacucuugaccucaggcgaucugcuugccucggccuccugaagugcugggauuacaggcgugagccaccgcaccuggccuccaaaaucuuauauaucccacuucuuccuucuuccuauuucuuggcauggaugaauuuacaucuggggcuuucauuuuuuuguucuguaauacuaguaaaaagucauuuguagauuguuuagaucugaugggauuuaguuaaagucauaagccugauuugcugugaggcagggcugaugugccaaccuaggaagagagaaagcuagugaauagaaguguuaggaauccagcagagggaaaagggcccuaccaugaacacacucuuuacuccuacuuggcuuguuauuagaugugccaacccuguuauuagguggcuuauggcuucuucuuucuuuauaucuaggguguuugaggaagguaaauaugccuuuugaauggguaauuucuacucuuuggugcugagcauuuuccaccuucgucuauacuguaaauaaccagucuuuuuuuuucuuuuagaaaguuacugcuugaguggcaaggaaauuagagaaacugcuucucauagacuaguuggguugcuggcugaaggggacccuaggagaugucuaauucaacacccuuauuuuaugaaugagaaacugaagccaagagaagaaaagcagcucauucaauauuauauaaguuaguuacagagucaagaccacaucucagcacuucugacucccuauuaaguauauuuuuacuacaccucucugcaaggcaaguguaagaggaauugugggguaguguaaagagugcagauuugagggcaugagaucuggguacaaacuguggcucugcuacuuacugaccuguuucucagaaaguaauaucacuuccuuaagcaccaguuuccuauuuauaaaaugaaauuauguugauacucugccucacagcguuaucauuagaaugaaaugugagaugcaggggaaaaaaugaaaugaagacuuuaaaguggacguggccaauuuacuuaugaauuuuuagcuccaucacuuauuaacugugugauuuugggcaagucacuuaauuucugugaacguaguuuuuucuuuguaaaauugagacaauaauagcucucuuacaggguuguuuugaggacauuaauauauauaaauguaggggaaaagaaauauuuuucccauugcuauguucauggcugaggcuccuguagcaaaagacauuaacgagagaggucgggcgugguggcucacgccuguaaucccagcacuuugggaggccgaggcaggcggaucaccugaggucaggaguucgagacagccugaccaaaauggugaaaccccgucucuacuaaaaauacaaaaaauuagccgggcguggugguggcgccuguagucccagcuacucgggaggcugaggcaggagaauggcaugaacccaggaggcggagcuugcagugagcagaaaucgugccacugcacuccagccugggcgacagagcaagacgccgucucaaaaaaaaaacaaaaaaaaacaaaagacauuaacgagagaaaagcaagcaaauauauuuaauacaaguuuuacaugacauaggagccuucauaaggaaaugaggaugcaaagaaacaggcaaacuuguguauuuuuauguuuagguuugauggaagaaguggguagucuuggagaaauaugauuggacaaaggcgguaugauguaaugguaauaggaucaggguuggagggaacuuagcaaggcugguuuguucagauuuuucuguaugucccugugucuucagagaaaaaugaggcuuuccucugggaauaaggaggguaccucuugaaugaggaucugauuaccugcuucaggggagaagggugaggggaagcugagagugagaauacuuucuugcgucugcuguuuucucauaugcuaagaugucauauuuugggguagcaugucuugaaccccauuauaaagaaucaaagugguggcuggaacauaauagguagucaguaaauguuugagauauucucagaagacuuaguucugucuucucaaaugguuucccuaaagucuuaaaauaaauacaucagaacuucuuguucugugguuuuaaaguguuuuguggaguuugauuccagaggcuauaggugguguaagguaugagcuuugcuguuagucagauuuccauucuaaacuccuguggcacauaggcaagcucuucugcccagagaagggccucuagagauggcagguuuugugguaaauggauugaaaaagaggaggaggaaacuugguaacugggaaacuugggucacuucugcaggcaguugcagcccacugaauagcaguaugucaggaccuuaguggugaaaccauuuuucauugugaucucugucucuguuauucuaagugucucaaaaacuggaaccaugucuaaguccucugcuguuucaacaccugacccacaguagauaugccaauguauuuuuuugaaauaauaucuaucuaaaguggagaacuucuguggcccauagaguuccauaaaucccuaauggcuccuaauucuucaccccagcuucaccuugcagagauauuuguauuuaacaaggauuuucuagucuuuaaucauaaggauuugcaggauuucaggucuuggguuuuuuaggccuugcucugcugccuacuucccuuugcaaauauggucaggccagacagcuauuuccuucaucccuagucauugugugggaccugccagguucuuucggguuuuuaaugcuggggugguauuuguggcuuuaaugcacaagaguuggggagcaugaaacccacaugaucagguaaacaucauucucucaguggguccaggguuaugagaaaacauaaugcugggauguucuuucuucccaacucuaccccuagaauugauacuuuuauguaagccauuaauucaguaaauaccuucugagcauauauacuguggaucagacauucugcugggugcuuuaaauaauuaucuuuccaaauacucacaaguuaauacuuugaguuagacugaggguauugccuucaauuucgcagaaaaggagucugaaguuuagaugaaaggaaaugacuugccuuagcuaguaaagggcagacccaggauuugaaaccaagucuucaugacuaaaagauaaucauugauugucaugcuugucuaugcuuucagaaugggaagcuccuugaagaugcaugucugauugaauuuuugcucccuguucucagcacaggggcuaaaacagaauuuuuaaaaaauugaauauguaauacauuggaaaguccuagauagaauaggggaauuggggugaggguauugagaaacuguuuccuaguccacauuauuucccuggagaagcuccaguccuuagggugauuuuuuuuuuuuuuuuuuuuuuaccuauaggauugaaaaggaaagcauuauucauuccagcaacccauaaggaaaacuaacacaaacauuguaaugcuuuaaagaucuucgugucucauugggaaaauaacaccuccuucacuguguuauuuugaggaaaagugagaugauaaaagagucugccugaacucuaacguuuuauguuaaguuguuuucaugccuggcuuuaccugcccuauccccuuucugggcuucaguuucucuauguguacagugagauguugaacugaauggucuugcugcucuuccuuccuucauuaacaugagaacagauaguugaugccucugauguucauguuguucccauugcccuuuucucuuuaagcgcacugccuaguuuccuuuaaagucguugccuucuuuaguuuucuuuuuaagcuguuucugugugggcuaguguucccuuuugagguugaauugaauuguguaaggccucaggaagugguggaagcaccuuccucaaaccugguugcaccaaaggcccaucaagucaagucuuguccccaaagaggaagagaaagccugggguucuuagcccaggcuaagauugaaggaguuucucuuucgagcuuucuggguuaauuucaaaacguacaggagggacauuuucuuuuaaauuucaaacacucacccuguauaucauuaauauuccuuagccauuuuuguauaauaucauuuuuuaauuucuauccaccuucuuaaaucugucccuugggucagacaaaaugaauucaaccuuuccuccacaugacaauucuuuauaaucacaauagugauuuuauuacuguucuucuccagcuaaauaguuucaagaguuucucaaaugacuaccucuuuuugccuauuauaccacuuugcuuuccacaaaaaacuucccauggguagucccuuccucaugcuaaucuuauuucugguucuguauaaccuaucacuucuuuguaaguuuucacacuauugcugaaauaagccaaacauucuuucucauguucccuuaacuugggucucauagcauuuuguuuguuuaacauguuuuccuuugcuugcuguccuuacacucaacaaccuucaagaccaaguucaaauaucugucucugaugccuucucugacauuguccuccugugccaggcagaauuaguauuucuuccuucaguguuuauguguuacucuguuguaauggcuaugacaucauuucuuauauuauauuuguacuguguuauauuuuguguuguacuguauuguaauuaauguaauuuguauauucuaccucuccuuaaacacuucuucaaaacaacccuuccaagguuagaaauacguagcaaauaccagguggucaauaaaagaggaaaguaccacgcauugaguaacuuacugcugugcaaguugccuaauaaauauucccaauccucacaacaggucucugacauauuuuuccauuuuuucccauaugagucucccauuuuacauaugagguaauugagguccagagagauuaaaugauuaauuucugaucucacagcugguaacucagacagaauugggauucaaacccaagcuugcugauuccaaagcuugaguuguguuuggaacuauucuucugacuccuaauucaguauucuuucugugcacaucaaaaacacacaaauugaguauguagauguguuuaaugcagugauggacuagaguucaaaugggagugugguggaaugaggagcaaauagcugugguacucucauaauuguguauuaagaaauagcccuagaguuauuaaugccuuaauugcaacuguaggcaauucuguaauuuggcauuuuaaaaugaaucuauuuuggcugggcaugguggcucacgccuguaaucccagcacuuugggaggcugaggugggcggaucaccugagaucaggaguuugagaccaguccggccaacaugaugaaacccccgucucuacuaaaaauacaaaaauuagcugggcgugguggugggcgccuguaaucccagcuacuugggaggcugaggcaggagaaucgcuugaacccgggagguggagguugcagugagcugagaucgugccacugcacuccagccugagcgcgagacuuccccugaaaaaaaaaaaaagaaucuguuucaucuuguuagcagauauaacaacaccuaccuuuggacauguucuguucuaaaaagggaugaaaagcugcuucucucacacuaccacgggcaagauagaugagcucagcuuugacuugaaacaguguuagugcuuaugaaaucuuucgccuccaaguuuuguccuauuuuuguuaggugcugguaaccuaccuuucagagcuauagaaucagacaaugggaauaaugggauucuuaucccaacuauuugaacagguucucaccagggagagcccaaacacaaaggaccuuuuuggaguugguaaagaaggccaaaauguagacccugggaaacaccucugccuccuuguuuuguggcaugggcugcugauucauccuauauucuuuuaaguuggcuaauagcggauguguuauagaaagguaacaaaaauaggaucuagcucuucuuaucucugugugguuuuggguaaaugauuuauacuuccuaugucuuuauguguuuuaauccagugauucuuuccaggugaagggauccuguuguacagggaccacacaucuuugcugcucagggacuaugcaaggcucuagauuacagcuucuuuugcucuccuuuuuuguuuuuuuuuuuucuuuuugucacagcuccccuauucacuauuauucuaaacaguuuuugaaaucucuuaccgucugauguccccucacccauucucuuuauuguugagguucauaccucuuuuauagcuuuaccaucauuuuagagugauuuugggagggaacauaaguaaauguguuuucaaucugccaauuuuaacuagaaacaaacuucaaaggaaguuaaaccaauagaaaacugaaguugcauuuauaucuagaguuauaaaaacuuuaccaugaaaguacaugagaggauagaccuuucaaugagauguucuggauucaaaucuuagcuccaucaucuauuaacuauaugaccuugggucugaacuuucuuuuuuuuuuuuuuuuuuuuuuugagacagggucucgcuguuucacucaggcuggaguguaguggcaugaucuuggcucacugcaaccucugucuccuggguucaaguguuucucauggcucagccuccugaguagcugggauuacaagccugcaccagcaugccuggcuaauuuuuguauuuuuaguagauucaggguuucgccauguuggccaggcuggucucgaacuccuggccucaggugauccacccaccucggccucccaaagugcugggauuacaggugugagccaccgugcccagccugggucugagcuucuuaauaaaggauaggccagcacagccuagcauagagacagugagucaaacauuuuaauaucaugaacaacaaauauuauauuuauuaucugcugcaugcuagugcuagacccuagagauacaaagaugacuaagauucacuuccuuucuuggagaagcuugcagacuaguggcaaagaaagagaaaauaauacuuuaggaacuguugauugagcauguacuaugaacugugauaaguacuggagauauaaagaugaaugagacaguuucaacccugaaugugcuuauuguauaguggggguggggugaugagaaggagcccuguaaaucaauaacuaauacaacggacaagggagaauagggcauuuacgaucaagaagggagaagugguaucuguaaguugaagaagauaccgcuucaggauugcacuacaugaucuuuaagcucucucuuggccccaaacaguccaugauucuauaugugauagauauuauguauauaaaaagcucaugaagagaaauguagauuuuuaaauagcucacuccggugugaaacagaauuagggaaguaggaaaagugauuuucugguuaucacauucuaaaacaacagugguuguugaacauuuuccagaaagugaucaagagagcaaauguuuccugaauaccuugccugaggucaguuuuucccuaagaaugguagaugauaccaaagaaguauaaaauaguguuucugcccuuaaaaaacuuugauuucauuaagaauguaggauauauacacuaaaaauaaauugaacagugccaccaaauaaacuggguacaaacuuuaguaguuuagagaaagguggcuguauuaguuuccuagugcugcuguaccacagauugggugacuuagaaaaacagaaauuuguggucucucaguucuagaggccagaagguugaaaucaagguuuuugcagguccaccucuggaggugccuggccucuauccuaguuucuguuacccucuggccuuucuuggcuuauggauggcuucuuuucccuuuguccuuucaccuaaucuuaucucugugugugauugucucuuguguccaaauuuccccuuuuuauaaggacaccaauuauauuggauuaggguccacccuaaugaccucauuuuaacuugauuacgucuguaacuacucuaauuccaaauaaggucaauccuaagguauuggugguuaggauuuuaacauuuuuuuuuuuuugagacacaauucaacccauaacaguaggcuggauggucaggaaaagaacuuggucagguaggauuuggauuagcagagagaaguagagauauugugggauaaguccuugcaguauucagaccuccaucagaggacacuugaggugaauucaucuugguggaaccaaggaguuuugagaucccccaaacagggacauuuggaggaaaaagacaacuucaguuuuuuuacuuaguuguuuuuguguauauuauacuauugugggcagcuuuucuuuuucuagaagcaauuuuguugcuguaugccacauuucuagucaugaccauuaagauguugauugcaugguauauaacaauuuauucuuaggcaacagaaauuaaauuauuuuaacuuacauggccauucacaauaauagaagauguuuugcuucguaauugugaugaguuuacaaagaguuagauggcuucacucagagaauuucacauuagaaaacgagggugaaucaggacauuucucaaucuguggcucuggggguuaggccaauaguuuuugagcaugaccacacccgggaaacuuaaaaauauaagcuuccugaugauacccacgucccacccuggaccaaauaaguuaaauuugggggauggugguugguaugggacccaggcgucggguuuuuuuuuuuuuuuuuuuagagcucuccagguuuacguaccugguugcagcucacuggguuaggagaauaagaaggaaacuggauucuuguccuugcugugaccuuuuggccauucccuaaaacuuuccaguuucaaguacaucucuucugagaauaaggaaaucuagguauauuaugucugagaauaaagaaaucuagguauauugugucuggcaaguuccaucuguuuaauaaccauggguaagucacuggaauucuuuuugagucucaguuugcucauuuauagaagagagauaauugaaacugcucuccaguguugcugugacaauaaaauauuugcagauauuucaaaaugcuauguagacuccagaauacuauauacuguaaaugugagggguguuuuauuuucauugacagacaacuugcugaagauaucacagcugcuuggugcccuagacagguucagaauucucaccuucugaaucuuuuaauuuucucauuaauuugaacugugauuuugcuuccuuuuucuuuuauuaaguuguaccugaaugccuucuguuuuggauacuucgagaucccuuggugucauuaaaagcuuacugaauuaauggaaaaaacauggucuuuagaguugcaugaauuugagguucaauccuggcuccauuaauaaccaaaucauuuuaaccucuuaaguuucaguuuuccuguauguaaaauggaguauuacaugggaaauaauguaaauguacuuagcauuuugcuugauaccuaauaagcacuggugauuauggcuucuuguuauuaugaggggcaguaauagagggggauacuuacauuacaguuggauaaggguuguaguagaggccuuuccauuugacuucacugagcagagccaucuccuugugguggcuguugggaaugggcuugcuggggagucuuccacagucuauuauaacaaucuuacuuuguauaauucuuuuuuuuuuuuuuuuuuuaagagacggagucucacucuguugccaggcugcagugaucacggcucacugcaaccucugccuccuggguucaagugauucuccugccucagcauccugagacuacaggcgugcgcuaccacacccggcuaauuuuuguauuuuuaguagagacgggguuuuaccauguuggccaugauggucuugaucuccugaccucgugauccacccaccucggccucccaaagugcugggauuacaggcaugagccaccaggcccagccuacuuuguauaauucuauacuguuuuagauacuuuuagaaacuauucucauuuaauccucacaauaaucugcaaggaaggugauaucucuguaucuucaauaaggaaaccauggcuaagagagaugaaaugaauugcacaaggucaccuugugaauaagcagcagagacuguuguuguuuaaggagaagccccaagccuugaggcuuuggguuucauuucggcuggacuuuugguuucaugaucggggcuuucugauguuaacccaggaaaccuuaguuugaugguuguauuaguuaucuauuguuguguagacaaauuaccugcaaaacuagcaguuuuaaaaaaauaaacauuuauuauuucacacaguuucugagggucaggaaucuuagaguggcugggcugggugguucugcuucacugucuguaaugggguuacagccaaacuguugcccaggacugcagucaucuggaggcucaagcagggcuggaaugaacuccuuccaaguucacucaugccguucauuguuggccagccucaguuucuuccuggcuguuggcuaaaagcuucaguucuuugccaugugugccuguccauagggcagggcaguucacagcauaucagcuggcuuccucaaagaagagauccaagagagaggagaguaaucaaaacagaagcugcugugucuaauguaaucaaacuucagaagugacauaccaucacuucuguuguauucuuucagucacauagaccaacccugugggagaggacucuacaaggaugcaaauaccaggagacagggaacauaggguacuaucuuagaggcuggcuaccuccaaguagugguuuucacagugguagaaaaauuuugagaccaggcuauacauaucauguauuaaggaauuaacuuuaauaaacagguuaagauucuauuccauguuccaggcaugguggauaugaggagaauucccauaugucuuuaagggauaguuucugagggugaagggagcagggauuccuucagaagccuucugggucucauuuuucuacuauuaauuuuucuaaguugguaacacaaccaugccuguuuuaccagcaaccagacacuuucgugagggucgggaacacaagaagauuucuuugcuauuggguguuaccuggugauuugguccuugcaggucugagcauuuugacucuuacuuguggagaaaauuagcugaugaaacugugcaucuccaauacuuaaugcuuuuaaaaacucacauucaguuuuacaugaucaucucaaaggaguagugaugagaugggaaaucagcuaaccuugaagucaguacaucuggguuugaguucuugcuuugccacuaacugaccaugugauccuaagucauguucucucucuggacugcaguuuccuuaaguauaacaaggaaguguuaaacuagggcuuugaaguggagccucacaagcuaccuggguaagguugggaggugagaagaggcugaggaaauagaacuuauccaccuccauuucagccagagaagcucuacuuuucgucuguugaaauauuggcauuacuguaagauuugauuggaaaaagagguagagagacuuuacaaaaaagcuuggaaaccacuggauugagugauugaauucucaaaggacuucucagugaaaagaaauggguuggcuuuucugaugccauugagcaaggacuagcccaagggguaugggauuacccuccuuuuuacagauaggauggcagagaaauggaccuagaugucucuaagaaacuuaggccuuuuccucaccuucuuuccuuuagauuuuuuuuuuuuuaagacgguauuuggagagaugggcauuaaauaccgauggcugcaucuccugucucuaagcugauugaagcuucuucaggaacaggauccaggucugcagggcuaaaggccuucccuugaaaggcagaguaugguacaggccucuugggagaggagggggucaagugaguuagcagcaggugagaaggacuggucuucuaaguuggucucugccuccuuuggauuauuuagcuguaaacauacuuucccuggccuauauggauccccaagcccaucuagcuuuuggagaacaaacuaauggaggagguagaggugggaggagcagguagaggugggaggagcagguagaggugggaggggcagauagaggugggaggaauucagaugaaucuugcuuccagcagcuuagaaggucucuuguuuuuugguggcuucaaugcauauuguuauuucccuugcuguauacagcaggucuuuacuagcugauugaagcuuaucucuaaucaucuuuucccuacugucuguuuucuuucuuuccaaguaaauauucuauuuuggaauagaagccuggaaauuaaugguuuaguagaaagauucuaagaguucuauuuagaaucagcagaggugagucaaguuccagguuuucuauuuaccugugugacuaugggcaaguuuuuuaaccuuucucaguuuguuuccucauuuauaaauuaggauugcugugaagauuaaaggauauaggcauguuaaguaugguacuuacccuuauaguaagugcccuuauaguaggugcuaaguauuuauuauuauuuuuguucuuuauuuuuuauuuuuagagaugggggucucacuauuuugccuaggcuggucucaaaacuccuggccucacacuauucuccugcuuccgccuccucaguagcuaggauuauagaugcgaggcccugcaccuggcuauuuuuguucucguauguuugaaaguuuaggauagaugcuaauuaaauucuaaaaaauaccauuuuauagcagaguaacaaaaucaguacugaagaaauuuuucaaaugaucuuuucugauauauucauuuuauacuuggaauugguacauuuuacacuuggcucagagugaagcagugaaugguccaacguuaccuguggaggcaccggggauuaaguuuauaauaccugauucuccgaugacagguguaccuuagacuagucugggugacuggggcuggauuaaauauccauacuagguuucuaacuuuaugcuuugagggccauugauuugugugaccugagaagccaguggcuaccuugagcuuagguacugcugaguggagccaaucuuauaccuucccacucuccugagaaauuuucccugauacagacccaggcaccugaugguucuugacaauuuaaauuuccuugacaauuuaguccucuuucccucuccauauguuaaacccagaaaagagaaggcaaguacaguauagccaugaugucucuggaagugaaugacccauuguacugagguagagacauagaaggagggcaggagaaaggauaggaccagaaaaguccuuggguauuuuuuuuucucuagaagucugcuaaggguuauucuuucuguaauugucugaaaagagaauuguagaauauuagggacugaaauuucccuuuaggggcaucuaacacaaccuuuaacccauguuugaacucucucuucaaaguuccugccagguaguuuuccaguaucuguguacuuccauguuggugagcccuguacuucuagaagcaggcauuuucuugguuagauauuuuggcuuucauuuuuuauuuuauguauauauauaauuuuggcuuuuaaaacuagaaguagaagcaguuauuuucuugguuagauauuuuggcuuuuugguuuuaaaagccaaagcccuaacuuuuaaaagauagaagagauagcaugcuccucuauagggcuucuaguuuuaaaacuagaguagaagcacucauuuucuugguuagauauuuuggcuuuuucuuuuaaaaacuaaacuaaaguuuaguuuggcuuaaaagccaaaguccuaacauuuaaaagauagaggagauagcaugcucuucauggcuucgaaucacuggccucucacaugaggaaacaggcuuaggcaaaugaaaugauguauaucggaccauugggugugacucuuccacucugccuccagcuaagagaaucaggcaagacagagacccaggagcucaguucuagagccucaaauucauccucaugucuuugugggugagugguuuuuauuaaaauaauuuauuuuuucauaggcuugcagaauguacuaguacuagaaagaaauuuacugaucauauagucuauuuuaaucaccauuuuauagauuaauaacugaguuccagagagguaaagccaucugcccaaugucauacacagagguucugugacagaacugacguuaggacugugguuuccugguagcaagaccuagaugucuuuccauaaacagcucuuuuagagaagcuguuaccaagcucuaaaacuauauauuuuuaagugccaugugaccuguguaccuugagauuucuauugggagcaacagcauuaguuaaaauuacacagauuucagucuaaaaauaucaaguuguucuucagccuaacacgagaagguaaagggcuccauccacaaacauuuauagagcaccuaaagaagcucauugucuguuuuggaggcaagccuuugauacaguuuggauauguguccugggcccaaaucucauguuuaauuguaaucccuaauguuggagguggggcuuggugagaggugguuggaucaugggaauggauuucucaugaaugguuuagcacuauccccuuggugcuguucucaugauagugagugaauucucaugagaucugguuguuuaaaaguguguggcaccucuugcaccccucucucuugcuccugcucuggcuaugugacgugccuguuucccucuuuaccuucugccaugauuguaaguguccuggggcuuccccagaaggacagguccuugggaagguauuuuaacuggggaggguggggacagaggccagugcuguguuugaccucugaugaugcuggaaaagaaauagauguuguuuucaaacuggguaguccaaggagaagagggagaaggaaaggaaaugcuugugagguaccugagacauauuguugaguuagcucuuggaagcagcacaagucugggaaucaggagaccucaguuccagugcuggcuuuccuauugaauaucuauucuuuuguagauuacuugcucauucuaagucuuggagauaucgaaaacauuuauaccuaucuaauaaagucuagaagggagauccauauacucuuaaagaguucagaggaguucacgagagaacuuuuguuugauuuguuuuagucuauauuugaauuucucaaucuugguacuguguauauuuuggaccgcauaagucuuuggggaguauggggcuguccugugccucauaggauguuuaguugcaucccuguccucugccugcuagaugccgguaguggcuaccucuuccccaagacaugacaauaaaaaacaucucuagacauugccaaaugucaccuggaaggcaaaaucaacuuuuguugagaaccaguggucuguauucaugugaauuguggggacagcuaaaagauaaaauuaauaauauuauuauaaucuuauuuagcacucacuguguaccagacacuguucuaagccuuuauuuaauccucauaauaaucguauaaguuagguacucuuacuaucacuguuucacagaugaggaaauugaaggaaaguaagguuaagugaauuaauagcaguuaauguuuuucuaaguaugugucagggacugugcuaaguaccugaccuauauguuaucucauuuaauacuuacaaucacucugugaagugaguucugauguuaucauuguuuuacagaugggaacagauaggcauagaucuguugugugccuaaccugcuacugaauguugagggcacacuagaguaaaugauuuaccucuuuaucuuaaugauuuaguguuguuaucccaauucauuguuuuaguuuccagacgacuuuuuccuauuuuauccucagaacaguacugugaaauagguaguaucauccccauuuuauagauaaagaaacagacucagagaaagaggcuuguguaaaaucucauaguaacugaugcaacugacuggcaucugucgcgcauuuuaguuuauuugugauugaccaugaugcuuccagcuauacuaagaagcaggcagucaggugacauacuguacagcaaagaaauacugagucccuguuugagauggagggagagcugagagaagcuucuucugauauguaauuuggaguuugcuggugaaguuuucuucugcauaugugcuuucccacgcauaucuuacuuccugauuggcacuggcuguguaucacaaguuguaauuauguuauaauuagauuguuuauuucuuuaacaucugacuucugcaguguucuauccuauaaguuacauaaauguaggacucuguuuuguucacaguauuccagcacagugucuugcaugcaguagucacuuuaugaaaauucugaaucaguaggcacaugagagguaauuaagagagagagauaaauugacuuagucaagauuauauagcaguuugguagcacuucugggacuagaucugauuuuuucuauccuuaagcccagaauucuuuguacaacauagugcugcuugccacaugccuaucaugauuagagcuauaugauuuugcucuguggucuuagccaaaucuguugguuuucuuuucuguaaacaaaaguauuaaacagcuguucuuuucuccuucccaucuuugguugcccaccagugauauccugguguggccuccaaccauagaguaagugucugcugagaaacagggaaaccuuacucucccugccaaccuggaacugggaaucauguuauuucuccugaacaccuuccuauuucaguggugauguggcggucauggucuaccaauugaaacagaaagcagaguuuggauuauagaggaagaaggcaguuggaguagcuacuuuaacccuucuuuauucagaacugcacucugagugccuauguacacauacucuagcgccuucuuacucuucauuauaaacauuggggucugcucauuuucccuuuaguuuguuggaaaaacacacaaaucuacuuaaauuaguugaggaaaauguccucuuccauuuucaguuauuuuguucaguaauacuagugauaagggaugucuauuaagagaaaauaugugggccgggcgcaguggcuuacgccuauaaucccagcacuuugggaggccgaggcaggcggaucacgaggucaggagauugagaccauccuggcuaacauggugaaacuccgucucuacuaaaaauacaaaaaaaaaaaaaaaaaaaaaaaagccagguguaguggcgggcgccuguagucccagcuacuugggaggcugaggcaagagaauggcgugaacccgggaggcggagcuugcagugagccgagaucaggccacugcacuccagccugggggacagagugagacuccgucucaaaaaaaaaaaaaaaaagagaaaauaugugucucuggaaauuagcuauaugcaaggcacuuccaugucuguuuucuuacauaaucuuccagccaccuugcgaaggcagggauuacuauuuuuauccuaacuuuacagagaagcuaagguucagugugaagucaugaucauauagauagugauagaccaggauuugaccucaacuugacugacccuuuaaguccaguggguauucuugccauucuaccauaguuguguauguguguauggguauguuuagcagcuuuauugagauaauucacauaccaugaaauucaccuacuuagaguguauacaauucaguguuuuuuuucuuguuuccggugggguuuuaauuucaauuuuuuuuuuuuuuguauauucacaggguuguacaaguacuacaaucuaguuuuagaauauuuugucuuggcugggcauaguggcucaugccuguaauuccagcacuucgggaagcugaaucaggaagauccuuugagccuaggaguuggggaacuagacugggcaacauagggaaacccugucucuacaaaaaaaaaauucaaaaauuaucugggccaggccugguggcuuaugucuguaaucccaccacuuugagaggccgagguaggcagaucucuugagcucaggaguuggagaccagccugggcaacauggcaaaauccugucucuacaaaaaauacaaaaauuagccaggcgugguggugcaugccuguagucccagcuacucgggaggcugaggugggaggaucaguggagcccgggaggcagagguugcagugagcagacaucaugcuacugcacuccagccugguaauagagugagaaccugucucaauaaauaaguaaauaaauaaaauuagcugggcauaguggugucucccugugguuucagcuacuugggaggcugaggugggaagaucgcuugagcccaggagguugagguuacaggugggccaugauaguuccacugcucuccagccugggggugacauagcaauaccccauccccucuccaaaaaaaaaaagaaaaagaauauuuuguccuccuaaaagaaacauggauguuguaauguguguuuuucauuuuauugcuaaauaauauuuggcaguauuuuuuugcugaaaaauauucuauuguauggaauucuguuuaucuauguaauuguauuuacugcugaauucuguuguauggauaugccacauuuuauuuauuccuuuaucaguucauggauauuuggguuguuuccauuuuuuggcugcgacuaaugcuacuaugaacauuuauguacauuuuuuguguagauauauauuuucauuuaccuuuaaguauauauuuaggaguagaauugcagggucaugugcuaacucuauguuuaacuuuuugaggaacuaccugacuguuuucuaaaggggcuguaccauuuuacauuuccaccagcaguguaugagaguucuaauuucuccacauccuuguaaauacuuguuacuaucuuuuuauuuuaggcaucuuagugggugugaaaugguaucugucucauaugguuuugauuugaauuuccuuaaagacuaaugauuuugaguaucuuuucauguguuuauuggccacuuggauaucuuccugggacaaaugucuauuuagagccuuuguccauuuuuaaauugguuugucuuuuuacuguuuauuuauuuuuugagacgcagucuugcucugucgcccacgcuggagugcaguggugcgaucuugacucacugcaaccucugucucccguguucaagcgauucuccugccucagccucuccaguagcugggacuacaggagcgugccaccacgcccagcuaauuuuuuguauuuuuaguagagacaggguuucaccguguuagccaggauggucuugaucuccugaccucaugauccgccugccucggccccccaaagugcugggauuacaggugugagccacugcgcccagccucuuuuuuacuauuauuauaagaguucuuuauauauccuggauacaagucuccuaucaaauauauguuuugcaaauauuuucuccaauuuuguggauugucuuuuugcuuucuugaugacauuauuuauagcacaaaaguuuuuauuuuugauguaguccaguuuauuuaguucuucuuuuguuguuugcuuuugguguuaugucuaagaaaccauucagggucaugaauauuuacaccuauguuuuccucugagaguuuuauacuuuuagcucuuacaguuaaagcugugauccauuuugaguuaguuuuuccaugugguaugaggugauagaggucaauuuucauucuuuugcauguuuauauccaguuguuucagcacccuuuguugaaaagacuauucuuucuucguugcauugucuuggcacucuuguugaaaaauaauugaccacaaacauaagcauuaauuucuugacucucaguuccauuuaauugaucuguaucuuuauucuuaugccaauaccauacugucuugauuacucuagguuuauaaucaaguuuugaaauugggaaguauuagucuucuuuguuuuucuuuuucaagguuguacaaguuuuacacuucuguuuuucuuuuugaugcuauucuaaauguuuuuuuuuuuaauuucaguuuuuggauuguucauugcuguguauagaaauacaguugauuuuuguauccugaaaccuuguugaacuuuuuaauuccaacagauuuuuuuuuugguguugauuccuuagaauuuucuauauacaagauuaugucaucugugaauauagauaguuuuacucuuuuuuugagacagggucucauuccgccaccuaggcaggagugcaguggugcaauuguaguucacugcaaccuugauuucuuggguuuaagcauuccuccagccucagccuccugauuagcugagacuacaggugcaugccaccacaaccagcuaaacugcuuuuuuucuaaucuaggugcuuguauuucuuuuucuuuucuuuauuucuuuuuuuuuuccaccuaauugcucugaccagaaccuucagugcaauguuaaauagaaguggcaaaaauggacaucuuugucuuguuucugauuuuagggagaaagcauucaguuuaguaugauauuaacuguggguuuuucauagaugccuuuaucagauuaaggaaguugccuucuauuccucauuucuugaguauuuuuuuuguaagaggguaucagauuuugucaaaugcuuuuucugugucaacagagauaauucuauggcuuuuucccuuuauuguguuauuaugggguauuaaugaauugauuuuuuggauauuaaaacaaccuugcauaucuggaaucauuaugucauacuacaauuacuuguugagcaccaacuguuuaagcuugugggaggacacagaugaguaagaugggguuauucacguuaauugaggagacaaaaaaaacccacacaggcuuaaacuuuagaguacaagagugggauaaagacaguaccuuguguugaugugugauaaacaguuaccaaaugaacuuuagagugaccuuauuuuaaggccauucagcaguuauaggauuggcauauuguuacuuuuugugacuucagguauauccuuucucuucuccagauaucagcuucaccaucuauacguggguaaguuagacuugguauuuaagaccccuucuaguuaugacauguugugaaauuacuuggcuuuuguggggcuucuucacuuagguccuuaugaagagugccauuuugauagcuccaaguagcuagaaagaugagucuuccuguucugguucagagugggggaaagaugcuuuacuucuuucuucguuggccuuaacugcacucucaucucagagagaugauugccuuccauaucaguccacauucuggugaaagggguaacucuuaagaaagaccauuucccuuagcaucacauaaguccuacgagaggaaaagaccacugaagaggguauuaggaguacauguuuuucaggacucagcuauauguuuaacucauuguuaaacauuggguaggucaguucauucuguucauacuucgguuccuuagagaauaacacuucuauugcauaaucucucaggguugauaugagacauaaauuauauccuagaugcauacaaagcuuuauauauugguuauuugcaaaagguagaguugcauaauguagcagaaaugcaaauuaucuuguaaauguuguaaaauaaugcagauaauguaguaaauacuagcaaaauuuugcaaauaauguagcaaaaaugcacuaaauaaaucagugguccccaacauuuuuggcauuagggacugguuucagggaagacaauuuuuccauggacugagcuugugggggugggggugguucagaaugaugcaaaugcauuacauuuaucauuagauucucauaaggaacacacaaccuagauccuucucauguguaguucacaguagaguuugugcuccuaucagaaucuaaugcugccacugaucugacaggagguggagcucagcuuugcucccuuguccccuucugugaggcccaguuccuaacaggccaugguacuggucuucggaguuggggaccccugaaauuaguuacuauauuuuaggcuccuacuguguuucuggcacuucugauaugugcuuuaaagauucuuuuccuaacgcuuuacaacaauuauuuguccccauuuaacagaggaggaaauuccaguucaaagagauuaaauaaucaucccaagggggaagagucagcaaucacaacuggaucuaacucuagaguccauauucuuucuauuauauuuuucugcccuuugguaaagagauguuuuccucuauuccacuuguuuugaaaaggucuugauagugugggucacauugguccauuuuaagaaaggauaaaauuugcuuuuguugacagcuacagcuuguccccacugucuaaacaguacuagacuuuggaggagacaguaggucugagacuaauuuagucacugguuauucggacacucauaggacugggccaaaaugggaacaaggacucuucgaauagcaaggucauuaucucaguguugaaggaacauuugaaguuauuaaacuuuguucucaucaaaugggggagucugaaauauguuuuuccucaccaaaaacccgauguccuguaaaccucagccugacucacuugaagauuuguuaucuucuuuuuuuuuucuauaacccccaauauuuaaucacuaugagacacauaaccuucuaauucuuagaagaguauuuucuuuggcaccacacaagcccuauauagcaggaaggaaauaugagguucagaaagagucuagucucagucuuaccuuuaacuucacugugugacccuggaaaaauaucuuucuucucuacucccacugcuacugcuguauucuagaucuucaucaucuguuuuguuuuuauuaaaauaauuuaaaaagcgauaucaaacuuaguuuuucugggucauuugagaaugaguugcugacaugacccuccaucaaccccacauuauuuccuacauaauaagaugguuguguaaguacaaugcaaccaucaaaaucaggaaauaaacacuguuacauuacuauuaucuaauccucauacccauucaagcuuugccaauuguccgacugucuuuuacagcaaaagaauauaguucagaaucacguguuacauuuagaagcuacaucuuuuuaguguccucggucuuuccuuaacuuugauaaccuugacacuucugaagauuacaggccaauuauuuuguagaauaucagauaaagcagguguuuuauagaaugucaucaccagucuuacguuaugcuucuuugguaguaaauauuacagaacuggugcuguauucguuucauugcauccuuuuagaugguagugguuuugguuugucccaugacuauugauguucauuucagcaucuugcuuaagguggugucuaccagccuucuucacugugaaguuacucuuuucucuuguauaauuaauaaguauuuuguaggcaguacuauguaaauauccguuucguugccaaacuuucaguguauuuaguuauuuauaucaguauggacucauuuuauuuaauggguaauaaucuauugcuagcaucauuuguuuuggugcucaaauucucuuugguuuggccaguaggagccaaaucagaaguuggcuucugucaacuuuugauaugucccuaucauucuuugacuacuuccuugcuuucuagcccaauaagauguucuagguucauccuguacuuucucuauaccagccaaggaauccugauguguguguguguguuuuuuuuuuuuuuuuuuuuuuuuuuuuuuuuuuuuuuaguauuaaauggcauuuagaauccaaaaucugguuccuagauaaugcucauuguuauuggaccauugcugcucccaggccuucucauagacauaaugaggaaaugagguucugacacccccaucacaggcucucccuacuguguggaugcccuccuuaucuugcuugggcuuugguacccuauagcagggugcucuuccaugacaacucuuucuuaacugugguuggcuucugacacacuacaccagggcaccccucucuccugauacggaugccuuccuugcuauacuuagacuaugauauuccacaccaguccaccucccugccccaaauguggaugcucuuuucacccugcuugggcucugauucuccucacuagacuacuugucucuuccucccccuccugauggacucacccugcuuaggucugaccacaguguugggcugcccucaucaucucuuaacuagacuuuuuuuuuuuuuuuugagauggagucuuguucugucgcccaggcuggagugcaguggugcaaucucggcucacugcaaccuccgccuccuagguucaugccauucuccugccucagccucccgaguagcuggggcuacaggcgucugccaucaugcccagcuaauuuuuuucuuuuuuuguauuuuuaguagcaacgggguuucaccgcgcuagccaggauggucucgaucucccgaccuugugaucugcccgccucggucucccaaagugcugggauuacaggugugagccaccgcgccuggccuuaacuagacuauuauaacacaaagccuccuaacugaucuccuugcuuucaaucuucuuauaccuuucacauuucugcaagagugaucauucuaaaauauaagucaaaucaugccacugcucugcuuaaaaacauuguaauaguucccuuuugcuuagagaauaaauuucaaguuccuugggcugucauucaaggaucucuaguaucugacccaaagguaccuuucguccucauuucuuauuaguuccuugguauacugugcacuccaacuaucgccacuggcuacuccuuagacauaccccaguacauuuacuccucuggcuuuuugccuuuauccucuccucugucuggcuuagccaacucucuucacugucugauaaaaucccucagaguccuaguucagaugucugcuauggaugucagagccugaauacagugaggaagauaacaauaagaggaaggaauuaccuggugaaaccucucugaccucuauagucauaaacaguccccuuuuuuucuacuucugauggaguauuuacuucauucucucucuuuucacaaucagcuguuuacauaucuguugccucugauucauuggcugcuccuugaaugcacucaacacagggcauugcaucuaguagacccucagggaaugcugauggaacuugucaagggaaugaauuuuggauggugaaguuaccacagcagugaaucuguugcuuucauuugaaguccauucacaggucccacugaggucugagaggcucugacuacaagaaaggguuuggagucuggcauccuugggucuagauaucugcccugugccagagcucuuucugagaaaaugauauauucacacuauucuccucuuuaguaaauuccaaauaugucuuuaaaaaaaaaucuacacugucauccuaaauaaaauaauuccuagcuacaggaauauagguauuuaaagcugcaaauaauagcagugacaucauccuacuaaaaaagccugccccaaauugucugaaggccagcauugugauaugugucuccugacagccuaucccugcagagacccucagucugucucugcagagacacuuaggcugaagugucagcaaaggaggguuuuagacuuucucagugacuuuaccagucugcacuuuuuggagcugugugggaagcaucacaggcuagguuccuuguagcauguggggguuucuagaggggaagagaaagauaggagucuguauuucuuuagaucccacuaccaaccccauuugcuccagccauagcagcaucuugaacuuuucuuguucugaucauucauucuuccggggcuuuguccagguuuucuuuucuacccugagauugaacugucugauuucaaagccuaggcucuuuuguguuucauaaucauagcaccgaauuuuuuuuuuuuuuuuuuuuaaagauugcucauuuuugcuuuuccugucagguuuucagucucauuaaaauaauuucuaaauugagaucagaauauuuucuaauauacagauucaauuuuugccuccacagggguugaaucaagguauacuuaccuacaagacuaacucuuauuuugauuuggccugagacacaguagaauguucccaauuuaagauuagcacuauuccaucugccuggugcuaauugaaacugaagaggaaggaaagcuuuuauucuauaauuguuuggagagcagcauggaaaacuccuuagaaugugaugaacuugauauuuacuagguuuauaaguuuuggcaaguguuaagcucucugugccccgauuuucuuaccuguaaaaugaggguaauaaagccaauuuuuaaagggcuguuauuagguuaaaugauaugauucuuguaggguugacucugguuuugacuuugucaccaacagugggaggugggagucaucaaccuaagcauugucccuggcuuaguauaugccauaauuucacacuaaagcuacguuuacuuccauuaucuuauauaaccuucauauugugaucagagaaaaaaagauggugguggugguucccauuugucaaauaaggaaauugauacucagagaaguugaguggcuugucugaaaacagagaccucugacuccuagucugagacuccuuuuguucuuaacaagucuuaggagagggccgugugguguaaaaaaaaaaaaaaaaaaaaaaagaggccuucaauugaaaagucaagaaugggcuuggugcaguggcucaagcuuguagucccagcacuuugggaggcugaggugggaagauuccuugaacccaggaguauuuuuucuuuuucagaaacagggucuugcucugucacccaggcuaugugaucauagcccacuguagccuugaacuugugggcucaagcgaucccccugccuuagccucccaaguagcuaggauuauacgcagaagccacugcacuaagaauaucuugauuuuguaguuuuagcuaggauaauuugggaaagucaacucaguuucuaccuuauuuaaacagaaauaugaauuauucuuuuuaacucacuuuggcaaauaauugucgagcauuuacuaugccuuacacggugcuaggcuugucccuucugucaagcuguuuauauuucacuaaggauaagagauacagauaauuaguuuaagugaaaagaguuauaacaaauguguauguggcagaagauaaugguggcuguggugggagugguccaggagggugccacagagauagccguggggcugggcauugcuucugaggagaaaucucaaaggaggguauguaagaauuaauuggauaauggauaugaaugugcuuuauuaguugccacauaaaugcagcuuuuuacaacugucaauucuuacagaaggugccucuuuucuagaaaccuuggcugaccgaguagaacaccauaguuggaguccaaacuuaauuaaagugagaagaaagauuuuaguagauugagauuuuauauuaaaaaaaaaaaaagcaaaagccugugucugaaguuuuuggaauccaggaguccuuaaaaugggauguguaugccuauuaaaauugucuucuacuuugaugacacaguggaccucagccacuuuugaguuuauaaaggacuuauuuauuaucacuuaaaaaaaagccacuugugcuccugcagcauuuuagauauuuaaaacagccuugcaaacaaguauguauccuggggaauaaaaugaaucaggacaagacaaagagaaauugggcggcugagccaaagauauguaauguuuuuauuuuuuauauuuguuuggguucaguagauguaauuauugagagcuuuguaugugcuaggcuuuguaugaaguacugagggaacagagaugaaugaagcauuucguaaacaaggggacauauagucuggcuggagauacaagacaucugugguaagugauaagcauuuuuaugagguacucuaagaucuuaaagguggaggaccuacucaagccguuggguaaggacugcaucagagauggcaaguuagaggagaggacaccugaagauuagaaguuuuggaggaaacagaagggaauaaugggagauaaguguguucuaugcaaugguaauagcuugaagaaaggcaccaggauuuaaauaguaccugguacuuaaagcaccuacaaauaagagaaacauuccucagaauuuaaugcuggaguguaguaacugauaagacuuuguauuuuguccccuuuuugaagagauagaacauuuuuaguuaguguuaguuauaagauuuuauaguggaacauuuguuuuuacuguacaguauuuuguguuccccauuuuaugagucucauuaggggcaaauaugcaguucccuaaaggagauaauuuagauacuugcuucccaagcuuccuugcuucuggggcauaggcagugaccuagguuucaccaauccgauaugcccagaccacacuuggauuuagcacuuaaagacuugagagaggagguaacgggaaacuaacuuucuuuuucugauggcagaggcaguagcauccccugcaagguuggguuccuggcacugaaguggcauuguuguuugugauugcugcacagagguugaauucuugauccagaagugacggugguacccauucuagcauguaaugaugagaaguagcugcagugguuuccucauuggacuaguucugcaguguaacuuugugcuuuauucuggaaguuuagccuuaagccuauuuuuccaaccuucaccaaauuuugugagcccccaauauucuuucaguacauugauuuucacuagacucagauuuuaaauugauuuucaccagacucagagucugaugcuuacaucuaagaauccuuugagucagaggucaucagacuacagccuguggggcaaaucuggccccauugccuguuuuuguaaauaaaguuuuguugaaacauagcuacacacauucauuuacauauugucaguggcugcuuuugugcuacaaaggcagaguugaguuauugagacagaggugauagggccugcaaagccuaaaauauuuacuauuuggccuuuugcagaauuuuccaaccccuacuuuaacuaauaaugguugucccuuaacaacacugaaauguuuccuuaaugagacagugaguauuaguuugaguuucacccuuuuuucuuaaauuuugguuuuggcuuccaggaugcucagagcaaaauuuggucaugaauugcaaagcauggaguguugguacuauguuuuaauugucuccuacuuuauuaccuguauuccacugaugauuacuauuguccuaagggguguguguguguguguguguguguguguguguguguguguauuugaaagcaacuugaaagccauuuuugaaguagacagguuauauucuuauucuguuuuuuuuuuuuuuaaagaacuuggaaagagugauugccugccuuauugggaauauaucaaauugugaagaauauucucagucuuccuuucauaucuaucuaguauugucuuaauuugcucagaucuuuuucauucuucugcuaauaagaggaauuuauuuaugguuagagaccaguggcuaauaaggaaucaauguuucagacuaguaagaagcaucuuuuucuugauucucuaguaugcuucuuguuuguaucaauuagaaauauuuucagcuguaaguaguagaaaacagugauuuaaaauauaggaauuaauuuucuggagggagggcauugguugcuuguauagggugggauacaaugccauuuagaacccaggcucuuucuguuuuucuacucugccagccuuuucuacucugccacucugccagccacugagugugugcuuuucacucuuguacuuaugaccucaagguuacuaggcuacuguagcuccagaaagaauguuugagaaaagaagaaaggggcggaaaggcagaauuagcacucugccuguguucuauuuuauaauuaaagcaaccauuuccccagaauccuuagaaacuuacugacuagaacuuugucacaugcacaugcccaacuuuaaaggaggcuggaaaaaugaguguuuaauugucucauuacuuuccuggauaaaauuaggguuggcaaaauuggcaaggaugaagggaugaauggauauugauuagggauuugaaagucauuggauuuuagugacuuuuuuuuuuuuuugagacggugucucccucuguugcccaggcuggaguccaauggcgcgaucucggcuuacugcaaccuccgccuccuggguucaagugauuucucccugccucagccucccaagauuacaggugccugccaccaugccuggcuaaguuuuguauuuuuaguagcgaugggauuucaccauguuagccgggcuggucucaaacucuugaccccgggugauucacccgcuucagccuccccagagugcugggauuacaggugugagccacugugcccugccuuuagugacuuuuuaauaugguuuuaagaaauguauuuguacccuguaugauuuuauaaaaaugugugcuggugccuguguuuuauuggagcuaccucauuuugggcuggagauauaguagcaaaugaggagauauauacuaccuuuccagucuagagguaaaaauaaauacuaucaaauacuuucaguaaauuggauaaguguuugggacuucucugagggccauauuuaggagucauuaaaucuguuugagggauuauaggaagccuucauagaaguggugacauuuaagcuggguccuaaaggauaagcaaagggaggaaaacuuaugggauuaugcaguaacuuguugcuguaucuucucugcugagggguugauuggcaauguuaauaccucagagauugugcauuucauuauuagauaccucugauuauuauaauguucuuauagaauucuccauuucuuccucccuuccccugucucucuuuuugguugggagggcaaaagguguuuuguaugacaugaugagagaacucuuggacaauuacuuuaggccacucuaagacugcauccacauuccuuucuuagccuucaggauucucuguagcuuuuuuucugacuggucuuucuagcuccauuuauucauucauuccuucauucagccauuacuuaucugucacccacuguuugcaaggaauaguucugaggucuggagauaaagacaaagucuuugccuuuguggagcauauguuccauuggagggagccagccaauaggcaaauaaaugucaguugaugauaagugccaggauacaaauaaagcaggauaggguggaauaaagggugcugauauagaguagagggggauuuuuaaaucauuuuauaaagauugguuagggaagaauuaucugauaaagugauauuucagcagagacuugaaggaagacagggaauaagccauaugguuaucugaggggaaauguguuuucaggcauagucaccauaggguaugaaggccuggaggagagaguguauauagccugucggagaaagccuuggugccuggagcagagugagugaaguggggaaaagucggagauaaggucagugaaguagcagggugagaugaggggaggagguagaggaagguaagaucauauaaggccuuguauguuuuucuaaggacuuuggcuuuuacauugagauuggggaagccacaggaagauuuuaagcagaagagagugaugugaucugagacauguuuuaaauagaucacccugggaggcaagaauggaucaguuaaaaaggauguuguaauauucuaggucagaguuucccaacaguggcgcuauugacauuuugggcaggauaauucuuuguuaugaggggcuauacuaugcauucuaggauguuuaauaguaucccuggcucccacuuacuaaaugccaguagcacuuacccaguuguuuuaauccaaaauuucccuugacauugccaaauauccccuggggagcagagcaaaucuguccugcccucccuaacuccucuucaccccacuauugagauccacuguuguacacaaaaguugcugaugguuuggaccaaggugauaacaguaaaggugaugagaagugguuggaccguagaucuguuuugaagguauaguugauacaauuugcugauggaugcuugugggggcugauagacaaaaaguggaguaaaaaaugaaucagauuuuuggcuuagcaacugaaagaguagaauugccauuuauugagggaugggggaggaaacaccugaaggaggaacagaguuuugacuuguuaagucugacagucaguggcacagcuuugucuccuauugucuuuaaaaaugcuuuucuuuuugaggguaagaacuaggucaugucaucuuugcauccauagugacgaacauugugucuggcauguagaauauguucaauaaguggugaaugaaugaugagauuauuuacuauuuccaagaaggaccaaguuauuuacuguuuccuaaaccguucauacuuuuuucuccuuugggccuuuguuuuugugauucacucaagggaaaucucaguagcucuaugaaaaauuuacuccuucuucaauaccaacccaaauacugccucuuccaugaaccuuuuccuaguucugcagguguaauuaaugucucccuucucugcacuucuuugccuuuuuugaaauucaaguauacuuugacuuaugacugguugcuuugacuuaugacugacugccacuaaauagauuuauuaauaucuuuuuucguuuccaucuuucuuuugcuuguuucuuuacuuauaguguuuuuguaagcuacuauuauuauuuauuuuauacuccaccucauaucuagaucuaagaugcucuagaucaucauuacugaaaguauacuccacaguaagugaccuuaacaggcaauuggccucaccaucuaauuacuacaagaaaaaauuucaucucagauguuguuuuaaauccaacaucaucauuguugacugauuuccuuguacauuuaacugguugugucaggagauuuauaauuuccacuuaguacacauauuguuuuaaaaguuauuugugguugcaaaagaacccaguaaaaauaaucauuuucaaauccuuuaggcacuucaaucacacuagucaucaguuauaagcuauuagauugaaagcuguagucuccaaacaaaaccaaauuuuugaaugauuauugaucauuugcuuuuauaauagaguuagcaggaguugcaaacucauaugccuacagaggagagauaagugacuuaaaaaggccugguuaggcuuaagaugacuacagagacaaaacauugcuggccaagguccaugacuuauaagaauaauuuguuaauuauuuacuuugaaaaccagaggacuauuuaaaugaaaggaguuauugcacuuaaaacauguuaacugcuaacuuguauaacuucagcacaucauuugagaucuccaggauuuaauuucuuugaauguacagagucaucucuaaaguugcuuuuaccucauuugauucuguuaguaauaaauaaaacugcuggcaucuuaccaguaugccucaauuucauaaguauuguguuucaucagcgggaacuaaacuuagccaaguuuccuauagcagcacccaccauugaaagagagagacaguguauuagccagccaguuaacuuuugguaaccaaaccagcguuugguuuuucagaacugaaaucuaaaauagaagaugucugaauuugauccuucccgcugaagauauuagugguucugccuaauacuguacauagauguuuuguuguuucgucuaccugguccuauuuauuugguucagucauuuuucuagugcagcacuuuuuaguuuuguauuugccaacuuccccuauuaguggugauuuccuggagacguaggccauuucuaggucaucuuuaauccucaaaaccuggaacaggcaagagcacaugacagauguuugaaaaauguuuaaagagauggcauacuuauuagcuuuguaggugacaaaaacugaaagagaaaacuaauauuuagaugaguaagcuuggaaugaugggcugaagccaacaagaugaaauuuaagaggaagacaaugaaguucugcauuuuaagucucaaaagaaauggcaacauaugggcagacuggaggagacuuagcaugaugcuauucuuaugaaaauggugguuuuggcugcugaagcucaaugucagccaaaggcauugcaguggauaaaaaucuaauguaacuucagacugaauuauuggaaguauuaaguacaguuaaaggaggugauaguuccacuauguuuugcaagggacagacugcacuuagaguaucauguuucccucaggguaccaggcaguaagaggaucauugcaaacaggacucuauuuaguggaggguacgcuagaucaucauuacugaaaguguagucugaacuguucccagcccacaaugagauaagcauagaaauugaaaguacuuagaaaucuuuauagcaauuugucagaguaauuuugugucuaaugaaucuaauaaaaaggaagaugaacuuuaucuuguaugucuuuguuucuuucuauuuuuuugcuugauacuuuuuuauuuuaauagauuuuauuuuuuagagcaguuuuagguuuauagaagaauuguguagaaaaugcagaauccggcugggcgcaguggcucacgccuguaaucccagcacuuugggaggccgaggcagguagauccccugaggucaggaguucaagaccagccuggccaacauggugaaaccccaucucuacuaaaaauacaaaaaauuagccaggugugguggcgugcaccuguaaucccagcuacucgggaggcugaggcacgaggauugcuugaaccggggagguggagguugcagugagccaggaucacaccauugcacuccagccugggcaacaggagugaaacucugucucaaaaaaaaaaaaagaaaagaaaaaagaaaacgcagaaucccucucuccccauuuccucuauuaucaccaucucauuaauguacaauugaugaaucaauauugauacauuauuauugacuaaaguacauaguuuacauuaggguuuacuguuuggguuguauaguucuguagguuuugacaaaugcauaguauguguauccacgauuauaguaucauacaguauaguuuuacacccuaaaaaugccccgugcuucaccuauucauuccuuaaccacuaaccccaaccuuucaaauaccuggccgccacuuaucuuuuuacuauuucuauaguuuagccuuuuuccaaauaucauguaguuggaaucagccuuuucagacuggcuucuuuuacuuagaaaucuacauuucagguucuuccaugucuuuuuguggguugauaguucauuucuuuuuuuacugaauaauacuauauuguaugacauaccacaguuuauucauucagucuugaaggauaucucagucgcuuccaguuuuuagcaauucugaauaaaacugcaauaaacauucaugagcagguuuuugugugaacauaguuuucaacucauuugaguaaauaccuaggaauacuauaaucacauaaugaugauucagucagugaugagccacauauaugauauagccaucaucacauauuaaugcaacacauuacucauguuuguggagaugcugguguaaacaaaccugcugugcugccagucauauaaaaguauagaacacauauguacuuuuuuuuuuuuuugagacagagucuugcucucuugcccaggcuggagugcaguggcacaaucucugcucacugcaagcuccgccuccugguuucacaccauucuccugccucagccuccagaauagcugggacuauaggcgcccgccaccacgcccugcuaauuuuuuguauuuuuaguagagacgggguuucacuguguuagccaggauggucuugaucuccugacuucgugauccgcccaccuuggccucccaaagugcugggauuacaggcgucagccacagcaccuggccaauuauauguguuauauaaugcuugauaaugaugauaaaugacucuguuacugguuuauauauuuauuauucuuuuuguuguuauuuuagaguguacuccuacuuauaaaaaaaaguuaacuguaaaacagccucaggcagguccuuuuggaggucuuccagaagaagucauuguuauuauaagagaugucagcuccaugcauguuauugccccuaaagaccuuccagugggacaagauguagaggugaaagacacuaauauugacagugggacaagauguagagguggaagacacuaauguugacaguccugaccuuguguaggccuagacuaaaguguguguuuauguguuaguuuuuaacaaaaagauuaaaagguaaaaaaauaagaauaggcaggcgugguggcucacaccuguaaugcuagcacuuugggaggcugagacaagugaauagcuugagcuuaggagcuggagaccagccuggacaacauggugaaacuccgucucuacugaaaauacgaaaauuagcugggcaugguggcacacgccuguaauuccagcuacucgggaggcugaggcacaagaauugcuugaacccagaaaguggagguugcagugagcugagaucaugccacugcacuccugccugggugacggagugagacucugucucuaauaauaauaauaauaauacaaagaauacaaaaaagcauauagaauaaagcuauaaagaaaauauuguauagcuguacaaugugcuugugucuuaagccaaguguuaaugcaauagagucaaaauguuuuuaaaaaauuaaaaaguuuauaaaguaaaaacuuacaggaaguuaagguuaauuuauuguugaagaaaaaaaaauuuaaguuuagugcagcguaaacauacacuguuuauaaagucuacaguaguguacaauacuauccuaggccuuuccauucacuuaccucucacucacugacucacccagagaaacuuccaguccugcaaguuccauucaugguaaaugcccuuuacauauguacuguuuuuuuuuuaaucuuuuauggcguauuuuuacuguacuuuuucuauguuuauauauguuuagauacacaaauacuauuguguuacaguugccuaguauucaguacaguaacaugcuauacaaguuuguagucuugaagcaguaggcuauaccauauaggcuagguguguaguagacuguaccaucuagguuuguauguguacacucugugauguucgcauaacaaugaaaucaccuaaugacacuuuucucagaauguaugccugucauuaagugacacauaacuguauuuagcuuuguaagaaauuccuaaacugucuuccaaagugguuguaucauuuugcauucucaccagcaaugaacgagagaguucccguugcugcauaucccugucaccauuugguguugucaguguuuuggauuuuaguuauucuaauagauguguagugauaucucauuguuuuaauuugcaguucucuaaugauaaaagaugcugagcaucuuuucauaugcuuauuugucaugcauauaucuuccuuggugaagugucuguucagaucuuuugcacaguuguuuuuuuuaaauugggucacuucuuacugaguuuuaagaguucuauguauauuuugauacaagccuuuuauuagauguguuuucucccagucugugguuuguuucuuuguucucuuaacacuguauuuugcagaaauuuuaaauuuuaauccagucuaacaugucaguuuuuucuuucauggaucuugcuuuuggggcuguaucuaaaaagucauugccaaacccaaggucaucuagauuuuccccuacauuauauuuuagacauuuuauaguuuugcauuuugcaaaugcaaugguuugugauccauuuugaguuaauuuuugugaaaagcauaaagccugugucuagguugauuuuuuuggauguggauguccaguucuagcacaauuuauugaaaagacuguccuuucuucauugaauuuccuuuucucuuuuacagucaguuaaccacauuugugugggucuauuuugggcuauuuacuucaauuccacugaucuauuuauguuuucauuaauaucacauugucauuaucacuguagcuuuauagcaagucagucuuccaauagauaucaauauaguuguaucuauaaaaauauauugccuaggccacaugccagaccaaccaagucagaaucucugcugggacucuaguauauuuacacauauuuaaagcuuuccaaguuauucugguggacagggagaauuaaaagccaccauacuaaaccauaaaaucaucaccuccuugaagaugugguucuguucacugaugugucuauccccagugacuugcauaagaugcuuaaauaguuguugaaugaacaaacgacuaaaagaacugggaguauuuaucuuggagaagagaaaaaguggaggggcauaauaaauuagccuacauacauacauaguugcaagccuuuaaugugacuugcccuggaggacguugcuccuggagcagaauuagaaauuuacagagagccaccuggcugaaugugaggaaacacugccucauagugcugguggaaagugagcuccucauuccugcauguauuucagaaaagccuggaagaccaucuauaagaggaugcugcauggggugggaagucgaguaagauaaguugcuaugauuauugcuuauuaguuugaaaagcugugucuaaggcagaggacugcuucuggcucucauucacccuguguaaauugggaugaaggacauggugugggguuaaaaaaaagucuuaaaaugacuuugaagcugaauccucagacuacagcaauucuccgggugucuauuauugaccaauucuuucuuucuuucuuuucuuccuuccuuccuuccuuuucuuuccuuuuuuuccuuuuucuuuuuuugagauggaguuucgcucuuguugcccaggcuggaguccaguggugcgaucucagcucacugcaacuuccgccuccuggguucaagggauucuccugccucagccucccgaguagcugggauuacaggugccugccaccauccagcuaauuuuuuguguuuuuaguagagacgggguuucaccauguuggccaggcuggccuugaacuccugagcauuuaccagauguguggucuuggagaagucacugacuucuuucaccaucguauucuguuuuccaccaaguucugcugcugcuucuuccaagcugugucuuuagaaaauaggcuugcuucuuuuuacauuaucuuacaauauguuagucuaaaucauuacuauuuucuguugccugaaccucugagagaaguuauuaacuuauuuccacuccuacccccuuucuccacugaacagccagugaucuuuuaaaaaauguaaguuagaguuugucauucugcuuucaaaccuuucaaagccuucccacugcuaaaacuuggaacaaaagccuaacuccuaauuaugacccgaaagagacaccgcauaaucugacuucugucaugucucuuaagagcaggguuugggagggggaagagugagguaauacuaccuccuagggagcauuugcaaaugugugaagguguguuuuauuguuucaguaauugggaggcacuacuagaggcacuacuagucugggccguguugguaaauguucuauaauguguuguucagcucagguuccaucacaaugccugaugcacaauaguugguuaaaaaauacuuauuguaugagcccuggacauuuucccuggaccuccguuuugacguaugugaauugguauagugccuacuucauaagguuguuuugagagagacauaacauuuauaaaguaccuaguacauaauaguucuuaauaaaugguagcaguggcuaggugugguggcucaugccuguaauccacaguuugggaggccaagggaagaggauugcuugagaacaggauuugagaccagccugggcaacauggcagaccccaucuguacaaaaaauauaaaaauaacugggugugguggcagguaccuguagucccagcuacuugggaggcugaggugggaggauuacuugagcccaggaaggucaaggcugcagugagucaagauccaaccacugcacuccagccugggcacacagcaagacucuugucucaaaauaauaauaauaauaauguagcagcugcugagcuuuguuugcuuagaggcagcuauaggggcccaccuagcauucuuccuggagcauuagaauuagaaccuggcacguuuggggaggggggagguguaucucuuucucugaggccuaaucugaaucguaggucugaccugaggaaucuuagaagggacuccucuauacucaucuguagaaacuaaggcacagaggagcucugguugucuuucuugacucuggagcucacacaggacucugacaagcccuggaaaaccuggcccuggagagaaauuaccuccugcuggagacuggguggggagaauagcugagagggugggaagauagcugucuccccgcccucagcucugcuuugcagaaaaggagaagcgcgcggcuuccucccgccuccuucccuccuuucuucccccgccccuucuguuucgccaaccccgacgcggcgccuucgcugccgcccugcgagagcgcgagcgugcugcaccucgggagcuggcggcugagcugccaggagcccagcccagcugaaucgagcggagccgguggagcaggggccuuguggguacccgguugggcagggagaggugcggcucugcgacggaaacaaucgccagagaugccggggcuagccuuccccaccagguaaugccggcccugccuggggcuccccuagcugggccggguucugggggaucuccgccggcuuucggagaguggugacacgggguccaguagauuuugaggggugucuuacuuuccucuuaccuuaagggacccuaaaugagagaaagggcugaggguggaaccuuuagaugagcccacccagggcuaggccugcacuggaaucagagcucugcccagggaagggugugaaggggaagcugcgccuuuggggaaccgcucagccucagaagcucugcuccuuugcaagcgcccuucugcuugguggccaacguggugcuuuccucugccuuggcuuagucgcuggccugcugggacugugggggcuuuucuguguuaagagguugagugaacugggagggaggagaccuggggggacugguccuauucagacauccucuguggcuugaguugccauaucugugcagugaaggacuugacauuguuuguuacucuggcuuuuccagacugucaaaccaucuuuuggagaggugagcugguuuaaagugcuaaaaugggcugcagagaugucccccucaacacuguagaagagaggagaacuugggaaguagaccuugguauccugucuuccagccagccuuuugaauggcaucuuggugguucuucagggacaaagcagagacugagaaugcugaugcuuauuuuagugugaugcguagguguguuagguguagggagguaggguugggaaguagaaggucaagguauguuaaugauucuaaacuggccaguuuuucuguccuuagguauaaaguugcguuaaacuagacucucuucucuggagccccuuccuuauucugcuaaguuaaugacagaccuggcugugguaauaucuuaaucacuauaauucuuuccuucuuuauuaccuggcaccaagaagcucaugucaggcccgauaauaaccuacuuugauuauuuuggaccucuuuccucccccuaguuuuuucaugacucuacgucuuccucuccucacuuuucuuucuauuuccuccuccugaucauuuuuccugcccccugccuaccuuuucucccgccguccccuucacccuuccuccuccccucaugcuuccccuuuuguauuucucccccuguguagccagucuuuccuucccucucuuggauccucccccucuugauuaggcuuucuucucuuuucuaaaauuuuugguuaagcuuucuuauuauuaguagguuacugguuuguagagaccuuuuccuguguuuaugagguccaaacauuguuuucuaccuaacucacuugcaucuagcuuuuaccuccaaauucuaucuuccccaggaccauucucucucuuuacugccucugugccuugccuugggccugccaacaagcacucccucuuccugcauuuguuucccaucuuugcugguggugguggggcagcaagcagguaggcaguagggaauaagcaagaugggaaguggggggccugagugggaggagagcaagaaugucaaguagugcugggcagaggcucaaguucccuuuagugagaugagugacugggaggaccagaaacucuggcagcugugagauagugcugaucuggaggaaaggagguagcccaggaaagaagagggaggauagcagggauggguuggagggacaggaggaggaggaggccuggaggagaagacagugcucuuuugaagaagaggguggccuggacaagauagugguuauuuguguguagaaagagaaagauuauagucugggaaaggggacuauauagguuaauuaucuuccccuuugaugacuggcuuuuugaacugauuucuacucagcaaauuuuuuuuuaguuaaaaauuuugaaagaauuuaccauguuuaucauguuuaaguguacaguucaguuucaguaaguacauuuauaucuuuuuuucccccuucauccuccucacucccuuuccuggccuuugguaaccaccagucuacucuguaucaucaugagaucuacuuuuuuuaccuccuacauaugagugagaacaugugauauuugucuuccuguaccuggcuuuuuuuuuaccugaaaaaaugguauccagugucauccauguugcugcaaaugacaggauuuuauucuuuuuuauggcugaauaauauuccguuguguguauauauacauauauacacaaauauauauuguguauauacacauuuucauuuuggcuauuaugaauagugcuacaggauucaugggagugugauaucuuucauauauugauuugcuuucuuuuagauauauacucaguaauggaauugcugaaucaugauaguucuauguuuaguuucugaggaaccuccaugcuauucuccauaguggcucuacuaauuuacauuuucaccaacagcauaugaggguuccucuuucuccccauccuugccagcaucuguuauugccugucuuuuucuuuuucuuuucuugagacagggucuugcucuguugcccaggcuggagugcaaugguacgaucauggccuacugcagcuucaaccuccuaggcucaagcagucuccuaccucaaccucugaaguaguugggacugcaggcacaugucagcaugccuggcuaauaaaaaaaaaauuuuuuuuuuuuagaaguguggucuccuuauguugcccagagugguugugaacuccugggcucaagugaucugccugccuugcccucccaaaguguugggauuacaggcaugagccaucgugcccagccuuugccugucuuuuugauacaagccauuuuaacuggagugagaugauaucacauuaugguuuugauuuguauuucucugauguuagugauguugagcauuuuuuucauguaccuguugguuauuuguaucucuuguuacgaaaaauguccguucagaucuuugccaguuuuuaaauuggauuacuuguuuuuuuugcuauuaaguuguuugagcgccuuauauauucucguuauuaauccuuugucagauggauagcuuacaaauauuuucucccauuuuguggguugucuccacuucguuaaucaacggaauuuuugugagcacuguccuuaaagugggggaguuagagggaaagcagagaugagaacgacaagauuacuguuuuauuggcacucacugucagaauguggaguguguguguguguguguguguguguguguguguguguauuucuccauaguggcucuacuaauuuacauuuuugucaacaacaugaggguuccucuuucuccccauccuugccagcaucuauuauugccugucuuuuucuuuuucuuuucuugagacaggaucuugcuguuuugcucaggcuagagugcaaugguacguacgaucguguguauguguguguauguauauauguguguguguauauauguauguacaauauucacagagcuuugaauauugcauccauccauuaucaaauauuucugaaccaucuacucuaugcuaauuaugguacuagguugguggcgauacaaaaauugaaacuggccucaguuguugcucucaaaugcagaucaaggaauguggacgcucaugugguaaguauuguagaaggaagcacaaggggcugugauaaugcagaagagggcacuuuugauuuagcaagacaguggcagagcuaggaccuaaacuuaagucuucucugaaggugauaucuauucucuuauacccuguuaucuccugaguuuguguauacauacaguguacaaagaguuuuccuauauccucuuuucugccuacuuuuggggcuagacucuagguacugcugacaugaaaaaaagaacaaucccauguggcaggucacugugccauagccaaacaaacacucauuaccuuggaagggaaacagacuucgucccuguuaacuucuggcucgaggccacuugggugacuauaugcugagcucccucucugagucauuugaucucuuccuuccuuuccucccuguuccauuuacuuaaauucaauuucuggcggguugcagaguccagagaccagaugcagcuaggcuaggcauuuucgcuuccacuggccucuauagaauagggauuuaacaccucauaggguuggugaggaucagaugaaauaaugaaugcgugaaaaugcuuuguaaagugcuauauagauaucauugugguuguucccgagugcauuuucaagccgugaaaaauugcucagaugcuauagccugaaagccuaggguugccacugacaggcaagaauaggcacucaguauagacaccaagauuuacuagacccuuucucugcccucgaaaaacucacagacuaauaggagaggauugaaccucaauccuccgugaguaaaggaaaaggagugggguagauagggcuuuaggacugguaauuuaguuccauggucaaacaaaaaccacgaaguaugugcuuuauuuaaggucgaacagauaguagguggcaauuauaaaagauacuuuuagugacuucuuaugauguaacacaaaaaggggaagggggacuuaaaaguagauugacuucaguucaaauccugguucuaccacuuacuguuaccugauuuuuaaucuuuuuaagcuucauguauaaaaauggaagauauucauaccuacuuugaaggguuauuauaaagcuuaaaaauaaucauauaaaaaaauaauaauaauuauauaguaggcacguaauagcuauacuuauucuacaaguccccugacuccuaggcuguuaagggccccucuucuggauucaugcagcaccuaugucuuuccucucaccaaucaauagugccaguuaccauauuguauuguuauugugguuaauguaucugccuuucccauuagucugugagauuuuugagggcagggacagggucuaguaaaucuugguguugauacugggugucuacucuuuuuuuuccuuugaaaucguaucucugucuguugcccagccuggaguguaguggagcaaucucagcucacucacugcagucuugaccuuuuggcucaagcaauccucccaccucagccucuugaguagcugggacuaccggugccugccaccacaccuggcuagcuuuuguauuuuuuguagagacaggguuucaccacauugcccaggcagaucucaaacuccugagcucuagugauccacccaccucagccuccccaaagugcugggauuacaggcaugagccacugcaccuggcuuugagugcuuacucuugccaaguccuauuuaguugcugaguauacuuugguaagcacagcagacuuacaaaagcauaucguugcuccuuuacaaagcuuaucacuuauugagggagauauauaauaaguaaacaaauauaauuacaacucaugaugaugcugugaaaaccaagaguuccguuuggucuuguuagauuugagguacugaugagaaacgcagguggaguugucuaauagaugguuuuuaggcugaagaaagcuguuuggucuagagaucaaaacuugggcauuaucaacguauuaauaauauguaaagccaugagaauggaggaaauaaucuugggaaaaguguaguguaucaguaaggaagguuccgagcaaggaaggucccaagccuuggauguguggaugauagcuggagaaggaggauucugcaaacgagguaggaguagacagaaagauggaaggaaagccaagugaguguacuucccuagaagacaggaaaguagaguauuugaaagagaagagaggucaauugcguuuaaugcugccaagauacugaguaacgugaggacagaaaaauaaggauuugauuuggcaagauggggauaauugauaaucuugacaagacugcuuuugaugaaaugguagauuguuaguuggcagacagaaggggaggaaguggagauaguuuaaguagacaguucugagaaguuuugcuaugaaggggagcagagaaauaagugguauuuggaggaggaugugggugucaagggaagggugugugugugugugugugugugugugugugugugugugucugucugucugucugucugucuuugaauaggagaugccaaaacuuguuuacauucacccaguauuucucagaucaguccagaaauuuagauaccaucuuaauuuuucuuuuuuuuuuuaaucacaugcuguaucuaaucuuuaacucauuugacucuaccuucaaaauguaucugccuuugaauuacuucucucccccuauugccaaucaucuaagccaccauuaguuuucaccuggauuauugcaauaacucccuaauggucucuccacuucugcauuguuccccugcagccuguucuccucugcugcuagaguggucuguuuaaaaacauaaaucagaucagugcucaaaacccuucagugucuuuccacacuugcugaaaagccaaauuuauuguggccuauaaaguuccacacugucugaccucugguuacaucucugaucccagucgcuuaccauauuucucuuuguuuacucaacuuuagucuugccagucuuuuugcuguccuacaugcccaguguauucucaucuaagacauuuguacuuauuacuccuucgcuuaaaaugcuuuuccagauauuacuaugauuugcugucucauuuaaaugaggucuuaaguaacuguuucucagagaagccugucuugauuaucuucuuuuauguaccaugccccaugcaugcgccucccccucauauucacacauacacguggacuugauauuguguauuuauuuguguauuucucugucugcaucucuuacuagaccauaaacucuaugagcacaaggccuuucucuuauucaacuagauuaguauugguacuuuguagaugcucaauaaauguuuguugaaugacugaauauaucuaacagagagggaaagguugacauagcugaaagagcagauuauuccaggugagaacgagugaaggaauacagggauaagagagaauuggcuucggaugagaggaagaacaccuccuucauuguaacuggaaggaagaaggagaaaauggaugcagauacagggaggcacauagauuugaggguaggaagauguaguucuucugccaagauuucuauuuucucauugaaaguaagcucauuggccgggugcaguggcucacaucuguaaucccagcacuuugggaggccgagguggguggaucaccugaggucaggaguucgagaucagccuggccaacauggugaaacccugucucuacuaaaaauaaaaaauuagccuggugugguggccugugucuguaguucuagcuacucgggaggcugaggcaggagaaucacuugaacccccgagguggagguugcagugagccgagauugcgccacugcacuccagccugggcgacagggugagauuccaucucagaaaaaaaaaaaagaaagaaaaaguaagcucauuagcuaaaggaaagggcuaguggaaaauccaguugaauucccauuugagguaggguaaucauauguaggaaagugucuuagccuauuuuguguugcuaugauagaauacgacagacuagguaauuucuaaagaaaagaaacauauuucuuaaaguucuagagcugggaaguccaagguaccugcaucuggugagggccuucuugcuguguuauuccgugguagaagguggaagggcaagagagcaagaguaacaagggaagugggggugaacucauccuuuugaucaggaacccacucucuugauaacuaauuuacuccuaugauaaugacauuaauccauucaugaggccagagcccucaugacccaaucaccuuuuaaagaucucaccucucaacacuugcagugaggauuaaguuuccaauacuugaacuuuggggacacauucaaaccaaagcagaagguaaucauaacuuucaagugaaagcaguuaacuggguuuuguaauguucucuaggacauuuggcugcuuaaguauaaugacaguugggagaaaguugaguucaacuauccuaaagcuaggauuuugccaguuaaauuuuggaaaaggagggaagggcaagggguugaugguuuuugauguuugaguaauuuugauggaucaugauuagauaaagagaggaaaaaaaggcaggggacugcuggauaguuuauuggagcucaaauugaagucuaggaauuguaguggaaauucuugagcaagguugucucuggaguauauaugauucauucuauguauuggaauuguugcacauuuuggugauaagguccuggguguaaucaugagaguauuggcuaacuuggacuggaggucagaaaauggaguggccaggguguugacaugaucaucauuguggcuguugaagucaccuagaaugaugacuagagggguucagaagaagauugaaccuggaacuaaagccuuucagugggagugaccagaaagugaauaguagucugcaaagaugugcgauagcagccaguggaagcuacucaaaggaaaauauagguuuuuacaagaggaagagaaagacaugguuuggaaauggcacugaaaauuaaggacuacacugauagguaggguguaagagggaaaacagcuuccaauugagagggcuuguagagaagccucuucuucagggcauagccagauuucuuuuaagguaaaggagcaagaguguagccaguggcaaaugagaaguuccagagggaacaguggaaggguuccagagucaccauagggggagggaauuuggucagguuagaggguucacagaaaaguuuggagaugagaguuugagugaucaugggugacugaaguaaaugaaaacuguaggacugauugauugauuuaguccuaauuaccuuuuagaggugggaggacugucccauuuucaugcuaugguuuuugacacuuugagauaaacuuuuccauugaggcagcauguggcaaugugggaaaucaggacauguucaggcagagauuggcuggaaggucaaccaacuaggagacaguacgauagauuucauuguuuccugggagguugaacgaaguggccccuuuaugguuccuuccagcucuccgauuguaagggccucaacuuuaugaggccuuacaggccucaaccuguaaggcaggucauccaaugggagguuuggagguuugaagguuaaauuucaauuuuugccugaauuauugggaauaacucaacugggguugcagauuaggaauuucccaagaugguaggcagaggauuauaagaccuguaaauauugguuucuggaaguaacucuagugacugucugcaaggugguaggagugaggaaguugcguaggugcggauggggguggggaggauuagagguacagagccagccuaagagaacuucagucugucacucuaaauuucucugccguuuccacuucacuuugcugccucucauucuucucuaauuguaggaagccucccagauacagucacuuguucauucugucucaaauuacguaauuaguguagaaagagaguuuucaagagaauaaucagaagcuaguaauguuuuuaucacucuuucauuuagugaucuuagguaaauugcauaacccuauagguuccagguucccauaaaauaaagguguuuauuuuauaaaaauaaaacuggcugauucuucaggauccuuucagguccuguguuuuuucugcuaacccaggcugccuuagucagugaaccuuggcuaauuaccagguguguaccagcucagccuagggauauagagauuaaacaaacuucaguuuuuucccuugaguuauucauggccuggugaggacaagaagcauggauuaugguugauauaaugaaguuuggaaauuguugcauagaaguacacauagaaugcuguuacauuucgggagcagaaguagugggaucuguuaaauuugggggcuucugugaagguuucauaggggaagugagucagguugggccuugaagaaugaguaggaguuugcuuggcagacaaguuggggcauuuuaggcagagaaaacagcauaggcaaaggcaggaacaugaaagcauagugagcuggaaugacauguuuagggaauaguagagaugaaacuaaaaagauaggugggggaaagaacaaauauuuguugaacauuuauuuugugccaggcagcaugcuaggugcuuuuauauaugcuuguuaauucucgugauaacuuuauaaaguagguagucuuguuugcguuuuaccuaagaggaaacugaagaucagaaaguaaaguagcuuuccuaaccacccagaaacagccaacaguuuuccucacuguugcucuagcagguguugcuaaaccagagcaaguggccaggcugcauagugggaguaucuuugacauguuagaaggacaucccucagcaaauucaagacugcagcauuccaguccccugccaaagaaaaccuccuggcacaauauaauuaaagaucagauucucauaaccaggcgucaagggcauacaguacuccccaguucuggauggaguguuggucaugccaguugcagcugcugugagcuguuuggacuaaaaagugugauuaguauauggaacagguuuuauuucuucuucucgaguuaauauuagagguuaucuauuccuuuccuuugccucuagagucagcaguguagugugguguagugguucuaucaccacacaggccuaauuucagguuccugccucugcugcccacuagcuguaugacccugggugacuggcagcaucuuugaagcuuugcuucuucuucuucugacuuguuuacuguucugucuucagcacuucaugcauagcuugucaaacgguagcugacgaauuaauauuugcacugaugaaugagaaaaaugauaccaaauagauuuccaaguuuucaguaaacuccaaagugugaucuaauguuagugauuauuaaaacagccccaaauaaugcuuaaauccuaguuguaaaaaugguuaauccugaagguuuucuguggaaacuguuucuagaauuuuagcaacucucuuaggcaguguggaagacucucuuaaacuccaggucucauugugugacuuggacuaagcaccagaauucguuuaucuucugugaugcuuaaucccauuguaugaacucaaggcaucacugaguccucagugcagauggguagcagauggucuccuccuccaggcaauaccucuuuucucauugucaucucuccacaaccuuguuuuuuaauuaaaagccccaucuuuuauuuuuaacauggggcauuuauugcacaauucuagagcugcuuagaauggaccauuuuucugucuagugcucuacguggugcagaacauaaaagaccugcugugaucugcacugucccacuuuuucagucucccauuuuaguccuuuauguugcauucugccacacuguacucucacauuuauguuauucuguggucuggaugcauuugccaucaucuuucuccaugaaaaucauucacucauuuuuugucucuuuucuuugggccaagcacuauauacuaaugccuggaccuacuccagaccaauuaaaucagcgacucuagggguagaguucaagcauuaauguuuuccuccucaacauuuuauuagguaaaauuucaaaaaucagaagaaucuuacagugaguaccuguguacccaccaccuagauucuccuaccauuaacauuuucauauacuaacuuuaucauauccauuauauauugacauguauauuauguuauaacccuguuaaucuuauuucuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgccuggcuaauuuuuuguauuuuuaguagagacgggguuucaccguuuuagccgggauggucucgaucuccugaccucgugauccgccagccucggccucccaaagugcugggauuacaggcgugagccaccgcgcccggccaaucuuauuucuuaaaaaugcauuugaaaauaaauuacagauauuaauauacuucucccugaguacuucagcacugguguaaaacuucagcaccagugagcuuuaagaaaaaagcucacaggggauucuaauagccuagaguuaaagaccacuagucugaccuauuuguucuuuaagcugcuacucuuaauaccaccucuuuucugaaacuucacugaucacucaaauucaauuuaacauuucuuucauguguguuuggacauuuuacuguuuguacuguucuacagcacuauucacaauuggccuggcauugugguuuucuagguucugccuucugcuaacuagauggugauagccucuagggucaggucauauuuuauucaugaucugucuaucuaccuaucuaucugucuuccuucaucuauuuguucuugguuucuagcauacauagcaccuuauauauuuuuauauguaagcugaacugcacuugaacugcacuugaaugaagagccugcaacugcagcaaaagguguacauaccuuucauauguguuugcuuacauauucuguguuuauauuuuuuugauuggaggaauaagaauucauuuaucuuuucuggcacuuagcucaugguagacuuuuaguaaaagucaaguccagccuaaaugugcuaauaacauuuuuauauuugccauuggcuagauuugacugaacuaaucauaaaucagaaguagcggaacacaaaggggcuagaauuaccucaagaacaguauaguuggaaaauccuuuggcagagaguuuaaagaugaggucugauuaaacaaacaaacaaacaaaaaacuaaagauagaccuaucguaugauccagcaaucccacagcuggguaucuacccacaagaaaggaaauugguauauugaagagauaucugcacuccuguuuguugcagcacuguucaagauagcugagauuuggaagcaaucacagugucuauuuacagaugaaaggauaaagaaaaugugguguauaugcacaauggaguacuauucagccacaaaaaagaaugagauccugucauuugcaacaacauggauggaacauguacaauggaguacuauucagccaccaaaaagaaugagauccugucauuugcaacaacguggauggaacuggaggucauuauguuaagugaaauaagccagggacagaaagauaaacaucgcauguucucacuuauuugugggaucuaaaaaucaaaacaauucaacuaauggacauagauaauagaaggaugguuaccaguggcuggaaaggguaguggagggcuaguggaaagggagggaugguuaauggguacaaaaaaauagaauaaauaagaccuauuauuugauagcacagcagggugacuguaaucaauaauaacaauugcauauuuaaaaauaacuaaaagacuauaauuggauuguuuguaacacaaaggauaaaugcuugaggggauggauaccccauucuccaugauaugauuauuuugcauugcaugccuguguccacaauaucucauguacuccauaaauauauacaacuacuaugugcccacaaaaacuaaaaauuaaagaugagguuugaguuuugcugggaaggauaaguaaaauuucuaucaguuuaaagaggguucuaucccuacucuaccuauaaauugcugugugaucuuagguaauuuccucuugcacucuggacuucaguauuccuaccuguaacauuaggcagucagguuggaugacuuccaaagaagccuuuggcuuugauguuaugugcaucuuaaaauaguugauuaacuugguuuuguuuuauaccggugacuguggaauccaggguaauaagaguagaaagagguaguuguuggugagcacauuccuucucugaaucccugucuacuuugauucaguauguaaaguaccuuacacacaguggcuacuugaaaaguguuuucuuucccgucuuucuacuguagcacuguaucuuuaugccuuguauagcaugcuucaaaagaggcacaaaucacuuccccuccuugguugccucuugaccaguauuaagucuagagacugcauagcgagaaacaucaaauuacaggucauaggugaugggacuucuacaggggcgauggcuuauaaauugcagagccaggacuuaaaccugggucuccugacuuuaauuccaguaaucuuuuaaaauauugcccuaccuuuugaaaccucacagugauccugcauuuauuauagagucauucaguugauucauaauuaaugcuucaauauaauuaguugcucauaaauuguuagguucccugagccucuggggcauugguaaaaugugaucgcucugucuuucucucugucuguuguauucauuuguuguccaggauggauagaauggugcuaucugagcuguuauaauguuggccucaugccuagcuuuauauugcagcacgucugaggcauugguuuuucauccuuccaaacuuuuggucuacagagacuauuagaagauuaagguguguauacucacuuuauucaaaaguugagcauguuuguuguuuuggaccuguuuuccuguaaacaaaguuuaaaaugguacagguuuuaaaaugugcuaauuauuuugaugaguguagauauacaaaaugaccauuggaggaucaaugaggguaaaaagaggaaagacuuguggagaaccuauaagaaagggcuuguuggagggcugcagggaagcuggaaaguaguauagaaaccuuaagcaaguucagaaggaagugauuaagaaagcacaaaauuguguucugugaguauaguugaagguccuggaaauguuuggcauugagaaaauagauuugggaggucucaaaagaguauuucagguaucuaaaguucugucuggggaagagauaguggucuuuucugaauagcucuaagauacaagauuuaguacuaacagauggaaguuuuuucuuuguuuauucauucguuuguuuauucaacaaaucuuuauugauuaccuguucugugccaggcgugguguugcagaucgagaaauacauaggacaugaacuuuguucuugagguguuuauagucuaugucuagcaggggagaggggugaaagggaaagcaaauguguaaacaaauuauugcaaugcaguguaagagcuuauuauaagugauaacucauuaaaugagauggcugaagauagaagagacagucuuuggagauuuuagauuuccugucauugcaacuuuucaagcauagacuggaugaccuaggcuggaauguaguaaaagaauugaaauauuagauuccaaugcuuauuuuagguuuuaaguaauaauggaaucucuuugaaagugaagaucuaucacagaauucuccaaacauaguaaaaggacugagaaauggagaaaagccuguaucaggaagguuggugaaaccuuuguuggcauaaucgugggcugugggccugaaauggaguuacauucaaugaagcuguugguugaaggaccugggaggcagggaaggacuugacuaggguaucagauggcugcagggaguguaauuuuggaacuggcagccuggagugggaagguacacuugagaacugagacaguaaaaguucucuugcgggagcugagggacuugaguuacaguugggagggaaaacaaagguaaaucugggaagagaaacuggaagaaauggauaaaaagaacaucagaguuaaucugcauuaacaagauuguccuugcuugcuugauuucuuuuguucaaaaagagaaggagcaguugguuugccaaaggugggucaggaugaauuaugcaaagaagugggguuaggguuuggccuugauggaugaguaagauuuuuaucagucagagaagggagaaaucauugacaggaaacacguugggguguguguuugugugugugucuguguguguguauaaguaaauaagaauacaaguacaguggaacagauuucugagguuugaauuaguuugaauuaggcugugucuagguguaguggcuuaguugauaaggcagguugaugucagauagugaaggaccuugaauuuuaucuguacuaaacuuccuaaaggcaagguauauaucuuuaugcaaaguuugauuaauuaaaauauuugaguucacuaugagcuagauacuauauaaagcauuguuggauugcaaagaugacaaaauugggcccaacauuugaggaacauucuggcucccagggaagacauaccuauaaacaauuguaauagcaauaauagaagggauaaccuggaaaguuacccauugcuuugggaauauggaggagggggcaccuaacuucuugaagugaugaggacacauuuccaaauggguucaaggaagaaauaacaauugaauuaagccuugaaggaugagugaauucauaguugaagcauagggaaauugguauucuaggcagaaggaucagcaugcacaaaagcauagaaguguaaaagcuaugggauauuugaagaaguuggagaaguuggguguggauagaguguaagggaaauuagagugguaguggugggaaaugaggcuaauuggugcauuuggucaaauaacagagggccucuaaaagcaagcuaaaaacaucagcuuuuauccugagaugucaaugaaggguauuuuguuuuguuuuguuuuguuuuugagacagagucuugcucugucuccaggcuggaaugcaguggcgugaucucagcucacugcaaccucugccucccggguucaagcaauucuccucccucagccuccugaguagcugggacuacaggcgcgcgccaccaugcccagcuaauuuuuugcauuuuaguagagaugggguuucaccauauuggccaggauggucucaaucucuugaccucgugaucugcccaccuuggucucccaaagugcugggauuacaggugugagccacugcucccagccagugaaggguuuuaaaaguagaagaguaguguguucuaagguuacugacagcuccuggauaaaggauugaggaaaaaacuggauguggggggauccguucuuuauuagaaauuguuaaaaaaaaaaacuccuauagauuuuauucauaguauuuuaaguaauugaugccuaaagcgguaguauucaaaucugacuggcauugggaucacuaauuuucaaaauacagaauuaggucuuaacucagccguucuaaaucaaaauuuauggaggccaagccaggauaucuauauuucuaaaagcucuugguaauuauugugcugguuuuuugaacccauuauucucuaaagcacuguuguguuuaacuccaaagagcuuauauuuuaaauagucaugguuaaauguauaauuucuacugcagcauggaagacuaaugagcaauauuuuuaacucuggauacauucauauguauccauugucaaggacguuuauuuaagauaauaacauuuucauuaaaacuauugauaacaugugauaggaaaucccccccaucuuuauuuauuuagagacagagucucccucugucacccaggcuggaguacaguggugcgaucuugguucacugcagccuuugccucccauguucaggugauucuccugccucagccucccuaguagcugggauuacaggcacccaccaccacgccuggcuaauuuuuguauuuuuaguggagaggggguuucaacauauuggccaggcuggucucaaacuccugaccucaagugauccgccugccuuugccucccaaagugcugggauuacaggcaugagccaccgcgcuuguccuauccccuaucuuuuagauuuuauucuacuguuucucagaaguaguggagauuuugccaguaaauucugcaccauauaggacaggaugguuacugcauugaccauuuuauauuuagaagaagaaagccaagcacaguggcucucgccuguaauuccagcugcuugggagacugaggugggaggauugauugagaccuggaguuugagaccagccugggcaacauagggagacucuugucuccaaaaaaauuuuuuuuaauuagaugggcaugguggcgcaugccuguagucccagcuacucuggaggcugaguggggaggaucucuugagcccuggaguuugaggcugcagugagcuaugauuguaccacugcacuccagccugggguaacagagcaagaaucccaucucucucucucucucucucucucucucuuuuuuuuuuuaaagaacaagguagaauuucagaggagggaaacacuggagagauuauauagucucagggguuagccaacuuuugcuguaaagggcaagauaguaaauaauguaaguuuguggacauacaaucucuguugcaacuacugaacucugccagcaucagguaaaaaaaaaaagccauagacaauuuauaaaugaauggguguggcuguguuccaauaaaacuaucuacaaaaacagcagcuuuccugacccuugauacaguccauucccaagagggaaaguguaacuugucuaagguuauaaaauuagagguuggcagagaacucacuauguggaaugcuguuagcaguuuuauuuaaucuucacauagaugaauaaaugaaaccuaagagguugaagaauuucucuaaaguuaguaagugguacugggauucacacuuaguuuuugcuaggccaaauuucugcuuucaacuacaucauaaugguuuuccgugcuuugcaaugucucagaaugggaaugcaaagaaaagcaagauauugugauuuuucauuagugcuuggcauauaguaggcauuuacaucagugaguguuagcaauaucauggugugcaguggaaggacuugagcuagacccugaaggaagggcuguauaauuuugauucuuugcaauuuuuuaacauguauuuccuuuuggucaaaaauaauaaaagaguuauauuguucuuauuucugauucuaguagcugcugcugguggugacaaugucaaauaacggccuagacauucaagacaaacccccagccccuccgaugagaaauaccagcacuaugauuggagccggcagcaaagaugcuggaacccuaaaccaugguucuaaaccucugccuccaaacccagaggagaagaaaaagaaggaccgauuuuaccgauccauuuuaccuggagauaaaaguauaguauuugauuuucuucucaucauuuauaugcuuuaaaaaaauuauuuuggguaaccuggauaaaagaucuguugucuuugacuuaauuuuccuuuaauguuuucuuucugguuaaauauuucccuuucucccuacaguggcugaagcaaaauggaaaauagaccuauuuuuauacucuauuaacuauaucugagcaaaacuguaagagaauaauuaugcucuugccagauuugggacaaucugaagugauuuauuuauuuuuaaauucuuaaacuguuuaugaagccacaaaauguaagaaaaauugaaaugucuuuauuuggaauuuuuuuccccccgaguuaguuucaauuggaaauguuuucuuuccaaaaucuugauugccuuuucuuuauuccagcuuccuggucccacuuucagguuuggggacuacguaucaguaagaauggcaaguaacagcugagaaaaggaugcagagauaacuagcauucagcaugaguuuacuaugaauaaauuauccugggcagccucauuuccuuuuuauugauaaaacuucuguuaauagaagaguaaucauaugaugaauaguggugauuuuaacacugauuuuaacacuguugauuuaauaguguauaugaaaaagucaccaagauccucguagacaagguuguaaaauaaagguuuugguguccacaacaaaagaugacuuuuguuugguaccaaaaauguugauuuaaguggcuguugcucugaaguaaaguucuccuuauauuugugggcccuguucuuauggcaugcuaaagauacuggcuuucuguguguaaguaguuaccaugagcuucugguuuagauggagcugggucaccacuuaccagcuuucugaucuuaggcaugucaguuaacugcuuugaccuuuauuuaguuuccuauuuuaaaagugagauaucauuucacaggguuguugugaagacuacauacaaaguuccuaauagaguaccuuccacacagaagguauuugaauguuaguucucugucucuuuacuccuuugucucugucucuuuacuccuuuguugaugaauagaaacugggaggcauagcugguagacuacaugguaaaaucagaacugagauucugaaacaguagggcagauacaacaagcacaaugguagauugcggaaaauaucucauguuguagaaaaauauaauugccuaacuacggaucaggggagaugguagaugguagugucauuagcccaauagggaacauagaaagaaggaacaaauuaggaguguuggugauuggagagcagggaagaugauuauuuuggacacauugcauuuguagugucuuuauauagauaugucuuauaagcagaucucauguauuguaaaugucguacaagugaaaugagaaauaauaaggacuuuuaaugaguacauugggcuuauaucguuauguguaugaguccuucuacuucaccuucacuucccuuuggguuugguggcuuuggguagaaaagaaggccaggcacaggggcucaugccuguaaucccaacacuuugggaggccgaggugggaggauugcuugagcucaggaguuugagacuagcccgggcaaaauaggaagaccuugucucuacuaaaaaaaaaaaaaaaaaaggagucgggcaugguggcgugugccuguaguaacagcugcuugggaggcugaggcaggaggauugcuugagccugggaauuugaaucugcagugagcugugaucaugccacugcacuccagccugggugacagagugagauccugucuuaaaaaaauaaaauaggccgggugugguggcucaugccuguaaucccagcacuuugggaggcugaggcggguggaucaccugaagucagaaguucaagaucagccuggccaacauggugaaaccccaucucuacuaaaauacaaaaaaucagcugggcaugcuggcaggcgccuauaaucccagcuacucaggaggcugaggcugggaguaucacuugaacccgggaggcggagguugcagugagccaagguugcgccauugcacuccagccuaggcaacaagagcuaaacuccaucucacaaaaaauaaauaaauaaaauaaaagauauggguaaggugcuuaaccuugauuuccugacuaauucauucauauaguagcugccaacuuccuugguacaagggcuaugaucugagacaguguuaaaugcccugcagucuucuuccacauauguagccacuuuguuuaucccucaauuuagauguguauuuauuuuuaauauuguaucuuaucaaccaguguucuugaucucuauaaauaggcuuucagcccaagugucuacauguagugaaagaggacuuuuuaaauuaaaaaguuuaaauuguucuugcugacucaaacuagaaagguaauaagauucucauccaguaggcaucaucaaaacuaaaaacauuuauguuucaaagggcaucauccggaaagcaaaaagguaacacacagaaaggagaaaaauuucccaaauuacauauuuuauaauggauguguaucuaaaauaugugaagaagaacuauugcaagucaacaaccgaaagacaaguaauuuuaaaaugggcaaaauaucuaaauagacauaucuccaaagaacauauacaaauggccaagaagcacaugaaaggauucucaaaucauuagccaucagggaaaugcaaaucaaaaccacaaugagauaccacuucacacucacuaggauggcuauaauaaaaaagauaauaacaaguguuagugaggauguggagaaauugcaacccucauaauugcuggugggaauguaaaauggugcagccucuguggaaaacagucuggcaguuccucaaaagauuaaacauagaguuaccagcaguacaugaauguuuauagcagcauucauaauagccaaaaagcagaaacaacccaaauaccccaucagcugaugaauagauaaauaauaaaauguggaauauccauacaaugaaauauuugguaacaaagacaugaaguucugauccgugccaugacauggaugacccuugaaaaugcuguguuaagugaaagaagccaguuacaaaggaucacauauaguaugauucuauuuguaggaaauguccagcauugguaaauucauagauagaaaguagauuagcgguugccuugggcugcagagagggagaggcaauuaaaacuaggagaugauuacuaagaggggugggguuucuuuuuguagugaugaaauguucuaaaauugauuuuggugauaccuguccagcucucugaauauauuaaaagccauugaauuuuacacuucaugggugaauuguuugguaagugaauuacaucucaauaaagcugauuuuuaaaaaagaagauuccagucugaaacagcagauggaagcagagccuucagacaucauuggaaccuggagggacaaucuuaugugcuaaaugggaaagugggggucuagauauugggauuauaguauugguucuuccauaaauuggcugucugauuugggucaauuauuucucuguagacgucagugccuucaucuagaaaaggagagagagcaguaggcaugugcaguuucuuuuagcuuuagaauccuauaacuggccaggcacgguggcucaugccuguaaucccaccacuuugggaggccgaggcggguggaucacgaggucaggagauggagaccauccuggcuaacacggugaaaccccgucucuacuagaaauacaaaaaauaagccgggcgugguggcgggugccuguagucccagcugcuggggaggcugaggcaggagaauggcgugaacccaggaggcggagcuugcagugagccaagauugcgccacugcacuucagccugggcgacagagcgagacuccgucucaaaaaacaaaauaaaauaaaauagaauccuauaauuacauaaaugugauguugcaaaggcgugguuagaucaggcuugucuauauaggugaaaagaaacuaggccauuguaaaguacuuuauucaaugauacagcuguagaaaauccuaggcuaaaucuaaguaaccuuaggcuaaaucugaucugaaaauacaucucauagccucaagaucaaaacugcaucucugcaggcugaaaacauagagguagaaaacauacagaguuauaagaaguucuugcaaaaugaucuaacuaucuuucauccuuugguuacagauuuucuauauuugcccugggcacauagguuucaucccuuugcuuuaagacccuugauggcuauaacuaaugcauacaucaaaaugaaagaagucugagguguuuuucuuuuguuuggagccuuugaucaaccaguaagcuacucaacuuaguccuauaaggauacacagcaguguugguagucuuugaagugguauaugcccuucauguaguauuugagcauuuauaccagcugcauagaguuaugucuggaacuggacuuauaacacagauugaguccagccacugacauuuguuaacucugauuuauuuuuuaaauuucauuccaauauccucacuucccauucauccuauaucauuaguaggcuuuugucauuugacauaguagauauaaaagcauuuucuaaacuaaaaugcaauacaaauaggagguuuguuuuuuaaaaauggaaaccucauuuauuguuuuauuugauaccuacaacaacucauuuuuaguuggggaggcuaaggcuuagagaaaaguaaguugcucaaggucucacaaguggaaagugggagagcugaguauggaacuaagucuuccuaaauuaucuguuccauuguaacauaacuaucucucuuaguuguucucaacccugauuacauguuggacucacuuauggugcuuuuaaaaaauacagggcggggugcaaguggcucacgccuguaaccccagaaguuugggaggccgaggcgggcggaucacuugaggucaggaguucuagaccagccuggccaacauggcaaaacccugucucuacuaaaaauacagaaauuagccgguugugguggcaggcaccuguaaucccaacuacucaggaggcugaggcaggagaaucgcuugaaucugggcggcagagguugcagugagccaagaucaugcuacugcacuccagccuggguaacagagugaaacuccauuacaaaaaaaaaaaaaaaaaggcugggcgugguggcucacaccuuuaaccccagcacuuugggaggccaaggcggguggaucacuugaggccaggagcucaagacuagccuggccaacauggugaaacccugugucuacuaaaaauacaaaaauuagcuggacgugguagugggcaccuguaauuccagcuacacagaaggcugaggcaggagaauugcuugaacccaggaggcagagguugcagugagcugagaucacaccacuguacuccagcaugggugacagagcaaaauucugucucaaaaauaauuaauuaauuaauuaauacugauaccugcauuccacccagaccuuuggagucagaauuucuagaggaguugucuugggucucuagagagauuuuugggagaugagaaagaagaaugaucuguaggcuguaguaaugguugagauuugagcugccaguggguagaaugucuuugggcauuaccuaaugcugaccucucuagcauggccucaguaugugccugggggaugcauaaaugauuggaaagagaagcuguaauugagggccuguaauaggugaugcugaguugcagaauuccaugugggaaagccugguuccugugguuaggaucuggagccuuugguuuauucuaagaagucuuucagcauuuaguuugaaaucuuuuucuggcugcauuuucacaagcaaaguggaauucucugagcuugggaagaguuuagcaaaguuaauuuuaacauuggacuaugucaguguuuaucucuccaaguuuggaacguuuuacugccuugagcucagauuagcucaguggagccaaugagaggugcugcuuaaaaaucauuuuuuuaaaaaaggccagugauuugugcugaaacuuugauggcuauaccaagacaugggauuuugcagugucagccucauuucccaugcuaucagaaagccaaguggucuaggucaaagauaggguuaaaguugggaugggugagguuggaagcuucuuuucccgcuuuauuuucucaaucccaagaucucuagauacaugaaaucaagaugauucuuuccucuuucucaccucaaccacaguuucucugucuuaaugaaugggcugagaaaccuaacaguuuuuuauauuaaugacaacucauguuuguaaaguucuuuaguuuacaaagcacauauauuuccuguaacuuaaagaauucuuuuuuuuuugagacagucacgcucuguuguccgggcuagagugcaguggcgcgaucucagcucacugcaaccuccaccuccuggguucaagcaauucucccugccucagccucccgaguagcugggauuauaggcaccugccaccacgccuggcuaauuuuuguauuuuuuaguagaggcgggguuucaccauguuggccaggcuggucuugaacuccugaccucaggugauucacccgccacggcugcccaaagugcugggauuacaggcaugggccacugcgcccagccaagaauucuuaacaucguuguaggaauccuuauuuagauauaagucuucugucaguuauauauguuacaaauaucuucugugcucuuagcuuuuauuagauuaaguaaauuccccuguaaucuuagacagaugcuuggcaugaugugagauagaauuuuaauguggucaaauuuauuaauuauuuccuuucuaaugcuuugugguucuauuuuugaaaucuuuaccuacucagagacaugaagguuuuucuauugaguuuucuguauucacguacaugagcacaugaucuguaaauuguaauaguucuuuuucuuucuuuguaauccuucuccuuuuacuucuuuuucuugccuaauugcacugguuaauaccuucaguacuaugaugaauagaaguggugaggaggaauacccuucuccuguuuuuaaucucaggaaaagcuuucagcauuuuagaauugaguauaauguuugcuccaguuuuugguaauuaccuuuuauuagauuaaguaaauucccuuguaauccuaguuugcuaagaguuucuaaucaugauugauaucacauuucagcaaaugcuuuuuucugcauuaauugaauugauuauauauauuuucuucuuuauuuucuuaauauaguaaauuacauucacuuuuuuuuaaaaaauugagauauaauucacaugccauacaagucaccaucuuaaaauguacaauuccgugguuuuuaguauauucauaagauuguacaaccauuacaacuaauuccaauacauuuucaucacuccagaaagaaaccucauacucauugcagucguuccucacuucucccuucuccccuggcaaccacuaaucuacucugugucuauggauuugccuauucuggacauuucauauaaauggaauuacacaguauauugcccuuugugacuggcuucuuucacuuagcauaauguuuucaagguucauccauguuguagcauggaucaggacuucauuucucuucauggcugaauaauaguauauggauguacugcauuuuaucuauucgucacuugagggacauuuggguugccuucacuuuuugacuguuaugaauaagcuaaugugaacauucacauacaaguuuuuguguagacauaaguuuucaucagauuccugcagacauacuucuagucaucauaaaaaauuugcaacugcagcaguagucccagggauacuauaucccugggauaugggaccaucaggauccuagguuugcuuuauuuucuccauugugucuucccucaguccgaagcucuuagugccuuccugccugcagucaugugcuuugugaaucugguaagaguuuaugaaauuugguugacuugcugagcagguggaaagauggaagaaagaucacacugcuuacuucuuuuggccucugcuuauucuguuucuuuuggaaaugcccuuucccaucucggucuggcuaaccccuguucauccuuuaugacuucuuucagguauuaucuucuccagaagagugguuuauuacuuaccuucuucuguacacagagcaugcaccauuguccuauuuugcagauugaagacuugaaacucagacuuucccugggucacccagugaguuacuggcaaaaauaauacugaauccuuccucugagauucuuuccacuaacagaaauuucuuuuaauucccugaccucagcuguuuagcuccuggguuuguggugaugagccagugagacagugacuggcagagcuuggugaagggcuguacacaggugaaggggaugauuguuacuuccaagaagggauuaauuggguuccagguggcucugggacuguaugacuucuccauuucucuccuguauuccugccucuugaauccuguuuucugcuggugauccccaacuggugaauacucagucuaaauauuacacaguaccaggccgggcgugguggcucaugccuguaauaccagcacuuugggaggccaagguggguggaucacccgaguucaggaguucgagaccagccuggcaacauggugaaacccugucucuacugcaaauacaacaaguaacuggguaugguggcgggugccuguaaucucagcuacuugggaggcugaggcagggagaauugcuugaaccggggagguggagguugcagugagcugagaucacgccauuguacuccagccugggcaacaagagugagacucugucucaaaaaaaaaaaaaaaaaaaauuacacaguacccaagcuaaauccugccaccuagauuuccccguuccuuuuacuucucuccucucccacuucaaccaagucauugcuauucuuguacuccgcgucuaaucuauguuaaacuguuauuucaguuaguaguugauaccagucaaaucucaguagggaucagggguauaauaaagagugaaagacuugaucagguagacuacaguccugugcucugugaaucaggacaagucaacuuacaucccugggccucuuuccucagggaaugggaucauggucucuagagucacucccuaauauuuucuuucuuuauuuuuuugagacacagccucacucugucacccaggcuggagugcagugguacaauuucaguucacuucaaccucugccuccugguucaagcuauucucaugcuucagccuccugaguagcugggauuacacgcaugugucuccacgcccagcuaauuuuugcauuuuuaguagagauggaguuucaccauguuggccaggcuggucuugaacuccugaccucaagugauccgccugcuucagccucccaaagugcugggauuacagacgugagccaccgugcccggccauucccuaauauuuucuagaguguucuucaacuaaguaagccaugugcuguauugaaauucagaaguacagggauuguaauuggaagugguaauuuugguccucaagaagcuuacauuuuggauuuuuaaacuagcaaggaauuauauaagauaggaaaugacuagaugcuuggugguguagcagacucagugucuugggaauuaacaggaagaagaaaggucaggaaauccuuccuggaaaaagugggaccugagccagucuuuaaaagauugcugagauagggagaaggagaagagagcauuccaaacaaggagaagaaaaagcaagcaaaaaguuggaggugggaauaugugagguauauucaaagguugcaggguaaagagugcucaguagaagcagagcugacuuuagcauuacccuguguguucauguauuaaaugauuucauuucucuggaacucuuuucuguaaaccacucaugcuuugagcuaacuuucuuuuugggucuccuuuaccaaaguuucuuaugcauuugacaguucaugccugugauguauuauauaguauaucaauuauauauaauagaaauaauguauaaacaugcauagauauagaaaauaaaaauugaaauaaaacacaaauauaauuguacuucccuaagugacuagaucagagggaauuuagaaacagaaaguaguuccaaagcccugccacauguuccagugcauucuggcuaugagaaagacagauggacuuacgucauaaaggacugcuugacuuggggcccugguauaccccuuagccuucucuuucucaaagcagcugcuucugagagggaaauugccaagugcauaaauagcuuaaacccuagcacuuggcauguaggcaaaugguucucauuaagauacugaagaaugaacguuuggaaucagaccuggguucaaaucccagcucucaguagcuguaugaguaaauuacucaguuuccucaucuguaaaaugacaguaguaguauuuaucucauaggauuguaagaaugacgguaguaauaucuaucuuguaggauuguaagaaugaagaaaaauacuauauugacaucaugguuuguauacauggcaaguucuuaaugucauuucuucuuacuacacugaaguauguuuucuugauucaacuugaaauuuuuuaggggagguaaaauagaaugugaagagccuuggcuuugaugccagacuuuuuggauuuuaauuacuuaaugauuguaggcaagucugcucccaaauuuucuaaucuacaaguaaaacuuaccucaggauuguggugauuguauuagaugauauguaugaaauaccuauuuaaaacugugggaugccaucucaggaaggaaucuuaacugcagagcuuugagaaagcauaguuucuuguuuucauagauucacagaauguaggugcuugagggacccuuaagaucaucuagcucauccucucccuuguuuagaugagaaagcagagauccuggucucucuuucucucucucucucuacacacacacacacacacacacacacacacacacacacucuguggugagguagaggugaaacuggcuugaacucuagaccuuuuuguuuuuuccuucucauuuugcuaccuuuuaucaggguuuugcugggucuguggagguguuagaacuucagaauuucuuuugguuaguguguugagcucccagacagcaggguuuuaaaauaagguucacaggugcuggguaacaaguguugugaaagucaggccagagcugcugaaaugaacauuuauuccugcccuggagagaauuuuugugucuuaggcagauucuuuaaacuccuugcccaguugaguuaaaugucuggucauuuuuuccuuucuucacuuacugucugagcaccuacuuuguccaggugugugcuagccucugggaagcugugauuaauuugacauggccucugcacuuagaauucagucugguauggaagauaaacacuuauaauagucaauuacuauuacauauauugggugcugugggaacagagaggguaaagaaccacccagccuagagaucaaggagggcuucacaaaaaagaugacuuacucuauaucaacuggcuaguuacugguaaaaccagaacuguuaacucugacagacgaucuuuuugccucucccuuuauuuuauuguuuuuuguuuuuuugagacagggccucacucugucacccaggcuggaaugcaguggcgugaucucagcucacugcaaccucuacauccugggcucaaaugauccucuugccucagcuucacaaguagcuggcauuacaggcaugcaccaccaugucuagcuaauuuuuguauuuuugcagagacaggguuuugccauguugccuaggcuggucuugaacuccuggacucaagcaaucugccugccuuggccucccaaagugcugggauuacaggcaugaaccaccgugcccggccaccucccguacuuuaguucaacaagaaauuaagucuuuaaacaugcauugaguaucugcuccaauccagauccguaacugagcucuucuacauaugugaaauauuaauagauagacuuugcccucucaaggagacuacagcucaauaaagagcuaaaauaagccuaaaaacaauaauguuccuguuuuuuauuuccuuuugccuguuucucuugcagcaaauaaaaagaaagagaaagagcggccagagauuucucucccuucagauuuugaacacacaauucaugucgguuuugaugcugucacaggggaguuuacgguaaguccugggucacagaaaggucuuuagucuuuuagaguucuggcugugcacuguuagauucaacccuuucucaucuuccugaugcuucuaucuuugccugagacccugauuacaauuuucucacguucaugagugggacacuuucaucgccaaaauuguauccagagaagccuuuccaucuccguuccuuaaauaauaaaccucuguuaaaugguaggcuugguagcaggcucuguguggggcacugaucaugcaggaacaacauccuauccuaccauccuggagguauagccuggugaaggagcagacaucuuaagaaaugacuaauucaaugagaaagauauuauaaaagaggcuuguguaaacucugagaguauagagagaaaggaaugacuaauaaaugcaucuuuugcugcuagcaagugucaaaguuagcucugauguucuuucaggcuccccugugacugugccuuccuguuagucuugcaugucucucuuacagggaaugccagagcagugggcccgcuugcuucagacaucaaauaucacuaagucggagcagaagaaaaacccgcaggcuguucuggauguguuggaguuuuacaacucgaagaagacauccaacagccagaaauacaugagcuuuacagguaugagaacugcguccagggcagucucagcaagagaugguuuuaaucugggugggaaagcucacaugccuauuagucugggaugagagaagaaaguaguggaaagaguggaaguggcacuuuaacguggaauuuuggaauuugacagccaagaugauggacuuugcaucaaacuugagucuucacucugucacugcacacguuuuuuuaaaaauagcaugguauuauauagagagaacacagguuuuaugcuagaaggucuagauucugaccuuuacuagguucuaccagucacuucauuucuuugcaucucaaaaugggaauuccuaucucaagaggcuguagugagaaaugguugggcgcagugccucacgccuguaaucccaacacuuugggaggccaaggcaagaggaucgcuugaggucaggaguucgagaccagucugggcaacguggcaaaacccugucucuacaaaaaauacaaaaauuagccgggugugguggugcaucccuguggucccagcuacuugggaagcugaggagaagggaucacuugagccugggagguggaguugcagugagcaaggaucacaccacuacacuccagccugggcaacagagugagacccugucucaaaaaaaagagguuauagugagaaauaagugagcugauugaugugagaguucuuuauaaguuguaaaacaucaccauagaaauguagcuaucauugucaucauuauuguuaauauuauuauuaguuauuuaauaacauuaauguaugucuuccucagggaacuaauuuuuauuaguuaaaugaaaaacaggccaauaaagaauaaguuucuuuagauguacccucgguagaagggacuauauuuuucagaguguuuuuaauagcagaauugggauuagaacccaggucuccuaauuccuguaacaucaccuuuugaauuuacuacuugccccuaauaauguuauuuggaggcucuccuuccacagcggaccagcuuuccauuguuuugcaggugugagaaccaaagaaggccuuucuaauaugcuaaauuaauagugggcuaaucuuuuaauuucuaggcucuuuacucauguugccuccuucaaauggcaguauuguugggaaggugagaaccaggaugaacuagugaauuuugaaggaugcuuuccccagccaguaucuggcuuguuucaagggcacagaugguggagaugacaggcugcagcuucacucaugcugcuaugguggugcccaggagagggccaugcaugugcccagcaguauuuccuuccucucgucuggccccgcugagucugucucacuuacuccauugagggacugagucauuucaaggaggaauugggcuggagggcuacugagugggaaaguuuucuagucaggaaauuagaguuuguguuuaaggaacuugucauggaaacaucagguuagaggcugucuuugaaaaccucaguggccaagucuuugcaaggaucuuuccugcauguauguauguaaauaugugcuaguggcauguaaauguguauguaaacagagacauagcccuguggguuugcauauauuuggaauuaaagccuacuuaaguauucaugaacaaagauaaaguccacucagguauucaugaacgaacauauguauaaauauaaacauucagguaauuauguguauguucauucaugcaugcacauaugaauaauauugaguguauauguacagauacguguguacaucuacuuuuguauguauaaauuugugcacauguauauauauguaugcaagaauuuuaauuuucuauaaguugaagacuagggccaacucuaggcaaaauugcauauuugguauagguuuuuuuaagugucauaucucuccuuucccuauuuaccauccucuuauacuauuaguuaugauaauacuaccucauuuguauaugcucacaugugaauuaccucaugugauucuuuugcuggaguccuguggugugaucuuggcucacugcagccugugccuccugggcucaggugauucuccugccucagccuccugaguaacugggacugcaggcaugcaccaccacccccagcuaauuuuuguguuuuaauagagacaguucaccauguuggccaggcuggucuggaacuccugaccucaagugaccugcucaccuuggcuucccacaguucugggauuacuggugugagccacugagccuggcucccucaugugauucuuaugauggccuuagauuggcagggcaaggacuauuaugcucauuuuauauacucaaagaaauuaauuaggcucagagaaguuaaaugacauaccccaagugacucagcugauacaugauggaaauguauuuuaaguugggccuuuaacuccuuugcugccuauaaccgaagcacaaucuuccaugcuaauuuuuuugucaaguauuucuauuuuuucaacacuuaauuuuuuuuuuuuuuuuuuugagauggagucucacucugucacccaggcuggagugcagcagcgcgaucucggcucacugcaacaucugccuccuggguucaugcaauucuucugccucagccucccagguagcugggacuacaggugcaugccacuaugccuggcuaauuuuuguauuuguaguagagaugggguuucaccauauuggccaggcuggucuugaccuauugaccucaugauccacccaccuuggccucccaaagugcugggauuacaggcgugagccaugugccuggcaacacuuaauuuuuuauaccuguuaguagcuaauguaauagggaaaaaguagacuagauugacaacucaacugggucuuagcccuauuuugccacugacuuacgugaccuugaaccaaucuuuuuccuuuucugcaccucauuuugcucaucuguaaaaugaaagugcuggaagcacuuucuguuccaucauucugugcuuuggaauuugauuuugauauauagaaguucaucaccuuuaaagggaguguuuacuuauuuuuauaugacauaacaaguaugccuauuaccaaaauacccaaucuucaaaaauacuagcaguacguaaaguuggggguagugcagugaaggcauaguguuguacucugccaaaguugauagucuauagucuuuuggacaagaaaaaacaaacgaauuauguuuaaaguauauccugaauuuauuucuccagaauacugcuagcuauucuggauuuguuauaagaacaaguugucagagcuugccuuauuuccugcuuuguggguucaugauuugcuguagugucaaagaagcuguaucuagcacuuuuuuacaugauggaauuggaauuguacauucucugggcuugguucuuggugaggaauauauuggauuugguagaauauuuccccuccuuaauucuauuaguggugaauuggcagucaguuuuucuuggacccaggggaauuaaagaacaaaacugaagacauuaccuggucuuuaaacuuacuuucuuccuaagaucuccauugggucucucuuucaaauuuuaugaagucuaagauaccacugauuguaagauguacaauuauuugcauaccaaucaaagaaaauaaagcugccaauuaaaccauaacaugcuuuagaaaguaggacacaccucuguuucagagacguuaaugugaaaaaauguacaucucagaaucagugaaacaugguaauugcuucauugagggagcuugauucuauucuuggaaaacaagacccuaccuuuaauuagacuugacaggaucaauaccucucuuuuccucaaccuuaguccuuuuguccuugugggcaguagauauggauauagaaggauccuuuaugaaagcugaaacuggagacuggccauguuuuggcauggaugacucaggauggugcuauggauucuuuccuuuucuuuuagaaugcagauuuucuuggccauuuaagccugacagugauauagcugaugauguggauacaguucuagcguaguauuuagaaugagaccagaauucaaaucuaauuccucucuuuaaccuguguguacccugggcaaauaacagucaugugccacaacaacagaccgcauauacaaugguggucugauaauuaauauuauaagggaguugaaaaauucuuaucaccuagugauuccugaaguuuaaaauaaauuuagcauagccuaaguguacacugguaauguccuacuuaggccuucacauuuacucaucacucacucacugacucacccagagcaacuuccaguccugcaggcucuauuuaugguaagugcucauauagguguauccuuuuauuuaccuuguaaaccauauuuuuuauuguaccuuuucuauguuuagauauacaaauacuuaccguuguguuacaguugccugcaguaacgugcuguacagguuuguagccuagaaagcaauaggcuauacaauauagcccagguauguagcaggcuauaccgucuagguuuguguaaguacacucuaugauguucacauaaugaccaaauuaccugaugacacauuucacagaacauaccccauugcuaagccacacccaacuguacuuaacaucucugaacuuguuuccaaaucaauaaaaguagauauaauaauaguacucagagccauaaugaggauuaaagaaggugauauguauaaugcauuuagcaugauaucuagccuguaguaccagucauacuauuacuauucucugaaucuggcacgugcuugaccagauagacuucuuuugcuguccagaaaaauuuaacuguaacuguuauugacuaagucccuuguuuuucuuccugugcagauaagucagcugaggauuacaauucuucuaaugccuugguaagucuuuauuuacucuauuuugaugugggcagauguggagguaaggaucaagacagugugguagaggcagagccugagcugggaggcacucauauuagucacuccugcacccuuggccucagaauuccuaucuauccaauaaagaaauuagauauaauaaauaggggguaucccuuucagcuuuaauguccuagaaauucuuucuuugugauaauuuuuuuauuuuuaauuuuuauggauucauaauagucguaaaauguucuagaaauucuaauuuuggaaccagaagguauggcuuuagacucaguuuuaauuuguagcuuugaaccuugggaaagucaguuugccucuuugagcuucaauuucuucaucaauaaaaugaggaugauacacugugcccucaccuggacaugucuucagauaccuacacuuagaagaaaauuuccucuuuggucuauggagucugcaaaaccaagauuaguacuaauuguugaagggagcagauuuuauucauuuaaagucauucauucuguccucugaaguuguaaugaaugcuuugacacucaaauggauguuauagaaaucaugaagaauuggcuggagaguaaacuagaugaucucucugucucucuuaacuuacaaauucuauuucccagggcacuuacagggauaaaaugugauguugauguauuugaaaggguccuauaaauaguaaaaugugaugcauauaagagaauacugcuuuuuuuuuuuuuuuuuuuuaaagagacgagguuuugcucuguugcccaggcgggagugcaauggugugaucauagcucaguguaaacucaaacuccugggcucaaaugaugcuccugccccagcccucugaauagcugggacuacagguauaagccaucacacucagcuuauugagugugaugucaaauugucagacagacaauuuuuuaaaaguuuugguagagaugugguucucauuauguguucucaaacuccuggcuucaagugauccuccugccucgaccucccaaaguguuaggauuacaggugugagccaccacaccugguugcuauuuauuuuuuacaucugauguugucucuuguacauaggugguuaugccauauugauuuacuaaacauuugcaaaagcccuaguuuauccuaugccaaguccggugugaauaagugacauuacagagauggucagacaugucccaguaccuaagaaccucccagucuugagguugaagaccucaagcagccaguucuucaugauuccuguuugugcuugaaggcacagacagacaauuauagugcagcaugcuaaccuucaugaagccaggggcugucucugacuuguuaauuguuauauccuuggcaucuggcaagucuuggcauuugguaaacauuuacugaaugaaagguuggaugugucagagaaagcuuccugaugguaaagucugagcugaaugaguuaguuaucuagagcagggauuaaggggaaaugcggguauuccacacagaaagagaauagcauguaugugggcaaggaaguucaugaggcauacuugcacagggaacugcgaagugguuaugacuagaaugugaauagugaaggaaguagaggugggugaugaggaggauugguaagcaggacagaucauguaggaguuugacuuaucuuaaaggugaugagacgcuuaaagaacuuaagcagaagagugguuaaguucuaacacaauaccgagucaccaucaaaauacuuugaaccaugcuuccaccaguggggacugguuuauucggagucauuuuuacacauauugauuauaaaaaacaauauucacacguucagugccuugcaaccuguuggauccuuucuuacugacucucugaauccucacaggagcuuacugagguaaguuauuauccuuguagaugauaaaacugaaauggaaaagaguuaauggcaauaggcaucugauucccagccuauacugcuuuccccugauuugugcugccuuucaucaaauagaagagaugugauuaaaagaugggaaagaauuugcaaauauaggaucuuugaauaguaaauuauuaaagaagaggcuuuaagccgaauugugcuuuguggcucaaaugucuuuaugcuuuuguaggaagagugauagcuaucaauauugagugccugcgaugcacgguguuaaaaacuuuauguaagcaugauuagccucacaauuacuuauguacaaaguauugucaucuccauuucauaggcagaaaaacagaguuuccugaagacuuauaauuagaaccacauuacaacugagucuugugaaucucaguuuaggguucuuuucacuguggcaaggaacaaaaaaagaugucauugaggucuuauaaaggagacugcaguaaagcuguagcuauguuguuuguuauugaggaggaagagcccugggguucaugccauauggcagggaggauaacaccugcuugguaaaaacuuguacugguuuaguaucuacaauuaaaaccacuaaggcugucaaggacauuguucuccccuaguucagaacauuuguccagcacuagcucagugcucuauauauccuuacuaguuuuacauggaggauauguuuuguauuaugguagcaugucauuauuuuccauguugguuucaaacagaugauuccacuugugaaauaaucaaauauaauugcugccuaagaaauuaagacucagaaagauuaagugacucacucccuacguuugaaugaguuaguaguagaaaccagcacaaaauucugcucuccugagcauucauguauucacucauacccuaaauauugacuuaguaucuucuuuaugccaaaauacaagugacacaaaaaugaacgugcacugucuuaauccuugagaaaaaaaauuaaugacagacuggggagauaagggcugcaagagaggcaugaauaauguacaauaggguuauauuugauggagugauuuauucugcucugaaguacaaggaaguuugcagaguucuugggccuuaaagcuuuguucguuuaacaaacauaaucuuaaagucccuuuuagcucuaaauucuguuaucugugguucacuggucugagaucugacucuaagauuccauggcauuuuaaugccugauucucauuuauaaaaugaauaguuaccacaugauaaguucuuugggugcugagaagucaaggacuaguaagaucucugcucuuggucucacaauuuuugugaugaaucagaacauguaaacaaggauuuauaauauaguguuaaguaagcaucagguaaugauaccaggcagagaaaaaggcagugcuuuccugucugauggacagcaugaacaaaaguuggguuaaggauccaguauguuaggccagagagcuuggacuuugugcuggagcugagggacuauuuuaaguagaagauugauguaguuggauaugugaugucuaaacuaacaucuuagauuucuuuggaaauuggaucaagauaguaaacugaauucaugugcccaucucucuugcuaucucaaauuucuuaauuucagaaaagauuucuuaaaaaccaaauuaaaagcaaugcucugaaacaaaagcaugacauaaaucaacuguugugaggaauucauggaagauagaaagcagaaaaggucagauugaucagagcagaagaagccacagcuuaaaguauguguaagagaagaugccuaggaaaaugaaaguagcuccagagaaaaugggcugaaagaauauauacaagaagcaggaaagagucaugggucaucuucaaggguaaauuaauuuaauucuaccuuugaaacaguaggggcagccuccuccuuacagugaacaaaaggcagcaggugcauuugauucuaagcuaaaaucagcuaauuuucugaagaaaguaaacugccuacuugaggaaagcucuugcuguggguauaggggccucagagagaaacagaggaaccugaguuaacugcaaaauucuaccgcagauauaaagaaaaggaaacaggagaaguagcucugcagugaaggaaaauacauuaaaguuuuccaucccaagaguaaauuucucauacuuuugauaccugggaggaggggaaucucuacuuuuccaugccuacauacccuaaaguaacacuugccaauaaccaucuaucuauaacucacaaacagaucguaucagaccucccauucagaguaggacaguggaaaaacagacuuacauaaguuucagaaaaacuaaugcuaauuacauacacuaaucuauccuucacuuauaaauaugaaugaauagcuaaggaucugcagacauuugagagaaacacaacauuaaagagaggaaccaagauaaggaaggaaaauuagccccagaggaaguagauaagucaggaaauaacuuuuaaaaaaaucuaguauuuucagagaggaucuguagauguuucaucuacaaaaacacccugcuauuagagcaaucagaggaggaaagaauguucuuaguauuaaaaacauaagacauaaauuuauggcugggugcggugcucacaccuguaaucccagcacuuugggaggcugaggcggguggaucaccugaggucaggaguucgagaccagccuggccaacauggugaaaccccaucucuacuaaaaauauaaaaauuagcuagguguggggguauaugccuguaaucccagcuacuugggaggcugaggcaggauaaucacuugaaccugggaggcagagguugcagugagcugagauuaugccacugcccuccaaccugggugacgaagcgagacuccaucucaaaaaaaaaaaaaaaaaaaaagaaauguauaagguuuaaacaacaaaugcauauaagugaauagggaauuaauaauauaaaauauaaaagauagaaaauuugagaauaaaugacaauagaggguuggucagggggauucaagcauaagcagagaacagaggcaguagaguaaaaaaauaaagaaaaaauagaagaaaaaauucccagcugaagaaaggcaugagucuucagaugaagggccuguuaaugaccaagucagauaauugaaaagagauccaagaauaaagagaaaaaucuuaaaagccuccaaagagaauauaguucauguccaaaggaacauuagcaucagacaucucauuagaaauaguggaaaaaacagcaguaucuucagagggaugaggcaaauuguuuagaaccaagaauuuuguaccuaaucaaacuaacauuuaacuauaaggugucaauauaaagguauguuuggacaugugaagaucaagguuuaccacccacagaucacuucugaaaggcuaaauaccaaauaguaacaucaauuaccucugggguuaauggugauuaagaauacucacuuaaaaguauuuuuaccggccaggcgcgguggcucacgccuguaauacaaaaaaauuagcugggcuugguguugugugccuguaaucccagcuacucaggaggccgaggcaaaagaaucacuugaaccagggaggcagacguugcagugagccgagaucaugccacugcacuccagccugggccgcagagugggacuguaucucaaaaaaaaaauaaauaaaaaauauuauuauccagguauuugauuaaaaagucaaguaggacuuguaauaaguagcucucauucugggaucuuccuucaccauugucuuggcaaucccuuugcauuuuuguguugguauuccuauuuuuucuaugccacgccuacauuauuuuuuguuuacuuuugaauuugguggagcauauccucuaguagcuuuaagaaaguaaauggaaaguaaacauuuaauaauaccuuucaggucucaaaauggggcguucucuaugcuacccucacguuuaauuaauacuucagcugcuuauagaauugcagguuacacauauuuuuucaucagaauuuggaaaacauuacacuuuugucaucuagcuuucgguacugcuaaguccaaagccauuuuauuuauccuucucuguaugugaccaaucuuuuuuucuacucagaaagcuuguagggucgucuuugucaccauugcuuagaaauuucacaauuauauuccuauuuacaucuauuuauacugcagggagcuuugugaacucuuucggccuggaaacucugcccucaguucuaggaaauugcuugaauuauuuuguugaugauuucuuccccuugcuucuuuuguuaucucuucauggaaccuccaucauuuagaucuuggaccuuuuuguuuguuuguuuguuuugagacggagucucguucugucaccaggcuggagugcagcggcgugaucucagcucacugcaaccuccgcuucccgguucaagcaauuccucugccucagcuucccuaguagcugggacugcaggcacgcaccaccaugccaggcuaauuuuuuuuuguauauuaguagagacgggguuucaccauguuggccaggaugauuucgaucuccugagguugugaucugcccgccucagccucccagagugcugggauuacaggcgugagccaccacgcccagcccuagaucuuggaccucuuaaacuaauucuccauuuuuuaaaggauuuucucucuuuuccuugcguugguuuuuauucugaagaauuaggagacuuccucaacuucaucuuucagucaauuuaauuuuucauuucuauucucauguuuaauuuucaaucacuuuuuuauuuuaagaaaauauauagcauucuuguuuccagaauugauauauuuucuuaucucuaaggaagguaaugauaggcuuucuuuggauguuuuuuccuuccuguuuagucuguuuuuuccagguggcccuuugccucauuuguuuugguuucacacuuuuauguuagagguuuuccuugcguauucagaggucugcucauauuuaugauugggguaguaaaaagcucacuagaauuuuaagcucauuggugguggacaauucaauacuuuuaauaaauuuauagaguugugccgccaucaccugaaaaaguucccuagugcccuuuuaccauucauucaaacucccaugcucagcccuaggaaaccacugaucugcuucuggucuuuauaaauuugucuuucuagacauuuuauauaaauaaacucauacaacauguagucuuuuguguuuugcuucuuuuacuuagcuuugaacuuuauguuguaacauguaucaguaugguguauuucauuucuuguuauguccaaaucauauucccuuguauggauacacuacauuuuauuuaucuucucaucaguugauguguacuuggguuguuccuacuuuuuggucauuaugaauaaugcaguuaugaacauucacauacaagguuuuguguggucucauuucuucagaguauauaccaaggaauggaacugcuggggcaugugguuaacuuuauguuuaaccuuuugaggaacugccagacuuuuuuccacagugcuggcaccauuuuauauucccacuagcaauuaaugaggguuccaguuucugccuaucuuugccugucccuguuguugucugucuuuuuauuguagucauuuuagugggugugaagugguaucucauugugauuuuauuggauuuccuaauggauaaugauguugagcaucuuuucaugugcuuauuggccauuuauauacaaucuacuucacauuaacaguaacugaaauccaguaaaauauguaaacuuugccccaguauauuuucauucccugccccuucuuuauucuauuacugccauucuuucauauacaugaauguguaugaaucuguauguguauaugugugugugcacguguacguacuguauauauuggaagccuaacaauugcuuuauacaauuauguuuuuuaaagaagucaauggaagaaauaacaaaaaguauuuuuuuagagucuuccauguuaaucuacauauuuaccguuuccucugcucuccauuauuacuuguggauuugaguuacuauuugguauuacuucguuucagucugaugggcuucuuugaguauuucuuguaaaucaggucugauagcaauaaauucucuuucucuuuguuaaucuggaaugucuuuauuucgucuucauuuugaaggauaguuuuguuggguauagauuucuugacuggcaauuuuuaaaaauuucagcuguuugaauaugucaucccacugccuuuugaccuccauuuuuucugaucagaaguuuuuguuuugauuuuuaaaauacucugaucagcagucagcuguuaauuauacugacuggccuuguacaugaugucaguuuucucugguugcuuuaaauauuuucauguugacuuuagcuuuuggcagucugacugugcguuuagguguuauuuuuuuuuuuuucuuuuucuuuuucugagacggagucucgcucugucgcccaggcuggaguacaguggugcgaucuugguucacugcaaccucugccuccugaguucaggcgauucucuugccucagccgcccgaguagcugggauuucaggugcaugccaccacagccagcuaauuuuuguauuuuuaguagagaugggguuucaccauauuggccaggcuggucccaaacuccugaccucaagugauccgccugccucagccucccaaagugcugggauuacaggcaugagccaccgcucccagccaggugugaaucuuuuuguguuuuccuacuuugggauuuaucgagguucuuggaucuguaguuuaauguuuuuaucaaauuuaggaaguuuuauccuuauuucuuuaaauauuuuuucugugucuuuuuuuuuucuuccucagagacucucauuauauguaugcuggugugcuuuauguuguuccacagcucuuugaugcucuguuuuuuucuuuaauuuuuuuuuaccucaguucuuuauauuagauaauggcuauggguccauuuucuuuuuucuuuuuucuuuuuuuuuuuuuuuuugagacagagucuugcucugucacccaggcuggagugcaguggcacaaucucagcucacugcaaccucugccuccugaguucaagcgauucuccugccucacccucuugaguaacugggacaacaggcacgugccaccgcacccagcuaauuuuauuuuuauauuuuuaguagagaugggguuucaccauauuggccaggcuggucucgaacuccugacuucgugauccgcccaccuuggccucccaaagugcuaggauuacaggugugagccaccgcuccccaccuccauuuucaaauucauugauucuucugccauauagaaucccuuguuuagcucucuggugaguuuuucauuuguuauuuuauucuucaacuguaguauuuccauuugguucauuugaaguaaugucuacugagaauuucacucguuguuaggcuuucuuaaaacucuuuaaacaugguuucuuuuaguuuuuugaauguauuuauaucugaguugaaaucuuuauucucuaaagccaacauuuggggacauucagaguuccuguugauugcuuuuuucccccuaggucgugcuuuccuguuucuuuccaugucuuauaauuucuuguugaaaauucaauauuuagauaauauucuguaccaauucuggauacugauagcccccucccccaaaaaaguugcuagcuuuuuuauuuguugguuuuguauuaucuuacuagggauaaaucugugacauagucucugucuguggucauugaugucauugcucaguguuuguuguuuuuuuguuuguuuuuguggugguuuuguuguuguuguuuuguuuuguugcagccuggcuuuccagagauugcuucuauguuugcuuagcugaaucuuuagccaaugauuugacacagauggugcucaaaaacuucaacucuguaaggcuucuuuccucuguugauggaucuauguguagguaggggaguacauuuacuguuuaggccuuuuucaagucuguuccagcuuuuacuuuauguugggcucuuuugaaucuuuuauguguaugcacauagccaggcaugugugacuagcaugaggcuuuucuagcgucugcugugccugugaacagccuuagccagaaauuaguuugcccuacucaggacuguagcuucaggcuaauagagcugaauaguugacccucugccgcuaccaccuuuggaagucacuuccaaugacagugccacugggccugggcauugcccauaucuccagcacaaagugaauguucuuggacuaugcaguuauacccuggucugcccugauggaacccccacacuucuggaguuggggcucggauggaugggaacaucccuugcccagaaugccagagauucuauuuuuaacccaaaguucaggaguuuaucagucauaagcacuucucaauauuuuguugaccuuuguuggauuuccagggaacugaaaugguuuuugucaauuuuguccagauuuauaguugcuuguuggggagaggauuugccagucuucucucucugccauaccuggcagucugcuuauaauauuuuuaaaaagauaaaggacagauuauucugggcuguaauaaaagaugcauuagagaaggcaagacuggggucccaaaaagcaaugaggaagacuuguaaaggauugguaaagguaagagaauauggugccuaagugaaagcagugguuaugaggcuaaggaacagaagguuuaauggaaagaacuuuuugaauccugauacgguuuauuuuccuuuuuaucauacugcuucucauggagggaguggggaaaggauuuuauguuuagucagguaucaauccuuggucucccuaucccaaggaaaaguaucaaguugaucuuguagggugagcauagucuuccuacugggacagaaugcuuagugagcacacccuggcuaccaucucaucuccucucuggguuggguugucacauuucaguggccauuuucaaucuguuugcauuauaucauuccgagcugcccagagccuugaguuuugauuccaguaccuagucauuuucuucuucacuauuuuccuugaccuuaaaacuucuauuugaucaggcagcagccacccaaaauuuccuuaggauauagucuuauccuugacugucuuagcugaaccuuggagccuucccaaggugguuuuuaacuggccuguuaaaaaccugaccuguugagagcugguuuugaucauguugaagauauaauaaagcaaacaagcuuuuauaggauaugaaaaaaaccaucagacccacuaauuuuuacuguagaauguaggcuaaugguuuaagucaguuaauaguacaguucuucgccauuuuggcaucuuccuucacaauccuguucccauuaucuccacuuuuucaauuacugagugccccaucauuuagauauuucauuccaguuuauacuacuauuggauaagacauauucauuuagcaauccuauacugagcacuuucuaaucaucuggccaacaucauuaucauagcuaauauuugaguauuuuaaaaaugaauuuuacauagcuuuaucucauuuaaccucacacuaacacuaaaguaaguacuaauacaggcuguauuucauaacugaggaaagugagagaauuaauaucuuacgcagaacucauaguuuguaagugauaaaggcgugauuugauccuaagcuaguugauuccaaaauguugguuuuuaaguauuauucuauccugccugauaaaacagacaguucaacauaaaaccuuaauuggagagaauuauaaaguagccagugauauuguguuaguaauucuaaugaagaagaaaaagaaaaaagaaaaucaaacuaaaaauugguaucaguggaaaaguacauaaaguauauuccaacagaggacguuugagaucugucacuagaagaacaauugaggaaguugcaagaagaacgaacuuacaaaguaguuacaaagaaguuuccaguguauuuauuccuuauugucaacugguuauaugcuaagaauauacaccuuuaagcaaaugcccaaauugcaaggauauaauccaggguacuauucauacauuucuguaauaaagaaaacccaaaccgguggauaaauuuauauagaaacaccuuuaaaauauuguugaacaauugaugcuaucugaaguuaguaaccuuaaauuaguaacauuaguaaucuuaaauuaguaacauuuguguucuacaguguuuugguucuaguaucuuguuuucaaaaaaguagacaguaucacagauuauauuuaauauucuugccuauuugcaguagaaaacuugccugugaugaauauuuuuguauuuaaggcaguggagaugguauauuaguauauauguaugaacauaugaugaauaaaagugcuauucauacaacauuucaggaaguaauaaauuugguacucuuucuaaaagcuuugaguacucuaucagacuauacuuuaaaagaacugagaaccaagaacccuugaguuuguuagaguuauaggugcaaauuuucuuuggugcuuuucacuauuuuguuauaaaauaggaauuuguauuuuauugccauugauuaaaaaaaccuuuucucuaauuugugagaaacaucuuaauaaagcacuuuaaaaagaaaaaaaauguauagauuacaucacuguucuacucacaguccuccagugguuucuuauucuaggucuaaacuccagaguuuuuauuaccgccucucugacuuuacauaaucugauucccagcuaacuuucugaccuuguuucuuuccuuacuuccccuuacuaacuuuguuacacccacauagguagaauuccuaaggguugugggaacauaccaagcauguuucugucucagagucuuuaacuucuuccaucugcuaggaauauccuuuucucagagagccccguggcuugcucccuuaauucauucaggucacuguuauaugacauuuuauuagagaggcuugccugugccuaucguaucuaaaauaguaucuccccaccuugucaaccaaucucugcuccuauauggagcagacacuuuggugauuguuuuuuacucuauucucuucuagaauguaagucauagaaccagggacuuuaucuguuuuauucuuuauguagccccagagccuagaauggagucuggcacacagugaauggauggauggauggauggcuauauggguagauggaugaugaauuggaaugucuggcuuuuguuugaaacagagauuugugguuauuagacauaaugauaauuuaauugauuccuuacaucucucuagcucuuuaccauuuucagugauuuuaugcucacuuugccucauuuaauccauucaguggccuucugagguaggcagagagcuguagucauuaccccuguuuuauaaauuaaaaaugugagacuuaacuuagacccuugcccaaggacacagggcuaagaaguaaaaaucuggguaauaaccuagaccuuucucucucugacagauguuaauaucacugcccaaagcuaucaccuauggaaaacagaaucuuuuacugaggaagguguugaaauccccuucucuacaguuuuauaaagcaaacaaaccuaguguuuacaguauacaucaggggagcuccagggcuaccugaugaugaagagccuugcugagucaacuguauucccacauuagguuuuuaguuaaauuuuguugaguggaauaguggggagaaaauaaauuagagcagaaaaauaucgaaauacauauuuugacagggaaaggaccucuauugaguuuuggaacuuaaagcgauuuaaggucaucuuucaaauuauaacacuccucuuccuucacauuccucaggugauuaaacuucaaaccaagaggacagauuuauugccuauggucaccacaacugcuuauauaugcccggcacugucaguuuuuaacuuaugcuuugugcuggaggcccuguuaaaaucuaugccaguuuuucuuacuuuaguaugucaaaugugguaaaagacagucucccacagucaguaccucuaguauauuauuccuuaguucuuccauuuaucccguuauucugacucuggaccuuccucuuaggaggcuccaggugucaggcaggaggggcucucauccugucuaucuccuauaccagauggucacuacuuuaggacauggaccaucuuuuucaucuuuguacauuuaugucaacaguaccuaucacagucuuacugagcacaaaguaggugcucugaaaauaccugaaacuguugaauuauaucaguauauauuaaaagauccccauugccucuccaguucuuugcugaucaaaugauagaaucauuugguaucuaucaaaaaucucauauuuuggaggcauuuugucucuuaauucuguguaauaaacaguaaugguaugcuauuuuugccuggaccugcccuaaaaccugccacucuuggcccagcucucuuauaguuugcauggggaaaucagguugucacagauuguaagcagaucuaauuagugguaaguuccauuccaggguagggcagaaacuuagggaaauaguauccagucuggggagaaauucauuguucucuuuagauaacaugauccugaugcugauguucuuuaucuucagguugaggugaggaccccugguaauguaauggguucaggagauuuuugcaaagagaggaaaagggcagggcaaaagccuguuuagacugccauuuaccauaucaggagagaguaagaaauuauagugaugaauuuugaaaaauuagaaacuuuugaucucuucccuacauuucauacuuuauuuccuguucaguguggagagaaaaauucauagaauaagaagguacugugagcuugucuucagggguuggguugggggagaggcagguagaaaagcuguaagcuagcuucccauucacagcuaggcuuugagugggagaaggaagccccaagggacugaguggauagugauggcuaaaagaagagggagaaacagauugagcuucugagacuagcuacacaaaggugagagcuuggaggcuaauguguauuucagaagggauaucaggaugggguuucucgugggagguuuggugauccugauaguuaaguuccauggcagcuggaccagaugcaucuugcuuuucuucuuugcacagaaugugaaggcugugucugagacuccugcagugccaccaguuucagaagaugaggaugaugaugaugaugaugcuaccccaccaccagugauugcuccacgcccagagcacacaaaaucugugagucuuuggggaccuggccaguuuugugauuuauuagaguaaguggggagagggaggaguuggugcugauaccuagaaguuuaauauucugguaggcguccuuagauuuuggagcuggugaaaucacugaacuaccuugacuaaagguacuuucuguaugauuaaagacaaaaaaucauguguuuauuuaucauugguuugcagauagucccaaaguguccuagguaauugauguuuauaccaguccagucucgguucuccacagauaggacaggaagauauauaggauugaugcuacuuagugcaggacuaacauaaauuauuccagucuccagggaagcaacaaauugucuugcuacagaucuuuucuucucuguuaaaugugcaguguucagccucuuagagcauuauugauaauauugaaagacccaagagaauauauaaauacauuagugcuauuaauaugcugggcaucaggagugcauuuugaugccggauguuggcagugauuucuauuuaacuuccuuugagguuccugcaucucugagaauagccauggucccucuaaccuugcuuugaaacaucuagucccugugccuuuuacuuaauuuggcaucacugagcacugaccuaccaucagaugauacucuacuaguguuucuuuguuuaggucuuuuacuaagaugagagcuccauaaugaaggaaccaucuagcacuucugugaucaugaaagaaaaaaaaaagggcuaccucuggaauacagcauucagggagguguucaaacagaaauugguugaaugacuauuggagaugcuguggaggaaauucaaaggaauuauaugaccuauuaggaugagaacuuacaaacagaaucuguggaaucaucucuguaggucacaaaguuaccucaagggaaaaugcgcuucaaaauuggagagucguuaacacugauaugguuuuuuuugguuuguagacauguucauuuaaaacauuuuuuuccccacuaaaccaugaacaccucaaaaaguagaggaaauccauauguauguauuucuagugcuuaacauaguucuuggcaccugcagagguggguaaauaucagaggacaguaaauauugaauuaauuaauuaauugaucuucauagcauuucuuucuaaaaagguauugguaauuccuaauuuauagaagaagcagcugagauuuggagaggugaauugaucugcccagucucuuaguaaacaaaagagccaggauuugaaagcagguaauuaaccccaacuccagguuguuuuccaccauagcacagugguauuuuuguguguacaaaccugugcuaggagccagagaaggagacuauuaaagaaggaaaaggcaagguuucugucuucaaagagauauaucaggacaggcaaaagaggacaaggcauggaaguacagguuuaggugccugggauauaguuugucuacagguacaagaauagaaaauugagaaaucauuaugcuagaguaguaaucaggaaggaagccauugccucugaucucagcgucuuggcuuauugcuguucccacuacuggaauguucucucccauuuccaccuauuaaaagccuguccagucaaaagguagcauggucaagcaguccaaggugcaggauguaguuggcuuuagucucuguggagccauggguuugagucccacuguugccaauggcuuugcaucaucgcagauaaaugaucaucauagauaaaugauccucuaucuuuguagaaaccuauccguccuucaggauccaguugcaggauccuguuuguuuauuuauuccaucaaauauuuaccugaaugcuugcuuucuuuuaguaagugguuagauggaggaacucacggaugaaugacccacauucccuguccuuauacuguuuauggacuaugcaaaagauaauugugauauuuuuaugauaaaaucuguuaaauaccuugaagcaucuccuggggaaaggaaguauaauuuaugaucacuucugaaccucaguaguauauagcuugcuuauuucuuuauaacauguaucacuuucugccuuguaguuaugauuuucucaccuccuuuauaagaaugagagguuggggcagcauuuuguacagggugaggcaacaaauagauucucaguaaauguuuguuauguaaaugaaugaauaggacauuuaauauuuuuaaaagguaaaauuugagugcuuaaugucugcuggggaugagucugauuaccucacauauuaaucaguuuacuccuacagcaaccccaaaagauaguuaucauuauuaucaccauuuuauagaugaggaaacugaaacacagagaaguuaaguaaccugcccaaagucaugcagaagguaagaauaauaagaguugggauuuaaguucaggcagucagguuccagaguccauguucuaaaucaucacacucuacuaccucuugaugaagaacaaaaguaguuccuucccugcaaggguucaggauguaaggagggaguaacucaauagaaguugguguuguacuaguaaugcaaagugcuauuugcauuacuacaggauaugucuuuuaacuuggggaagcauaaaauauuacaaaugaaggggauucuuaccuaauagaauugucuucaacuaauuucuuuuguuacagaauauuucuuuuagcuuggggaauacaggauauuucuuuuagcuuggggaagcauaaaauauuacagaugaaggggauucuuaucuaauagaauugucuuuaacuaauuucuuuugauaguugucuagccucuauugaauaucuuuagugcugagacucucacuucuuuuguuuacagugagaguaaggaaggccauuuuacccagaaugggugggccugggcacagaggaggaguaauauagauuuugacauaagagaaaggaugaguuuauugggguuugcucuguggauguucuaaccucacaucuaggagagguuccccuaugcuaacaaaggcuggucuugccaaaauuuugcacuaauaaugcagguauacacacggucugugauugaaccacuuccugucacuccaacucgggacguggcuacaucucccauuucaccuacugaaaauaacaccacuccaccagaugcuuugacccggaauacugagaagcagaagaagaagccuaaaaugucugaugaggagaucuuggagaaauuacguaaggaauuuguagcuuucugaaccuuucuucguuuuaugacuggucaagcacagagauuugcuggucguaggcuugguccaugcagcuggcuggccaugcuugguaccuuaggcacagacugcuucuccucacccugccccugaaccucccuucccugucucacagcccugguuggauacuauguuaggauggagauguggugagaguguggauagcuuacuuugagggcagggcaucccucaccccuaggcauguauuauagcgaagacaaauaguuuuucucuaaugaauagccuagaaugccauguugagaaagacugaggaccuaguggaaaagggcacugugaucaauuauugauguuuugccauugaccuaggagaagacgcaucugccaucuugguuguaggaaaagagggaagggaaguuaacauuuuaugaaccuauaguauguaucaaaugacaagcaaaauauuuucuugauuuuuuuuaaauuuaauucucuuauuaacccugugaagaaaagcauuaugauccuaauuuuugcaaugaagauaucugaggcucagggaggcuaaauauccugcccaaaaucacgcagcuaaaaagugacauggcugagguuagaacacaguuuuuguuccuguaaguagagcauacugccucuugcugucaaguggaaacuuccauuuuacuuucuuuagcugccagaaauggggguauguuaggguagcuuauuucuguguuucaguaaacugcagaagaauucauguuagaaggaagaacuagguugaucugugggcuuggaagaaucauuugacaagggcuuuaauuuauucacuguaucuacuuacuuccaaaaaggauuugaugugaccgauuuggcgacgucugcaaacuggcauugcuuugugguucucuaguucuuccugauuaauuccuauaugacuuuaaaacaaauuuucacuguuuuaaaaauugcccuuuucuggaucccucauaaaaugacaaaguaagaaaagccacuuaccuagucaucuguuuacuccuguauguagucuuguucucuaaaccagaguuuuuuguuuuguuuuguuuuaacaauaacacuuagaauuaugacuuagaauuaagacuuggccugggaguuaggacacuugaguugaagcuucugcucagccacugacuugugucuuaggcaauuuucuacuguucucuaaaccucauuuuucucauuuuuaaaauagggauguuaauacuugucucauuugcaaaucaaaugagguaauauaugugaaaaguaccaauuccuaguaauuggguauuaauggagagcacauuggaccgggagacuaaaaaugaaacuccuaaucuuagcucugacaccaauuugcugugugaccuugggggggaaguaucuucuucccuucugugggccucaauuucuccaucucuaaaauacaaguuauaaaacccaguggaaaaccucuaugucguugcacuugaaauauucuuuguuguaaaccucuucucuacuuuaucucucuggcuuuuacuuaaaguggaaaucaguccauauaucaccuuucugaaguuuuuccagucuuuuuuuugugugugugugccucuuucuguaccccuuuggcuuuuaucacagcaauuauuauauuuucauggaacuuuaugcuuacuuaucugucuccuccaugaaauugaccuucuugagagcagggacugccuugacugugucauaucucuucauuccuaacacaacauauggcuuggugcguauuaaaugaguaaauauuuacugaauggauuaauuaaaaaaugaaugacuuuuaggaguuuagaaauggaauagcuuacuaugaaucaaagcagucaaggugaugaaacuuuugguugagacuuaugggggaaaagcugagggccuguuuagcaugcuuuuuggcuauuggagguaguucuuuaacccuugccagcuacagggguuggggaaauguggaaccuuuuuuguaucuugauuugggaaaaaaugauucauggucucuguuucuuucaaaggaagcauagugagugugggcgauccuaagaagaaauauacacgguuugagaagauuggacaaggguuaguaggggcauuuucuuucccuggagaaaugacuuuaaagugugugugccggcauauaugauuuugcuuuuuuuuugccucucauaaaccuuguucuucuuucuccacuuuaccccucacccaucuggaguuguuaugugagacugacuugagauuuggcagaauuaugcuuaauaugagagagaugccauuagcugaccauguugcuaaaaauaccccugcagugacagugagagaacgguuuuuuuucuuagcacaaaaccaacuucccaaauuacaacucugcuuuuccggaugaacccuguuuguccuagugcugagauccaccagcacuaauauaaaauggaagacccaaaacuauaaauccuucuacuacugugauaggaccuguuuuucuagguagaugccagaauuuauccuucuugcauucauccuucucuguaucuuauaugcugcccucaguguaaugaauucagcaagucuuaacugaguuccuauugugugcaaggcacuaugaauucagagacaaucucugcuuccaaggaccucaagucaacagaaaaagauaggcaaacaauuguauagucauauguugccuaacaaaggggauauguucugagaagugcauccuuaggcaguuuugucaugugagcgucauagagugaacacaaaacuaaauaguauagccuacuacacaccuaggcuauaugguauagccucuugcuccuaggcuacaagccuguacagcauguuacuguacugaauacuguaggcaauuauaacacaauggugguuguauaucuaaacauagaaaagauacgguaaaaauacagcauaaaagauaaaaaaaagguauauuuauguagggcacuuaacauggauggagcuuguaggacuggaaguugcucuaggugagucagugaguggugagugaaugucgaggccuaggacauuacuguguacgcuacuguagacuuuauaaacccuguacacuuagacuguacauuuauuaaaaaacaaaguaauugugcuaugacguuacaacugcuacaguguuacugggugauaggaauuuuucagcuccaucauaaucuuaugggaccaccaucauaugcgguccaucguugacugaaacgucguuaugugacacaugacugucuuguguuuuuaaaguguuuggcuguuauuuugagugaaagaagcuagauaugaaaaagcagauacugucucauuugauuuauaugaaauucaagaacaggcaaaaguaauauaugauaauagaagucagaauagugguuauuucugggaggaggauguagagugggaauaggcaugaaggaaucuucggggguaaugacuguagugucuuuugaaaguggccauuauuuugagugaaaaaagccagauauaaaagagcagauacuaugucauucuauuuauaugaaauucaagaacaagcaaaacuaauguaugauaauagaagucagaacaguguaguuauuucugggaggaggauguugaguaggaauagucaugagggaaucuuugggggugaucuugguagugaacacauggguguguacauauauaaaaaucaaguuguacacuuaagauuugugcaaauuaaguuauaccucucuauaaaaaaaaaaugagauuucuaaagacccaccaaaagagauaaaauuaaaaagaaacugaaaaagaaaaaugucuggcucucaguguuaguggaaugaaagcauuguugcuaaugaugucauugaaauuuucuuuuuuuuuuuaaauuauacacccaagaauuucugaaaauaaaagauugcauaauauagggagguucuguuuauacagcauucuacaguucacaucuguuauuugcauuuauuguuuaauccucagaacaacucugggcuugaguggaucuuauuuuuuucuaguuccaguguuuuucaaaauagacauacuuuugugaguuugaacugguguaagguauuuaacaccuugagaaaaaaauuauuuugcuuaccucagaguaaugugggaugguauuuccuuuagguagugaaauugagauauuaagaauguagcagaaauguacauggacaagcauaggcaagucagguuucuucucuggacuggaguuucuuccuguaaauuuaaggaagacagauugugaauugaggaccuuuuaccuccagaacuuuugugacuuuuuuuuuuuuuuuaguuacugauauaugagaccuauaaauaggcaacaucugcauaauguucuuuccuugcuuacuugacaggucuguuagugcuaagggaagaaugaaauauuaauuaagcacuuaugcugauguuuccacauugcauaauuuuuaaaauauaacugucacaccaauaugaugaauugguaauauuguaauuuuugcuugcuuuuauuucuccuuuaagaccugaagauuauuauucuuuuggacuuggaauucauaugucuaauuauaugucuauucaaguuagaaauagguauuaagcagugggccuaaguagcuuucuacaacuuuguaaucauggagacaguccccugaggcuugggcauguuuguccuuuaagaauauuacaucuaguaggaucaggaagggauggggauaggaagacagauaccagcuuuauaacagaagauagcuaggggcaggauaaucaggcagugaagaaauaacugccuguacaagucauccaauccuuauuuuauagccaguauguuauagucacaguuucuaggcauguagcuagggucccaacuaaagagugaugauuagggagcuggugaccauaguuucuagcugcaaggcaugcuuacacaugacuuuucccccuggauugaccuggaauuauaaucucagggcuugccuaggaagcagucuuguaauagagcagaauuuuaauuuucuucaaauugcaucauauguaccuaacauauggcauguacagguacaaauauguguuacaaauuacuuaccuacaaauacacaggguuuauggucuuaagcauaaaaugaggguuuuaguuauuuugaauggauuuaguuauuuugaaugaauuauuacuuuccuagcauuauuucugcauuucuuccccccuucucugucuguauauaugaauguguauauacuuaacauacauauguguacacacaugugucaaguggggucauucuuaccuuggggguggggcagagguacccucagaucuucugggagcauguauguuugaaagaguauauuuaauaucauuuuauguuugaaaaaugaaaacuaaaaaccacuuuuauaauacaaacuacagaaaacaaaauucacauauccuguugauggaauaaaugauugaaaaccauuauuuuauuuuaaaggauccaaguguauccuguaauaucagagugggaaggguacuuugagauuagauuauucagugugguucuucaaguuuuuauaguuuuuuacuauuuauaguuuuuuaaaguaaauuuucacuaaagauagcauacauaaguguacaacucaaugaauuuucaaaaagugaacacgccuauguaaccaguacccagauuaagaaaaagaacauuaccgacacccuggaaguccauauuccuuuuugauaaauaaauaagauaugcuggcccacccccaaacacauucugaaauucuccgcagggccccuuucuccccaccugucacccccccaguugaaaaucauagaucuaaucuuaucccuuuuauagaugaagaguuugaagccacaagaaauuagagccacgugccaagggugauggaggagaggagagaagcaagcaggaacaggaaauuaauauauauugagcaucuguuauaugauaugcaguuggcuaaguacuuuacaugaacuaaucaauuuaaauuaucuuguauucucuuauguccacuuuacaaaugaggaaagugaagcucaaagaaguuaaauaacuuucuuaagauccuaccuaguagguacuagguagaaguaccagguuggaauucaggucuccuggccacuagagccuacauucucuguacuaccucuuauagcuucuuaaaugugagaauggaugcugcagggagaggauuauuuuuacugcucuuguuuuugacacucacagauuguguguagaacugcauuugacaaauaucacuuuauugaacacuguguuuuuuucccucuuucuccgccaccuuacuguucagugcuucaggcaccguguacacagcaauggauguggccacaggacaggaggugaguauccaccacccacuguugcuccuuuaguucuguuucuuuuuauuugggauuaauuuuuagcccuuguuaggucaacaggaacaguucuagguuuuuuuuuuuuuuuuugggauggggucucacucugucauccaggcuggagugcaguggcgugaucucugcucacugcagccuccgccuacuagguucaagcaguucuccagccucagccuccugaguagcugggauuauaggaaccugccaccaugccuggcuaauuuuuguauuuuuuaguagaggugagguuucaccauguuagccaggcugcucucgaacuccugaccuuaggugaucuuccugccucggccucccaaagggcuaggauuacaggcaugagccagugugcccagcuggaacauaucuaguuucuuacuguagcauacaaaagccaaauagcaggauaacauuaugaaacuuaagguuuggacuaaggugaaauaguuagauggagggaaguggauggauuugagagauaacuuagcagguagguucaacaggauuagaugauugaaugugaacauuacuuacaagugggugauauuauucaaggagaaaggaaaaagaaauuggauacugccugauugccaaguggauaguugcuuacauaacuuuggggcuugggggagaaaucugaucuacaggagauuuaaaccaugucucuugacuccuaaucuacuggugcuaccuuuacuuuccacugaacagugaaauccucauuuauuuggaggcagcuuuuugucccucucauuucauuaagccaugagaacuauagcuaaagccugcugacccaaggucuuauauucaguagaagaaagauaugaagggaauauagaguacuugagguuuccuugcauuuuaauauuugguugcagaguaggagugucagccaaugaacuguggauggcagcugccccagagaaguucuuacuucaaagaguaccaguacacaauaauugagagaggcaccuccucuuccaaugaaaauagaguugggcuucugugagggaggcugcuagaaacgugcuucuauauuuuuggugguugaaaccacguggcacccuggagaagucaugguuaauagggguagcacauaucucacuaggcucuugugaguuuuuacaaguguuaaagccaaauauuaaggcuccaccuaggguaagccaaguuuuaaaaaucauuauuaugguuaaggauuuauucauuauucuuugaugugagaauccaaagaccuagaugcuuauaagccuuuagcuacuuauauaaccuugggcaagucauuugaccucucugagccugaauuuuauauauuuauaaaaugugcauaauaaaauguccacgaaaguguugaaagaauucaguaaagcaauacaugugaaaaugcauuauaaacuuuaugaacuacauauucauauuuauucauuuuuacucauauacauguguauguauuccacaaagcauuugcuuuaugccacaccuuaugcuaagaauucugugaaaguucacagacauuaaaaucauauguaaauguaagagaccauaauuuccuuuguguacauauaaaagccuuguaauauugacacgaaucugccuuaaaguaaaaauaauggugaggaaggaaggauaauauuaucauggcauuuuaaugauggugaauaugaugcagagauuaaaauaaagaaggcuauaccaauccugaaaagaacucuaugagguagguaauauuauuucuucuuuacugcugaggaauuugaggcucaggguguauagauaacuuuuuuuugcaaaguuguacugucagcaauuaccagggacuggauuagaaucuuugacuccuaauccuguguguuuugggccgcaagagcacaacagagcugagguuagauacuagagucccuucuggccucucaggccucacaguccuugaugggaggcagguaggugaugauggugguuccuggaagcccuggaggcuggcugugugagaagcuggccagaggaaagagaaauuuaaauucauuguaugcgugucuugugguuacaaaacuaugaauggaagggaguccaucaggguggcuaaugcaguguggucaggaaggcuucauuuccugccccagggagaauaaaucuuuauuggaguccaugggaugcucucagucuuugugaguucuugcuuauuggggguuauccagcugagaagggcagaccuagugucucacauauaggaagaauguuagugcugggaagucuuccaguuaacauauccaacaauuauuuuucaaguguguuuuuagagagaauguguacaauagaaagaacagacuggaagaggcuuuggagucacauggaccuguaggcauugauuaugaccuuagaauuuucuuaugagucuuagccucaauuuucuuacugaaaaugcagaucaugauucuuacuuuguaggguugugugugguuagguuuuacugugauaauauaaguacgucaucuagcacagagccuggcacacaguugguauuugauaaacaguagcggugggagaguaguugcugugccaaguacuuauuaaaugcuguuauuacugugauuaccauuuuuguuauugucuaaauuuauugcuuaaauuauuuacuuauaugugaguaaugcauuggccauugucucacuugguauucaaaacaauccugaaaagaggggaaucaagguugagauuaucuucaauguauugaugaagagacugaggcucagagagcuugugauuggucaaggucaguaagugacagucagauccugagcuuaaguccucagaguucaaguccaguucuuuuucuguuacaggaaugcuaucuccuagccuauauagguggggcuuaggugaaggacacuuagccuagcccauaguuaguagcuauugaaaaggacuccuggccaggcgcgguugcucaugccuguaaucccagcacuuugggaggcugaggcaggcagauuacgagaucaggaguucgagaccagccuggccaacguggugaaacccuguuucuacuaaaaauaccaaaauuagcugggugcgauggcagaugccuguaaucccagcuacacgggaggcugaggcaggagaaucacuugaacccugggggcagagguugcagugagcagagauugccauugcacuccagccugggcaacagagcaagacucuguauuaaaagaaaaaguaaaaagaaaaggacucccauguccuucccuagccuccauguuagccucuuucugccucuccuccccugcugcugccagcagugaccacugugugguucguaagcagugucccauccuccaagauggcaugaguaacucaaaagacauucuucuggcuccaguccuuaaugugcguuauaagggcuaacuauacuuaauaucuuuagaucaacauguugcuuuucaaacguuaggaaaaacuaaugcucagcuguuauagacagcugcagccagaccagaagccugaccuaacaggaaaccccacuccaaagcaauuuuuccuuacuugagguagggaauggagguggucagauuuuuuuacagaauuacuucuauucuaaaugauuaaccuggucucugcaagagacuguccauucuugacuugaagaaauaauagagucagggauuugucacauaaaaguuugaaucauuccuucuuuauacuucuugcugcuucuagaaagacaacuuaguucuguuagauguucguguucuuguccacuaagcaggaaaaaggaaaaauaucucuagagaaugaacacuuagaaaauaauuuaaaguauacuucuaugggauagaggagcccauugccauuuuuuuuuuguuuuuauuuaaaaacaaaguacuuuccaaccuacugauuucucucuugccaucuuccuuucuacagacauuuguugagcaccaacucuguguguaaaggccuguguuuggcauugaggguucugggcuuucaaucaagcccucaaaccucucaauacacacaaacauacacacuaaucauuauacaugauagcaaguuguaaguuccauaagagagggauaaauaugaucuuauagggcuuuaaagaagggaaaaggcauauuggguuuggagaaugaaguuuccuuuggccugauacaaaaagaguaaguagcuuuugaauguauggaaaugauacaggcuguuccagaugaagagaagauucugaacaaaggaagggggacuagauaccagggagaacauggaguguucuccaugaacacucuccucugugaaggaauagaguuggaaguaaaguaggggccagaucaugagaacuuugaauguuguacugagaagcauuucuaggcaaccaggagccauguaaguuuuugaacaagguuaucaaauguguacugugggggaaaauuaaucuggcuacauguacaggauaacuugacaucccuuuugaggguucuaauccugauuuugcuauugaauagcuauguaugcaagucacauccucucugaaacacaguuuccccgucuguugaaucauuaguaauauuuagcacacaaggugucuuugaagauuaaaugaaauaacaaauuugagaacaccuuauaauaguaccuuacacauagaaggaauugauaccaaguaccuuagaaacuaacguauaccauauauucauguugucuggaaauuuguuuuuauuucuguagauagagcucucauccuccuuuucucuucuuucuuaaccugaucaacucugauuuaucuuucuacgccagguucagaaagucacuucccccuuuaugaagccucuauaccuagccagauugaaagcauucuuggcuuuugccguauuuuauguuucgcuagcauuuuguaugagccucuguuauagcaucucuuuucuguugugacuuuuuaaaaguauuuuucuacaccaaaguuugauucugaaacuuugauguguaucacagugaccuggaggacuuuuuacaucacagagcuucugauuuaguagauuuggggugggacccgagguuuuuauuuccaacaagcucccagaugaugaugaugcuggcuugagaccucacuuugaagaccacuggucuacauagacaaacugugaauuacucgagggcuaagacuguaucuuacucaucuuuguuuccugaguacuuaaggucugguacuuagcaggugcucaauaaaugggaaugacuaugguugcacauugaauauacucuugauuucagguggccauuaagcagaugaaucuucagcagcagcccaagaaagagcugauuauuaaugagauccuggucaugagggaaaacaagaacccaaacauugugaauuacuuggacagguauggaguggugggucccaucagagggaaagggccuuugggacugauugguggugaagcuguuagagaagagggcagugccagcccucagaacugccuccauuuaugagucuucugugaugcugagcucucuguaugugacccuguguaaugcuggacaccuuuuuugcugggaaauccuucuguguuaggcugaacucuaccaccguguagcuucuaacaguugauccucguacuguuuguuuugccuaagggaaaccuaccaacccaucugccugagucaaacaucuagguccuuaacucauuuuacaucccaaaucuuuccuuauucugcucauccuccugaauaacuuguuguuuguuuauguucucuuaaaaugcagugugcagaacuagauguuucauuugagaucugaccacuauggagagagugggacucuuucuaaacucaacacagcuuaaugauuucauucuuguuuuaucuuuuagguugucugcuuugacucccaguaaguuugcagucaacuaaaauuucugauuuuuuuuuuuuuuuuuacguaagcuugcauuaaacuggaaauguggaacuuuuucacuaucuucauuaagucccauuuuuauuauuuuagcccaucauuccagcccaucaaaauuuuuuugcaaaauaguaauagugguuguauauaauauuuguauugugcuuuacuuuguaccaagcacuuucaugaacaguaucucauugugagguaggguuuuuuuauccauauuuuacagacaaggaaacugagguuuauagacguuaauaacuuguccaagaguaguaagccauaaaacagcaaagcaguguuuugaauuugaauauuccuagcaccaauaucuagcaccuuucuauuuuaucauguucuuuucuccgauaccugaaaaaaaaaaaaaguuaagcuucuugcccaggguucagagacaucguagguggaggugaaauuggacuaaaucuuggacucuaauuucuuuaccucuuauauugcaugaccagcuaccucuuccuguuacugguagauuucauaagggcgccuucuuguucugcaucuaaaacacuaguaagcuucaguuuccuuaaagaagaaaagaguugaacuuugacauucccaacacuauaaagaauaaagccuucuucuuugagauggcugugucuccuuaauguggguccugacuggcucugaagaauccucugaaaguuaguaccuuaucaucucuuucagaacuuauuauacagagaauauagcucaugcaaacuacugaaggcgacagggguauuagauuuugguucaggauauggaaaaaugaaagcugucaguaaggguauggccugucucacaaaauggugaguuccccaucaguggaugcaucuacaugauaaaacgauguuauugaaggaauuuguguucugggaguaggauuaagagacuuauagauuuguuuauuaaucauaucuuuaccaguauucccagagacuuuuacucuggaaauuagaaguaaauaaugcuaucuuugcccucaaauaguuccuggucugguauagaaaaaaaaaaaauaccucuguaaggucauggaagaggacauuaaccugagcauucagugaagguguugcaaaugagggucugugguuuuugugagaugucccagaggggaacuccaucacauauggaugaacucaugggcagaacccucaugauguaaucaccuuccaaaggccccaccuccuaauaacauuagugauuagauuuucaacauauaaauuuugagggacacaaacauucagaccauagcaguucaaauccccauagucuucucucucaaaagagauuguugaagaaacacuuagucugucauguuuauuagucaggacauuaaaaaauuauaaaucagaacacagaguuuuauggaaagagcugucgauuaguagucaaaaaaauaggauucaaaucuuacccuugcuugauugcauuuguuaaaaucuuccaacagucuccacaucuguccagcaguauucccaauaucaggaugaagauaagaugauaccacacaguucaagccaaugcaagaaauguuuuuuuccaauccagcuucuuuguccaagacuggcagaagacuuuagggcucuaggcucgccuuguuuuuauuugucugauucuauaguaaggaaacauugaccaaauaggcuaagugaccuuuuuauuuaucguguaauaggguugagugauccaacuccugagugaaacuaucacuucuaacucaugucagcccauaaucucucuggggauaucuuacuaaaugguagucuuggcuuaucagaaggcuuuggcuccauaagcccuugcuaaauucauuccauucuugaaccacagacacucaaaguagaggucaauugucagcauaaugacuauguauacaacacuuugcagcuuuuaaggggcuccuauaaacauuauuucguuuaauauuuauaguuaucuuuuauuuuuucagugauuuauuuaguaaauauuggcaucugcugugcuggacucugaggauagagucuugaacaagacccaauacuuggucucauagaucucagaucugguaggacucucugggagguuuaguagcucucucuucuuuggguaacauggacucuaaauccuaucuuugucaaauguuuggaugcuucuagaggugugggaaucaugucagucuuucuaauuuuaggaugucuuccuuuguguugugaugaaauauaauuuuauuguaucacuucaagcuagagaucuuaguucugcccuuuggggcuucacagaacauguauacuugguuuucuccaggagcauccuugagagauucaaaguuagugauucuguuccccagauucugcuuuuccccaaaguaaagaaccuuuuacuuuacuuugugcuaagacguaguuucacucuguguauaugcuuagccuuugaaacccagugcuauggcucaguguacucugauuguucucucucacccuuuaucuguauuccugcaguuaccucgugggagaugagcuguggguuguuauggaauacuuggcuggaggcuccuugacagauguggugacagaaacuugcauggaugaaggccaaauugcagcugugugccgugagguaaggccaagggccaagcagucuuggguagaaagcugccuccauauuccugucuccugaaguucccuguacagugagaucucagccugggcucuguggaauugguagaaauuagugcugacacugcuaucauuccuguauuguaccuguguuugucauuucuaucaccaugauuuuuuuuuuaacgauaacuuuauucuacccauuguagaaaaauuauaaaguacuagaaaguauauauuguaaaaagucacucauaauuccagucuuagagauaaccacuugccuaagcacguuauaauauauuccuuuaucucuuuuaucugggcauauauuucaaucauuuuuauucugcuuucuugcuuuauuuaugugcuauaaggaaaauaaaacagaguaagaagguagugauggaggaaguacuauuuuagacaagacagucagggaagguuuugcuauagauuugaguaaacaucugaaugauauauaaaagcaagccagcaaaaaucuaggguaaaauacuuccaggaaaauaaaaaaagaaaacaaagcucaaauagauacucccuuucuccucauugcuauuaaaugucuagaauugauaauacgcugauguaggaggaagaaaagcccuccagaaagccuggacaguguccucagggaauaaccacauuucauuuccauuagagcaaaaagaugaagggaauauucagagacauugaggauauuggguguuuugcugaugacagacuggacuuucugauggcccaauaaugcaaaaguaauugcgguuuuugccauuacuuaaaaaaaaaaaaauaccaaaaccacaauugcuuuugcaccaaccuaguagaaaaguuaggaaauuaggggaagcauagaagaugagaugagguucagaauuuuguggagaugaguauaauaguaugauggggguuugauggugcaagagcugaaggcauacugcugaaauuauguaguuauauauuuaaucaguguuaagaaaaauaaaaugugaaaucaauacugcccuagaaaauaaugguccccuuugcaaacaacuuugggaucuagaauguucacaaguaauuggaauuaauuaauggaauuaauaccaggcugggauucuuagggguucugacuuuuuuuuuuguuccacuacuaaugcaguauuucguaaccuucuuuucauuaucuccuucuuaaggaggcuuuuuccuaaucauacucccugccaugaaauuguaauaucacagauauauagcuaagcuguuugggucauaaaccauuguaauaccuaagauuuuuuucaccccacccccuuacccucaggaacgaaguuucacuaguugagaauacaugcauauguauacuuugggaaaucauuuugccucauuauuaaucuguaaaauggaaauugcaacauucacacuauauauaccuuaggggugcuauauggaucaaaaagcacuuggaaaaaaauguuaauguuguauaauagaugguauuacuauucuucaguucuaauagagaucaucuucuccuuuuaaaaaaucuuuauugagauauaauucacccauuuagaguauauaauucacuaguuuuuaguauauucauagaguuguacagccaccaucauaaugaauuuuagauccuuuuuaucaccccaaagaggaaauuaauauccauuaacagucacuccccauguccccugcccugacucucccagcccuauguaaccacuaaucuauuuucuaccucuguaguuucccuguacugggcauuuuauauaaauggaaucauguaauauuugcucuuuuguaauuggcuucuuuuacuuagcuagcauuauguuucaaagauucauccauuuuguagcauguaucaguaccucauuccuuuuuauugccaaguaauagaauggacauuuggguuguuucuguuuucggcuguuauaaaaaauaaaaaauuacucuaugaacacuuauauaccaguuuuuguguggagguauguucucauucucuuggauauauaacuacagguggauugcuggucauauggcaacucuauacucaacuuuugaggaacugccaaacuguuuccguaguagcuguacuguuuuacguuccugccagcaauguaugaggguuccaguuucucaagauaauucuuuuucaucauaauuucugacauccugagaccuguuucuccacccuucuaagaagagcagcucuuacauuuucagggaaaauccaauucuggauauuguuuuauucuuacuuuagccauugguauauucuuagaaaguaaaguauuagguuaggaccauuuaaauaguauuuuccuguucacuuauaucuuuaguguuuuuuaauugguagaaguuucuaaaaaauuaguuuugggucaaugaaaucaaauuauugauuuaguagaaaagcugagaugaucucaucugauucccaaauuuuauagauggaaguccagaauuauauagucaaugggguagcagcagaaccaggcauuuuaauuguaccauugugucucuuuauuacucauucugccugcuaaguauagguguuuuccaagauucuucucuuucuccuuuacccuuugccggguucaaccauuuuuauaacuuaaacaaaaaucaucucuucccaaaugacuuguaaauauuuaccauaauuuaucauaaauuaaguugccuaccagacauuugucuucagauaucaaauucagcauauccaaaauaguacaaaauaucuccucaccaaaauaagauuauccugcuaacuuacugcuucuaguaucacuuccauaugucugcuuccucaaauaugacccuuauuuguuguuuuccucuggucugucauuauaagauccuuuccauuuuucuucaguaauuucucuugggccuuagguccuuuaccaaggaucuaauuagaaaaaaaauuacauuggaggaacuccuuuacuuaaaaaaacuguuuuaaggugaaaggcagcauggaguguuaaaagaauguuuagcuaggagauggaagacuuguuucuagaucuggcucugcgauugauuuggggcaaguccuuuuacucacuggggccuuacuuccuuuauuuuaaagugaagagguugaauuaguggauuuucuauuaagucuucuguauuauauguauguccuuucuuucucccccugcccacaccacuucaauagugucugcaggcucuggaguucuugcauucgaaccaggucauucacagagacaucaagagugacaauauucuguugggaauggauggcucugucaagcuaaguaaguaggagccuuaggaaugauaauacuucucugccuguggggcccugucuccugugagauggucaucauauaauaguaacuacgacacucaccaaagggucuuuaugauuucaugggauaugagggcuguuuuauauuuucuguauuaaucauaggauaucauuucauuauuuuuucauucauuuauacauuuaacaacaaccacaaaaaacuuugcugaaugguuacucugugcuagguccugugaugggcacugagaguaaauuuucccuaccuucucaaucuaguauggaaaacguguaauagauaauuagaaaaaagaguuuuguauaauuucuuucauucaguuauucagcaaacuuuuauugaauguccaguacaugcugguccuucuagggauaugaggacaaguaagaggacauaauccauacucucaaaggcuuccuaauuuaaauaaauuuauaauugcaauauaauguaaaaaccauggcagguagagcauuuuguucaaagguguaaagaccaguagaccagacaaacaggcugugucauggguggaugggcaguuuauggaaggacugcuagcagcccugggucuggggcauaaaaacagggccaugccuagucauaggugauugggguuuaaaucaaggacucgugcccaaggaauaagacaaggaccuagucgccagauuugggauuaugggaaugguuuuucaagaacaaagcagaauugggaugagcaaucaagaccaaaaugggcagcuuggacuuuaacacuaaguccccugguuugaggagaaguaggaggccagagaugguguuucuuauauuccuucuauuucucuucaggguucaauaggaaauaggcuaggagcuagacaugaaggugguagucaagugacuuuggagagacaaaggauagcagagcuggaagccaggcggaucuugucaccuauguguagguacacagucaacacuuacugaagugaguguauauccuaaauguauguucuuucucuuauuuuucuuuucuagcugacuuuggauucugugcacagauaaccccagagcagagcaaacggagcaccaugguaggaaccccauacuggauggcaccagagguugugacacgaaaggccuaugggcccaagguugacaucuggucccugggcaucauggccaucgaaaugauugaaggggagccuccauaccucaaugaaaacccucugagagugaguguuaccaguucuauuucaaguuauuugggcuguugucucuagucccaggaaauaagaauccaggguguucucugugguuuucaaccuggagaucccuuuucuggauacaacuagucacuguugaacuuaaaguauaaauggccaaagaaaaggaauauuagaagucacucauucauuuauucaacaauuauuugagucccugucaagugcaagaaacuauucuaaugaaaauaaaauaaauuaauauguaguaacagaugguaaaugcugugagaaaaagcaaaguaagggaguuaacagaguaauggaggaacaggugugcuauuuuagaguagagagggaaguucucucuuauaaguuauuuuauucugcagaguugggaagucauuagaggguuuugagcugaggaguaaugugaucugauuuauguuuuaaacagaucauuuuggccgcuuuuauggaaaauagacugcgagagacuguuguaauaguucagagugguggugucuugguaggaguggaagugagaaguggucagauucaggaaauuaaaggacuagcugacaagaugaacugaauauuagagaaagaggaaucagcaaugacuacaagauuucuggucugaauugcugaaaaaauucaguugccaucuguugaaauggugaagagcauacuuaaguuggguaauaaagaguugguuuugaaugugcugauuugaaguguuaauuggacauuuaaguggagcuggaguagaguuuggcuuaagagucuggaguucaagggugagaagucaggacuauaaacauaaauuuauuaguagauaauauauaguugguauauauaguagguagaugagaucacucaccuagggaaugaguacaguuaaagaaaagagauuugaguacugagcucuagguuauuccacuguuuacagguuggaagaacuagcaaaguagaccaaggaguggccuuucuagugugagagaacagagaagugucuuggaggugaaguguccuggagaugaagagaacagugugcuucccgaaggaggaggaggguagauuaugugucaaaugugauugauagguuaagaugagacugagaaaugaacauuggauuugccaauguagagguucuuaaugaccuuaauaaucaguuaucaguagagagauggggaugaaagucuaauuaaauucaugaaaguggaagaagaggacauugagauggcauguauaaacagguuuuuuuuucucuuaaaggaauuuugcugggaaggguaacaaaaauggagcacuaucuuaaaauggagucaagggaggguuuuucuaaaagaugaugucugugugcuaaugggaaugauuuaguggagaggaggaaaauggucauguacaagaaggaagugacaaccauagaagugauauccuuaagucgaugagagggguucgaucaaguacugaaguaaaggacauuagauuagcauggacaauuuaucccuuguaacagagcaucucaacacaggugcaaauagguugguaaucuuggugugggcaaaugugaaauuuauucugauugcuuuuauuuucucauuuauucccaccucccauccagugcaggaauucccugugcacuguugcugguagguggucaucuacaugcucaugucauccuugaauaucucugauuauuggaaauugcuucagugcaccaaacugaaacuaccuucuguaguuucuauccuuugaucccagcuuugccucugacuccacauacaacauacucuucccucccuuagaacggccuugcagauauuugaagaugauaauugcugggauauguuggaaauaagacagaaugauccuagacauaggcauauuuuuuuauuuuuuuauuuuuauuuuauuuuuuuuuuugagauggagucucacucugucaccuaggcuggagugcaauggugugaucucagcucaccgcaaccuccaccucccagguucaagcgauucuccugccucagccuccugaguagcugggauuacaggcaccugccaccaugcccagcuaaguuuuguauuuuuaguagagaccacauuucgccauauuggucaggcuguucucgauggucucgaacuccugaccucaggugauccacccaccucagccucccaaagugcugggauuacaggagugagccaccacgcccggcccuagacauaucuuuuuauguuuccggacccuaucugugaagugaagaugauaagucuugcccuauuacccagaguuaauuguggccauuaaauuagacagugcuuauguaaguacucuuugaauuaagugcugagugcuuguaaagauuuagucuuacuguuuuucuuuaccuuucccaggagacgcuucauuuaggggacuaggguggcaacaguuuucacuuacauuuaauauuccuuuccugcuagaagagaucaguucuuggaugacugaggugaaggcaccaggaauaauuucugccagcagcugggcagauguuuaacucaacaggcuaaauggauaauaaacccuucagauguguaagcaagaauaauaauaaagccaggcacagugacucacgccuguaaucccagcacuuugggagguugaggcaggaggaucacuugagucuaggaguuugagaccagccaggccaacaugguaaaaccccgucucuacugaaaauacgaaaagcagucggguguaguggcuggugccuguaaucccagcuacuugggaggcugagucaggagaauugcuugaaccugggagguggagguugcagugagccaagaucgugccacugcacuccagccugggcgacagagcaagacuccaucucaaaaaaaaaaaaaaaaaaaaagaagaagaagaauaaacccuuaggucuguaacauauuucauaaguuuacaaaguacuuucaaauacacuaucuuauuuuauuuuuacagacaugugagaugggcauuaucaucaucccuacuuuacagacagggaaguuguacauagucccauggccuuuaaauguucaaccugauccuuaggucauacucuuuccaguauauauacacagcugcuacuuugcauccuagagcauaaagcagcugaccauauuucuagaacuuguauauggggaacaagagagagccucauuuggagcucaaggugauucaccauuuuuauugccaggccuuguaccucauugccaccaaugggaccccagaacuucagaacccagagaagcugucagcuaucuuccgggacuuucugaaccgcugucucgagauggauguggagaagagagguucagcuaaagagcugcuacagguaacuguccuuaugcagggaagcaccuaauucagggaaucacuaaaccaggccuuuuuuacuucauguuuguaagguacuggauauuauagaacuaggcuucucuucuaccacuuccuacacucacucuguuccuacugcccuuuuaucccugggccuuugcucauuuauuuucuuagccuuucucagccuguuaaaacucuacacguucuccuaggcucaguuuacaaucuauuuucugagcaccuauugagcuuugcuuguagcuuuuuugcuugcuuccuuccuuccuuuccuuucuucuuccuuucccuuuccuucccuuccuuucccuucccuucccuucccuucccuucccuuccuuucccuucccuucccuuuccccccccucuucccucucccccuuccucucacgccccacagggucucacucugucacccaggcaggagugugcaauggcgugauuuugucucacugcagucuuccucuccuggguucacucaagugaucuucccaccucagccucccagguagcucagacuacaggugcacgccaccauaccuggcuaguuuuuuaaaaacuuuuuuguagagacgggguuuugcuauguuggccgugcauggucucaaauuccuggguucaagcgaucugcgcacuucgcuuucccaaagugcugggacuacaggcaugggccaccaugaccagccugcuuguaucuuucauuagcacuuccuuuguucuguuugaauuagucuggcagaguuuguuugagucuuguugagaaacgggucucugacacccaaaucuuacacaacuuauauuuugcugggauuagcucaaaggauacauuuuuagcaaaggaacauaaguuuauuuuauuuuauuuauguuuuauuuuucuuucuuuuuuuuuaauucuuuuuuuuuuacauuuuauuauuauuauacuuuuaaguuuuaggguacaugugcacaacgugcagguuuguuacauauguauacauguaccauguuggugugcuguacccauuaacucgucauuuagcauuagguauaucucuuaaugcuaucccuccacccuccccugaccccacaacagucccgggugugugauguuccccuuccuguguccauguguucucauuguucauuuccuaccuaugagugagaacaugcaguguuugguuuuuuguccuugcaauaguuugcugagaaugaugguuuccaguuucauccaugucccuacaaaggacaugaacucaucauuuuuuauggcugcauaguauuccaugguguauaugugccacauuuucuuaauccagucuaucguuguuggacauuuagguugguuccaagucuuugcuguugugaauagugccacuauaaacauacgugugcaugugucuuuacagcagcaugauuuauaauccuuuggguauauacccaguaaugggauggcugggucaaaugguauuucuaguucuagaucccugaggaauugccacacugacuuccacaaugguugaacuaguuuacacucccaccaacaguguaaaaguguucguauuucuccacauccucuccagcacguguuguuuccugacuuuuuaaugaucgccauucuaacuggugugagaugguaucucauugugguuuugauuugcauuucccugauggccagugaugaugagcauuuuuuauguguuuuuuggcuauguaaaugucuucuuuugagaagugucuguucauauccuucgcccacuuuuugaugggguuguuuguuuuuuucuuguaaauuuguuugaguucguuguagauucuggauauuagcccuuugucagaugaguagguugcaaaaauuuucucccauccuguagguugccuguucacucugauggugguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaucauuuuaggucuaacauuuaagucucuaauccaucuugaauuaauuuuuguauaagguguaaggaagggauccaguuucagcuuucuacauauggcuagccaguuuucccagcaccauuuauuaaauagggaauccuuuccccauugcuuguuuuugucacguuugucaaagaucagauaguuguagauaugcggcguuauuucugagggcucuguucugcuccauuggucuauaucucuguuuugguaccaguaccaugcuguuuugguuacuguagccuuguaguauaguuugaagucagguagugugaugccuccagcuuuguucuuugggcuuaggauugacucggcgaugcgggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccacgaguauggaacguucuuccauuuguuuguauccucuuuuauuucauugagcagugguuuguaguucuccuugaagagguccuucacaucucuuguaaguuggauuccuagguauuuuauucucuuugaagcaauugugaaugggaguucacucaugauuuggcucucuguuugucugucauugguguauaagaaugcuugugauuuuuguacauugauuuuguauccugagacuuagcugaaguugcuuaucagcuugaggagauuuugggcugagaugaugggguuuucuaaauauacaaucaugucaucugcaaacagggacaauuugacuucuuuuuuuccuaauugaaugcccuuuauuuccuucuccugccugauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugagauaugucccaucaauaccuaauuuauugagaguguuuagcaugaaggguuguugaauuuugucaaaggccuuuucugcaucuauugagauaaucaugugguuuuugucuuuaguucuguuuauaccuuggauuacauuuauugauuugcguauguugaacuggcuuugcaucccagggaugaagcccacuugaucauggcggauaagcuuuuugaugugcugcuggauucgguuugccaguauuuuacugaggauuuuugcaucgauguucaucaaggauauuggcuaaaauucucuuuuuuuguugugucucugccaggcuuugguaucaggaugaugcuggccucauaaaaugaguuagggaggauucccucuuuuucuguugauuggaauaguuucagaaggaaugguaccauuuccuccuuguaccucugguacaauucggcugugaauccaucugguccuggacucuuuuugguugguaagcuauugauuauugccucaauuucagauccuguuauuggucuauucagagauucagcuucuuccugguuuagucuugggaggauguaugugucgaggaauuuauccauuucuucuagauuuucuaguugauuugcauagagguguuuauaguauucucugaugguaguuuguauuucugugggaucgguggugaucuccccuuuaucauuuuugauugcgucuauuugauucuucucucuuuucuucuuuauuagucuugcuagcggucuaucaauuuuguugauccuuucaaaaaaccagcuccuggauucauuaauuuuuugaaggguuuuuugugucucuauuuccuucaguucugcucugaucuuaguuauuucuugccuucugcuagcuuuugaauguguuugcucuugcuuuucuaguucuuuuaauugugauguaagggugucaauuuuagaucuuuccugcuuucucuugugggcauuuagugcuauacauuucccucuacacacugcuuugaaugugucccagagauucugguauguugucuuuguucucguugguuucaaagaacaucuuuauuucugccuucauuucauuauuuacccaguagucauucgggagcagguuguucaguuuccauguaguugagcaguuuugagugaguuucuuaauccugaguucuaguuugauugcacuguggucugagagacaguuuguuauaauuucuguucuuuuacauuugcugaggagugcuuuacuuccaacuauguggucaauuuuggaguaggugugguguggugcugaaaagaauguauauucuguugauuugggguggagaguucuguagaugucuauuagguccucuuguugcagagcugaguucaauuccuggguauccuuguuaacuuucugucucguugaucugucuaauguugacagugggguguuaaagucucccauuauuauuguguuggagucuaagucucuuuguaggucacuaaggacuugcuuuaugaaucugggugcuccuguauugggugcauauauauuuaggauaguuagcucuuguuguugaauugaucccuuuaccauuauguaauggccuucuuugucucuuuugaucuuuguugguuuaaagucuguuuuaucagagacuaggauugcaaucccugccuucuuuugguuuccauuugcuugguagaucuuccuccaucccuuuauuuugagccuaugugugucucugcacgugagauggguuuccugaauacagcacacugaugaguccugacucuuuauccagucugccagucugugucuuuuaauuggagcauuuagcccauuuacguuuaaaguuaauauuguuaugugugaauuugauccugucauuaugauguuagcugguuauuuugcucguuaguuggugcaguuucuuccuagccuugauggucuuuacaauuuggcauguuuuugcaguggcugguacugguuguuccuuuccauguuuagugcuuccuucaggagcucuuguaaggcaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugcugagagaucagcuuuuagucugaugggcuucccuuuguggguaacccgaccuuucucucuggcugcccuuaacauuuuuuccuucauuucaacuuuggugaaucugacaauuaugugucuuggaguugcucuucucgaggaguaucuuuguggcauucucuguauuuccugaauuugaauguuggccugccuugcuagauuggggaaguucuccuggauaauauacugcagaguguuuuccaacuugguuccauucuccccgucacuuucagguauaccaaucagacguagauuuggccuuuucacauagucccauauuucuuggaggcuuuguucguuucuuuuuauucuuuuuucucuaaacuucucuucucgcuucauuucauucauuucgucuuccaucacugauacccuuucuuccaguugaucgcaucggcuccugaggcuucugcauucgucacguagcucucgugccuugguuuucagcuccaucagguccuuuaaggacuugucugcauugauuauucuuguuauccauucaucuuauuuuuuuucaaagcuuuuaacuucuuugccauugauucgaauuuccuccuguagcucagaguagucugaucaucugaggccuucuuucaacucgucagagucauucuccauccagcuuuguuccguugcuggugaggagcugcguuccuuuggaggaggagaggcgcucugauuuuuagaguuuccaguuuuucugcucuguuuuuucgagacaggaucucucucuguugcccaggcuggagugcauggcgcaaucauggcucacuguagccucaaccuccccagguucugcugaucuucccacuucagccuccagaguagcugggacuauaggcgugcaccaccauaccugccuaauuuuucuauuuuuuguaaagacaggguuuugccauguugcucaggcugggcucaaacgaucugcccaccacagucucccaaagugcuggaauuacaggcauggcaucagccaccaugcccauccauggaacauaaguuuagaagauaauuagugaguguggcuuuuggagucuuuacacuuuauucauuggaaauccucagauaauggcaaugauacucuacuuauugagagugagauuuugccaguuuguggggaaacccggagucagggguuuacuaggccuuuuauacuccugccugccuaauccugauaauuuuauaugguugcaaaaauugccuuuagcaggccgcaucauuuguauuuaacauauauguuucaaguacaauuucuuauaacuaguguucuuuuauuguauugcccacuagugaucuaauaguaaguaucacaugcaacuuuaugaaggcaugcacugucauuugcuuucguauuaugaagcccagaagugacagagcagggcagggcagggcagggcauacugcccuguguuaauuaugaaucucuuuccuauuggauuauaaccucuauuuuguuaaucccugagucucauguuuuaccuaggacuugacucaggauagguacucaaaauauauuuauugaauugaaugaaauuacuggaagaacccacauuggaauaucacccucuggaacauacuuagcaugucuuuguaauugagguuacugauuauggcauacuggccuauuaguuaugagaucuggguucugccaaguauaacccauuagucucuaguaucuguuggaacuaaaagucucuuaguacaauguaggaccccuuuugcuguucaugagaguuguauucuggaaacugugggcacugggaaauguguaaauacuauaugcuaagccugcgauuaguaaagauaccauucuuaauuaaauaccaaauuauaguucuugaaagguuagugaccucuaaaguuuucuuccugauauaguaauauaacuaguaauaaauggguuauauugaaucuuuaccauauuuuaggcacuaaacacuuuauauauuuaggcacuaagcacuuuauauauuguccuuuacaacaacucugugagucauagguucuauucucauuuuuacaggugagaaaacugagguuucaaguguuuaguaacuuuuccaugauagcugguaaguagcagauccaggauuucagccuguuuggcucucaaguguguaugcucuuggccacugcucuuaauaggcucaaagaguaucacaacuggaagcccuuagggcucaucuagucuguuuuguuuauuagacagagaaggaaacugaggccucccaauucgauguuggaucaugcugcucucaacuuaggggaauugcagaaacaugugaucugagaaagcuggcuuuuuaacuuguugguguacauuguaaauauugaaaaccaugacuuugagaaucacaaaucauaaaagcuucacaucuguuucuccugugagaacacacuuauagacagaaauacauagaaugauauauauuggaauucauaucuucaugauuuagcuaggaucuuuuauuccuuucauaguaauaguacguucuuguucucaguagcucuuuauacuaucucugucccaacagaaguugcagcaauucucagcaaagaauauuaguauauauguuucucucucuuucucuuucucucucucucucugucucucucucucucuguguguguguguguguguguguguguauacauauauacaauaugacuaaucaagggaauuguaaguauggcagaagaaucagauaugcucaugugaguugaguaguuauguuuagaggucaaaucugguucucaauuuccugguagccagggcagaaaaggaaaugugauagcuccuauauuuuuuaucaaauagaagaacauccuacagcuuuaagacacaaagcuuuuuuacuacuaaauguuuaaaaagaaaaaaaagcaccauuuuuaagaggcucugagaauuacauaaggaauuguuagaccaggcacgguggcucaugccuguuaucccagcacuucgcgaggcugaggccaguggaucaguugaggucaggaguuugagacuagccuggacaguauggcaaaaccccgucucuacuaaaaauacaaaaauuagccaggugugguggcgggcgccuguagucccagcuauucgggagguugaggcaggagaauugcuugaacccaggaggcggagguugcagugagccgagaccgcaccacugcacuccagccugggcaacagagugagacuccgucucaaaaaaaaaaaaaaaaaaggaauugcuuucuguaacaguuuuacugaaaauuuagaugcaauuuucauauaauauuuucuccuaaauagucauuaaauguugaagguauggcccaaaguacagcccagugaaagugauuugggaaaggaccaagcuacugaacuuuuuacugaaugauuagcauuauuggauuugaggauagaacaauaaauuccuagaucaaugcuccuaaaaugcaguauugcgauauacuacugggucaugaucuauuaauaccuuccccagagguaauuauuauucugauuaucaccaugguuaggcuuaccucggaagaaauggaauaauacaauaugaacuugcuugucuggcuucuuucccuuaaugugucugugagauucaacccauuugucaguguaccaauuacuuauuguauugcuguguaauuuucuguauaguauuauaugaauauaacacuauucauuuuuccauucucuuggacauuuggguucuuucugguuauuggcuauuauaagcaaaucuuuuaugaacauuucuguguaugucuuuugguggcuauacaaacuaauuucucuugggaauauaccuaggauuggaauuacuagaguauagguagauguauuuaucuguaaguagaugcugccaaacaguuuuccaaaguggucuguuuuaagauguccuucaauuuggggaugaucagaagcuuuccacacagcacccuuuacaaacaaagaugccuuuaugucuuguaaugguuacuggggaagaauguuaaauagucaugugucuuuugcuauuuuucuccuuucuagcaucaauuccugaagauugccaagccccucuccagccucacuccacugauugcugcagcuaaggaggcaacaaagaacaaucacuaaaaccacacucaccccagccucauugugccaagccuucugugagauaaaugcacauuucagaaauuccaacuccugaugcccucuucuccuugccuugcuucucccauuuccugaucuagcacuccucaagacuuugauccuuggaaaccguguguccagcauugaagagaacugcaacugaaugacuaaucagaugauggccauuucuaaauaaggaauuuccucccaauucauggauaugagggugguuuaugauuaaggguuuauauaaauaaauguuucuagucuuccgugugucaaaauccucaccuccuucauaaccaucucccacaauuaauucuugacuauauaaauuuaugguuugauaauauuaucaauuuguaaucaauugagauuucuuuagugcuugcuuuucugugacucaacugcccagacaccucauuguacuugaaaacuggaacagcuugggaaugccaugggguuugauaaucugccagggacaugaagaggcucagcuuccuggaccaugacuuuggcucagcugauccugacaugggagaacaaccacauuuuucuuugugugugcuucuagcagcuguucgggaggaccuugacccaauaguguucccaugcuguuucuugugaaaugcucucggcuauguagcagcuuuugauucccugcauacccuaggcugcugccccuauccugucccuuguuuauaacauugagagguuuucuagggcacauacugagugagagcaguguugagaagucggggaaaauggugacuacuuuuagagcaaggcugggcaucagcaccuguccagcucuacuugugugauguuucaggaacucagccccuuuuucugccuaggauaaggagcugaaagauuaacuuggaucuucuaaugguccaaaucuuuuggucacaauaaagagucuccaaauuagagacugcauguuaguucuggauggauuugguggccugacaugauacccugccagcugugaggggaccccguuuuuaagaugcauggccaagcucucugcaaauggaaaugcuuacacuggguguuggggauguuugcuaccuccugcuauuuuugugguuuugguucucccacuaugguaggaccccuggccagcauuguggcuugucaugucagccccauugacuaccuucucaugcucugagguacuacugccucugcagcacaaauuucuauuucugucaauaaaaggagaugaaaauauucua

SEQ ID NO: 191794 - RNA, 23474 nt, Homo sapiens
gcgacgucacgcucggcuauaaaaggcgcggcucggggcccuugcggcgcuggaggagcucgaggcugaggcugccggggggcugugggcuaccgggccgccggcgccucagcgauguuuuacucagggcuccucacugagggcggccgcaaggagaccgacaugcgggaggcggcgucacugcgacagcagcgccggaugaagcaggcggugcaguucauccacaaggacuccgccgaccugcugccccuggacggccucaagaagcugggcucguccaaggacauggugagcccccgccgccguucucgccccggccccggcggcuucgcgcccgccguuuuccgaggcccggccguugcggcuuucacugagucacggcccggcccgccgcugcccuuggcucgcggucgcugcgucgcggauuccuccccuuccaguaccccugcugcgguuucgguggggauuccgucguagcuuuucuagcuugcgcuccccucggcugugccuccucccuggaugucucuucuccaguagaaagaagagguccugcccugcccucuugcccucgggucuucuuucuuuuuccuuauucuuaauaccgaauuuuguucacggggcuugugccuccuaugcuguguggcuguuccuaugacccagacagaggugauuccuaauggcuuuccgugagggggaaagaaguggaaagaggguuuuuugacaguugccagauccagaggacuucuguugaauccauugucccccuaugcaaaacccacuucucuaguuuugguccuaacuuugaccuuccauccugaguggggagagagaaaaggggccaaaugugaagguuuccugaacccccaacaucucuucaucauucuccucuuccagccccgcccccaaggaguggguagagggaggaagccaggcugcugcaucucaccgaccagcuaaugugugcaucuggagcuggggugggugcagucuuuuuuucuagcacaguuguuccuggcauuaaguagaagcaccucaggacagggggccuggggucaaagaugguacuguccucuuucuauagaaugggauggauggcuaaggguuaccaauauaaagaacuguauuugucaucccucagccacuguagugguccugggccaaguuuauguuuaacuuuguaguuuuaucuggaguuuucuuguaguuugauuguuuucuugaauuucacaaucgcuuuauucauuugggugguaauaugugaaacacuaauuaaaugucuuuuaacaaaugaaauaggugcucugcauaauuuuucuaguauuuuuuauuuuaagcuuuugaaauauuuaauuuuggaugugguugucggcccuaguucacugaaauugccauuucuggccccaggagggcagagcuucugcauccauuuccuuuuuuuuuuuuuuuuuuuuuuaauuuaacagcucuaaugauacacagguacauuauauuauacacaguauaauauaauauacaaaaauuuuucuccucccugccauuaguuacuucugugcagaguuugucuacuucaguuaucuugcucuguuuuuuuuacaaguuguguuuuuuuguuuuguuuugcuuuuugcacaacccacaggauaguuuaucugauuuaugcuaacccagagugauaagugauugaaaugugcuccugcaaaagagauaacucucuuuucccuucuuucacuuuaaagcaaucucgauucauuuaacaaaucagguucgagaaguauucuuuccuucaggccaaauaauccuauccuaguuccuagaaugcucagcaaucaauaaagaaggaaguauuauauuaagagaagaauuaaaauacagaguuuuuaaaugcuggauuugguugucccucguugucgaggaguuuccuagcccugagagcuaccugaacuuccuucugccuaggauuucuuauacuacuucaugcuguguaagaauuccauccgcuuuucugacucuagucugucucaguugagucacaaagggcugauagcauacagcacaggcagcaggcugcaaagaggaaggagccucaagaagcaggauauugccuugaguaugacacauacacaugacaguugacuguaaggcucugaaucaugguucacgcuuucugugccccaccgucauggaguugauuucccucucucacuguuuucacaccuauaauguacaagugauugcacagaacagccagguuacagaaaccaaggcagaccgagguagggcuaggagagccgcaagcgcuggggugaggcagcaugcuuaaacucucuuggaacuguuguugcagccuuaguacaaucuuagaagugaccuuagaaguacauuauuauucuuuuacuuuauaaauacaugugggauagaccaguguugacucaauuuucucucacugcaagggaaauuuggaggauguuaaaauuaauugaauaguucuuacuuggaguaguuuauaguauaaucucgauagaaggaguccaagaaaagggagaggauagcaucagagggagauaaggaagagagaggagaaauuaguuguuauugacuuuuggguuugugaagauuguagguuguuuuuccucauaccagcaaccuauauuugaauauaccgcugggauuucugaauuaucuaccucuuacuaugcuguuucuguaauguucacugcuugauaccagccugccagcucuuuuaggacuggcagaaggcaaccauaggaaaucaaagggggucauguucucuuggccccaggaaagugccuuugccuauuccuguguaucuggaguuggcugauacaaagucuucuguggaaauuauauuuuugucugccccuuuugcuuuuauccuuuuaucuuguauuguucauucuguauuagauuaagaacuaaaaccagagauaugagugaguaauauuauauuugauuuuuuuuuuaagagacggguucucacucuauugcccaggcuggaaugcagcugcagucacaucuuacugcagccucgaccucgcaggcucaagagauccucccaccucaaccuccugaguagcuaggauuacaggugcacaccacaacaccaaucuaacuuuuguauuuuuuguagagaugggauuuugccauauugcccaggcuggucuugaacuccuggucucaagcgaucugcccacuuuagccucccaaagugcugggauuacaaacaugagcuaccacacccagcccugauuuuuuuuuuuaacucagugaagcuggagaaaaacaucuccguucuuggaaauuugccuauuguaauuuaucuuguuuuagcuaccagguucauaaaaguuuuucucauugugcuaaggacuuuuuaauuuuuaaaaacagucauguuaugugguaauaugcugucuuuccuaaaugauauuauacuuaccuguaggcauuaggccauauucuuacuugucuggcaauagaguuuuucuuuccuacauaugauugcuucugaucauagcuaaaugcuuuuucaaaacugacuagaauuaggaaugaugcugggggaaagaugguugaacacaguaaagcaaacuuaccauaaaauaccugaacagaaucucugucuauuagagcaggucuguguggugugcccuauagauuagcuauccauaucaccacaaaucaugggcuggagaauuucagaggcuuagaagagaagcgugaaauaccaguauaacaccaagaucuggcacaaacugaagauuugcagagucgugauugcauccucguaauagcaaacauuauuugaauacuugcuguguucaggacacagucuaggggcuaagacacaaauaggaagacagaaaaguuucucauuauaaacagguuuauagguugggggcagggaaggacagaucaguuaauuuaauauacaaauauuuauugaguaccuacuacacaugucaugcaauaauuuaagcuuuggagauauaauagugaaccaaaacugaguuccugccuugacggaacuuucauucuugugggaggaaggaggcagaaaguaaaauuaaguaaauguauauaagguaauaauaauaaauauuuucuauggagaaaauaaaucaggguaaggggaauagggaaggcagugacuggggugggguggagucuggcuauuuuguacaggguuguccggcaaggccuaucugauaagauuacauuugaggagauacugaagggaauuaaggagcaaaguuucucagggaagaguguucuaggcagaaggaacagcaagugcaaaggacugaggugucacugugcuugauauaacugaagaacuguaagaggaccaguguagcuagaucaaaaugagcaagggggagggugauagaagauaacaucagagauguaguaggaggccauugugcaggcauuugggugguuuuuuaaaauuauuauuuuuuuuauuuuccacucuuuucagcgcauaccuaugcauuuggguuuuaaccugagauuggaaacgaguggaauauuuugagcagaggggugauaugauacauacgacuuauuuuacaaaaagacuacucaggcuacuauguggguuacacuguaaaggggcaagaguagaugaagcaggaagacugauuaggaagcuauuauacaguaauugaagugagaguugaugguaccucagagcagugugauaagcugugaaggagaggaggaaggaucagguucuggauauauguugaaggcagagcugacaaauguaauugaugcauuggauuaagagugaaagaguaaucaaggaagaccaugagguuuuuaacuuagccauuggaagaacagaauuaucacuugcugaaguggauaagacuugcagcggggagcagguugaggauggcaaauaagaaugaagaguuugcgggcugggcgcgcuggcucaugccuguaaucccagcaguuugggaggccgaggcgggcaggucacgagguuaggagaucaagaccauccuggcaaacacggugaaaccccaucucuacuaaaaaauacaaaaaauuagccaggccugguggcgggcaccuguagucccagcuacucgggaaacucgggaggcugaggcaggagaauggugugaacccaggaggcggagcuugcagugagccgagaucgugccaaugcacuccagccuggacgacagagcgagacucugucucaaaaaaaaaaaaaaaaaaaaaaaaaaaugaagaguuugauuuuugaacaaguuuagggucccaauuaguuacuuaaauguagaugcugaauagacaauucuagaagaagauaaguaacaccaccagaaagccugugcuaguugccaagauguaauagucagaugugccagaggaguccagcggaagaagugauuucucuaaccugaugugaugauaaggauggagacuggcaucuauuuacaccuuuaccauucccuuugagccagcugacugugagaugguauggagagaaggcugccucuagagugugcuuuguagaaccucagaguaggaagaauuuuacagguuaucuggucuaauuccuugcccauuugugaauccuuucuaacaaaaugcagccuccgugagcagcugagaaaccauuaucucagacuaauccacaaaacagauaauaaugaggaauagguuguuuguugggucaugagcaaaggcaaagaaauagaacacagaaggccuggggcaguguaacagccugccuuauguuuuugagcaacugcaaacugaagaacaaucuguguuuccaugggguagaaugggucacguguuauauacucagcuaguaagcaaagagaaggcacaaauauuggugaccuuuuggauuuccaaggucagagauagagacauguauacugggcuugacucaggaguccauguuuaucuauagacuguauaugaggacuaaaauggaguagaaugauuucaggcccuuuugggguaaaagaaaaagugaaugguauccaugacccuuguucuaacuaagcucuaguuguggcucuguugcuagcuagugaccuuggauuucucucuugggaauaaaugcuacaaagaaagcagaccccuaccauuuccucuguuuucuaguuugguucauucuguggaccacagaaauccauuaguuucugucuggguagcuuggguaaagggauugagagaguggcuuuaaaguucuugcucaaauuaugauucuaugguauccugcacuauagucugauuccucucaccucucuuuucuucaaacucuauaguuugguuagaagagauguuuaagcagugugggugccagauugaggaacuguagcuauuuucacccagaauacagcacuucccauaguguucauuuccuuuagaagcucuugauggcgauggaggcagaauauuugaacuugccugguuagaguuuagaugccucuagcagccacauuucaggaagaguagagaagcagggacugcuuagguuaguagcugccuuguugaaguuuagcauaaagcagaauccacgucagaaagacgacuuaaaaauuaugucuaaauggccaccaggguaucugcagcauccaucuagcaaauuaguacuguguauccuuuuuucuuucuuuuuuuuuuuuuuuuuuuuuuugagacggagucucgcucucucaccaggcuggagugcaguggugcgauccgccucccggguucaagcgauucuccugccucagccuccccaguagcugggauuacagacacccaccaccacaccuggcuaauuuuuguauuuuuaguagagacaggguuucaccacauuggccaggauggucuugaucuccugacuucgugcuccaccugccucggccucccaaaguguugggauuacaggcaugagccacugugccuggccuccuuuuuucuuuuuuugagacagagucucacucugucacccaggcuaaagugcagugucgugaucauagcucacugcagccuugaacuccuggcuucaagugauccucccaccucagcucccaaauagcugggacuacaggcgugugccaucaugcccagcuaauuuuuaaauuuuuaaaauuuuuaauuaaaaaaaauuguuuuuguagagacacaauuucacuguguugcuagguuggucucaaaguccuggccucaagcaguccugccucagccucccaaagugcugggauuauaggcaagagccagugcaccuggucaguacuguguaucuugaaagacaggacggcccuuggaaagccaauaugucaauaaacaaaugagaaccacuuaaccauauuuauaaaacagucauagacuggggauacaaauaguagaaauucuuuaauauacaaguauugaagggauucugaaagaaagaauucaaugauauuaaucaagaaaggcuuuuuggcugggugugauggcccacaccuguaaucccagcacuuugggaggccaaggcaaguggaucaccugaggucaggaguuugagaccagcccggccaacauggugaaaccucaucuccacuaaaaaggcaaaaauuagcugggugugcugcuacgcaccuguaguccagcuacuggagaggcugaggugagagaauugcuugaacccaggagguggagauuucagcaagccaagauugcgccacugcacuccagccugggagacagagugagacuccaucucaaaaaaaaaaaaaaaaaaaaaaaaggaaaaaaaggcuuuuugaagaaagaagggguagagauuucuuucaguacuaugucaagagcugaggauauagcugaaaucaagacagucauggucccugcccuugugcaguuaacaugcugguagggcaggggugaaauauaaacaaguaaauacacaaaauaauuucauauugauaauuacuaugaaagaaauagugagauuuguuaguaacuaaaaaggugaccuaccuacuuuaaguuguauggucaaggaagguaucucugaggaaaugacauuugaacagagaccuggaagauaagagggaccuaacuauuagaaauguuaggggaagaacauuucaggcagaggggacagccagugcaaagggauuggaaugggaaagaaauuuugagcaaggaagugaguguggaugguguugaaucugaaugaauaaagggagagugguuuguauauggaaggagaggcaagggccaguugguacagagcuguauagagaaggguaaaaaguuuggauuuuuucugaagaacaaugggaagccauugaaggguuuugaguaaaguacuguauuaccugacuuauguuuuaaaaagcuuacucugguuuccaugcaaagaauggacuggagaaggguaaaagaagaggcagaaugcaaguuaggaggcugugacaguacagauaagaaauuauagugguuuggauuagauuggagguaguaaagauggggagaagcagaucaauuccagguguguuucagaguacaauaucacuuuugaugggaggucaggaaaugaaaaaaucaagaauggauguaugguggugccacuuaccaagguuguuggaaaggaauuaacccaauauguuaaaacugaacaagucuuuggaguucaaaccuccuuuaugacugaucaagagaguaagguuuggagaaaaguaaugcucauagagguuagugauuugcccaagcuaauaugugacaagugguaauuugcugaaagcagaaagccuucauggaguaguaauuaaaaagaugagauugggaaggaggaugaaugguaguggaaggucuugaaugguaaauugaggauuuuucuuuguuacaacuagcaagagaaccacugugggggaagaggaccaugaaaguaauguuaggagauugggcuuagcaguaacguaaaugaagaagaaaauaagaggaggcagaauuucacccaccgagauagggaauaagggagaaugcgcaaguuugauagaaaauaucagugggauaauuuacauuugaagugccuguggaauaucuaaguagagaaguugaaaaaggcaguuggaucuaugggucuagaauugaggugacaucuggacaugagauagagucaucaucauaaagguaguaauuuaugcaaugaaaacagauaaaauugcccugggaguauauguagagugacaaaggaccaaagauagagcgaugaggaacacuaacauuuaagaaaugaacauaggcaaaggaaccagugagagagacaggaacagaauaaacaggugguuuuagaggccaguggaggagcguuucaggauaaaugaaauguugaguuuauugcagcauuguuucuaauggcaaacauaugaaaauaaucuaaaugcccauuaguaaauaguuaagguaugcuuauaccacaaacuugucugucaaggaugugcuguuuuaaaaugcagaaaguagggcagacauaagaaaauagaugcuaagcugguuauaagauaaccuggcauuauaccugccuaaguuacauugugugugugcacaugcuuuaguuuuugcaucuggcagacacuguuaguuggcuaaauuaucacccauccuuagcccuuuucuuuaugcugaacuccucuauagagauuauaaaagcuaaauucucucccaaugucuguuagagcuaggaguggccauaugaguucugaccaagaagauaugggcaaaaaacugcugaaggaacuucugggaaagcuuuuccuuuucugauaaaagcaauugaugguguuaguguagucccuccuccuuccucauuucuugaauguggauauaaugccuggagcugggguauucaucugugaccaugaaggaauguccaagagaauuaacagagucaauagcccugaaguuguuaagcugcugaguuaguaucagcagcuucuaugucuagacuucuuguuaugugagaaaaauaaaucuccauuuaaacuacgguaaguuggcuuuucuuguggcugaacucuuuucugcuacaugggguauauuuuuauuuaaaauuuuuaaaaauguaaauaauuuaaaacuuuuaaaaauuuaaagcuguugcuuguguuagggaucuccauaucuccaaguaaauggugauacugcuauuucuuaauuaacuguuuucaucacuaucuaucuagucuuacuuuuuuuuuuuuuuuuuuuuugaggcagggucucgcuuuguugcccaggcuggagugcaguggugugaucuuggcucacuaccaccuccaccuucuaggcucaaauuagucuccuaccucagccucccagguagcuggggcuacaggcgugcacuaccaugccuggcuaauuuuuguauuuuuuguagaggcagaauuucaccauguugcccagucuggucuugaacuccugggcucaagcaauccgcccgccuuggccucccaaagugcugggauuacagguguaagccaccgcacccagcccugauuuucuauuauaauggauaaaaacuuaauucucuuacaccuucccaucauauucacucuucuauuauacuaacauucuguuaaauaacuauuuugggucaaauaagcauuuauugcuuacauuauuaugacuauguucuuguuauuuacagcugagucaaauguacuauuucuuuucucauaaaaacauuuuucucaaaauuaauaauuuccuugguguuuaaaaaaaguuuccauguaaaauuuaauucuccuucaaguaacuuaaaacuauagauggucuagcaaguccauuguuuucuuggaggauccuuccuagagcccccuaucuuuucauuucauuuuggacuggcugcuuuuaaggccuguaggcaaccuguauccuggacuuuuccuucaacaccauucuuagaacugccuuugccucucuauuggauucuuucauucuuagaucucauguuuuucuccuuguuguuuguuucccuugcuuuggugaagcaugcauaucuuucaguagcuucuugagaagacacaggaaauaacuuucuugagucuugauugauaguuugacuagguuuacaaauuauguacuaucaaauuuuuuuuuuuuuugagacggagucucgcugugucacccaggcuggagugcaguggcacaaucucagcucaaugccaccuccacggugaguuccagugauucuccugccucagccuccugaguagcugggauaacaggcacccaccaccacgcccggcuaauuuuuguauuuuuaguagagaugggauuucaccauguuggcuuggccaggcuggucucgaacuccugaucucgugauccgcccaccucagccucccaaagugcugggauuacagacgugagccacugcgcccggccccagauuuuugaaggcauuauucuauugucuuuuagcuuugacuguuacuguugaauaguccucuacuauucugauuccuaauccuuuguauuuugaucaucuuuuucucuuuggaaucuuguggaaucuuugucaucaaugcuauuccaaaauuucacagugaugugaaaucuugauguggaucuuuuuuccuucauuaugguaggcuccaugugggcccuuucaaucuuuaaacucauguccuucaguucuggcuuaguaugauaacccacacuacccuucagcuguucucgaaaucugaaagccuagccaagcuaucaacuaaucagucuuuuuauuuacucuuacaagaagaguaaacuuuuggcauucuccucaguucuccagaucaagugagucucaugaagacuuuagucuauuuccaacccuaauugcauccuucaacuguagagguucugauaccuguaacuccucagccuuuuaauuuuaguuugaguaguacaacugcuuuuacagcuagaugcaaauauauaacagcucaaacaaaauaguuuauuuuuucuuaaguaacaguauuaguggaaaagucaacaagacagccucuuccauauaguccuuuagagacucaaacuaacaguagcucuucugucuucaacauguggccucugagaagguaaccauaguggucaucuccacuccagccagucagaagaggaaaagaauauagagaaguaugcacaggagauuuuuaugggccaggcauagaaauggugcaugucacuuccacucacauucuauucuguagaacucagucauauggcuaugccuaacuacaaagagggcuaggaaacagucuagguaucuucucaugaggaagaggagaauuuuaaagaggauuuuaaagagcaacuggcagccucugcugcuucagcucucugugaagugaaaugguauaaagcacuuagcuuucucuaguccaggucauuaauugcugcuuuucugccugcuauucagauuccagaauuuugucaacaucuuuuuuuucuucuuuauuguucuuuuuguuuuguggguuuaggacuuauucuuuuacugucauuuuagugaaauuuuggcugaaagcagagguaaauaugcagcuauauuguuacuuaagauauaguauauguagguauaauaaaaugaccagagaaaaacaucucugagguucauauggguuuguuggcuguaaauuuucuauuccugaacuauauuaugaguacuuuuuaauuaucaaagagaaugaaaagaauuauguauauugacauagaaaaugccuuuuuguuuugagacggagucuugcucuguugccugggcuggagugcaguggcgcgaucucggcucaaugcaagcucugccucccggguucaugccauucuccugccucagccucccaaguagcugggacuacaggcgcccaccaccacaccuggcuaauuuuuuguauuuuuaguagagacgggguuucacuguguuagccagaauggucuccaucuccugaccucgugauccacccgccuuggccucccaaagugcugggauuacaggugugagccaccgcaccuggacagaaaaugcuuuuauauauuaaaugaaaauagaaaauuucagaacaguuuuauaguaugauuagucuuuuauauguuuauaaauguauuaauauuuuuugaaagauauauuucuaaauuuaauggucauuauuuguugggagugggacugagaagggcuugagagauuggggagguuuuugcuuuuaauuuuauuuauuuauguauuuguucauuuauuuauuguuuugagauaaagucuugcucuguugcccaggcuggagugcaguggugcgaucuaggcucacugcaaccucggccuccuggguucaagcaauucuccugucucacccucucuaguagcugggauuaaaggugcaugccaccaugccuggccaauuuuuguauuuuuucuuuuaguagagacaggguuuugccauguuggacaggcuggucucgaacuccugagcucaagagauccgccugccucggccuuccaaaguguugggauuacaggugugagccaccgugccuggccuuugcuuuuuauuuuauauauuucagugauacuuaaguauuuuacauugagcauguguuugaaccuuuuuugguuacuaaagaacaaguaaaggaauagucagcagggccaaaugcacuagaaaagucugguaaaauuaaggcugaaaaugucuauuguauuuggaaaucagagguaauuauugguaugggauaagaagugaucucagugaagaaaauaugggauaucagaaaauagaugucaugguuuagucuuuuuuuaaaaagaccauuccagauaaggagggugauuaaaggaggcuguagaguaaaggcagcaggaucugacauuuuguggaggaguuugcuccccaauaucuaggaacuuuuaguauguuuuauaacuuuuggaagaagaauccaguagaaagaggaaaauacagaaaagggaugaauucaagcauaaugauuucagaacuucccucguuugucucaucuguccacuaaugauuagguuccuuugcaagauuaagaacuagauaaaguguuuagcaagaccaauguaggaagacauccccaaacuuuagguaagagggcuuuguuuagguggucuuugaaacuccuuccaaucuucacuucuacaaguccaguuuuaucugaguugguccugguaagcauggauguaacagaaacaaacacccugcuuuaguauggcuugagcuaggaauccauucuuauuggugagagagauucgaaugaaacauuuucauuucuuuugagaagcaaagcauuaucccaguguugcaucacaaaaucugacagaguuagcacuuccucuagcuccuagucaagcuaagaagcucucauuuucuuuacaagugccucucccuccacuuuucccaaagauaccaguuuagaaugugcuuugccaagaaucaguguauuuugggaauccauuucuucaucucacuaggguuacaaugagucauggcugugacugcauucuuccuuaggaaucugaaagguggcagauacacugaagaccuccagugccagccccuccccuugaaagguucuaggcucugggcuucuaagagugacuuccuuccccauagaaugaaagugucaucugguauauguuagauagaaacuuggggugaaacacucuccuuugagggauuuuagguuaaacacucuccuuugagggauuuuaaaugguauuguagccgggacauaagauauuuguguauacaaauuucuccagucaaaggauuucuuuucaagagauaucuuaaacuuucuggaggccacuuugaauagaaacaguggagcaugauuauaucugcccuaggaacucuccuaagcucuaucaaaguguagacuuaaacucacacuucucauucugcuucuuaacauuaggcauccuggcaugcauauaaggucuaauuaaguccccugcuucuuggucagugucuuuccccuucauaccuccacuuuuugggccauugaagggaagggaaauggaugacaagauagggcaggagaaaccaguguuuugaggaccaggggaugccagcaucgaugauucuuguguguucgcucagguuucaaagugugucugcugagaggcuugcucagcaagugugaauuccugucuuuucacccuauccacccaugggugacucaguccacaggacagccagccacuaaggcuucugcaggcugcaucugaaagauaagagagugagacuugacacagaaguaggcagagcuucugaauaccuguguuagcuaaguuucuucagccuaugaaaaugagcugcccuuucuauaaggcagugauuugcugucaccuaggaagauacagagauuacuuacucuagacuaagaccacuuuucccuugaaaugcucuuguaaggggaagaaagguagcaggccuagguuaguccaaaucacaaggguucucaguucucuuaagcccuagaauauuuaucggcccucuccacauuucccagugucauaucuugcauuuucauucauucaggguggccuacugcaaauugguuuaugguaccugcucugacaauaccagugaaguccucacuugaaggaaguauaaauaagaagcaaagauagagcucaguuaugggaggcuccuucauuauuuuuauggcaccugggggacaaugggaaagagggauguggccugucacuaagaagucucugcuuucuaucccucaagcaaccucauaauauucugcagaggcgccucauggaaaccaaccugucuaagcuccgaagcgguccccgugucccuugggccucuaagacgaacaaacucaaucaggcuaagucugaggggcuaaagaagucugaggaggaugacaugauuuugguuucuugccagguaauguucugagaacagcuuuuccaggguuuucuggaaaguaggauguggggcccucuccuccugacuuuauagagugugggucucauggaauucauaagugaguuuuaaaaggggcacuccaugcaacacuggaaguguaugcaacauuuuguaagcaugugcaucuuuaugggaagaaggaacaaagcuuucaucagauuuacaaauggguaugugauuuuuuuaaaaaagauuaagagcuauuugguguauagcaugaaacaccuagaguuuuugggggaucuucugucagcucuggauucagcaggaacaagagccagucaaaggcagacuuagcaguggguaaagaugggacacuauaacccauaauugggaggaugcucuccaacccugccuuucauaugacaucugcugcuugcugucugcaucuccuuucccuuucgcuucucuggcucuuauugaacaguacauuuccuccccacagugugcuggaaaggaugugaaagccuugguugacacaggcugccuauauaaucucaucucuuuggccuguguggacagauugggguaaguaggcacuugugcugaguggaacuuagaugugacuguacucuucgcuugacucuauuuuaugguuagagauggugagggucucuacagcagcucaaagagaaguaugcagaguucagaucucagcuggaaccagaauccuuaguagaggggaggaguaguggguuauccggcaagugggagaaaucagugagcagggaaaccuuuggcuuucuguuaacucccccuauuaaguuuugagcaaagaccucuaaacuugaaugagagagccugagaccucuggcucauugugugcccugcccugauccacuagauagcaaauuaaaaggagcuguccuguugguauacuccauccagaugaguaaaaguagggaugugguggggcuuagcuuacucagagucuuucuggaggaugcauugcagguccccaagaaacauccaucagaacugagaauaggacugcagcugcuacugggccugggccaucauaaggguaauuagccaguaguuucuuuuguuuguuuuguguggcggagccucacuguguugcccaggcuggagugcaguggugcaaucucagcucacugcaaccuccgccuccugggcucaagugauccuccugccucagccucccgaguaacugggacuacgugugcgccacuaugccuagcuaauuuuuuguauuuuuuguagagaggggguuuugccauguugcccaggaugguuuucaacuccugggcucaagcaaucugcccgcuucagccucccaaagugcuagcauuacaggcgugagccacugcacccagcccugagcuuuugugugguaaaaauaugaaguauagugcaacaugaugguuccagaaagacuaacaauguccuggugcauaauuaggcagcagacugccaugauuccagaggaauuaauaaccaucuguaaaacugcaauuauuuuucuuuuggaugggcuauaacaccaaaagagaggaaauagaggaaagcagaaguauuggcacagaaaguucauaauuaaguauuuauccaccaacccauaauagcucgggugcuagcuauuccaaucagcuuauguaacaugugaaaccuugguacuguuucuuuccuuccuccccugcacagacaaguuaaauuaacaaggauuuucuccaugauauuccuugcugauaugaauaucagugcacuuaccaaauaaguacuugccuccauuaacauuauagucuaagacagacugaugaagacagagugaaauagaaaggacaaugagaaaauuacacauugaacaaagcaccuuauaaaauuaggauuaaucugacuucucuaguaucuguuacucacagauggguaaaaggaugugucaacucaauugccucacacaauaguggggauaguaggauacagaauaggauucucugaauauaucaguucuccucucuucaccaauacacauaagugauguaagguuuuugagaacgggagaugagucuuuaguguuuuuauaucucccuggcauguuuaggacaaagugcuggaacaacauauguaggauggcuagcacuuuucgguagauuaaucccaggagaucccuggagaauuccaauuguaggucagaagguaggcauugcaggauucuaccaggaaucucugucaaggggauuuugguaucuuccucuuugguacagacucaaggagcaugucaaaucccacaagcaugaaggagaaaagcuuucucuaccccggcaucucaaaguagugggccagauugagcaccuagugaucacacugggcucccuccgccuggacugcccagcagcugugguugguaagcagaauugagggcuggaccuauggacccuaacggaaacccucucccuacccccaacaaaaccucaugucaucucaugccuguaaauauugacuuuuucaaaaugguucccauuuuuuuguacuguagaccuugucccaauuuuugcucuccaaaguaauagaugggcccugagcuacauucaagacauguugagaaucaaucaguaaaacaaauguggucagauaaaaaaaaaauucggccgggugcggugggucaugccuguaaucccagcacuuugggaggccgaggcgggcggaucacaaggucaggagaucgagaccauccuagcuaacacggugaaaccccaucucuacuaaaaauacaaaaaauuagccaggcgugguggugggcgccuguagucccagcuacucgggaggcuaaggcaggagaauggcgugaaccugggaggcggagcuugcagugagcugagaucgugccacugcacuccagccugggcgacagaacaagacuccgucucaaaaaaaaaaaaaaaaaaaaaaauucaaggagcaagaggccgggcgcaguggcucacgccuguaaucccagcacuuuggggggccaaggcgggcagaucaccugagguugggaguucgagaccagccugaccaacauggagaaaccccgucuguacuaaaaauacaaaauuagccgggacugguggcgcauaccuuuaaucccagcuacuugggaggcugagguaggagaaucgcuuggacccgagaggcagagcuugcagugagcagagaucgcgccauugcacuccagccugggcaacaagagcgaaacuccgucucaaaagaaagaaaaaaaaaaggagcaagaaaacacauuuuuauguauaggugaaaaugucccuugagagcuuuccaugaacuaguuagagacagagagcaacuuacuuacuccuuugccauaaaucccuugauaauuucccaccaguuuccacacuucucuacauuuuacucuugacuacuccaaguucuugguuuuuguguaaaggccuuuguccuuuagaguaaaaaagaccuggguuugaaucuuggcucuauugccuuguaaguuuaaugaucuaggaaaauuacuuaauauaacacaugcucggccaggcgcgguggcucaugccuguaaucccaacacuuugggaggcugaggcggguggaucuccugaggucaggaguucgagagaagccuggccaacauggcaaaacccugucucuacuaaaaauacacaaauuagccaagcgugguggugggugcugguaaucccagcuacuccagaggcugaggcaggagaauugcuugaaccugagaggcagagguugcagugagccgagauugcgccacugcacuccagccugggcaacaagagcgaaacuccaucucaaaaaauaaaaaaaaaauaaaaaaaaaauaacacaugcucaauauauguuuauuggauguuauuggauggauggauggaaccuaauagugauuaggccaacuucuaagcaagcauggaaauggcuaaaucuuaaucauuuuuuuguuuuuauuagaugacaaugagaaaaacuugucccuuggucuacagacucuccgaucucugaagguaagauugacuccacuuaccccuugauacuuccucucugaggcagguauccucuuacacaggaacucauagugguaucacugacaaguuaccuguuuucagugcaucauaaacuuggauaagcaccggcugaucauggggaagacagacaaggaagaaaucccuuuuguggagacagucucuuugaaugaagacaagugagugcccaaaugggucagaucaagucacauccauuugucaucagcugcgagcagggugguggugguucucagacaggacaugggguuguauccugucuuuggcuuucaauuauacuacaaauccacccuuccccacacccagaguucaucaccccacaaaacucuguagugcacacaucagaaugagcaauggugaugccacacagagugguagggaaaugacuagcuuugaaagcaaaauuuuacuugccuucagcuuaacuuuuuuugaauuuggcauuauuucuccugauauuuauuucucauuucagcacuucagaagcauaacuacagccugcagcaugucugcacgugugcaugcauacacaccggguugacagauagagaaaacuggguuugaaccaaaugccguagugacuugcuguggaccaaguccuuccaucuaauagaagcuccaggggcuccuucccauucagaccucucuagacuauagucuaugcuuagagaucuugucugguuauggccauuguuuuuuacuacuuugaucacuuaacuuauagaccuuuuuugacacugccagucucacuuguggccuauuucucugcuucuuccaggaauuugcuuuuauuagucaaguauaggggcugccagguucugugucuccauagauauaugugcuucuuuuccuauagcuaaauguauaauaaacaggaaccugaccuuuaccuccuuucagcuguuucaaacaggugccaggauaccuaugucuuagaauuagaguuucuucaaauugauucauugauuucucaaguauggauuaugugaaagagcccagggacauuauccauuacaguuuaacucuuucauuuaaagguccagagaggcaagugaauugucuaaguucauauauuaggucagugacugaagggaccaagaacgcagaccugauuuccaagccaagacucccaugcugccucauuuguauucaagccuuuaacaggagggcaaagaggugagaauguguuaaaaaaaaaaaaaaaaaggcagagcaugggaggaauauucucuggagauggaugcuaggaugauuuggguagcucucccuccugugugccaagcccaguaaaaguuccuugccccaaacugucacauuuaggcccucaucuuggugccuaaaaacgagcguacaaagaugaaugaaaugguuucucacugugaaccucuuggaggaaaggaggaaccacagacagaggaauauuaaucccucucugauauggaauugaaggcuuaaguaaaucagagugucacugucagacguugauuacucccaagauccgaucagcauuucugcccauccuauuaugugucugucaaggacugaaguagcuggaaaccaggaguagagaaagauggggggaaaaaaagagcaaggccagaauagaagggaguagacugaguagaaucaguugguggagaggccuaucuagauaaaccuuucugggaggcagggaaugacauuuucaggcagggaauugagauguucaguucuguccugauacaaggaaagaggcagagcaggagccggcaauguuaaggacaacuuuuuauaacugcccaguauuuccugaccccugucaaagguuggggagaauacaagguuucuugaagcuuuuugacuggggugucacauuaggcacacaggugucuauaauggaaucuccccuucaguuuggucauagaagugcuuggacaagucagaaaaauagcuagcuguggguaucccuuuaagauauucccaagucuacccugugucauagcaguaguucucagaguguuuguuuaaaggaucccacuuugaacuuugccaaguacuaccaacuaccuugucugguguucagcaacugccccuacugaacagcccuuuggaacucugaaugauuugggccucacagaagcucccuaaagccuaggaacuuggugacuaucauuugaacaacuaggcagccauacugcagucaguugucauggggucauucccuaggcccccuuccuaucagccucuaccuaaagaagcuagauaggaagcuaagcacagccaugguugggaggcuauaucuaaagcucaugaggggugaucccgggguuaccagccuucagcacucccucuagcaacaccccauucucuuaccuagcggggauuuguaccuuuccacugaggccucuccaugcuccuucccuaccuuucauggcaauacuuuggccugccucuuauccugguacuaaguugaaguaaagcucacccuuuacuucccuacuugaaaguucuacucugagccuugacucuuagccacagugaggcauguugaagguuccugcugguuuauucuuuuuuuuuuuuuuuuuuuagacagagucucacucuguugcccaggcuggagugcaguggcacgaucucgguucacugcaagcuccgccucccggguucaugccauucuccugccucagccucccaaguagcugggacuacaggcaccugccaccacgccuggcuaauuuuuuguauuuuuaguagagacggguuucaccguguuagcuaggauggucucgaucuccugaccuugugguccgcccaccucagccucccaaagugcugggauuacaggcgugagccaccgcacccggccuucauucacuuucuuuaaaugccuccaaguugauuauucuccuagcucauaucuccuugaugugcaugagggagcacugggucuaauuuuugggggcugagaagguaagaaggugaggucaguuuuucccaggaguccuaaaaaauucugguaccuuacauugagggugugggagaaagggugucauaguucugaaaauaggcaguagcaugaagcaccagaccugucucauuccuuauuagaugucuaucucaaauaacagaguuugaaaaauauugguuuuaucauuugauauuuccaugccugacucgggaaaauaacauuuucugacuucuuucuauuuucuugcccugcacagacccuaccugguacaauuuucuauuucuuagcucaaagugucuauacaauggguugccugguaugucagcugcccucacucuuguguaauagaaauauauugccaggcuggggacguggaggagacgaacuggauuccucccuccuccuguugccaggccucucugcauuggcacuuuauccuuucaguguuucuggcuguguuggguucauuugugagacugauguaacaauaaagugaaaucuuccccucug

SEQ ID NO: 191795 - RNA, 15080 nt, Homo sapiens
auguaacugaacaaugggccucgucuggaacuucaucuuacaaaggggccgaucggcccguccggguggccaaggauuugccgcccguugaguccgggccgccccgagcgugucagccccgagugcggcaccgauaacgcgguucgcgaggaugcuggagggugccggcccggccaccugacacucccgagccauaggaugccuuuuaaacgcggcgaucgggccuguaauuugggcggcgcgggcagaaggaguuuaaagaaaaauaauugucccgcccugaucgugucgugucguguggcguggaugggggaaaggucuggggcaugcagggagacuacgcuuggacuugggaguaaaggcuggccuuccaagcauuuacaguccuacagacucauccuaaguccaggcaguacugaggccuguuucuggacaaggucuuggcccagcauuuguuuuuaucguggguuugcggugcccagaguuuggccggccuccgugugauuaggaacauccuaccguagauaagguaucuuaaagaaggagguguucagcaccuguguuuugaaaggccuucgaguacugcgcagaugaccacuuuuaaaacugcagauuuuaaagcugauacuuccagagauuaagacaagccucgcauuuguaagguuaacagggaagaugcaccuuuuaaagugaguuuguuuuguuuucaauguacuguuugucaucagccuaggcaaucugugugcuuucgagcuguacuguuuauuggccgacuugcucaaggcaaaaucccucuggaagugaggggaggaguccagcggagguggcuauggaagcccuaucuagaugggggaggggagauuuuauggggcucucggacugcuuucuauuuuuggauggguugaaagaauuuguuaacuuuuagccacuagaaugaacuuaguuuuaggcagcauuuauauucuuuuuaggguuagaggcagauuuuacuuggcuauuuuuuucaagaaaagauaguuaauauccagcuucagucuuccuaaauuagccacaauuuauuuugcuugaacucuaacaaaggcuuguguguugcuuucaccuacgcauucagcccuaugaaaggcucguugaagguuagguugagaaggcugacuauaggacuuggauccuaaaaauuguauuuguauuuuucuuucccuagaguuugcucuccaaagcucggggaauugauuccagcucuguuaaacuccgggguaguucucucuucauggauacagaaaaaucaggaaaaagggaauuugaugugcgacagacuccucaagugaauauuaauccuuuuacuccggauucuuuguugcuucauuccucaggacagugucgucguagaaagagaacguauuggaaugaguaagucguuuauuuaacaguuugguucuccaaauaaccuaagauugguuugguauacuuaucaaaauuuaguuccuauuuaauggcauggauguaucugucagauauauugauagaaaaauaacauuuuuuuuaguuccuguggugaagacauggaagccagugauuaugagcuugaagaugaaacaagaccugcuaagguaaauagcuuuuuauuuuuauuuuuuugaaauuuacuuuucugccacuuaaagcaugcuaugaauauguuaauaagcauuaacacauaagguagaaugguuuuuaaauuucacacauagcccuaucaccauagcaagaaauaacuguuuucguauauuuguauuacauauauggaaacacuuuuuauuacagagaauuacaauuacugaaagcaauaugaagucccgguauacaacagaauuucaugagcuagagaaaaucggcucuggagaauuugguucuguauuuaagugugugaagaggcuggauggaugcauuuaugccauuaagcgaucaaaaaagccauuggcgggcucuguugaugaguauguauuaaacauuuugucuuuugcucuuuuguccccuaugguguuacuaacauuaagguuucagcuggucaaacacugaauuccaucucuaacuuuugagaagcuguaaugauuuaaucagguccuuuucacuuaauaccaucaguucuuauuggacuuguugaauaauaugagucugauuuuggaaccuaacuuaaauuucuuauuucuagucagcauccaugaauucacaguaaaauggaguuuauucuuaccugaguccuagggcaagcaacauuucuucuuucugauaaaucuuuaauggaaucugccuuuggaaaaaucucuuacaagucuaaaccccuucucucuuaagcaaguugcuuuuuagcauaacaauagauaccaaaaauuuauuguaugaaguuucagauaaauuaauucaguuuaagcuugagugaaaauuauuuaccauucuauuaaucucaaauuucuucuaggcagaacgcuuugagagaaguauaugcucaugcagugcuuggacagcauucucauguaguucgauauuucucugcgugggcagaagaugaucauaugcuuauacagaaugaauauuguaauggugagugauguaaugguuuucuugugagcuugagaaaaugaacaucgaggaaauauuuaugguuaucuaaaaucuugcucuauuucugucacuuuuaucuuuuauaaauuuaaagaucagagaccuaacauaaauuucaaguacaagguuaaaaaccuuguccuuucugaagcaccuuguacauaucucaguaguagaacuucgcauacuauuuaugugcuugucgcuccaacugagcuuuuugacaagacuauggccucgacacauauauuuugguguccguaguaccuagcguagugugugaagcauauaguauuaugaaguguuaaguugaauagauucuuccugugucuggucuuugauuuccauuucaugugaggugcugcuaaaacugauguuuguuagucacugagucucuguugaucuaaauucagcuguuucuuuaagcauucuguaguccggcccuacucccacguauccaaccuagucuacccuagaauccacuaacgcuuuauuauguuacauucuuuuaguucucuagcuugucgucucucccuccucuccccuaaggaugaaacaaaacaggcauguauagauucaaguuuggaugucuuguauagcuuucaguuucgguaaguccuucaagggccgacuuaugucucuccuuuucuauuaaaaaccuuuaccaaagucuuggucagaauucugguucuuauggacgucugucauuauuauauaccaaaucuuuuauggauuauuucucaacacuuuuguaguuuauaagugugaugauuggguuuucauacucaagugugaaaugugccucccucaaaccuuguuacgacaucagcacauuaccagucugaaaugaaaaauaucuguaguuuguuucuauuucuguauaucuucugugaauauagacaauuuagaguuuagugaacacuugagaggagauaacaaaauuuauuuuuguugauucuuauuauuccuuaaauaaacaagaccaguuaucucauaacuuguaaauaaauaagugguguagguauggauucagguuccccauauuuaaaaacagugaacaaaacagaaguaaaagauccauuuuucaaaccugauuccucauuauuuaauaaaguucuccacacuugaaagaacuugagugucuaguauacagccuugcugcuaguuuuuuucacacagcucuugaaauguuucuauucauaccaucaaaauauuuauguaacuaucacaaccuuauggauuauucuauuucuuaaccuucauuuuucagguauugcauuuaaccuagaacaacuugaccacaaugucgucuccauuugauauuuguuagacaccaucucuuuucaguuuccuucuuucucuuucucaccuucuugaugugaauaauucucuuaacagaauaguucauuaguaguccaggaaugucaaauauguagcaaccuaccaauacaugguuguguaaaucagaugauucugagaaaacucacgugggccugggagauagggaacugagugaguagucuugcuacccucucagauuacaaaaaccuuguccuguaauguuagauuauaaaauaaucuauugaaaauaaguuuuuauuuauuuauuuauuuauuuauuuauuuauuuauuuauuuuugagacagagccuugcucugucgcccaggcuggagugcaguggcgcaaucucugcucacugcaaccuuugccuccaggguucaagcgauucuccugccucagccuuuugaguagcugggauuacagaugcgcgccaccacucccagcuaauuuuuguauuuuuaguagagaugggguuucaccauguuggccaggcuggucuugaacccugaccucgugauccaccugccucggccucuuaaagcaauauaaaacucuugaagaaaauaaauaguccugcaugaaacaggacugccucuuuguguggcuauuuguccuacuuagauaaaagaaaauacgacuaucuggaugcauuugugaucucuuuuguuuccuguguccaccguuccucucuccacauaaagcuuugaauauaccaauagggcucaucuucacaucuuuuccacaguuucacuggaaaaggauucugauauuuauuuguacaugaguaacugauucccuuuauugugauuuaauuuccuuauuaucuuauucauuugcauuauaagccuuuuaucuugguuuggugauagauuggaauuaaccuguauaaacaaguguagaaaaauauugauggauagggaaagagaaccugaaaugucagaaccuguuuugcucucaucaccuuucuugcccuucuagcaauaagagaagaaaugggcacagcuaugguugcuggaccugcuaaaaaagagaauuagccauauucuuucuuagcacauuugaucuaggacuuagccuaucuugucugacagcguuauugguuugcucccuucuagagcacucuuuccccucccucaguucaagauuuguacaaguaaggagaacauacuuaagacuaagauaccgagauguauaauuuauuuuaaaaacacauuugacguuauguuauuuucuuauuuaaauuauaggaccuccuuuucugacuaauacaucauugaccuuccuaauuuuaguacccagcucugauuuuuuuauuccuaagccuuaaacaggagauauuuaaaacaauuccucauugccuuugagaugaaauacaaacuuuaaaaguuugaaaaaauauaaacaaauuaacugauugauuuaacuaauucuauaaaagcagguuauggucucauucauaguaagaguaguauaaauuauaacuauacuaaaauacugucuuuuuaccuauaacauuuauagacuugucaaggguauggggaaacagguaugcucaugcauugacaaugggcauauauauugguacagccuucucuguggagaagaguguguguguguguguguguguguguguaaaacacaccaucuccauauauuacaaaugugcauacccuuuaacccagcaauuuggcuucuaggugauauacuaaauguacgugaaauuaccaauguacaagguuauuuauuaggccauaguauguaauagcaaaggcuuggaaauaauuuuaaaauguccaucaaaugagggacugauaaaugcauuucuuucuuucuuucuuuuuuuuuuuuuuuuucgggggacugagucucacucugccaccaggcuggagugcaauggcccgauaucggcucacugcaaccuccgccucccagguucaagcaauucuccugccuucugaguagcugggauuacaggugcacgccaccacacccagcuaauuuuuguauuuuuaguagaaacgggguuucgccauguuggccugcauggucucgaacuccugaccucgugaucuaccugccucggccucccauagugcugggauuacaggcgugagccacugugcccagccaauaaaugcauuucuacucaauuauacaauggaauucuauaaagacaagaagaaauggguugucuuuguauauugguauagagugaucuuuaagauaaugaacauaugcuguuauuuaugcaaaaaguugaaaagaauacauagaccugagcugggcgugguggcagugccuguagucccagcugcuugggagucugaagcagggaauuugaauuuggguuugggaauucuaggcuguagugccgaucuauguugagcaucuaugccgaucuaugccgaucuaaguugagcaucaguauggugaccucuguggaguggggcaccaccagguugccuaaagagggguaaacuggccuaaguuggaaacagcacaagucaaaacuccuaugcugauaaguagugggaucaagccugugaauagccacuggauuccagcugggcaacauagauagacccugucucuuauaaauuaaaaacaaaaacaaacaaaaaaaaagccaaccugauaauacugguuuacucugagaaagaaacagguggauugcugagguguaugauugagagagagacuuuacauuuuauuuuguacccaugcaaauguauuaccuauugaaaaaacaauaaaauuuugauuucacaagcagguugaagggagaagguccuauaaaauaacacuuucuugguugagauugguugguugagacucauuugguaaagauggaagaaagaaaauauuucagaaagaagaaaaugcuaauauuuucuaucuuuguuagguggaaguuuagcugaugcuauaagugaaaacuacagaaucaugaguuacuuuaaagaagcagaguugaaggaucuccuuuugcaaguuggccgaggcuugagguauauucauucaaugucuuugguucacauggauauaaaaccuaguaaguauugcagaucuucugaccuguguucuuugggguuauagagaauaaauuacuucauuaugacaacauugaaaaaauauauaucuucuguuuucucauuguuaguuuuaaaaggccuuagauccacuuaccaauauuguuuuaugauuucuauucaucucuucccuuguuaauccccaaaauuugagauaaacuuuuuugagacagugucucauucuguggcccaggccggaaugcaguggcaccaucuccgcucacugcaacuuccccaucccgugcucaagcagucaucccaccucagucuuccgaguagccgggacuauaggcaugugccaccaugcccagauaaauucauuuuuauuaaaagccagaaauuuuugcugcaucuuacaggaacuacaggugggauacuaaugagggcacuaaaaaucuguguuuaaagccccacucuuccacuaggccagaccauauuaaaauuuccccaguugacucaaguccuuaauaguugauuuguucaaauuaguaucuacuuaaggaucaugcauugcaucugguuauaucaguuuuucuuuuucagaacccauccucugcuuuguaaaaauaauauacacuuaucuugcaagcuaucccuuuuucuggauuugacuaguugcuucuuguaucauuuagcuuguuccuuuuucuccuauauuuccuauaaauuggaaguuauaacuaaggauuauggauucaaguuaagcaucuuaggcuagaugaauuuagugagguuuuauuaaucuuuggaaaccuguugauuugugagaauuucagucauuuuguacaacuuuaugaguuauaugcuagaauuucauaugcguauguuaacaagucacuaaaguuucuucuuucuuuuuuucuuuuuuugagauggagucucgcucuguugcccaggcuggagugcaguggcacagucucagcucucuguaaccucugccucccacguucaagcgauucuccugccuccgccucccgaguagcugggauuacaggcauacaccaccaugcccggcuaauuuuuuguauuuuuaguagagacggguuucaccauguuggcuaagcuggucuugaacuauugaccuugugaucugcccaccauggccucccaaagugcugagauuacaggcguaagccaccgugcccagcauguuuuuuauuuucaaaagacaaaaauauauuuggauuuaaggcaguaaaugugaauucuuaaggaauagcuguacucauauaaaguguuagacaaauauaauagacccuuauaagguauaaaaguugaaaauauuaagggaugugaaguuuaaaaaucuucaaauuuagaccaggugcaguggcugacgccuguaaucccagcacucuggcaggccaaggcaggcagaucacgaggcaggaguucgagaccagccuggccaauaugaugaaaccccgucucuacuaaaauuacaaaaauuagccagguguaguggugcgcaccuauaguccuaguuacucgggaggcugaggcagaagaauugcuugaacccgggaggcggagguugcagugagccgagauugcaccauugcacuccauccuaggcaacaaagugagacuccgucucaaaaaaagaaaaaaaaaauucgccgggcguggugccucacgccuguaaucccagcacuuugggaggcugaggcggguggauugccuaagcuugggaguucaccaccagccuggacaacacggugaaaccucgucucuacuaaaauacaaaaaauuagcugggugugguggcaggcaccuguagucccagcuacucuggaggcugaggcaggagaauugcuugaacccgggaggaggaaguugaagugagcugagaucgcaccacugcacuccagccugggcgacagagcgagacugucucaaaaaaaaaaaaaaaaaaccuuccaauuuacaaauaccaucacaaaauaaguuguccuauaaagaaaguaaaacguauagaugacuccaguaaauguaacauaaauuuaauacuaaauauuugugcgugugugugcgugcacgcgcgcgcacacacacacacacacacacacacacacacacacacacacauauauauauauauauauauauauauauauauauauauauauauacuuuuuuuuuucuuuugagacagggucuugcucuguugcccaggcuggagugcaguagugcgaucucggcucacugcaaccucugccuccuggguucaagcgauucuccugccucagccucccuaguggcugguauuacaggcgugcaccaccaugccuaguuaauuuuuguauuuuuaguagagaugggguuuugucaugcuggccaugcuggucuugaacuucugaccucaagugauccgcccaccuuggccucccaaagugcugggauuacaggugugagccaccacucccggccuuauuuuuuagagauagucucacucuguugcccaggcuagaaugcaguggugcaauuauagcucacugcagcuuugaauuccugggcucaaaugaaccuccugccucagacucacaaguagcugggacuacaggcaugcaccaccauucccagcuauuuuaauuuuuuucuuuuucuuuuuguagagacagggucucacuaucuugcccaggcuggucucgaauuccaagucuuagguaauccuccuaccucagccuuucaaagcacugggauuacaggcuugagccaccauaccuggccaauacuauacugauaaaacuauuaaaauagaaucugccacuaaaagcucauguuaauuaugaucuuaccugaauuugaagaaaaaagguaauguguauacaauaggaaauagugaaucacaaagccauauugcaagguagaugcuauauggucagccagacucacuggcuaaaugacucauucugcucacaccagccuuauagcgcuacauuaaaacuugugcuuucacagaauuucacaaauuacugauacuaccuuuuuugcugaaggguaaugugcuagaagacaagggccucauccaguuuaaaguguuuaggaucagugcuaggcuggaaaauauauucccagaggcccagagugguggcucaugccuguaaucccagcacuuugggaggcugaagcuggaggaucacuugaggccaggaguuugaucagccuggccaacauagugaaaccccgucucuacuaaaaauauaaaaguuagcuagauguggcaugugccuguagucccagcuacucaggagguugaaugaagcaugagaauugcuugaaccuuguugcagugagccaagaucaugccacugcacuccagcuugggugacagagcacacugucucaaaaaaaaacaaaaaaaauucccagcaacuauaacccugguuucuguccccugagaugcuuauuccauggguuugggcuagaacuugagaaucggcauuuuaaaaagcauuauggaugauucugguauaugaucuuguuuaugaacucugguuuuauuauuauuaguuuggcuuacauaauuaacuguuugacagguaauauuuucauaucucgaaccucaaucccaaaugcugccucugaagaaggagacgaagaugauugggcauccaacaaaguuauguuuaaaauagguaagaaagguaaucagauuauuaccuucagauaaagagaaggcuguuuuguuuuugcucuucacuguaaguuuuucaauacuucuaggugaucuugggcauguaacaaggaucuccaguccacaaguugaagagggcgauagucguuuucuugcaaaugaaguuuuacaggagguaauuuuucuucucccuuaaucauaguuugcuuuguaacacuuagcaguugauagaagaauauaaauucagauauauuaaacuuugaaguuaacuaauagaauggaaauaaaaucuaaaccgucaucugagggcauuuaauaagcaaaaagucaugaaggcaaagauuuauaauggaguugucguaaaaaauauguucucauacaccacugguggaacuuuauaauggcauauccuuuuuggagaucagaguauuaguauugcauuaauauuuaaaaaucauguacccauugacucauaauuuucacuucuaggaguuuuuccuauagaacuauucauauacaaauacaaguugagaacaguguaaauaaguguuuacuaauaagagaaugauuaaguaaauuauggcacauaguuauuaguauggccuauaguuucaaaagagugugacaguauuucuugauaaaaauuuugaaugaaaauagaauaaguagaaaaauauaaaguguaauugucugaucccauugcucuuuguaaauauguguauauauauguuugcuuuaucacguauauguguauuuguaacuugucaguguguuucuacguguuuuguguuugcauaugaaugccuagagguagagggauuucuuuugagaguugaauugggcuguugauaaagaagaggcauuuacucuuaucuauguguuugcauuuuucccccaagaguguguauuacuuuguaauuuaaaaaauaaacauccucaaauuuagcaguuuauucucugaauaggucccaaacuuaaaugugguauuagacacuuugauuaaguccuauuuuucaccuaagucaucuuugagguguaaucuuguuuuauuuugaccauguuuacauuccuuuaaaaaauuguuuuaauuuuacagaauuauacccaucuaccaaaagcagauauuuuugcgcuugcccucacagugguaugugcugcuggugcugaaccucuuccgagaaauggagaucaauggcaugaaaucagacaggguagauuaccucggauaccacaagugcuuucccaagaauuuacagaguugcuaaaagugagcauuuuauauaugaagcccuuuauugacaugguucuauauuuuauuaaaugcaugucuuuaccuucauuuuacuuuucuuuuuaagguuaugauucauccagauccagagagaagaccuucagcaauggcacugguaaagcauucaguauugcuguccgcuucuagaaagagugcagaacaauuacgaauagaauugaaugccgaaaaguucaaaaauucacuuuuacaaaaguaagugaggguuuuauguuuucuuuuugcuuuuucauucacuuuaauucucaaauuuuaaugagagaugauuuaagcuuucugucaacaaaggauguagugguuuuuuguguuuuuuguuuuuugagacagggucucacugucaucaggcuggagugcacuggugcuaucaugacucauugcaaccuccaccuccugggcucaagcuauccucccgugucagccuccugaguagcugagccacagaugcaugccacaacacccagcuaauuuuuauauuuuuuguagagaugggguuuuugccauguugcccaggcuggucuugaacuccugggcucaaaccauccaccugucuuggccucccaaagugcugggauuauaggagugagccaccucacccggcuccaguaguucgauauguuguuauacggugaaagcuuggggacuucugccaugaauuaguauuuggccuauuaaauuuguguuguuucuaaacuuucaaauuacgaacuuuaaaaauguugagacuaacauauauuugcaaguggugauaguccccaagccauaaaugguaguaaaagcuaagcgagccuauaccaaucuuuucuucccagacucucaccaaaaguuaacguuguccuugaaacauucuguucuuauuuuaugaaaggaugaaauuaaugucaauuugguuaggagaugauucucauauauauguuuuuaauuucuggcuaaaucuuuauauacugaaugaagauucucauauuggacuuaaugacuugauauuuucaaaaagcugguugcaaugguaaagguuauuaaaaagagaauauuggagaauauuaaguuaccacagaucacauuucuaauucuuuugauuuauugcagccauuuugcuuuuaaccuaauaaaacugacuugaaaagguuauguuaacaauuaauauuaacauuuaauauuuaaauuauaagaauuguauauuaagagguuuacuugccacuaguuugauauccaucauaguucauacaaauaggaaauaaaguguuccuuucaucucucuuauguaaggauagauucgcaauauaaauuggaguuuuugaaauuauuauuuauuuuuaauuuuuuuuuuauuggggauagguuugucuggaaauuguuuauuauuauuuauuuaaaaagauggggucuugcucugucacccaggcuggagugcaguggcacuaucauagcucacugcagccucaaacuccugggcccaagcgauccuccagccucagcuucccgaguagcugagacuacaggugugagucaccacauccagcucaaauuauuuuauaagaaccaaagucauuacuagcaucuuuacuacuuguuuucaaguaugugugauacuguaauucaaaaagcauaaaauaaaauaauuucauaaauuuaaguuguuuuaauagaagcuucaguuuccuguuuuauuuuucaauuacaucuuagaauaaugauggcaugcaaauaucucccaaucgacaauauaguuuguguuaguuucuuagaaucucuuccuaggaauaauaccuuguuuucuauuuuuaugucagagaacucaagaaagcacagauggcaaaagcugcagcugaggaaagagcacucuucacugaccggauggccacuagguccaccacccagaguaauagaacaucucgacuuauuggaaagaaaaugaaccgcucugucagccuuacuauauacugagcuacuccuuucccaccucccccugaacacugugacaagaggaagcuagguugaaaucacugauagaauccaguuugcaauuacuuucucgauuggugucaguaguuuuacugauuaggacuuuuauugugaauuacaguugaaagcuguauuuugaugauugcuaugucaggcuuucaucuaaucuuaccagucugucuucuguaggaugugucacuguuggauguuacaccagccuuuccaggguuaaccacugugguggugugcugcuuauaguuugcuguugcauuguaauaaaaggugucuuucccuguagugaccuguaaaaaguacucaagggcuuuauuacagacauacccucccuuugaaaagggacaugcuaaaagacucauuacuacucagccuucaauguaccuguguguccaucuuauauuucuuuuuuuuuuaauugugaauuagacuuguauaucccacugggagcacuuuguaggcauugcaugaaccaugggaugaugauucuguggagguauugccuugugaauuugcugcuauuuuaguuuugucuuugcuguaaacuuguagcauuaaacaaucauuguuguuaauaggucuucuuuuugaaacaauuaugugaaauguauagcugcuuuugaugaaaagcagcuauuugccuuuuuuuuuuuuuccuuugaacuuugaagcuagugcauuggaaaaaugcacccuuucccuccuuuggaaugcuguauuaauguaguauaauaauuacugguuuuguaacuuguucugguaauguccuucccggacucuuuuuaaaugucucccccuaaguuuuauacuugauuguauuauuagucuguuuuuaaauguuuugcccgguuuuucucuucaauauuuguguauauaaaccgaucuucgugauacuguacauagcuguuugaaaugccagaaugacuucugacauuccaaguuuuucacaaaauauauuuuaucugugauuagccauuugacuaauaauacuggcuaacagauguugaaaaaaauugucuguuuguuuucucauuaauuuuggucuaaaacauguuugcacuugucuuugacuuguguuuuauuaacauugauuggcauauuaaaagucacucugagcuuaccuuaauugucuaa

SEQ ID NO: 191796 - RNA, 11990 nt, Homo sapiens
ucacuacaucaaguaucacaauguuuauugauagauacaaguauauaaaaucagggcaugaacaugacuugauaaauuaaguagacuuaauuucaauacuauaauaggagggaccaauucaaauucucaccauuuguuucacacccacaaaaaccacuucaagggcauuaacgaucucucaaaacugaucaguuuugugcaaguaaaccauguuucuuuuaaaaagacuugugcacuugcccaggcucaaggauauuaaaaucuagcacauaaagcccauuacuagagguagaaauacaggcaauauacuauuacggcaacaaccaucaauuacaguuaagaauuuuucuguaacaaccaaauggauaaucaaauauugcaacaacucaaguauuacugagcaaagugcauuucuacaguauucaguguugcuauucaguuuucuaacuuaaaacagccuaugauaacuggcagcaaagaagguccuugcaauagacugccucugcuugagaacuuaugauguaauuauugcaugcugcuaauauacuaucuaaacauuaaagauacuccuaaaauauuugaugguagacuaugauuaagacauuacacuacaaaaaaaccuuaugcagaaggaaauccuaacugacgugcuucugcuuuaaauauugugaaaacauuacagcggaaugaauuuucgcagugguuaggucaaaugcaguuacaucauagcaacaguauguuuugcacaauuuaaggcuuuggcugguucuuuagucagcuucuuccucugauucuucuucuucagcaguuucuaaccagguuagccacugauucaccuauaaauuaagauuuguaaauuaaaauaguucaugauauaaacagaaauccauccaaaaaguuuuaggugguacuacacaguuuuagaauaugaaacaaggauaucccuaccaacaauuuguauauuaaguuaacgaacagugguauauuauccagauuugggacaacacagagcuaaagauuuaauccugcaaggaugauccucgugaaucuuguuuaucaucagcaauaaaaagguaggaagaugcugcaggaccaauguuucucaagccugggcccccuggaaaacuaguagcaugagaaagaaucaccuggauuuuguaccacagaccuacuaaaccagaaucucuaggaauaggccuggaaccugcuuuuuaaacugcucuucaggugauuugagagaaugcccugauguucuuccccuagggcuacaaguucauucaauaagaaaaaaucaaauugugagaaaucagaaacaucuccucuuuuuagaaaaauauauaguauuuaaacuuuuuuucuuuuuuugagacacagucucacucuguugcccagacuagagugcaguggugugaucucagcucacugcaaccucugccuccugggcucaagacauccucccgaguagcugggaccaggaccacagaacaugucaccacgucuggcuaauuuuuuguauuuuuuagagacaggguuucacuaugcugcccaggcuggucuugaacuccugagcucaagugauccucccaccucagccucuuaaagugcuaggauuacaggcaugagccacgugcccagcuacaauuuccucuuuacugauguuuuuaaaaaagcuuaaaucgaaacuuguacagucacucccauguauauaaguagcuauacuccuugaaaaguuagcuaccucuaacaucuuauacaccacuagaauugauucauuguguagcuuuacuuaauaauagcuucaaauagugcagaaugaaauguacaggugaagacaaacuacuaacuaggacuaccuugccuguauuucaguugaaaaaggcucuuaacuugaaguuaauaccaagcaaacugaaguaagcagaccaaauuuuuaacaaaagacuuaccuggaacaaagccuugccuuuucccggaaacucuuggguuauaucuucuuuccaagccaagaaagcuucuucuucaauaauuuccaugucauagaagugcacaaaaaagcgaaguaacaugccuuaaaaaaaaaaaaaaaaagaaaaaaguaauaagcccauuauuuaguguucuguuuaagaacuuccucacgccguucuucugauacaaguccucucaccuuuugggaaguugcuguuauagcagugcaccuggagagcauacagggcacugacuuguagaucaacgugaucaugaagaaauuucugcauuacuggcuugaaagauaguaguaguuguuuuuccugcucuaacuguucuuuggaaggagcagaggaugaaucuguuucaucgcuggggggguuuacuucacuagaaauguacuguaagaagcuggacagaaagaggucuuguuagaacccaacagugaguuuucuugcucaagagacaacucuuagucuccuacgcuucuuuuccaguacaugaaacauuaccauaugcagaaaaccauucgucuuaccuagucauuaagauguucacaaauccuuuaucuacaugaaguuugggagagauguuaucuuuaauccauuuauauaugguuugaggggauggauccaacuuuauuugcuucaacaguuccuucuccaauuugaggagugggaauaagaaacucagucccuuuccuuccaaaaucuccaacaugcgguccuuauucugaucaauuucugaagagacaaagccaccugcaucaucuaauaguucauuuuaccaaguuguccuguccagagagcagagcuucacaaaugauguccccaaguauguaagauccauguagcagaauagagaaccaacccagcaaaugaaaaaaacucaacauacggaucaaaugaaaguaguuaaauuauaaaucucucuuuauaggugagaucugugguaauguuuaucauuaucugagcaggacaaucagacugucugaccuacauaaauccacucaagguaccugaaaucucuagauauaauauuaaaaaaacaaaacaaacaagucagcauucucuuaccugggagcauuuucugcauauugaccuugcuuuguugaaaaaguucuguuaaccauucucgaucuuguaauuuagcuaacugcugaagacaaaguaggaagagaggaaaaugggugccacuuucuagugguugagcuaguucugaaaugcucaccagcucugaaaugauggcacgagcugcaaacugugcuaaauaggauuucaccaaagggaugucaaccuccaguuugggacacugguccaauacauucaggaaagccuugaaagaaauauacaacaguuuaucaguuuucgaauuugagugguaagaguucuuaccacacaaucaguaaaguguccuaccugcaugaaguugucacuuguggcuaucccuuccuguuugaguaaacugaucaaagaacuugcuuuuucuuuaucuucaucgcuucuaucuagugacaggaugauuacuuugcuuaacaucucaggaagaaaguguuuaggagcccucauuucucuuacaccauugacagccucauuugcauuuccacuauuuagauauucagucacaacaguuuccugugaagaacacaaguaucuuuaauguauucucuaucucaaauacaggcuaauuacacuaaaaugggauauuugaaacuuacaguuaguuuaaggaguucuuccuuugacggugguggcuuuuugcuggucuuggcaggcuuuuccuggauaagcgguggauuaguuuugagaccaagcugaggugucuaaaaaacaagcaaugacagacuuuuuuuaaaaagaggacuaugaaauuagggggaagaacacacuaaauuuagaaaaaagucuucagauaucuuuagaaaaugcuguccuacuauggucuguaccugucccagaggugguguuugagugcguggugguugugcacuaggaggaaucauaguuaucuggggcugaagcuuuggcacuugauuuuuauucauuaggaacgacugagcaggccucaggcuaaucuggaauugaaaacaaaauauaucuaaauuaacaacaugcaguuggcgaacauauuaaauacaacauucuaaaauccuauacagugacagaaucuagggaaacauuaagcuuuuugaaaaacuaaagaagguacuccacauuaacagguuuaauuuuuggcaaaaaauuuaaagaucugaugcauacaguaguaagauacuauuauaaaucuuacauucucuuagaauuagcaugacuaaaauauucaaauaaaaaacugcaaauuuaacuacaguuuagaaaaugcccuguuuuauccuuaguuaaaucacccuuacaaagaaagaaaccacaauauuuugacaaccaguuuucuugcucuaacagacuuuaggagacuugcccucauaucucauaaucuucgcucacaggacgcuggacauucaaagaaagaaaaagaaguauagaaaagagagaaaaacgucaagaacuccagcauaaaguccucuuaauaacgcgucuuuuuauaaucaucgggcaauaaauuucugaauggacaaacuaugguauauaaguaacauaggcaaauguaccucaucugcauuaagcuguccuuucuuagaaaaccgagguggcauauccuucgacuguccuugcagcugggauaagagucccugacucugguuaugguagagcuggcuuagccccuauuucagaaaaggagaaagaaagucuagauaaaaagggguccacaaauuaugguaaucaaguaccaaagggaugagccaagccauaaaguuaguuuaacugaauuugcccagagaaaguaaaagaugaaacagggaagaauaaaaaucuaaccuaucaaauaaagugaugugauuuuacuaauacuuuacuaaucuuaaggauaaacauuucaguuugaaauaaauguugcagauaagguuuagaaaacaugcacacucaaauauuacuuaccuggcuuuucauaaacuugccucccaucucuccaaacugcgauugugugggaggcaugaugugucccccauggccauugaagaguugauuugaacgaugacgucccauggugggugaaaaucuauccuggauaacuccuggaccaguaccaauuccgcuaccuuaaaauacauauacggacaacucucaaaacuaaaguuaacugauuuuucagcuuaacgcaaccauuguuuuuucaaaauuaccuggcauuuguccaaacauaucagcaaguccuccaagugggucccuauccauuuucauccuggguggcaugaacggucccuccagaaagaagucacuucucaucccuugagccauaggagcaggaauaaacaccccuagauccuuuagaaaugaagugaauaugcacuuuuugucucuggacacuauuucacuuaaaacuaaaauucuugcaacuagggggggaaaccuagaauauuaaaccauaauuuauguuauuucuguaaauaacuucuuccaaaaauggcagacaaggcugggcaugauggcucacaucuguaaucccccgacuuugggaggcccaagccuugguuugcaugaggucaggaguucaagacaagccuggccaacaugguggaacccugucucuacuaaaaauacaaaaaauuagcggggugugguggcgcacgccuauagucccagcuacuggggaggcugaagcaggagaaucacuugaaccugggaggcagaggcugcagugaaucgagaaugcgccacugcacuccagccugggugacagugcgaaacuccgucucaaaaaauaaaaaaauaaaaguggaagacgagacacuaaaaacauuaagcuccaccacuaagaugagacagaccccucaagcguuuggggugggugaggaggaaacccauucuauucuacacacacagagucuaugugacaaacaaaacaaaacccaaucuuacuuuuacugcaucuugacgaauuugauugaucgucuuugguccauugucaagaaaagccuugcgaggaacccaaugguguucucgcaacucuacgguauccuuuaauugaaaaauaauuuuauuuuaauauuccuaaaccaaaaacucagcuuaccaacaaauuuaaagaaaccaguauuaccugcagcaggaaacgaauccuugcuggcaauuccuuacuuaacaucaaggagcacauucgggcaaaguacugauccauuaaggacugauaagagaagaauacauucauuggaagagcuaaagcaaauguguucaauuuacagcuuuaagacuucuaaaauuauaacccaguuaauggcuaaauauggcaaucccuuaugaugucacaaaaaucaauagcuugauuuaaagacaaacuacuuguacuacuuucaucagcuacacacguaccuuggcucguucauggucuaaucuaggucccacuguccucauuaucugacagaggcacuccaaauccucucccauaucuuugaguuggacucucuucuucuuuuccaaaagcuacaagaauaaaaggccauggugacaaaguuuuaguuacucugguuuaggcguaguacuuucuuucccuuuauguuugcacugacucauucacaguuccuacagaaucuaguauagggcuuucuaccagucugguugaucaguucuaacucuacuuugucaaacacaccacguauuucaaauuauucuguuuaguaaauuuuguugcacaucuguauuuaacuagucaaccucccucuuagaugaauaauugacucauuuccuccaaacgacugacuacauucgccuaacuucccugucacacuuacuguuuugaugcacuuaugaaggauagauucgugaauaagaucaagcuugccaagcucuccaaugaauuugauguuucccaacaucuugaucuuagcaauggcucucuguuccuccuccucggggaggaggggauuuucacgcuuaucauagacugaaaaagauaccaaugaaguaagccaacauucagaauuaagcugaaaauauacaguaguacuuauuaucagcuauaagucuuaccaucaacauuucuaguucgguuuucaaauucaucuuguaauuuggaaauuaggaggcgucugaaugucuggaaaagaagacauugucaugcuuuauuaaggaaauuuuucaagucaacuuuaaaacaagcaaacaaaaacuaccacuuacggugcuuugcuucuguccugguugacccucugcugcugggccaucaaaguuuggugcaucuucugccaaucgcagacauagcugagcauacagugagcuauacuuuggcucuucuagggcuuuguccacaaucuacagaaaaugucauugcuuaaacuaaauaugaaaacuucuccaagaacccuuccuuuaggaaaaauacaaccaccuaaauguuagcuauuacagucuaccaaaaauguccaguuauacagauuucaucuagucacauccaucuccugggagucagaaaaugccauggauaucaaaacuuucaagucuacauaaacugucauacaaugcauuuccaagaccuaaauacgguguuuuccacaaaagaaaaagaacagcuugcuaagcacucccauuuaccucuucaaccauaccaugaacuuaacauuuaccucuucaaucuaaugcuacuaaagucagugguucuuuuuaaucaccaucaguauucaaaaauacauaccuaucuaacucacaccuaaggguuuuaaguaguaauccaaguguaaaaaaacacaacuugaguuuguuaaacaguucccucucccuuuugaguuaagccaauauuuaaaacuuaccagcaguaugaccccuuuaaggaugaguuuagacucuacacccacauugaggagcucaaggcauagcuugucaaacuuuucaggaguaagcuuauuuaguaugcuggagaaaaaggaauuacauuuuaaguguuagcuaauacacagaauuugaauugaaaaacugcuuuuaaauuauacugauuuuucuucuaacuugcucccuuuaaaaaaucaagacauguuuucuuacucaucuaaaaccaaagggaugcugaaauaaaccuguuauuuuaauuacaaugauuugaauuggacugggggguccccagcuguuugacaagaauccuuucucacuuucucaagguuagagcgcaaagaucucauuaucaaggcuagaccaugaacuaagaccauuauauucccugccucacuggcuuaaauaacauagcacuucccuuagucaagggaaaugcuagcaugacaggauuauggauugcaauccaauggcugaaagcaacgggaagccccaaaauaugacgugcuguucuucaguucaagauacauuuuuuuuuuuugagacacagucuugcucugcacccaggcuggagugcaguggcgugaucucggcucacugcaaccuccaccugugggguauucaagugauucuccugccucagccucucuaguagcugggacuacaggcgccugccacuacguccggcuaauuuuuguauuuuuaguagagaugggguuucaacauguuggccaggcuggucucaaacuccugaccucaagugaucugcccaccucggccucccaaagugcugggauuacaggcgugagccacagugccuggccaguucaagauauuuuuaaaaauugcuaccaugaggauucauuaaaacauacauacucugggcaugaaccuugccuucuuaguaauacagcacacacaccaaacacagcuaauccacacuucccaucuuuuaguaaaacagaccuugaaacuuacccucuuacuuuccugaagauugcaucaugucguucuuuuucguuugcggaguuguuugcugcggaguugucaucucgucuagugcuucgugcaggaauccauuucugagcguuuugcccugggguuuuccccaggaacucgcugauuaauaaaaaucagcaaaaacacuuauugucacacaccaaauguuaaacaucauaaauucucuuacauagaaaaaaguaauuuaggcuuucucgacuuccccuccaagaaagccaacucuggaaauuagugcuucuggaacaguagugugcaucagaaucaccugaagggcuuguuaauacagauugcugggcccacccaguuucugcuuucacugguuugggguggggccuaagaauuugcaugucuaguaaauauucccaguaucaacgcuguggaaccacauuuugaaaauuaacauuuuuuuuaagagauggggucuugcugucuugcccaggcugaucucaaacucuuggguucaagcgacccucccaccuuugccucccaaaguuguuguugggauuacaggugugagccacuguaccggcugccaauaaacacuuucuaauguuuuauugaccauguugagugcguacuacuuuacuaauaacaaucaguaggaauaauagcuacugauuucagaaaaacacauuaguaaaaauaacccaaagaauaaggaaaaaaauaacagcuugagagucucaacucacuuagaaaauuuggcuaaggaauaaucaggaacugauauucuguauuuaggauacccaacagaaaccacgccccuuaagauuaggagucuugauggcuauugccuuaauuauaccgucacaugggaaagacuuuuaaucuguuaaauaaagcucacuguuuuuuuacauguuuaccacaccuguugccagcagucuugggauagugcugaggugcaccccuacuuccuccuccgcccgaagaagcacuauuuaaaagaaaaaaauuguuuacuguaucccaacuaugucucacucaaaaagaauaagcaucuauuuuguguuuugcuuugcuuguagagaugggggucucgcuauuuugcccagacuggagccaggccuguauuuuagugcuuguauauuaugcuacaaaugaagacugaacucggacccaaaggaaaggcaaauaauugauuuuauuuauucuucagauggcaguucuuagaaggcugucaaugaaaacuuaagaacuuuucaaaugaaaauugcagcccauuaagucggacuuauuugcuguguuaacuacuuuuugagacuggccuuuucaaaaggauuccccaaaauaaaucuacaaguaccugaaacgagaagcacccccuucugcaaucgcacucuccacuuuggcggcuugacaacgaagaaucuucaaaagaauaauauuaauagaugggguggggaggggaggggacaggagaaaugaaauaccuggaacgagaaagagcaccaaaauuagacacugcuaacauacagaucuauaagccuucauucaauuacaacguauuucagauccuggcacugucacugcauugcagaucuguaagacuaaccuaaaauguacucaaaacacugacaauuacauuuuguuuagccaccuggaaauuccccgguguucaaggaugcaaagagacuucguagaacacaagagcauuuuaaacggcucagaacgaaucuuuugaaaaagccacauucuacuaucuuuaaaacugagcacugagaucaauagaaaagucuaacuacagacacgagcaacaucacguggaaaaugucugcccuaggaauuuuuacugccuugacgaggccagcgacuagaugaggucucuccgaaagcucuucagcaguuuuccccuguccacccuuucgccuccuccccguggagagcucguggaaagacgcgcgagagggggccggguguacaggacuagcacuugcaggcggaagaccagggccacaacauggcagcaggaaccuccgccccguuuuucccuuccugggaacaaaagagcggagcauuccucccacccaggcgcaaguuagggaagugcuuccgacaaccuccccgcgaggcccgggucgcucgacggggaggagcagcugaggccacccccgccagcccggcgcccagcucuuuguucuccaagcaggaaggcggccuccugcccacccgccgccuccaagcgggcccccuccugcaccauaaauccccccgggacugacaaccgccucgccacggccuccucugcugacaaaaggggcagaaaucaucacucucucuuuccuccccgacgaagggcagccccugccgacuccagguccuacacaccuccccgccgggaggccaggcuccgggacgccugcgguucccuggucccgcgccaacggccuggccuucccugccggcccgcgugccucccgccacggcgcuagcgguccgagccacgcucccucgccguccgagcacagccgugccucgguccgccacggccucgucccugcaggcgucggccauccggccaugaccgcacggcggccuggccaacacugacguuuuccuucuacuccgucagcaacaggaagagagaacaaaagccaagacuuuccagguaucugaagcgcagaggaaaugcuaaaaaagggucgccccacccggcuccgccugcggccgccauuuuguaccacucgagaagaagcgaccagggacggcggccauuuuagagcgcuccacucggcggcggcagcggcucaacucaccuucaccgagaacucagcagcugccaccgcagcugccuccucaggauccggucgucggggauagggaagggaggggaaaggggaacggaaaacaaaaaaaagggggagggaagggggaggaaggagucggggacggccucaaacucagcucagaggagucgcugcugcagccgccacucgguacccgcugccaccuccauagagcuccgacucacugcuggcgcuaaggcgugucugaagccgaacuuaucacucuuggggcagccgaacccaccagagucuccccgaauggcuccuucgccgcccaaucagcggcccgguugccgucugc

SEQ ID NO: 191797 - RNA, 54785 nt, Homo sapiens
agagcggagcggugggccgggggcuggaggacagguuugugcgcuggacgcaagcaccaggcgcagccucgcucgccgagacccggccagguaaggccgguggccgcgcgguaggugcggagcagcgcggcgggagauuaggggugggggaguccggagauaaggcuccggucuucgccugccuugccagagcagagaggauggugggggccgugcugugggcggggcaccggcggggagggggcucccagcgcgagccggaggcgcuggguucccucugcuccacucgcagcugggcacccgagcuuucuucggggucgaggaggguggcuggcucuuggcggggagcaggagaggguaggugccaaaccgagacccuggcggggucccuucggguuugggcaggucgaugggcaagggggugcccacuagugaggagggacacccaccaauuccaggcgaugcuccccugugccgcucagcaaagcuaggcccggggauccugcucuucuccggucugguuaagccagcaaccucugacacuuaggagaaaguuaguguaagucgugauaugcuuuucacuuaagugacaaauuagguacgagaugaacccuuuugguuuuaggagaugagaaacaguauuuccuuguugcaccugcuaaguggcaacucagugagcaaauaugguuauugugguugguguuugcaacggucuuagaugacaguuauuuuacaguaucaaauggcugggagagggagggaaagaaggagagagagagagagaauaugagggaaugagaaugaacgggaaccauuaugauuuuugagagacagaaccucuugaaauucuaugucugcuaaacuucuaaauugaauaauguacauuuuaugcaauugaauaagcuagugcuaccauuuaagccugcuacuaaggcucuguuaaauccguggacgaauaugaacacuaaaagauauuaccuugguuuaaaaauaggggagguuaaaugcaaauauuucugauagugaauuuuguuugagggagauuguggacuuucccuaugggaaaguuaaagaauugaugagauagaugcuuuaaggaauguuuuuguuuuuugaaacuugaauaaguucaacaaauguugaacaaauauuucaacaaaucuucuucagcuaauagggucaaaaauuaaaauucuggaaauuuagaauuagaaaugaaaucucaaauaaugucacucuccuaauuaggaugaacauggaaacuucuauuucucaucguggucuucaagcuuuccaugaucucaucuaccuuuguaguagggggucaaauuuuuuuuuuaacuagacaauuuuagaaacuuaaaggaggcaaaaauuuauuucugucuccguguguuuacucaugcucuucucuauccaaauuuuacccaucuuuuuuuuuuuuuuuuuuuuuuugagauggagucucacucugucacccaggcuggagugcaauggcccgaucucagcucacugcagccuccgccucccggguucaagggauucuccuaccucagcccaucgaguagcugggauuacagggacccaccaccacagccagcuaauuuuuuguauuuuuauuagagacgaaguuucaccauguuggccaggcuggucucgaacuccugaccucaggugauccacuugccuuggccucccaaagugcugagauuacaggugugagccaccgugccuggacgacccauguucuaagagucgaaucugucuauguuguguuuaccuuucuuugcucucccaagguacauauuguucauaucacguauuuuguauauauucuuucagcaugcuuuuugccaaguugguuugcgcucugugaauaacaguugagauaaaaugcacaauuaagacaauuaagguacuuuucaagacacaacuaauuaugggcacuaauaucaauaacaucaauucagaugucuuuuuuguuuugggauauguuauuaaucucugaacacauacuaaacuaauuuugcauuacuuagaauaauauguaaauuacuuuccacuuucuaaggacccuuuugaaggcuggguucuacaaaauacccuuuugaguacuggguagcuggcagaagcaagugcaggauuuaaaaauguauugaaaauaauccuuuaggccgggcaugguggcuaaugccuguaaucccagcacuuugggaggcugaggcggguggaucacuugaguccaggaguucaagaccagccuggccaacauggugaaaccccgucuuuacuaaaaauacaaaaauuagccagacguaguggcgggcaucuguaaucucaacuacucaggaggcuggagcaggggaaucgcuugaaccuggaggcggagguugcagugagccgagaucgcgcuauugcacuccagccugggcaacuagagugaaacuacgucucaaaaacaaaacaaaaaacaggcuacuaacaauuucaaauaauuuauucaaggaaaaacuucaaucacuuucauuauuuccaaucaaaaauuuuuuuuacaaccaugauguggugaaaaguauacuuaguuagaauuucauggccagauuccaguacgggcucugccaaacgaacuuggccaagucaguuaacuuccuucuguauuuauaaccuuuuauaaaaguagggcugaauuagauuacaguaguccuccuuuauccuagagggauauguuccaagggucccaauggaugccugaaacuacagguaguaccaacccuuauauacgcuauguuuuuugcuauacauacauaauaauaaaaugaauaacaguaauacacugaaaugaaaguuauaugaaugugaucuuucaaaauaucuuguuuuaccucagguaauugaaacugcagaaagugaaaucgcagauuagggaggacuacuguaccuccaagauuauuucugaucuuagaauucucugauucuaaaauccuaaagcagccuaauagaaguucagauaguaguuacuugauuuuauuuuuggcagagcauuuuuuuuuuuuuuuuuuuuuuuugagacagggccucacucuguugcccaggcugacuggaguacaguggugugaucauggcucacugcagccuggaacugccaggcucaagugauccuccuaccucagccuccugaguagcuaggacuaaaggagcaugccaccacacccugcuaauuuuuaaguauuuuuuuguagagaagaggccucgccauguuguccaggcuggucucaaacuucuaggcucaagcgaucugccugucuuggccucccaaagugcuggaauuacaggcaugagccacuacaccuggccuuggcagaguuuuuuuuggcaguguauuuuaauuaucugaaguacaguauauguaaauaauaaagagauuauaauuuuaauaauauguuuauugagugauacagaucuguuuuucauaagccuauaaucuaggauacuccaauccguuguuaagacuggaaaaaaaggagauauaauaguuucauugaugaguguccuuuucuacagauguagacaacagaggcucuaagaucuauacuaaugucuugaucagggaaaagcuggaguccaacucagcuggucauacacuugauauuuuauuugaaccucacuuuccuguugacuuucauuuucaaagggaaaauggaggugagcaccagguuaucuguggccuuugaaacuggugccauggagaaacucaaaagccguuuauuuuucuucacccuacccuguuucaucauuagauuugugacauugauaguaagaagaagcaauccacguuuccuagcucaaggcagugucuuagagaaggaaaccugagucucuugcuacaguucugauuuaagguuggaaggaagagauuauguuggaugcauugcuuucauuggucuaugauugcaucaggacuuugguucuggcaauguucagagaagagcucuaauguggccuuucaaaaaugacuguaagaccgggcaugauggcucaggccuguaauccuuggacuuugggaggcuaaggugagcagaucacuugagcucacagguuugagaccagccugggcaacauggugaaaucccaucucuaccaaaaauauuaaaaacuagcugggcgugguggugcgugccuguaguuccagcuacucuggaggcugaggcggaaggauggcuugagccugggagguggagguuuugaugagcugaaauagcgccaauguacuccagccugggugguagagucagacccugucucaaaaaacaaaaacgaaaacaaaaauuacuuuuaaaguuguaugucaaacuggucuugcuugcuuuuugugucguuaauuuuuauuuauuuauuuuauuuauuuuuuuuagacagggucuuucucugucauccaggcuggaguacauugguaugcauggcucgaccuccugggcucaagcaacccucccaucucagcuuccugaguagcugggacuacaggugcacaccacuacacccagcuaauuuuuugauuuuuuuuuguagaggugggguuucaccauguugcccaggcuuguuuugaacuccugggcucaagugauccacccgccucagccuuucaaagugcugggauuauaggugugagccaccaugcccaaccuggucuugcuuuuuaaguucuaccacuuuggguguuuacagaacagauuuucauauuucuuuauguuuccuuuucaagacaagaagggcauuaauauuuauugagcaauuaccauugucaugcacugugcugguuacuuuguauucauucuuauuuuccucgcaucaacaaaccugugaagagguaugagcucaguuuucuagguaggaaaaucaagacucagaggcaaguagcuugcgaguaaaugggggaaguuaggauuuaaucuccuguuuguguguuuauuuuuuaccauguugugucaauaaaagucauauaacuuuccaaaauacaacaugcaugugauuacucuccugcauagauuauuuuauguuaaauauaccauauguaaaacaagaaauacaugucuccuuaaaauuugaaaauauuuuauuugcuuuuuuuuuuaacagacuacuuagaaauaacugcuuauguuuacuaaugaguuugcacaugagcugauuuauguuuuacauguuauuuggugggguuucaaaaaagaauuugaaauauuucaucuuauuacugaucucugugacaaacuaggaacaaaguuaauuuuuuuaaauuggugguaagaguaaagaaaaauuccaguuaaggauuuaacaggaaaaguugcccuauaucuugaagucucauugcugaaaaaaauaagcuuuuaaucugaauuccuccuaguuauucaagaguggaggaauacaggaaaauuugggcauaauaaaucuauaucuauaucuauauaucuauaucuauaucuaucuaucuaucuaucuauauauauauauauauauauauuuuuuuuuuuuuuucccaagacagagucucgcucugucacccaggcuggagugcaguggcaucauuucgguucacugcaaccucugcuucccagguuuaagcgauucuugugccuaagccucuugaauagcuggaacuacaggcaccugccacuaugcccggcuaauuuuuguauuuguuuaguagagaugggguuuuaccacauugggcaggcugaucuugaacuccugaccucaggugaucucuccaccucggccucccaaagugcugggauuacaagcaggagccaccgugcccggccaacaucuuuguuuauuccgguuuuugauucuguuuauuucauguaucuuucuccccuccuuaauggaauaugauauaauuuagucuccuuccacaucauaaaaauuuggcacuuuucacauuaugugacaaaugcauacacuaucauguaccauuaccacuguaaaaagucuaaauuuugugauuuugugucuuuuauuuauuuauuuuuauuuuuuuuuacauuuagaacguguuacgagucaguuuuuagugaaaaaacauugagcuaggagccaagacccaucucuucacuauuuugguauugugcaagucaucuuaccucucuggaucucaguugucucaucuguaaaaaggagauaaaaauuauuuaccugccugaacguaaguacucaauaauugcauuugguugcaaagaaacaugacuaucacuaccaccaccaccaaaauacaaaaaaggaaaaaccaaaaacgaacucacagauggcuuaaacaugcaauauuuauuuuuuauauaaaauaauaauugaaauagcacucuaggauggguauaguggcuuuauaaagucaucagagacuuaagcuucuuucaguucuuuuaucagugaucccuaagacauucuuguaguacugguucuuguauguccaagauagcugccagagcucuaaccaucacugucauguuccaggcagcaaagcauaggcgaagaaagaugcauccucuuccuuuaaggagaauuccugaaccaaggcugaggcuauaagaaagcagggaaauguagcugacugcaugucugcccucuauaaaauugggcuuuuguuacugagaaggaaggaaagauuuggauauuggcaagcaaauagaagugucugccaugauaugaaucuuuuuaucuuucagcucugaaaucuguaagcugugauaaccacucauagaagcuucuauaauuugccauggcagagauauaagucugacuauuaacuacagaaggaaauaaucuucauguaauaaauuguguuucuguuuuuacuuuuagcccuuaauucauuauagaagcuuuucugucuuauuuguggauuuguucugguuauuuuuuaaaauuacccauaaaugcucaauagauguuuguuguacauuuuaugguuguguuaaaaagagcuaacauuuauugagcuacuugcuauaaucaaggcacuaaaaugacagagauaaguuaucccaaggguaucacauaacuaaucaucaggaaguaaauuuauauugaaaguaaauauaauucaucucaagauacauuucacuauggucacaugaggaacacuugccuuccuugcuagcuaaaaguaguuuguucuuuuucuuuccuuucuucuuuuuuuaaccacuuaacuguuaguugucuugaaauuuucucuuacuacuaguucuugcuuaacuuauuuagccacaccaauauuuuauuuccuuccagacuuuuauuuuuuuuguugagacggagucucacucuuucacccacgcuggagugcaauggcuuagugcaaccucugccuccuauguucaagcgauucuccugccucagccuccucaguagcugggacuacaggcauccaccaccacacccaacuaauuuuuguauuuuuaguagagauggggucucaccauguuggccaggguggucuugaacuccugaccucaggugaucugccugccucagcccccuacagugaugggauuacaggagugagccaccgugcccagccccuuccagacuuuucuuugugaauauuauauaaauauacccuauacuuguccugcaaaaugguucaauugucauuauuucuauuucaaaaguaaacugaaauaaauagcuuugagaaaaagaaauucagggaauggaaauuggagugagaaagauucuaaagauucagucaaucuuuuagaguuuuuagaagggagacaguaaguuaagauuuuauuucuacacaguauauuuguauuuuugaaaguuuuuacauuuuuugguuguauuagauaggcacaaaguacaguaguucuuuugcugcuaguauugcaguuuccuuuuuucugaucuagacuuguugaccucaaacaaaauaaucaggagacuugugaccauaaaaacaacccaguuuuuaagagacauuuaacguuauaaaucaccugacugagaaugucuguuuggugaauaccauuuucaugacuuuuaauuuuuuuuaauuaacagaaaaguaucaugcuaugcauuguuuuguaagcagcauuuuaaaaauugcaauuguauuuaauagcuuaccuuccucacuagauugaagcccugugaggguaaggacuaugucgaucucgcuuaccuuugucuucuagcauaguaucugguaccauagucauuacuuaauacauaaauauuaguuuaguuuuguuuuuagaaacaaagucucaauacauacauacauacauacauacauacuuauaauagguuaaaggaaacaugcuucaauucagccauuaauugaaaaggaagaggggcaaaagaagaggguugaggaagauggaaaaagauacauaaaagaggcugggcgcgguggcucaugccuguaaucccagcacuuugggaggccaaggcgggcagaucacaaggucaggagaucaagaccauccuggcuaacauggugaaaccccgucucuacuaaaaacauacaaaaaaauuagccgggcguggcugggugagguggcucacgccuauaaucccagcacuuugggaggccgaggcgggcggaucacgaggucaagagaucgagaccagccuggacaacauggugaaacccugucuuuacuaaaaaaaacacaaaaaauuagccaggcaugguggcaugcgccuguagucccagcuacuuaggaggcugaggcaggagaauugcuuaaacccaggaggcggagguugcagugagcugagauugcacuacugcacuccagccugugcaacagagcgagacacugucucaaaaaaaaaaaaaaaaaauuagcugggcgugguggcgggcaccuguagucccagcuacucaggaggcugaggcaggagaauggugugaacccgggaggcggaguuugcagugagccaagaucgcgccacugcacuccagccugggugacagagugagacuccgucucaaaaaaaaaaaaaaaaaaaaaaagauauauaaaggaggaacagagacuacuuccaaggaaagagaaaauuuucaguuuucuguacuuuucacccugguuaucuaugguaauuuuuuuuaaccacuuccaggauaucuugcccaacaaucaaaacaggaaaccaucacacauacaugcgcgcacgugugcguacacacacacacacacacacacacacacacacaaagcaaacuuaaucuguauaacuauggguauaaaucaguagcuaagaaaucugccucuguguaugaauggaaauuuuauuuuuugagacauguucucacucugucacccuggcuagagugcuguggcgugaccauggcucacugcagccucaaccugcugggcucaggugaucuucccaccucaucccccaccaaguagcugggacuacaggcaugugccaccaugcccaacuaauuuuuguauuuuuuguagagacagagguuucaccauauugcucaggcuggucuugaacuccugggcucaaggaauccacccuccuuguccucacaaagugcugggauuauaggcaggaaccuccgugcccagcagaauagaaauuuugacuugguugagacaggggaagagagauuagcuuucuuuuaggacuuuaaaauuuaaggaaauuauaucuacugaauacuaagagaagcuuaagaacucugcuuacuuuguaauuuuaccagaggcucugaugccuuuggggucagugccucccauucugucuugagaugacuacauaauuuagaauuucacaccauccuacuuuagagaguaaauuaucagccuguccugguuuggaugagucuacuguuucagccugguucagcccagugucuccucuuuagguccguaucucucuuaugaaagaagagggugauaaaggaaaggagaaggccauucuuacugaccugauaguggaagaaaaguagguuaguucuccuucuuccuauugccuguccuuaucacucaucucuuucuucuauauggauauuuguauauuuucucauucaugaaaaucuguaaaccuaguaaauuugcuguuauuccuuuaaugcagacacauuugacaucuuggcauuuaaagagacuuuugugucauuauuuuucugccuaaugugcuggaauacuuaccauuuuuuuuuuaaauacaguugauguuuauggaggccuuauuaagaauuagagucaguguuuaaauuaauuguccuaguuaugucuagaauaagcacuaacagauuagaaacuaguagaaaacauucuccaucaaucaaaaauaaauuuaaaaggcaagaaaggagaggaaauaaauguuaaagagguaggauaaauagaaagcccuaccagccugagcaacauaaugaaaccacaacucuaccaaaaaaaaauauauauauauaucaccacgcaugguggcuugcuuguggucccagcuacuugagaagcugaggcaagaggaucucuugagcccaggaaaucaaauuugcagugagcugugagcucaccacugcacuucagccuggguggcagaaugagaaccugucucaaaaaacaaaaaagcccuauagaaggugguagauuuaaaaaucaagauaugguauuaaggccgggcgugguggcucacaccuguaaucucggcacuuugggaggcugaggugggcagauugguugagguuaggaauuugagaccagccuggccaacaugacaaaacccugucucuacuaaaaauacaaaaaauuagcagggcaugguggcgcacacuuguaguccuagcuacucaggaggcugaggcaggagaaucgcuugaaccugggaagugaaggcugcagugagccaagauugcaccacugcauucuagccugggcaacagagcaaaacuccaccucaaaaaaaaaaaaaaaaaaaagauacguuauuaaaucaacuuuaagggcuagaugugguggcucacuccuguaaucccagcacuuugggaggccaaguugcauggaucacuugaggucaggaguuugagaccaccuuggccaacauggugaaacccaaucucuacuaaaaauacaaaaauuagccggguguggugguacccaccuguaaucccagcuacuugggaggcugaggcaggaaucgcuugaacccaggagguggagguugcagugauccgagaucgcggcacugcacuccagcacgggcaguagagugagacucugucucaaaaaacaaaaaacaaaaauggcuugaagaaaucaccauuccucuccccgguagagagaacaguguuguaugggaaaacacaaaagguaacaauucaagaaaguguuuaaaaauacuuggacuacaaaggugaagaaguccuuagaauaccuuuaucaauuuauuucguuuaauuucuuuaugugugcauaaaaaugaugugagaaaaaucuaugauaugccuaaaaauacuuucagcaaacauaagauagaauuguaagugaaaaagcacggugguguaauuuaauuggcagcauuuuuuucuauauaguauacaauggugugucuuaauaucgauggaaucuuuuaucccacccugaggucucugucacccaggcuggaguaagguggcacaaucauagcucccugcagccuagaacuccuggguucaagcagucuucuuaccucagcuuccugaauagcugggauuacaggugcaagccacugcacccagcccaauggaaucuuaaagccuauuuauuuuauuuuaucuuuuucuucuucuucuucuucuucuuuuuuuuuuuuuuuugagacagucucauucuguugcccagacuggagugcaguggcacaaucuuggcucacugcaacugcaaccucugccuccuagguucaagccauucuccugccucagccucccggguagcugggacuacaggcaugcgccaccucuccaggcuaauuuucauauuuuuaguagagaugggguuucgccauguuggccaggcugguugcaaaccccugaccuauggugauccacccaccucagccucccaaaguguugggauuacaggcaugagccaccgugccuggcccuuaaagucuauuuaauaacauguauauacacacacacacacacacacacacacacacacacacacacacacacacacacacacacacacacacacauauauauauauauuuuuuuuuuuugagauggaguuuugcucuguugcccagguuggaauacacuggugcagucucgcucacugcaaccuuugccucccagguucaggagauucuccugccucagccuccugaguagcuaggacuacaggcgugugccaccaugcccggcuaauuuuuuguauuuuuaguagagacaggguuucaucauguuggccagguuggucuugaacuccuaaccucaaccaaucugccugccuuggccucccaaagugcuggcauuacaggcgugagccaccacgcccagccucuucauacccuuuugcuagagauuuucuuccaagcacccuauauuaauuuuacaagcuuuacaagcuuggugcuggugcuuucuucaucuuaucagaagaugaugacaggaaguuuucagauucauagucuuuccucaaacucuccuuaaaugauucauugaugaagaccuggagggcuggccuucaugaaucacaccaacuuguauuacuuuucaggcaaccuauucuuuauucagauacacgcucucagaauguaucaagaacuaaacuaauaaacacacuugucagguuauguagugcucuucaacauucaaaucagauuuagcuacucuuccuuuagcucagccaccauccaucaaccccauacuucuuaaaaaugcuuaauauaacaucuugggggaaaucauuuuauaauuuaauguuuaauauggcaacaacuuuuggcuguaggcauuuacagcaauguuacagugauuuguuauuuucugaccauucucguaucaaucuuuuuaccaccuuuagcauuaauguagauuuugaggcauguaaaagaacaucaggauuuugucagaauuuccuguugacuaaacucagcuuuauuuuuuccuuaaacuauacuuugcuggaaguugugcagcuucuguucaguauuuucaggaaguuccugacaaauugacauuugcaugaguccaucaauucagccucauguuccuugaguuuuuuuauuuauuggaggcauaguugguuucugcuaucuucauuugcauuguuuggcugcugauagguaauccuguuguguuuuacuaacaaaacguaacauggcuuugucuacuugcagguaucuuccugucuagagucagguaaagcacuaguuguuccuuuauaagaaagaguaaaauugcuguuauuccccuaauaucaaguauuugcuucacuaacaucagcugcuuuguuucugugcuuacaaaauaacuuuucauuuuaaugccaaaucauagcuuaauguuuaugaagauauuuacaaugacaagcaccaacaaugcaaaaacucaaucugaaguuaugacaauaauaauaacuauaauaaaguucaugcauguacacauaacaaagacuauguugcuguugcuauguggcuaauuacaauuuucauauuccauuaauugaggcuggguauaguagcuuaugccucuaaucccagcacuuugggaggcugaggcaagaggauugcuugagcccaagaguuugagacuggccugggcaacauguugagacccugucucaaaaaacaauaaaaaaaauacuaauaugguugggauauaaaggucagucaugagauaaaagauuaaauuuacuguaaagcuagaaaaucuuaaguuuauauauauauaccuaauauuugaauaaaaauuaacagaauuauaaggaaaaagagacaaaaucaugauauaagauuuucaugugcuuuucuagugauuguagaacaagcaaacaaaaaucauugagaacauagaaaaugggauaauuuugaaaaauuauaagcaugacuaguguagaaggugaauagugguucaugaauuguauuuuuaaaauuuuucacauuuuauaaacuuggauuuuuuugcucuauuuuuacuccuuuuaaaaaaauugaaauaugauuuacauaucauacaauucucucuuuuauaguauacaauucacuggcuuuuaguauauucauaagguuaugcaaccaucucaacgaucuaauuuuagaauauuuucaucacccccaaaaggaacccuguacccauuuagcacuuauuucucauuuccccucccuccaccagcagcccucaacaaccuguaaucugcuuucuuucucuguggauuugccuauuuuccacauuuauauaaauugaaucguauaauauguguccucuugcuucuggcuguauuuacuauuaaucaguucuguuguauuuuauuuuuaaacagauuucuccuuaaaaauaucagucuuggccgggcacgguggcucaggccuguaaucccagcacuuugggaggcugaggcgggcagaucaccugaggucaggaguucaagaccagccuggccaacaugguaaaauccugucucuacuaaaaauauaaaacuagcugggcaugguggccuacaccuguaaucccagcuacucuggaggcugaggcaggggaaucacuugaacccgggaggcagagguugcagugagccaagaucaugccacugcacuccaaccuggguggcagaguaagacucugcaucaaaaaaaaaaaaaaaucagucuuuuguccuuuaaaauuaucaaaaagugaaaguuuuuggcuuugaaauggcagucacaauucauuguccucuuucuugcaaaaguuaaaaauaaauccagcuugaaugaaauguaagucugacaaucucuaaaccugaaaucaaggaggagcuuuguuucugcuuccacagaagcaaauucucaguuugaucagagaggauaauguuccauauuuuguuuccaaagugugaaacuuuccuggcuuuacaucauuuuuauugugucuagauaugaacuuucuuugcuaguucauuuuccuuguuguuaaucuuuguaucucagcaaccaggccugcuauuugcuuuaccaacauaauuuuaagcuggcugaguaagcaauauuuaguuuaaaggcauuuacaagucauauaacuuaaucauuuuaaaugaauggugugaauacaagcagcuuuucuuuuuuuuuaauuuuauuucuguuuaguauuucugauuacguaacaggaaagaucuguacuaaaaagaauaaauagauaauagaauuuaaguacuuaaguaauacuaaguucaaguuaaauucucuuauuuaaaauuuuuuuuauuuuuauaaaugagggaacugaagugggaaaaguuaauuggcuaaccugugaucauauagcaaguaaguggugcagcuguaacuagaauauagaucuaaauuuaguucugccuuacugcuugguguaaaacccacuuucuauuucuccuuuuuucccacuuucuauuuuuuaaagauccaaguuuaccuuugagaugagcauucucuuucugucucauuguaggugagguugguaaauaauagagcaaagggaggcaguauguucuagggcagugguuuucaaauguuggcauguaucagaaucaccuauagggcuuauuaaaacagauugugaggcccccuacacccagagucucugauuuagaaaauauggaguaggccuugagaauucgcauuucuaacaaauucccaggugaugccagugcugcuggcccagggaccauacuuuugagaaccacuccugaaaagccaacaaaggcuuuggagucagucacucccaggucuacacucuagcuguaugacugacugcugugugaacuagaagugauaugucucaguuucuuguacuuugaaauggggauaauaauauugacuucacagagucauuguaagaguugaugcguuaauauauuuuaaaaguuuagcauacugcuugguacauaguaaacauucaauagaugguuucuguuguuauuuauaauaagcauggggaucaauuaaaucuuuaggaaccauaaauucaguuaguguuuuaaagcaguuucucagaaacuuuuugugacuuugucacuucaagauguugucagcggcuaggugcaguggcucaugccuguaauuucagcacuuugggaggcugagcuggguggaucaucugaggucaggaguucgagaccagccuggccaacauggugaaaccccagcucuaccaaaaauacaaaaauuagcugggcguggugguggguaccuguagucccagcuacucgggaggcugaggcaggagaaucgcuugaacccgggaggcagagguugcagugagccgagaucgggccauugcacucuagccugggcgauagagcaagacucugucucaaaaaaaaaaaaaaaaaaagauguugucagguguuguuaggacauacacacacacacucauguauacaaacacauucucuugacuuuccuucuuauuuaugguagucuuggcaggagaggaagagagcagcagaagugacaaaaacacguggaagauauggaaaaauuagaacccucauuuauagguggugagaauguaaaaugauauagcugcuuuagaaaacaguuuggcaguuccucaaaaaguuaaacuuagaguuaccaaacugacucagcaauucuacuccuaguuauauaaccaaaagaauugaaaaccuguuaacaaaguaacuuaaacacaaauguuuacugaaguauuauucaaaacugccugaaagaaacaauccaaauguccaucaguucaugaauggauaaacaaauauggcauauguauacaauggacuaucuauucagcuauaaaaaagaaauaaaguccugauacuuguuacaauguuguuggaccuggaaacauacugcuaagugauaaaaggcagacacaaaaggcuacauauuguauaauuccauuuauaugaaaugcccagaauaggcaaaucuauacagauagaaaguagauuagugguugccaggggaugggaaaaaaggguaacagugagugacugauaauggguaugggguuucuuuuugagaugaugaaaauguuuuaaaauuagauaguagagaugguugcacagccuugugaauauucuagaaaacacugaauaguauaauuuaaaacauuuuaugccuuaugaguuauaucucaaaaaacccaaaaugcacaccuauguauguguggacaagaagcaugaaugaauaauaaaccuuuuuuguuauuaaaaguaauuguggggaagaggaggugauucauagugagaagacauucugugaaguauacuacccuauuagagauucuaguauccuagagaugaguggaucucagguuuuaguauacauaggaacccccuggaacccccuguuuguuaaaacagguuccuggcccccaccccagaggucuuggguacagccugagaauuugcauuucugaucugcuuucagaugaucuuguaagauuuuguaagauugagaacuaaacuuuggguagcaucuuuauagauuagacauaugcuguacuuaaaugggugaauuuuaugacgugaaguauaucucaauaaagaugcuaaaaaauuggcauaaagauaguaaaauguaaguuuuagugguuuguuaauggcaagacaaugcucuguaagggaauugguuuaauuauuaauuucuucauuuguaaaaugugucacucuccuguguauguaccaccuaggguuguggugaaaaugggguuauguguucuuuuccaaaugguguucuguggguaaaacguguugccuuaaaaaaaaaaaaaaaaaaaaaaagccauggcuagauugaagcuuuuguaauuagccaaauguuuucuuauacuauaaaaacaauauaggccgggcacaguggcucacgccuguaaucuuugcacuuugggaggccaaggcgggcggaucaccugaggucaggaguucgagaccagccugaccaaaagagagaaacccccgucucuacuaaaaauacaaaauuagccaggugugauggcacaugccuguaauccgagcugcuugggaggcugaggcaggagaaucgcuugaacccaggaggcagagguuggggugagcagugaucguaccauugcacuccagccugggcaacaagagugaaacucugucucaaacaaacaaacaaacaaacaaaaacaguuuaaaauauuguauucugucuuuuuaauuuuggcuacaaaaacauuucucccuugauuuucuuuagugaucuauuuuaagcauuauuuuugacaaguuuuaaucuauucuuuccuuuccuauaauuuuuuuuuuguuuuauuaaaccucuugagauuaaauauaugauuaaugugacauucggaaugcauguauauagaguuaaaacauuauucaugacuuuaccauaauuacuccuuuauuucagaugagguggaggaccauccugcuacaguauugcuuucucuugauuacauguuuacuuacugcucuugaagcugugccuauugacauagacaagacaaaaguacaaaauauucacccuguggaaagugcgaagauagaaccaccaguaagugaaaugaagugaaaugggaggaauuauaacuaaaugaaaugaauuauaauuguaacuaaaugagguggaaugaggugaaacuauaacuaaaugaaaugagaggaauuauaacaaaaauauugcuaauauuuauuacuuauaaaauuguacacuugggaacuauuucugaaauagcagugaaaagaguauuggccaagcauaugcuguuuaccauuacacaauauuuauuuaauauaguuaguauauuagauagaagaauuaaucguaauacauuuccaacacagaccugacuagccaagaaaacacuguauuauauucaaagcagaggcagauaacaauggggagaaaccaaagugguaaaaucuucauugucugaacuauauagaaaaucuacuggacuagagagugucguaaaaaagaaaaaucuaccuuuaaguaacaauaaaagaugauauugguucugauauaaaacuauuuauuucagaaauauagcuuuucacuuuguugaaacuaucaaaguaaauaugucuuaaugccauuuugcuagaaauuguuucacaggauugaccucuuuagauucaaacaaggaaaaaccugcagaagcauuacuguugguuucuuaauuugaaggauacuggacuuuauuaugaugaauaucucaagcaagugauugaugugcuggaaacagauaaacacuucagagaaaagcuccagaaagcagacauagaggaaauaaagguaaaugcaauucaauaauauauacauauauguaucuuaauuuaaaauuuuuuuagagaugaggucucaccauauaacccagguuggccuugagcuccugggcucuagugauccucccaccucagucucuccaguaguugggacuacaggugcgugccaccaugcuuggcuuaaauauuuaacaaacauuugcacgugccaggcacugagcuaaguaccagaaauacaaagaugagauuuauucccagcccuuaaggaacccucaagggaaaaucauauccagaaauagauuauaggauggauuauaugaugaguauuuaaucuagaaauacagaaggcagacacauaaucuaauaugaagcaguggggcgaggugggaaguuauucuuccuaauagagauuaugccagagcuuaaagauguagugagaaaaggagagguacugggaggcauccuagacaaaggugcaaugguacagaggcaagaaguauaugggaaacuggaagcaguaacuguggcuagaccccagaaugggaaauggaggccugaguggccaaaagaugagguuuggaaagaaucacagucucguugacagagggccuguauaucauguuaagggguuugggucauuaucugaggacaguaggaaguuauucaaaaguuuggaauaggugagguccugguguuuuaaucagguccagauuaacagaagagauaaugggcuauguauuauaucaaucagagagguuuaaccauuugacucuguccugagaacccuauuugacauaauuccagccauagucagcucuucaguacucauaauaagaaaggggguuguaaagaucugacaugagagauucuuguaaagucuuuccuuaaaaggaaaugaaucaguuuagcuggguuuaucuuagacucagugaguaaaaaaaaauccaguuaauuuuaaaauuccaauaaugucuccuaagauaauuuuguuugcuuauguuaccuuuauuuauuuaaguuuuacuuucuuaaaaaauuacguugcuuuuuuucuagaaucagaauaagagaacuguguuugaaagacucauucugggucaaacaaaccuuuuauuuuaguuucuguucuuggugugaacuucuuugaaagacugacucccguuagguuguggugucugucagcgcucagguguggcauuuaguucgcagcucuccucuuggaaguugugaacuuuucuggggaaaagguaauaguguuaugcuaauaauuccccggaauugucuuugaggauaauccuacucuucuucugaaggauuaauucgaucuguggaacaaguuuccuauggugaauauaucugauguagaacucuuaaugucuuguaucaggaguaagaacguuauuuggggugacauagaaaauguggaucaugggagauacuacauagagauauucaggcaaaagaagaaaauaagcuuccuggauuggugcagggaauacuuuuauaacuaucuuccuuucacauucaauuccuguuucuaugaaggguuagggggaaccaaaaugaaguuaaacaguuacacaauaaaaaagaaaugaggguccgugugugguggcucacgccuguaaucucagcacuuugggaggcugaggcagguggaucaugaggucaggaguucaagacuagccuggccaagauggugaaacccugucucuacuaaaaauacaaaaauuagccgggugugguggcaggcaccuguaaucccagccacucgggaggcugaggcaggagaauugcuugaaccugggcggcagagguugcagugagccgagauuguuccacugcacuucagccugggcaacagagugagacuucgucucaaaaaaaaaaaaaaaaaaaaaggggggccggggcaguaguucacacguguaacuuugggagacuaaagcaagaggauggcuucuagccaguaguuugagaccagccugagcaacauagcgagacccugucacuacaaaaaauuaaaauuuaaaauuaauuuaauuaaaaauuauccuucaaauuaaaaaaaaaaucaucugaggccaggcacaguggcucacauuuguaaucccagcaguuugagaagccaaggcgggaggaucacuugaucccaggaauucaagaacagccuaggcaacauagugaaaccccuaucucuaccaaaaauagaaaaaauuagcuagaugugguggugugugccuguagucccagcugcucagaaagcugaggugggaggaucacucgagcccaggaguuugagguugcagugagccaugauuauaugacuguacucuagcccgcaugacacagagcgagaccucaucucuuaaaaaagaaaaaaaaaugaguaaaacuagacaauaaaacgcaaaccaauagaaucaucacaaauagccaagcaaagacuucuguuucauaaaaaacugacaaaaaaaaaaguuagaauuuucucuuuccuuuuuuuuuuuguuuugggacaaggucucacucugucacccaggcuggaguacagugaugcaaucuuggcucacugcuaccucugccucccagggucaagugauccucccaccucagccucccaaguagcugggauuacaggugugggccaccuugucuggcuaauuuuuguauuuuuaguagagaugggguuuugccauguuguccaggcuggucucaaacuccugaccucaaaugaucccccugccuuggccucccaaagugcugggauuauaggcgugagccaccaugcccggccucucuuuccuuuucagcuaagcauuuugaaaggagaaucauauuacauuucuucacuucccaaacauucccuaacuggaaaggugaugguacugcccucacuguuccacugaauauaccuucauggagggcauccaugacuucuuaauugccaaaucuagugaacauccuaacaucuuugauuccucauucuacugggcuccuuuauuucucucaauaguuuuuagauuucaggguuuguuaaaacauauugcuguuuccuaccuucgggguguccaauucaguaacucuagagccugcauuucugaaguucccuggugaugcugaugcuuccaguuggggacuacauuuugacaaccauuguuuuaucuaauaauaaugacuauucucuccuugaaauauacugcucuuuuugauucuguaacaguauauucuccuaguuuuccuacuaauuacucaucuaugaagaaaguaaucaaaagagaccuaaaaaagauaaauuuugaaaagcuuuuauauauggaaugacuaaugcuuauagaggcccacugacuuuuaacuuaauuuaaauguucuuuuuugcccuaauggugcugaccaacuuaacuuuuuaaaaaaauaacaagccaggugcgguggcucacaccuguaaucccagcacuuugggaggcugagguggguggauugcuugagcucagaaguucgagaccagccugggcaacauggcaaaacccugucucuacaaaaaauacaaaaauuaaucaggcaugguggcaugcaucuguaguccuagcuacucgggagguugaggugggaggacugcuugagccugggagauugaggcugcagugagccaugaucaugcuacugcacuccauccugggugacagacuggacccugugucauaaaauaaaauaaaauaaaauaaaaauaaauacuuuguugacauauaauucauacaccauaaaaucuaucuuuuuaaaggauaaaauucagugucuuuuugucuguuuuuguuuuguuuuuuuuugagauggagucuugcucugucgcccaggcugcagugcaguggcaugaucucagcuuacuacaaccuccaccuucccggcugacacgauucuccuaucucagccuccugaguagcugggacugcaggcaugugccaccacaccuggcuaauuuuuguauuuuuagcagagauggguuuucgccauguuggccaggcuggucucaaaacuccagcgcucaaacgaucuauccaccuuagccucccaaaguucugggauaacaggugggagccacugcacccugccauuucaauaguuuuuuuaaaauauacccacagagucgugaaaucaucaccacuaucuaauuuuagaauauuuucauuguuccccaaaagaaacugugugcccauuaagcuguaacuccuaauugcgccccuuuccccaaccacagcaaaucuacuuuucaucucuguggauuugccuguucuggacauugcauauauguggacucauacaauaagugguuuguugugucugguuucucucauuuagcauaauguuuuacagguucauucauguugcagcaugugucagcauuuuauacuuuuuuauggccaaacaauaugccauuguauugguauacuauauuuuguuuauccguucauuaguugauggacguuuagguuucugguuuuuuggcgaguaugaauaugcagcuauggauauuauguuuaaguuauuguguuaacauguuuucuguucuuuuaguuauauaucuaggaauggaauuguugggucaugguaacccuauguuuaacuuucugaggaacugccaaacuguuuucugaaguggcuacaccauuuuacaauuuaaccuuuugaguuucugcuuugugcuuuaaugaugcuuuucuaaauuacaugguuuuucagacaccuugauuuuagaguuaaagcuaaucuuuuuuuuuuuuuuuuuuuuuugagacggaguuucacucuuguugcccaggcuggagugcaauggcaugaucuuggcgcacugcaaccuccgccuccuggguucaagcaauucuccugccucagccucccgaguagcugagauuacaggcaugggccaccacaccuggcuaauuuuuguguuuucaguaaagaugggguuucaccauguuggccgggcuggucucgaacuccugaccucaagugaucugcccgccuuggucucccaaagugcugggauuacaggcgugagccaccgcgccuggccuuuuuuuuuuuuuuuuuuuuuuugagacagagucucgcucuugucguccaggcuggagugcaguggugcaaucuuggcucacugcaaccucugccuccuggguucaagugauucuucugccccagccucccagguagcuaggauugacaggcgugugucaccaugcccagcuaauuuuuguauuuuuaguagagacgguauuucgccagguuggccaggcuggucucgagcuccugaccucaggugauuacccaccucagccucccaaagugcugggauuacaggcgugagccaccacgcccggcccuaaagcuaauaucuuuugaaagaaauucuuuuuauaauauuaaauuuaucuaaauuagucaaaaguauuuaucacuaauguauuguaacccuguuuuuaagcuguugcauuugucuaaaaauggaauguaauagauaaaacuaacuuacuaauuuuguuaacagagugggaggcuaagcaaagaacuggauuuaguaagucaccaugugaggacaaaacuugaugaacugaaaaggcaagaaguaggaagguuaagaauguuaauuaaagcuaaguuggauucccuucaagguaagugcuaaacaaaagguaggauuuuuuuuuucuuuuuuccuuuugaaacagcguuuuacccugugguucaggcuggagugcaguggcacaaucacaguucacuacagccuugaccaccugggcucaagugauccucccaucucaaccuccugaguagcugagaccacaggugugugccaccaugccuggcuaauuuuuuuuguuaguuagacaggguuuugcuguguugcccaagcuggucuugaacuccugggcucaagcaaucuuccuaucuugaccaaagagcugggauuacaggcaugagcuggcgggccuggcuagaaaauuuuaacauuugguuguugaggucaguuuauauuaguacgugccaucuauguucuucuagucaaaauuuuauguuaguauugauuuggcuucucuuaauuuuuagaauuuaauguuuuaaauagauaauacauuuuauaucauucaaaaaucaguauaauaagccauaauuauagcaaugaaaaggaagaaugaaaaguaaucaauuaaacaacugguuuaaagaaggaaaaauaauauuaaaggaaaccaaaaggaagcagagaaagaauaucuaaucagaagaauuuucauacauggaauagaaaauuuuucagagaucuagccccagaaaaaaacacaagauccagaccauuucuuuucuuucuuuuuuuuaaagaaaaucuuuuaggagacgagaucuuccucugucaccuaggcuggagugcaguggcauggucauagcucacugcagccuugaacuccuagggcucagguaguccucccaccucagccucccaaguagcuaggagugcaggcaugcaccaccaugcccugcuaauuuuuuuuuuuuuuuuucugagauggagucucgcucugucgcccaggcuggagugcaguggcgugaucuuggcucacugcaagcucugccucccggguucacaccauucuccugccucagccucccaguagcugggacuacaggcgcccacuaccacacccagcuaauuuuuuguauuuuuaguagagacgggguuucaccauguuagccaggauggucucagucuccugaccucgugauccacccgccucggccucccaaagugcugggauuacaggcgugagccaccgcacccggccuaguuguuuuuuuaauuacguuuuuuagagauauggucuugcuguguugcccaggcuggucucaaacuucuggccucaaguaauccugaguugcuaggauuacauaugcauaagaauaaguuucauaaagggauacuaucugucuacucuuuaaugauuugagugauucuaucaaaccauuaaagagcagauugucaauucuauuuaaucuauuccagagcauagaaaaagaaggaaagcuuccacauucuugccauauauugaugccaaaaucaaaauuauuaugucuccaaagaauacuaucucaugacaguuggauuuauuucaggaauauaagauggacuuaauauuaggaaaucuaauauuauaaaucaucauauaaauaguccuaaggagaaaaaaaucuuuaaaauuuugauguaucaaaaaaaagucauaaagucaaaggacaaaugauaaauuggaauaaauauuagaauccuuauucuuuuaauuuuaggcuaugagaagauuaaauagcuauguaauagaauuuccgaaaugcaaggauaucuuaaaguuaucuugcugggcaugauggcucacgccuguaaucccagcacuuugggaggccgaggcgagugggucaccugaggucaggagauugagaccagccuggccaacauggugaaaccucaucucuacuaaauauacaaaaaucagcugggugugguggcacaugccuguaaucccagcuacuuagaaggcugaggcaggagaaucgcuugagcccaggaggcagagguugcagugaacugagaucacgucaccucacuccagccugggcgacagagcgagacuccaucucaaaaaaaaaaaaaaaaaagaaaaguuauaagucauauggcuuucuccauguaugcagaaaauccauuugacaaaauugaacaccaauucauaauuuaaaguaauaaaauacuaauuaauagauaaauucuguaacacgauaagcuauauccaacucaguuacaucauacuuaguggggaagcacaaguauguauccugacugaaauuagaaacaagacaguguugcccacuguaaccaccacuaaauaacaucgcuuuggagguacaagccaaaacauuuauuuauuuuuaauuuuuaaauuuuuaauuuuaauuuuuuuuuuuuugagaccgagucucacugagucacccaugcuagagcaugcaguggugcaguuucagcucacugcaaccuccgccuccuguguucaagggauucuccugccucagccuccugagucauugggauuacaggugccugccaccacucccggcuaauuuuuaauuuucaguggagacaguguuucaccauguuggucaggcuggucucgaacuccugaccucaggugauccaccugccuuggccucccaaaaugcugggauuacaggcauuagccaccgugccugaucuagccaaaacauucauacaaauaaaaaaaauuuggagguaaaguaauuggaaaggaggugauaaaaccaucuuuuuucacagaugauaugauguuuauauauauguggaacacccaaaauaauuaauggaaaaaauuacuauaaacaacaggaaaauugagccccucaauaggaaaauuaugguaaacuuaauccguagaaaucaauauuuuccauauguacguaacagccaguuagaagacagaauggaagaaaaggacuccauuuacaauagcaacaaagauaaaauguccagaauaaaccuacucagaaaugugcaaaacugacagacaaaaacuuuaaaauacucaugaaggaugcaaaaguagacuugaauaagugggaagacacaauaacuuuuugauacaaaggcucaguguuauaaacaugucaguuuucucuagauuaauauauaauuuaaacauaauccaaauaaaaauauauacuuuuauuuuucuggcaccagccaagugaauuuuucaaagugcauaugaaaaaggacacgaguaggccaggcaugguggcucacgccuguaaucccagcacuuggggaagcuaaggcgggcggaucaccugaggucaggaguucaagaccaguuucgccaacauggcaaaacccugucucuacuaaaaauacaaaaauuagcugggcaugguagcacaugccuguaaucccagcuacacaggaggcugaggcaggagaaucacuugaaccugggaggcagagguugcagugagcugagaucacacuauugcacuccagccugggugacagagugagacugugucucaaaaaaaaagaaaagaaaaagaacacaaguaagaaaacuuagauaccucugaaaaagaacaauaaaggacuagauauuagaaauugaaucuuuaauaucuauuaaaucuuuaauauugaauauuaaauuaugucacuaagccucagucauuaaaacuguauggcuuaggcaaaaaguggaaagaccagugaaacacaacagacauuccagaaguagaguuaaacacacaacauaauuuaguuuaauauaaaggugauaucucauuauuagugggauaaagauagguuuuuauuuuuauuauuauuaauuuuuuuuuuuagacaggucucacucuguugcccagguuggaguacagugaugcaaucauagcucauugcagccucagacuccugggcucaagagauucucacacuucagccuccugaguagcuaggacuacaggagugugccaccaugccuggcuaauuuucuuuuuuuuuuggagagagaaaaucucacuguguuccccaggcugguuugagggaacuccuggccucaaaugauccuucugccuuggccuccuaaagugcagggauuauagguguaugccaccacacccaacacauuuuuaauuaaguaguguugguauaacuugcuagccauuuggacaaagguauaguuaaaaccacaucucuuauauccuuuaucagaauaauuguaaaugaauuaaagauuuaaauguagaaaauaaaaucauaaaaguacuaugugacagcacaggugaauuuccuguauuaucuuggaaugaacuuucuaauuaugagucaaaaucaaagaguagauuuagccaguggaagaucuuucaagcugguucauguguccuugugauagccucccauagguugguuaucugggugguuuguugucauuaauaaacaucugaacauuuaacucuuggaauagugguucuaaaacuucagauugcaugagaaucuccuagaaaucuuguuagaaauguagauuacuagaucucaccuccagagauucugacucugggaaagaguauaauaaucuacauuuuaaacauauagucuuagaaaacaaauaccaaauacucaucauccugaaauuaaggauaucaaugagaaguaaauugagucaugccaugcuacuugggguagucaggcaugcaagguaauuccauacuuaaagccaggccuaagauguguggagauuucucucccugggacaacuuccauccccucagucuuaacaguauccucuucauuccaagauggguacugaauuucauugcauaaagaaaacaguguaggcugggcgugguggcucacaccuguaaucccagcacuuugggaggccgagguggguggaucaccugaggucaggaguucgagaccagccuggccaacauggcaaaacccugucucuacuaaaaauacaaaaaaauagccagaugugguggcaugugcugcuagcuacuugggaggcugaagaaggagaaucgcuugaacacaggaggcggagguugcagugagccgagaucaugccacugugccccagccugggugacagagugagacuccgucucaaaaaaaaaaaaaaagaaaagaaaacagucugauguaacuuuuaaacuaaggaauauuguuuucucauugguucaguaugaauugaaauaucugauaauuugaggaagggcuuaaacagucuuaauuuuagggagggggguaauuuuuaaaguaggcaguuuuuauucuuuuuauugaaauggagucuggcuguguugcccaggcuggucuugaacuccugagcucaagcgauccaacugccucaggcucccaaagugcuggguuuacaggcaugagccacugugccuggcccauucacgugguucaaauguagaaaauguagagcaaaaaucuaccugauauuuuuguauccugucaguucccaauguccccuaacaccauccuccuuggguuuaucuauuuguuuauuuuuaaguuaaauaauugagaugacguuuugcuauguuguccaggcuggucuuguacuccuauuccuggcuucaagugguccuccugccucagccucccaaagugcugggauuauaggcaugagccacugugccugacucuugaguuucuuuauauauaagcaaauacaaauacaauuuuuuuauugucccuuucuuuuuaugcaaaaggaaauacacauuuuugugcauuguuuuucaauuaauaauauauuuugaauaucuuucuguauuaguacauagagaccaucucucuuuuuauuuuuuguuuuuuuacagcugcauagaacuccauuauauggauauacuauaauuuauuuagccaggcccgugucaauugacauuuagguuauuucuagugaacuaucugugcauaugucacuguguaucccuguaagauuaucuuuaggauaauuuccccacaguggaauugccaaaucaaauuauauauauauauuuguaauuuugauagauauugccacauuugccuccauagagguuguaucaauacacauacccgccagcaauaauuccucacaggcuuacuaauggcaugugucaucaaacuuuaggaguuuuccauucuguuagauaguauagcagugcaguuuuaauauguauuucucuuauuuugagugagguuaagggucuuuuuauauauuucacugucuggucauuuuuuuuagggcuaagucuuaaaacaaguauuuucuucauaaauagaacugcuaguacagugccauacuuagaauucagugaaaacuugguugaaccagauuuagcaguucuucacuuucuggcauaacaauauguuccaggaucaacuuguaccuaccuugccccagcucuggaaugagccauuucucugaggagcacugguuuuucuuaaggggcaacuauauuuuagaucaagagcuggcacuagguacgcuccuugcuacuggaguguauuuucuuggcaccuuaauugcauggagcuaggaaauaugcaugucuauacacauagacacauauauaaacacauacauauucauauacaugugaaacaugcauauacauguuaaauguacauauuuuagaaaugcugaguucacacagauagugcuaauucccauucaucucuagcaauuucuuucuugccuuucacccuuccauauuuguauauuccuucuuccuaaaugagagcugauuuccaacaacuucaacaauguacccauuuugcucaauucuagaagggcucguauugcguuguuucuggugagcugucuuguauguauauccacuguguauccauuacauguguccacuauguaauacaacugaaacaauccagcaucacuucacccauuucacuauaguaaauuguaacuuguuuuuuaaacguuaaaaaaauugauauuuccuuaaaaauacuucauaauuaaaaggaaauuuaccuaaauuagauuuuuauuguuucauaagugauccauuggagcaauauacaaggaauucuuucauguaagcuuuagagcaauuauuuuuagaaauucuacuuaaaccuuugauaaggauacuauauuagagauuuauuaaaagcaggauauuuaguaguuuuaagauaauuaaaaaggguuuguuauugugcugauagucaacuaguuauuuaagauauaacauuaaaauaugcauaaggccaggcaugguggcucaugccuguaaccccagcacuuugagaggcugaguugggaggaucacuugaggccagaaauucaagaccagccugggcaauauagugagacccugucucuaccaaaaauuaaaaaaaaagaaauuagccaggcguaguggugcacaccuguuguccuagcuacuuaggaagcugaggugggaggauugcuugagcccaggaggucaaggaugcagugauccaugauugcaccauugcucuccagcuugggugacagagcaggaccaugucucaaaaaaaaaaugagagagaauuuuuaaaaauauacauguuaaauugcauuccacucuagguucaaggacacuaccuuuaacuagaauaacauacgcaguauucauaaaguaaauauaagccuuuauucuaaaacuuuggauuuccuuauaaaauccuauaggaauaaauaugaaaucuuuuucuuguguauaauuauuauguuucuagcuucuagaaauugaucauuuacaguuuucuuauuuucuuucagauauaggcauggaccaccaagcucuucuaaaacaauuugaucaccuaaaccaccugaauccugacaaguuugaauccacagauuuagauaugcuaaucaaagcggugagaauaauuccaaaaaguuuugucuuuauugugccuuugagguuuuguaauuugacaaguaaacccaaugaaauggaaauauaacuuuuauauauucuguagaaguucuuuaaaggaagguagcuuaacccuuauuaauacagauauuaauauguacauacaggucuaaaaucccuuauccacaauuccuaaauccaaaagcuguaaaaacugaaaccuggccugaaugaaccaauuauaguaaaaccauuuacaguuuuuauuuaaccuacuuagugugaauauuuauagauuuugcuuaagaaauacuagucuguuugauuacagaugcuacagggauauuccauaauauggcauauguaccauauucccuuucuuuaagguagaaaauucugagcacaucuggccucagagauuccagauaagaguuuguggaccucucacauuaugugugaauggaacuaguucuaaccuggcagguauuagauuaguuaaaugguuagaagccauuuuaguuuucuguacugucuagauuugauaauaguuccuuucuucuucuuuuuuuuuuuuaaaucaacuuacauauuacuugcuuaugaggaguuuccuaaaguuggggcuagcuuugaacuuuuaguuucuuugaauacucucugguaauaaugaugacuaaaauugcugggcaugguggcucaugccuguaaucccagcacuuugggaggccaaggaggguggaucacccaaggucagcaguucaagaccagccuggccaacauggugaaacccugucuguacuuaaaauacaaauauuagccgggagugguggugagcgccuguaaucccagcuacucgagaggccucaggaggcugaggugggauaaucgcuugaaccaagagguggagguggcagugagccgaaaucgugccacugcacuccagccugggugacgggugaaacuccgucucaaaaaaaaagaagaaaaaacuugacuaaaaugaaaugguagaauuuaaaaagaggaguccaguauguuuuugcccucccguaccacuucuguucaagaguaugcuauauucaagaauggcuuuauuuacauuuuucaagugaauguuuuuauuuaacuuaaaugcauuauugcauuucaggcaacaagugaucuggaacacuaugacaagacucgucaugaagaauuuaaaaaauaugaaaugaugaaggaacaugaaaggagagaauauuuaaaaacauugaaugaagaaaagagaaaagaagaagagucuaaauuugaagaaaugaagaaaaagcaugaaaaucacccuaaaguuaaucacccaguaaggauugugacuuuaugaaaccauuuuuagauaaagauacuucuucguaucagcggauuuuuauuguguuauuaguacuuaaaucuugauucuucugccaaguuccucaaauuuauauuuugagucuguacagauagauuauauuuuguuuugagcaauuuuuuaaaauugguucacagggaagcaaagaucaacuaaaagagguaugggaagagacugauggauuggauccuaaugacuuugaccccaagacauuuuucaaauuacaugguaacgauuugauacaaauauuaauauuuauaucugcugcuugaaaaaguauuugcuuuccucuuaauugauuucugccaaggucugcuauugaguucuagugagaguaaaugguuagaguuuuucuaggguaauaugauagucuuuauugcucaccugcaguauaaaauguuuuagauuaguagcucugucuuuauacuggcuuuuacuguugagucauaugaauuacugcaaaguucucuguuaagugaaaacuaaacugugacuagcuagguuauaucuaauaggcuuuauacuauaauauuacauuuuacuucuacucucauagaauauugcuuuacuuuauauuuuuggaaaaaaauggucaagauacgcuuuccuuacaaaugauuaugaauuacaaauaaauacagcauauuuaucaguucagcugaucuaaagcuucaugacaaagaauaaaugcuuuucugcagucuauugaugcuucacaucaguacuacuuuuguaaacccuuuauaaaucauuguauuuuaauuauuuucuaaguuauuaaaaucuauuuuugcauuuguaacuuuuaaacuuuagaugucaauagugauggauuccuggaugaacaagaauuagaagcccuauuuacuaaagagguaaaggaguuuauuaaguauucaguguucuuguucucucucuuuuuuuccuguuacuuucuuuccuuucauguucauuuaaaauuuuucuuuuuaguuggagaaaguauaugacccuaaaaaugaagaggaugauaugguagaaauggaagaagaaaggcuuagaaugagggaacauguaaugagugagguauguuuuaaaaguuuaagauaauauguuauuucuauguauuauuuaauucuugcaauaaaucuuuaagauggaaaauauacagaauuuguauuuaaauggaguuugcguuuuuguuuuuguuuuuuuuuugagacagggucuuacucuguugcccaggcuggaggcaguggugcaaucauggcucccugcagccucaaccuccugggcucaagcaauccuuuggucucagccuccugagacugaggagggaccacaagcuggagccaccaugccuaccuaauauuuuuuuuuuuuuuuugagacggagucucacucugucauccaaguuggagugcaguggcgcgaccucggcucacugcaaccuccgccucccagauucaagcaauucucugccucagccuccugaguagcagggauuauaggcacccaccaccacaccuagcuaauuuuuuuauuuuuaguagagacaggguuucagcauguuggccaggcuggucuugaacuccugaccucaggugauccauccgccuuggccucccaaagugcugggauuauagaugggauuacaggcaugagccacuggccuuuuuuguuuguuuuugagacauagucucacucugucacccaggcuggagugcaguggugcgaucuuggcucgcugcaaccucugccucccggguucaagugauucucuugccucagccuccugaguagcugggauuacaggcaugcaccaccacgccuggcugauuuuuuuauuuuuaguagagaugggguuucaccauguuugccaggcuggucuuaaacuccugaccucaagugauccacccacuucggccucccaaagugcuggcugggauuacaggcaugagccgccgcaccaggccgauuuuuauuuuuuuuaagagacagcaugucuuugcuacguugcccaggcugucagcuaacuuuuuaauuuuuggagacacaaggucuugcuauguugcccaggcugaaguuugcauuuuugauccagauuauuauacuagaugccuuuaguaugaauaaaauaauuuguaacuacuuuaaaauauucuaaaagauaaagaugcuacugcauaucagguauaaaacuuuuuuuuuugggcugggcaugauagcucaugccuauaaucccagcacuuugggaggccguggcagguggaucucuugaggucagaaguucgagaccagccuggcaaacauggugaaacccugugucuacuaaaaauacaaagauuagcugggugugguagugcauaccuacaaucccagcuacucgggaggcugaggcaugagaaucgcuugaacccaggcggcagaguuugcagugagccaagauuacaccacuguacuccagccugggugacacagcaagacuccaucucaaaaccaaaccaaagcaaacccuuuuuucaguacugaaaaacaaaaacaacaaccucugguuacugccucauuucucuguuucucuucaaggaguugucuauucuuccucuuccuguuaauucuucacuuuuccuuuucgccuuaaucugugcugauacaguugaugccucccucuuucucgaaaugcuuucuucacuuggcuuuuaggaaaccaccccuccucaguuuccucauaccucacucucucuucuuugcuggcucuuccuccucuuuccaaguucuacauguugcauugcccugggcccaucccuuggccguguucuccuuucucgcuucguucucuccuuaagugauaguguggagccccaugucucuauauaugcucuauaucugcauguaugcuggugaguucaacauuuuuaucuucagcugucuccuuucucugaguucuaggguuguaucugcuugacaguucuccuuguguuuaacucacaucuucuucaaacccagaucuguuccuuccucagccuuuuucauuucaacaaaugaaucauaauucaucuaguugcucaggcuaagucauccuuaacuucuuuccucacauccugcauuuccucuauaaguucugucugaucuaucuuucaaacagauccagaauuugaccacuuccccccacuuccacuacuauuuaauaccaaucaaguccaagcaagucuccuaacuggcaucucugcuucuauuccuuaccccacugcagacacuucuucauaaguaggcagaguaagcucuuaaaagcauaaaucaggucaugugcucucuugcacagaaauacuucaguggcuugcaauuucccuuguaauaugaucccaaaucccuccuauuuccaaaagauucgugacuucauccuugccuugcucucugugacucucucuccucuggccuucugauguuuaccucucaucaagcuuguucccauuuuagggcauuuggacuuaauauuucuuuuuucuggaauaccccuuuucuagaucaucacaagguuuuacuuccaccgagucugugcucaaauguccaugguccauccaaugacuacgcucauuuaaauauuugccuuucucugcaguucuugcucugccucuccucccuuuaagccaaaaacucugauauaggcaucauaugcaggguaacugaaucccacuauuuugcuucaguaacuuucaucugaauuuuugagugguaaaugcuaaauuggggucucuguugacugcugacaucccaacuaucaagugaauuucuuugaccauuauagauuacaccuuuguaacgaaauuugccacagccuguaacagcuguacaagaggauuuggagagguugucagcuuuaguuuugauuuugguaauuguguuuuuuuaagaaaaaauguugagagcauuuuaauuuaaccuccuuuacucuuggcuaaaaccguccucuuucuggaaugguucuuuuucuuacccaagaacuuggcuucaagagggauuauacauauuaugguaaaggaggaagacaguaacagucaccuaaccacucagaucagcugacugaaacuuaaugguuuugugggcauuagguauauagauaucucauauuuuccaauuugaauuauauagaagagaaagauguuuauuuuguaauucuaguauaauguugagugcucuguuuuuuauuuuuuuccuccaguuucuguggaaguuaagugaguccuaauugcuguauguuuauguaguggcaucuauuacaagacaguugauagugucuaaauaauaugagaaagauuuacuuuauauuauguauacauuuuguuuuaaucagguugauacuaacaaagacagauuggugacucuggaggaguuuuugaaagccacagaaaaaaaagaauucuuggagccagauagcugggagguaauagaaccuacucuaaaugagauguaugguucaacaaauucuacaucagucuauucuacuuuuaacuuuuauuccccauuauguuugcauguauagucuuacuaucuugggauuuuuauauaaaugucaguauaaaauaaugaacuucauuucuuggaaagcuuguagcaauuuauuucuuguuuauaaucauacugcauaaaauuggaagucuuuuaaaaauuauacuuuuuucaaaguauaaaauaggauucguuauugaaaauuagaaauauagauauauugaaagaauaaauuagaauucaccuauaauuuuacuaaucagagguagauucuugaguuaugcaucguacuguguuaauuuggaaugguaugcaguuuguauauauaguauaugcacauauacaguauguaaacaauguauugucucauuuuaaauucacacauauacauauauucauauuuauguguuuuuuguuguuguuuguuuguuuuuuguuuuuuuguuuuuugagacagagucuugcucuguugcccaggcuggagugcaguagcgcgaccuuggcucacugcaaccuccgccucccagauucaagcaauucucugccucagccuccugaguagcugggauuacaggugcccgccaccacgcccggcuaauuuuuguauuuuuaguagagaugggguuucaccaucuuggccaggcuggucuugaacuccugaccucgugauucacccaccucagccucccaaaguacugggauuacaggcauaagccaccgcaucaggccagucauauuuauguauuuuuuaaaauggcuucauacuguauaaaugacuuuguauguugaugaaauacuuuuuaaaaauuuaacaauauuucacaaacaucuuuuaauaucauucuucaaaaacaugauuuuuaaaaugacuacccaauaugcaguuauauggcuguagcauaauuuauauauccauuucuccaaauuuagaccuuuuggguaaauuccaguauuuuacuguaaugacacuaugaugacuaucuguuucuucacacauuuuugggcaaucuauaaugauuucccugggauuaacucccaggaauagaacuauucuuaagauuuaugaaaaauuuuuuaaauuucucaguauaucuuggcaaacugcucgagaaaaguauaucaacuuguaacacagucaacuguguauaaaugaaugcauagacaacuugaaaagaauaguugagaggcaccaaccaaaauggauggaagaaagaacauagucuuuuucuacauaaaaacugaaaauauuacuauuuaaauuaaaauuuuaauuguccagaaaauaguuuaagaaagggugaacagcuacucuaguuuacccaggacugaggaauuuccaaggauguggaacuuuucauugcuaaagccagacauuucugggcaaauugggacaguuggccccuuuaguuugacaucagaaaagucagccucuuuuuguauuggguuuuugucuaacguuugaaauguuucuugacuuuggugaagaagaagaaugcuaagauuauuugaaucuacauucccuuuagugcaucugguagacuagaagaucaauagauaauuauauacuuuuaaaauuuugacauaauuucagauuuacaagaguugcaggaauagacaggaaaucccugaauacauuucaaccagguuuaacuacauuugcuuuaucuuucucucuuucccuccucucuauuuuuaaucucuauguguguguauguauaacauauaauuauguuguaauguauauacuuauguauauguuauguauauauauaaacauguauauguguacauauauauaaaguuuugaauugcuuaagaguaaauuacacaucaugccacuuuaaucuaaaauacuugaguguauauuucuugcaaacaaagauuuaccuuauguaaucauaguaaaauuaucaauacuacacacaugguacucuucuccaaucucuagacuuagugagauuuugucaauuuucccaauaauauccuuuauaacaaaagaaaauccaagaugauacauugaauucaguuguaaugucuuuuuagucuccuuccaucugaaacaaucaagaggacagacuauuauguuguacaaugucccuugaauaccacagaagagaugcucaguguauccuauuagaaggcacauguugacgauccccauaacugguaaugguagcuuugaucauuuuguuaagguggugucuaccagauuuuuuuauguaacguuauuauuuuaccuuucacauuuuaaaaaguaucucgucuagcccaccauagugagagaaucagaagucaguuuuuguuuuuuuauuuuauaaauacagaccaggucucacuauauugcccaggcuggucccgaacuccugggcucaaggaauccuccugccucagccucccaaaaugugugagccacugugccuggaaagaagucagcuuuuuuuuuuuuuuuuuuuuuuaauaauuuuaggaaaaauaaagacagagucucucucugucacccaggcuggaguacacugacgugaucuuggcucacugcaaccucugcccccaucccccucaaccugccugggcucaagugauucucccaccucagccuccugaguagcugagaccacaggcaugcaccaccaugccuggaucuuuuuuuuguguuuuuaguagaggcaggaugucgucauguugaccaggauggucucaaacuccugagcucaagcaaucugccugccuuggccucccaaaguacugggauuacauaugugagucaccgugcccagacagaagucagcuuuaaaaaaaaaauacauucaauaucauaucaaaaguauuuucacauaauauuuguaagccuuauuuuaaaagcuauggagguauauaaacauuuuuuuaggguuugacauuuaaauuauuucauuuuuuacugcuauuuuaaaaagaaaaugcugcuacaaauacauuuuuauauaaagcuuuguacgugauuaggguuguuuuauaggguagauucucaauguagcauuaccaggacccagggaauauuuuuaaggcuauuuuuaaggcuugaacauccugauauacugaaaguaaggaagucccuaaagaaugauccagauaugucacaaagacacaaaagccaguuugaagaaacucucacuggccaaaucugggacaauuugaacguggaaauaaugaugauaaggauuagagcuuauugaauaaaacaagaagccacgagucuacacugauauaaguagagggagagagaaggccgaauucuuuugcaaaauugcuuuucaaaagacuuacgccauuuauauuuccaccauuaaaaacgugugcacucuuuaaacauaucagagcugggcacgguggugccuaccuguaggcccagcuacuuaggaggcaggaggaccacuugagcccaggaguuugagaccagucugggcaauguaaugagacccugucucuaaaaagaaaaaaaaaauuuuuuuaaaauacuuugagaauaugugaauguauuauuguugauguccauugaugauucuagcuagaauuauuacugugaugguugacaaauggagauuuucuaaccugaucaucccuucuacauuuguuaguuggcuuucuacuguaaugaaaaacuauuccuuccccucgaccuucuacuuauaucaguguagacucauggcuucuuuuauucaauaagcucuaaucuuuaccaucauuauuuccauacucaaauugucccagacuuggccagugagaguuucuucagacuggcuuuuguguccuucugacauguccgaaugauucuuuggggacuuccuuacuuuuaguauaucaggauguucaaggcuuaccuuauucuuucccugacccaacccagaaugacccauuuuucugagaagcccugcagaccaagaucugggcccuggauguuccccuugcuacuguagugucauugcuuccaaggucuugucagaugacagagcaggggaauuaaaagaauauguauauaauauggauguguauauguacauauguacacacauacaugcacacauacacacauauacccaccuauauacauuaauauucauuucuacauaucuaucaauauauauuaaaacucaugaauuuacacugauaucuccaguugcaauccaacaacucuugauuuccuuuuuuucauuuuaauuuuuugaaguucagggguacaugugcagguuuauuauauaguuuauauauauauaaacuugugucaugggguuuuguuuuacagauuauuuuauuacccagguauuaagcccucauacccauuaguuauuuuuccugauccuucuccuccuccugcccucuauccuccuauaggccccaguguguguuguuccucacuauguguccauguguucucaucauuuaccucccacuuauaagugagaacaugcaguauuugguuuucuguuucugcauuaguuugcuagagauacuguccuccagcuucauccaugcuccugcaggggacaugaucucguucuuuuuuuauggcugcauaguauuccaugguguauauguaccacauuucuuuaucuacucacuuacuuugggcauuuagguugauucuaugucuuugcuauugugaauagugcugcaaugaacauaugugccacaacuuugauuucaacuuagcauucuaucuuuugccauauuucaugcaaaaccuaacucccuuuuccuuaaaaauauuucauuuauucacucaauccuagaauguacaagaaguuucagaauacuaauccaugccucuguaaaauaagaguuuaaauuuuguuuagauuuuguuguuguuggggccagugcaguagcucaugccuguaaucucagcacuuugggaggccgaggugggcggaucaccugauaucagaccuggccaacauggugaaaccuugucucuauuaaaaauacaaaaauuagccgggagugguggugcacuccuguaaucccagcugcucgggaggcugaggcaggagaaucacuugaaccugggagauggagguugcagugagucgagauugcaccccagcacuccagccuggaugacagagcaagacuccgucucaaaaaacuaaaaaagauuuuauuguuauuuuuaaggugagggcauauuguacaaauacuaugaucaaaaauuacuuggguuaguucauuuuuuuccuccccguucuguggguuaucuuacucauuuaaaauaaaaguacuauuuauuuacuucuguuuuucuauucaagcuuuaggauuuuccugucuuguggauuuuaauuuucuugaguaugugaaacauuaacacauuuccagaaauugaaucuguacaaagaagguguauucagacaaguuuuuucuuuauuuuuuuuaauaaguaaaauuuguugugugugcauacauaguauguguauauauuuaugggguacuuagauauuuugguagaggcaugugauguguaauaaucacauaauggaaaauuggguauccauccccucaacuguuuauccuuuguguuacaaacaauccaauuauacucuuuuaguuauuuucaaauguacaauuaaauuauuauugacuauagucccccuguuguacuaugaaauacuggguuuuauucauucuauuuuuuuuuuuuugguacccauuaacuauccccaccacuccccaacuccacacuuuuccuagccucugguaaccauccuucuauucuuuaucuccaugaguucaauuguuuugauuuuuagaucccacagauaaguaggaacaugugauauuugucuuucugugccuggcuuauuucacuuaacauaaugaccuccaguuccacccaugguguugcaaaugacaaucucauucuuuuuuuauggcugaaauaauacuccauuguguauaaguaccacauuuucuucauccauucaucuguugauggaugcuuagcuugcuuccaaaucuuagcuauugugaacaguacuacaacaaacauggaaacacagauaucucuuugauauaccaauuuccuuucuuuuggguuaagauugcauuaagauugcugggucauauguuaacucuauuuuuaauuuuuugaggaacuuccacacuguucuccauagugguuguauuaauuuacaugccuaccaacaguguacgaggguucuuuuuuuuucacauccuugccaacauuuguuauugccugucuuuuggauaaaagccauuuuaacuggggugagaugguaucucauuguaguuuuguguuucucugaugaucagugauguugagcacuuuuucauaugccuguuugccauuuuaugucuucuuucgagaaaugucuacucaaaucuuuugaccauuuuugucagauuauuagauaauucccuauagaguuguuugaaccccuuauauauucuaguuauuaaucccuugucagaugcguaguuugcaauuauuuucucucauucuguggguuaucccuucacuuuguugauuuuuugcuuugcucugcagaagcuuuuuuacuugaugugaucugauuugucuauuuuugcuuugguugucugugcuuacggauauuacucaagaauuuuuuguccaggucaauguucuggagaguuuccucaauguuuucuuguaguaguuugauaguuugaggucuuagaguuaagucuuuaauccauuuugauuugauuuuuguauaaggcaagauguagguaucaagcuucauucuucugcauauggauguucaguuuuccagcaccauuuauugaagagauuguauuuuccccaauguauguucuuggcaccuuuuucaaaaaugaguuuacaguagguguguggauuuguuucuggguucucuauucuguuccauugggccuguaugucuguuuuuaugccaguacgauuguguuuuggugacuauaguuuuguaggauaauuugaagucaaaugaugugauuccuucagcuuuguucuuuuugcuuugguuauucuaggucuuuuguaguuucacauacauuuuaggauuguuuuaucuauuucugugaaaaaugucauuggguauuuugauauggacugcacugaauuuguagacugcuuuggggaguauggagauuuucacaacacagauuauuucaauccuugaacauagaauaucuuuccauuuuuugauguccucuucaauuucuuucaucuguguuuuauaguuuucauuauagagaucuuaacuucuuugguuaauuccuagguauuuaauuuuauuuguggcuauuauaaaugggauuacuuuuuaaauuucuuuuucagauugcuuauuguuggcauauagaaaugcugcugauuuuuguauguugauuuuguauccugcaaauuuacuaaauuuaucgguucuaauaguuuuuuuuuuguguggagucuuuagguuuuucccaaauauaagauuauaucaucugcaaacaaggauaguuugacuucuuccauuccaguuuggaugcccuuuauaucuuucucuugucuuauugaucuagcugggacuuccaguacuacauugaauaacaguggugaaagcgagcauccuuguuguguuccagaucuaagaggaaacacuuucaguuuuucccauucgguaugauauuagcugugggucugucauauaugccuuuuauuauaucaagguauguuccuucuauacccauuuuuugaggguuuucaucaugaagggauguugaauuuuuucaaauucuuuuucagcaucaguugaaaugaucauaugguuuuuguuuuucauucuguugauauaucauauugauuuguguauguugacccauccuugcaucacagggauaaaucccaguuggccgugauguaugaucuuuuuaauguauuguugaacucaguuugcuauuauuuuguugaguauuuuugcauuaauauccaccagagcuauuggcuuguaauuuucuuuuuucgaugugacuuugucugguuuugguaucaggguaguacgagccuugucaaaugaguuuggaaguauuccuuccuccuuuaguuuuuggaauaguuugaguaggauuggcaucaguuuuucuuuaaaggguugguagaauucagcagugaagccauuggguccugggcauuuuuuugcugggugacuuuuuuuuauggccuugauuucauuacuuguuacuggucuguucagguuuuggauuucuuccgaauucaaucuugguaguuuguaugugucuaggaauuuguccauuucuuguagauuuuccaauuuauuggcauauaguugcucauaguagccauuaaggauccauugaauuucugcaguaccaguuguaaugucuccuuuuucaucucugauuucauuuauuuggguuuucucucuuugucucuuaguauggcuaaagguuugucaauuuuguuuaacuucaaaaaaccaacuuuuuguuucauugaucuuuuguaucauuucauauucauuuauuucugcucugaucuuuauuuuuucaucuucuacuaauuuuggauucaguuugcucuugcuuuuccaguuaagaugcacuauuagguuauuuauuuugagauuuuucuuuuuugauauagacaguuauaacuauaauuuucccucuuaguacuacauuugcuuuaucccacagguuuugguauguuguauuuccauuaucauuuguuucaagaaauguuucaauuuccuucuuaauuuuuucauugacccacugguuauucaggagcauauuguuuaauuuccauguguuuguauaguuucaaaaauuccucuuauuaucgauuuguaguuuuauuccauuguggucagagaagaugcuugcuauuauuucuauuuuuugaauuuuuuuuuuugagacaaagucuuguucuguugcccaggcuagagggcaguggcacuaugucagcucacugcaaccuucgccucucagguccaagcaguucuugugccucagccucccaaguagcuggaauuacaggugcaugccaccacgcccagcuaacuucuguauuuuuaguagagaugggguuucaccauguuggccaggcuagucuugaucucccaaccucaagugauccgcccaccuuggcuucccaaagugcugggauuacuggcaugagccaccaugcucagccaaauguuauaagacuuguuuugugaccuagcauauugucuauuugucuauuuauuuauuuauuuauuuauuuauuuauuuauuuuugagacagagccucacucuguugcccuggcuagagugcaguggcgcgaucuuggcucacugcaaccuccgccuccuggguucaagcgauucuccugccucagccuccugaguagcugggauuacagaugugugccacaacgcccggcuaauuuuuguaucuuuuuaguagagaugggguuuaccauauuggccaggcuggucuugaacuccugacuucaaguuauccacccacuucagccuuccaaagugcuaggauuacaggcuugggccaccgugccuggccuauauugucuaucuuugagaacgauccaugugcuaaggagaaaaauguguacucuauagcuguuggaugaaauacuuguuaaguaucuauuagauccauuugaucuauaguguagauuauguccaauguuacuuuguugauuuucugucugggagaucugucuaaugcugaaagugggguguugaaaucuucagcuauuauuguauugaggccugucuuugucuuuagcucuaauaauauuugcuuaauauaucugggugcucuaguguugggugcauaucuguuuacagucauucuaucuucuugcugaauggacccauuuaucauuuucuuugucucuucuuaguuuuugucuugaccucuguuuugucugauguaaguacugcuccugcuacugcucuuuuuugguuuccauuggcagggaauaucuuuuuccaucucuuuauuuucagucuguauaucuuuauaggugaaguguguuucuuuuaggcaacagaucauugggucuuguuuuuucaucuauucagaugcucuaugucuugauugaaaaguuuaguugauuuacuuucaaaguuauuauuauugauaaguagggacuuacuccugccauuuuguuauuuuucuggauguuuugcugucuucuuuuucuuccuuccugucuuccuuuuagugaagcuaauuuucucugguggcaugcucuaauuucuugcuuuuuuuguguguguaucaauuguauguuuuuagauuugagguuaccaugaggccugcaaauaauauuuuauaacccauuauuuuaaauugaugacaacacugauugcauaaacaaacaugcaaaaagaaaauaaauacuuuacacuuuaacuucaucccccugcuuuuuaacuuuuuguuguuacuuuuucuuuuuuuuuuuucgagacaguguuucacucuuguugcucaggcuggagugcaauggcaagaucucggcucaccacaaccuccacuuccuggguucaagugauucucaugccucagccucccaaauagcugggauuauagucaugcaccaccaugcccagcuaauuuuguauuuauaauagagacaggauuucuccauguuggucaggcuggucucgaacucccaaccuaaggugaucugccugccucagccucccaaagugcugggauuacaggcgugagccucugugccuggccucauuguuaccguuuuuuuuuuuuuuuuuuuuuuugagauggaguuuugcucuuguugcccaggcuggaguguaauggugcaaucucagcucaccgcaaccucugccuccuggguucaagcgauucuccugccucccccucccgaguagcugggauuacaggcaugugccaccacacgcggcuaauuuuuuguauuuuuaauagagacaggguuucuccauguuggucaggcuggucucgaacucccagccucaagugaucugccuaccucggccucccaaagugcugggauuacaggcaugagccaccgcaccuggcuguacuuuuuauaucuuauuuuauugccugccuugaaaaguuguaguuauuauuuuauuuauuuuuaguuauuuuugaucgguuccucguuuggucuuuuacuuaagucaagagaaguuuauauacgacaauuacaguguuauacuauucuguguuuuucugggugcuuacuguuaacagugacuuuuguaccuucagaugauuucuuuguucucauuaacauccuuuuauuucagauugaagaacuaccuuucacauuucuuauaggacaagucugguguugaugcaaucccucaguuuuuguuuaucugagaaggucuuuauuucuccuucaugcuuaaaggauauuuucagugaauauacuauuccaggguaaaaaauuuuuuuuccugucaguacugcaaauauuucauaucagucucucuuggccuauaagauuuccacugaaaaaucugccaccugagacagagucuugcucuguuacccagacuggagugcaguggcgugaucuuggcucacugcaacuucugcuucucagguucaagugauucuugugguuuaggcucccgagcagcugggauuacaggugugugccaucacaucuggcugauuuuuauauuuuuaggugagaugagguuuuuccacguuggccaggcuggucuugaaauccuggucucaagugaucugcccaccucugccucccaaagugcugagauuacaggugugagccacuacgccucgccaggauccuuucuuuguacuugaccuuugguaguuugauuauuaaaugccaugagguagucugacgugaguuaaaucugcuugguguucuauaaccuuuuugcacuugaauguugaaauauuuuugauauuauuccuuugaauaaacuuucuacccuuaucucuuucucugccuccucuuuaaggccaauaaaacuccuauauuugccguuuugaggcuguuuucuagaucuuguaagcaugcuuucauuguuuuucauucucucuccuuuguguccucuguauuuucaaauagccugucuucaagcucaguaauucuuucuuauacuugaucaguucugcuauuaagagacuccgaugcauucuucagcguguccguuccauuuuuuuaacucuagaauuucugcuugauucuuucuaauuauuuugaucucuuuguuaaauuuaucugauggaauucugaauuccuucucuguguuaccuugaauuucuuugaguuuccucaacacagcuauuuugaauucuguaucugaaaggucauauaucucugguucuccaggauuggaaccuggugccuuauuuaauucauuugguuaggucauguuuucuugggugguggugauguguguagauguuuguugguaucagagcauugaagaguuagauacuuacuguaaucuucacacucuggguuuguuugugcauguccuucuuuggaaagcuuuccagguauuccacgggacuugggcccaaaguccaguaauucugugauuuuugcagacucuuaaaaguaccaccuugguggucuuggauaagauccagaagaauucucuagauuaccaggcagagacucuuguucuuuucccuuacuuucuuccaaacaaauggucucucucucugugcugagccaccuggaacuggagguguggugaugcaaguaccuuuauggccaucaccacggaacugugcugggucaagccugaagccaacauggcacugggccuugcccaaggcccuuuccuucaugguggcgaguucccccagauccuggguguguccagagauggugucuagaagccagggaauggaguaaaaaacccuagcaauuuaccugauguucaguuuuacuguggcuaagcugacacucaaaucacaauacaaaagccuuccugcucuucacuccucuuuccacaggcagaggacccucucccuguggccauuacuaccaccaucucugguccacaugggguucugccagccacugcugauauuuacugaaagcccaagggcuuuucugucaccuugcgguaaaugcugccaggccuuuacccuucagggaagugggcuccccucuggcccaaggcgaguccagaaaugcuguccaagagccaaggccuggacucagggacuccaaaagacugcuuguuggucuaccccauuguggcugagcugguaccuagggugcaagacaaaaaucgccuuuacuuucccucugcuuuccucaaacaggggucucucgccauagccacuacagcugggaaugugcugggucaccccgaagccagcaugucucaguccaagacccacagcauacuccaugggucuugccgcugauuauucagggcccaggggcucuuuacuuagcaagugaugaagccugccaggacugcucccuuaaggcagcaguuuccuuuugggccagcaggguaugucuagaaaugucaccugggagcuagggccuggaaucagguccucacaacucugccugguguccuauccuacuauggcuuagcugguauccaagaugcaaaacaaagcccucuuuacuuuuuccucuccuuuccucaagaaaggagucacuuucauagccacaagcugcacugccugagguugggggagggguagcacaagcguucccuuagccucaccagcugguaucuccccuggucaccugcuacccuaguucacuggcucuaagcccagccuagcacuaggaguugccuaggaauuacaguccuccuuuccuagacugccuuucaaguuuaccuaggaccccagagcacuucagcccgcauggugaggccugccaggaaauucagugcccauugcugggaugggugauucuccucuggcuagggcugcuucaaaugcuccuaugcaugggcagugguggagcccagcacagcuuuauucucugcugugacagggcagcacugaguucaauguaaagucccccagucgcuaugcucccuccccagagggcacagacucucugugcugcaggucugccacgagggaaugggagagagguggcauaggugauucaagacugucucuuuugcccuucucagugucuuugcaggugauaugaaguugaaaccagguacugugagugcucaccugauguuugcuucuugugcuuuucugugugcagacagcuguuaaaauuucauguuucagugaggguuggggggaaugacaaauuuuauuucucuucccacguucucuuugccucuucuacccaguucucacucuuugccuuuaguugucaaucccagaagagaaucucuugaguuuuucuuccuguuuuuccuuuuguucaaaugaguacauaaauauauauuacuuauuuccccuuccuucuuaccuccaaaggcguaauccuauagauacucuuuuauacuuugcuaaccauagaauuuuaaagcuaaaucagacuuuauuguuguaguuuugagauuauucuuuccucauuuuuuuucuuuuagacauuagaucagcaacaguucuucacagaggaagaacuaaaagaauaugaaaauauuauugcuuuacaagaaaaugaacuuaagaagaaggcagaugagcuucagaaacaaaaagaagagcuacaacgucagcaugaucaacuggaggcucagaagcuggaauaucaucagguggcauuuugucaaaagauuauggcauuaaaaagauuuuaggugcuuuguuaaaagccuguguuuuuguaacauauuucauuguacuauauaguacacugcuauagcuauacuauaguauuuuaaauuuuaauacuuuaaaacuguuuuguggaauauuaaucuaaauuuuauuuuauuucauuuuauuuuauuuugagacagccugucucccaggcuggaguauagugcugugaucauagcucacugcagccucaaacuccugggcucaagugauccucccaccucagccuccccaguagcuaggacuacaggugcaugccaguguuccuggcuaauguuaauauuuuuuguagagaccaggucucauuguguugccgaggcuggucucgaacuccuggccuuaagugaucuucccaccugggccucugaaauuguugggacuauaggcgugagccacugcaccuagucaaaucuaaaucuuauaguuugaauaucuuuguuuuagaaaacaauuuucauuuacuuuguugugcuuugucaaaggucacacauaugauagaaaaucaaguuauacuuuuaacuuucauuuuccauucaccaggucauacagcagauggaacaaaaaaaauuacaacaaggaauuccuccaucagggccagcuggagaauugaaguuugagccacguguguaauuuuguuugauuauuuauuuaggaaaauaaauuauuuuaucaauugaaauccacauuuauuacaaauauaauuucaaaucauuaagauguuauguuauuuuuuguguauuuuuugugguauuagagcaauuuagauuauagaaaaaugaaaaugccuccaaaaguuuuauguagcagcaaauuuuaagugcuguaucauuuguauaauuugauaaccauauuuaugguaaaaugauuuauuucaacuuuauuuguaauucuuucuaauuauauuaaucuuaccagagaauauguuuuuuaaaauugugaucuaugauuagcuaagcauauuuuuuaaaacaaguauauuuguauaugaaggaacauuuagaauaaaggaagauacuuuuaaaauaagaacuuuuuucuuuuuuccaacagacauuuaaagucugaaguccaccagaacuuggaagaaagcuguuaacucaacaucuauuucaucuuuuuagcucccuuccuuuuucucugcucaauaaauauuuuaaaagca

SEQ ID NO: 191798 - RNA, 9783 nt, Homo sapiens
agccguagacggccgagcaguggagcgaggccgccuaaaggagagccgcgcugucgaugagucccagugggccaccuggagcggaaguggaggagcggccggaaguagccggaaucucugaaagacugaccgacugacucugacaggauccggggcugagggaaggaggcggcggccauggaguugggcgagcugcucuacaacaagucugaguacaucgagacggugcgcggguccagauauguauccuccucuuuccaacccugcgucccuuugaggccuggucggcguucccaaccugccccuaccccaccaaccccugucccuuuggccauuagucccggauuaucuagcgaugccccguguaccgucuggcuuugcuguuuacuccgcgcuuggccaguugaggccuuuuguauuuauuccugauuuucucauagggguaaagugccuucgggaggauaggacaagucccauccuguucauacgaauuacagcucggacuucgggcccuuuuacacugccuuuuguaucuguuaacuugcgcuaaaaacgauucgguucuuuuuuuuugaggaaggggguuggggggcggagacucugucgcccaguccugagggccgcggcgcgaucucugcucacugcaaccuccgccucccggguucaagcgauucuccugccucagcgucucgaguagcugggauuacaggcgcccgccaccacgcccggcuaauuuuuguauuuuuugguagagacgggguuucaccguguuggccaggcaggucccuaacucuugaccucaggugaucgacccgccucggccucccaaagugcuggcauuacaggcgugagccaccgcacccugccgauuugguucuuuaugaucaguacaugauauguuuguaaaaucuuggaaacagggcaaguggucaauuaacguuacuaucguuauuuugguuuucuuugcuuucucacaacucugauacucauagucauuauccucguuuuaaggccguaaagcccacgcguggaagugggauuugaauccgcgucugucugaugccaccaagcuauagacauucaaauuaugaguuuauuccuugagucccuaguuuccuuuguguuuuuauuuuuugagacagguucucacucuguugcccaggcuggagugcaguggcacaaucacagcucauugcagccucggccuuccaggcucaagcgauccucuagccucagccuucugaggagcugggacuacagacacgcgccaccaugcccggcuaauuaaaaaauuuuuuuuuuguugagaaggggucucacuauguugccuaggcuggucuugagcuccuguccucaagggauccgucugccucagccucucaaagugcugagauuacaggcaugagccaccauacucagccauaguuuccuaauccaucauugcuuuuuugauauccuggacucacuccauuguggacagcaccccacuuuauguuuuuuucucucaaaugggagcuuucuugauggaaaccuguaguccagaaaccuauuaaguuugcuuuccccgguuuuccguuguuuucuuuuaggcaucugggaacaaagucagucgccagucaguguuguguggaagccagaacaucguucucaauggcaagguaagggacaaagccagcuccaggcugcaaaccuuagcuugcguucugcuaauugucaccacagcagggcagauaaaauguugccauaucuccuauuuauuguuuacauuuuuaauucucuuguuuuuaaauuuuuuauuuuguaaauuggaucuccuuuuuguuuuuuuuuuguuucgguuuuuuuugagacagucucacucugucgcccaggcuggagugcaguggccccaucucaggucgcugcaaccuccgucucccagguucaaccaguucuccugccucagccucccgaguagcugggauuacaggcagcugccaccaagcccggcuaauauuuuguauuuuuaguagagacaggguuucaucauguuggccaggcuggucuugaacuccugcccucaagugauccacccaccucggccucccaaagugcugggauuauaggugugagccacugcacccagccuaaguuggaucucuugaaugcaaaaagguucaauaagaggcaacagaaaaccuuuuuucuuuuaugccaggaacaaaauacagugguaccuagaaccaacauuauuuuaugauauagugugcauuaaacuacugggcacaaaguguaacagguaaugaaauauuugaagguagaaacuaaaguaauacuuauaaaauuaucucuuuaguaaaaauuaauaauucacuauuaacugaaacucuuaaaacgaaugugacaauuggaaaagauauuaaaguaugagacaaauaugcaaaguggaaucugaaagccugagaaucuuguaauccaaauaaauuacaauagcaaagagacgaguauaaacuuggaagagaaaauaucacaggguauauuugagcuugacaaacagugaaguucacaguuguuuuccugccaucuggaacacucaauuuugaaauuaauuuuucuuuaaauauuacaucucuaacuuccagaaggaaaauagucuccuuauaaccaagagaucacaaauauuuucaguagaagauaauuagucuccauuaagccugucauaccaaggaauuaaguggaaaagaaauauaauucaguaauugcugcucagacauacuguuucuuuuuuuuccuuuuuuguugagacagaguauugcucugucacccaggucggaguacaguggcgcgaucuuggcucacugcaacuuccaccuccuggcaucaggugauucuccugccucagccuccagaguagcugggauuacaggcucccgccaucaugcccaccuaauuuuuuuuuuuuuuuuuuuuuuuugagauggagucucgcccuguugcccagguuggagugcaguggugcgauuuuggcucacuguaagcuccgccucccaggcucacgccauucuccugccucagccuccugaguagcuaggacuacaggcacccaccaccaugcccagcuaauuuuuuguauuuuuaucagagaugggguuucaccguguuagccaggauggucucaaucuccugaccucgugauccaccugccuuguccuccgaaagugcugggauuacaggcgugagccaccgcgccuggccuaauuuuuguauuuuuaguagagacaggguuucaccauauuggccaggcuggucuugaacuccucaccucagaugauccauccacuucagccucccaaagugcugggauuacaggcaugagccaccacgcccagcccaagauuuuuuuucuuauggugaacuauguauaacaauuugccauuuuaacaauuuuuuaaaaauuuuuauuauuugagacaguugcccaggcuggagugaagcggcgccaucucagucgccacaaccuccgccucuuggcuucaaggauucucaugccucagccuccuguguagcugggacuacaggugcacgccacuacacugggcuaauuuuuguauuuuuaguagaggcaggguuuugccacguuggccaggcuggucucaaacucuuggccucaagugauccaccugccuuggccucucaaaguacugggauuacaagugugagccacugcacccagccuaacuauauauauauauauauauauauauauauauauauauauauauauauauauauauuuuuuuuuuuuuuaauacgcaguuuugcucuuguugcccaggcuggagugcaauggcacgaucucggcucaccacaaccuccgccucccagguucaagugauucuccugccucagacuccccaguuacaggcaugugccaccaugcccagcuaauuuuauauuuuuaauagaggcgggguuucuccauguugaucaggcuggucucgaacucccgaccucaggugaucugcccuccuuggccuuccaaagugcuggaauuacaggcaugagccacugcgcccagccuuaccaauuuuuaaguguacaauuaguugcauuaauuacauucacaauguugugcaaccaucuccacuauccauuuccaaaauuuuuucaucaccccaaauaaaaacucuacacauuaaggaauacacgcccauucccuacuuccuuccauugcugauagccugaaucuacuuucugucucuaugaauuugccuauucuggauauuucauauaaguggaaucauacaauauuuguccuuuuugucuggcuuauuucacuuaguguaagguuuucaagguucauccuuguuaaagcacaucagaacuucauuccuuuccauagcagaguaauacuccauuguauguauaugccacauuucguauaggcacuuggauuguuucuacccuuuggcuauugggaauaaugcugcagugaacacugaugugcaaguaucuguuugugucccugucuucaguuuuuuugaguauauaccuaggaguguauauacucaauacuugauuuggcaauguuugguauauacaaaagagcgugauugcugggacaaauggugagucuauguuuaacuuuuugggaaacugacaaauuuuuuuccaaaauggcugcaccauuuuacguuuccaccagcauugugcaggguuccaauuucuccacaucuuuaccaacacuaguuauuuucugguuuuuuuuggauuauggccauccaagggaguauaaaaugguaucucauagugguuuugauuuguauuuccuuaaugacuaaugauauugaacaucuuugaauguugcuuguuggucaucuguacaucuucuuuagagaaaugucuguucaguccuuugccuauuuuuauauuguguugucuuuuucuuauugaguucuaggaguucuuuaugcauucuggauauuaaacacuuaucagauauaugauuugcaaaugcuuucuuccuuucuguagauuuugugcaucccuuugaugcacaaaaguuuuuaauuuugaagucugguuuaucuguuuuuucuucuguugcuuguguuuuuggugucauauuaagaauccaaacuuauggccaugaagauuuacugccguguuuucuucuaagagcguuaauggucuuagugcuguguuuaggucauugauccauuuugaguuaauuuuuuuuuuuguuuuuugagacggaguuucccucuugucauccaggcuggagugcaguggugcaaucucggcucacugcaaccuccgccuccuggguucaagugauucuccucucucagccucccaaguagcugggauuacaggcaugcgccaccaugccugacuaauuuuguauuuuuaguagagacaggguuucuccauauuggucaggcuggucucaaacucccgaccucaggugaucugccagccucggcgucccaaagugccgggauuacaggcgugaaccacuguacccagcuugaguaauuuuuuuauaugguuugagguaggggucuaacuuaguucuuuugaauguagaaauacaguuauccuggcacuguuuguugaaaauacuauucuuucccuguugaauggucuuggcacucuucuagaaaaucaauuggucauagaugaauagauuuauuugugaacucucaauucuauuugguuggucuguaugacuaucuuuauggaacacugcacuguuuugauuaccauagcuuuguaauaaguuuucugguuuuuuuuuuuuuuugagaaagagucucacucugucacccaggcuggagugcaguggcacgaucucagcuuacugcaacuuccuucucucagguucaaguaauucucuugccucagcauccugaauagcugggauuacaggcaugcgccaccaugcuagagacaggguuuugccauuuuggucaggcuggucucgaacuccugaccucaggugauccgcccgccuuggccuaccaaaguagugggauuacaggugugaaccacugugcucggccuacuauaauaaguuuuuaaucaugaauuaugagucuuccauguuuguucuuuuauaagauuguuuugccuauugagggcuguuugcuuuuuuuuuuuuaauuuuuuuuugggggagggggauggaguauugcccuguugcccaggcuggaugcaaugguggaaucuuggcucacugcagccuccacuucccagguucaagcaauuguccugccucagccuccccaguaccugguauuacaguugcgugccuccaugccuggcuaauuuuuguauuuuuaguagagacgggguuuuaccauguuggccaggcuggucuugaacuccugaccucaggugaucugccugccucagccucccaaagugcuuggauuacaggcaugagccaccaugccuggcuaccuuuugcuuuuuaaagauguuuaauuuggcaauauuuuggguauacaaaagaauauaugugacauauaugucauaaagcauaaaauuaaaucaacaccagugaacccuauacccaacugaagaauuggaacauaaucuguauacaauaaguacuauuuuuauguuccuccccuauuccuauuuuugccacccuccaagagaaaaccgcuguccugauuuugugucuuauaaauuauuuauuauuuaagcaaauuuuccacauaucccuaaauaauauauauuguuuaacuugguuuccugugauuuauuuuuauuuuaaaaaucuuuauuuauuuguuuaauuuauuuguuaguuaauuuuuuugagacagggucucacuuuguugcccaggcuagagugcaguggcacaaucauagcucacugcagccuugaccuuccaggccaggcucaggcgaaccucccaccucagcuucccaaguagcuuaugcuacgggcaugcaccaccauugcuggcuaauuuuuuuuucuuuuuucuuuuuuuuuuuuuuuuuuuuuuagagacacagucucgcugugucgccugggcuaaagugcaguggugcgauaucaacucacugcaaucuccacguccuugguugaagugauucucaugccucaaucuccugaauagcugggauuacaggugcacaccaccaugucuggcuaauuuuuguauuuuuaauagagaugggguuuaaccauguuggccaggcuggucgugaacuccugaccucaaguauuccgccugccucggccucccaaagugcugggauuacaggugugggccaccacaccuggcccuauuuguaguuuuuuuaaggaacguucauacuguucuccauaguggcuguacuaguuuacaucccaccaacaguguauaagaguuuccuuuucuccaaauccucacuaguauuuguuauuuuuugucuuuaugauaagcauccuaaacugcggugaagugguaccucauuguggucuuaauuugcccuucccuaugauuagugauuuuuuguuuguuuguuuuuugagacagaaucccgcuccauugcccaugcuggagugcaguggcgugaugucagcucacugcaaccucugccucccggguucaagcaauucuccugucucagccuccugaguugcugggacuacaggcgcacaccaccaugcuggcuaauuuuuuuuguauuuuuaguagagacgagguuucaccauauugcucaggcuggucucgaacuccugaccucaagugauccaccugcaguuggccucccaaaaugcugggauuacaggcaugagccaccgugccuggcugauuagugauguuuagugaacauuuuaaaauauauauuuguuggccauuaguaugucuuuugagaaaugucgauucaaaucauuugcccauuuaaaaaauuagauugaguuuuuuugcaguugagauguuugaguuccuuguauuaauauauucugucuuugaagaauaguuugaagauauguucugccauauuuucauucuguugauuguuuccuaugcugugcaggaucauuuuaguuugauauaaucccauuuguuuauuuccuuuuguugucucugcuuuugaagucuuacucaucuuuuccaagaccagugucuuuaagcauuuccccuauguuuucuucuaguaguuuauagucccaggccuucauuuaggucuuuaauucauuuuaaguuauagaccaggugcaguggcucacgccuauaaucccagcucuucgagaggccaaggcgggcggaucacuugagggcaggaguucaagaccagccuggccaacauggugaaacccaucuuuacuaaaaauagaaaaaauuagcuggguguggcaugcuuguaaucccagcuacucaggaggcugaggcaugagaaucacuugaacccaggaggcagagguuguagugagucgagauggugccacugcacuccagccugggcaacagagugagacucugucucaaaaaaaaaaaaaaaaaaaaagauuucauuuugaguugauuuuuguguacagugacagguguggggucuacuucugcuuauggauaugcuguuuucccagcaccauuuauugaagagauuguccuuuuccagaugaauguucucgucaccuuugucaaaaaucagcuggcuauagauauguggauuaauuucuagguucuauucuguuccauuggccuaugugucuuuuuguaaugccaguauuaugcuauuuugauuacuguagcauugcaguauauuuuuaagucuggcagugugaugcccccuucagcuguguucuuucuguucaggauuacuuuggcuauucagagucucugcgaauuuuaggaucuuuuuucuauuuuugugaagaaucucauuguuaucuuguuaagauugcauugagucuguagacugcuuugggagguacucagcuuuuauuucuaagauucauuguggucugugcauuuuauuuuauuuucuuuuaagauggaguuuugcucuuauugcccaggcuggaguguaauggugcgaucuugacucacugcaaccuccagguucaagcgauucuccugccucccucccuccccacacaccaccucuuccucccaccacaccuggcuaauuuuuuuuuuuuuuuuuguauuuuuaguagagaccggguuucaccauguuggccaggauggucuugaacuccugaccucaggugauugcccacuuuggccucccaaagugcugggauuacaggcaugagccacugcacccggcuggcccgucugugcauuuucacugcuguguacaauuccacuuauccacccuccucuugguggaaaguuacuuuguuucuaguuuuuugcuguuaugaacaauccauuuauauuucuaucccuucucuuucagaacuuugucauuucuguuuuccugagcccauauaucagaugucacagugccugcagggauagaaagagaucagaugagucaguaagacugagugugaacaauagagagugguggggccuggugaauuggagaaugugaccaaucuaagcccaagcugguuguuacugugugggaauacaggcccacguggcaacaaucagcuuuccagagcgucugauucuuuuucaaaagcaacuggaaaucucacuuuuuaaaaugcaagauguuccacuacucaaauaguaauguuuaauuuuaaaugauuuguuaaaaugccacguguccuuccuguaggagauagcuaaaaaaaauuaaaagaaauaaauaauaaaaaugcugcaugagccaaacaau

SEQ ID NO: 191799 - RNA, 50849 nt, Homo sapiens
ccccgcgcggcgcgggccagggaagggccacccaggggucccccacuucccgcuugggcgcccggacggcgaauggagcaggggcgcgcagguaggauccggggcccgcgcgcggaucggguugcgaagguaucgcccgggcacgccggcugagggcguucgggaagggcucggccgccggcggggaccacggggaccaccccgacuccgagcggggcccgagcccgcgacucucggugcgcgcggagcagcgcccgguuccguccuugccgccgaacggcagcggaggcgcgaggcccgggguacguggacacccagcgcuccccaaagccggugcuggcagugagaccuccgccgggacggccugcggggguggggggcuugggguuaggcugucggaggccacgcagccccucuucuccgggcaguggcgcccagcccugcgcucaggaagucagugaggacuucggagagagaaaggguggggaaaguucugagaacuguaaauuugaguaguaggucagugaaucggggcggucuccgccuccgaauaucagauggacccaauaaucgcgaucauugacugggacuuguuuuacugaaaggaugccaagugaaaccucccacuaacuucucuguggccggugcugugcgucauggacauuguacagaugaggucaccaagaccccagccgcuuuaguaacuugcccuaaggugccgcccacuugggaguccguggggcagcaggacuagagcccaggcaaucccacgccagagccagcugcucuccaucucucaaucacguuugaggagcccccacaauaaccagaaucuccgggagauuugcuuaaaaugcagauucccagguccuugcccugagauucagauucaguaaacccaggaaucugaucuuuauuuuauuuuuaaaaauuuauuuuauaaagauggugucucacuauguuguccaggcuggccucaagugauccucccaccucggccucccaaaaugcugggaugacaggugugagccacugagcccugauuuuuuuuuuaaacaaaaucuggauuucuuagacuuaagcaagauaggggaccacuaguuugucugcuucugggguucaaggaaugcccccaggccagcgcuaacccugcuccaguucuagucucuccccuuccccagcccucugggaggcaugacccacugcacuucccugcccccaguagccuaugaggagcccaaggcauuugcugggaccucagugccuuuaucaaaaucccaaaguccaauggggaaacaggcucagguguagguuuggccaggguguccugcacauuagggcauuccaggguccugcagggguuucuuagaacucggcuagcccagcccaugaaugggaggugaccugcuaagccacucauucacucacuagcacucauucagcuccugcgaggcccugggugguguucugggcacuggugcuugccucaaggagcacccccucugcaggaagacagacgugagggcugggagggugcggaugcaccagcggcugcaggaccacaagccagaggggaucagcucuucaaaggucacugggccaggcuucccagcacccagggacccugagcuagccuugugaguagagcaggggagucuggcagguagaggaugggagguaaagggaggcacagagugggcggaggcugggaagugugaaagggcacuguguacagaaccuagggaguaagcagaagccagagauggauggaaaguugggcugggcugcauuguggaaagccuugaaugccaugccaaggaacuugggccaguguauucaccuuggcuugaguuguaaaagcaacaaugcagauuccugggccccacccugggccucuggaucugaaucuggagggagacgcuggggaggcagcagggaggaaaaccugcagucacucaccccauuuacaacacaugcaguuaccggcagguccgagauaaccuaaggguuuccaaaugcuaggaagugacucaaugacugauauguuuaauacaauacaaucccgguugcaaaaugcccagggcaaggguggggguguucaguuuucuaaugcucccaguucaaaaaggagcugaaaugaauugucaaagaagugacaagcugggcgcagugacucacaccuguaaucccagcacuuugggaggcugagagaggaucgcuugaacccaggaguuugagaccagccugggcaacauagugagauccuguuccuacaaaaaaaauuuaaaaacuuagccaggcgugguagcaggugccucuagccccagcuauuugggaggcugaggugggaggauggcuugagcccagguggucaaggcugcagugaacuaugauugugccacugcacuguagccugggugacagagcgagacucugucucaaaauaaacaaauacauaaauacaugagaagagagaaccuuuucuaccucccccaucucccugcccucuuccacccaccccaucugggacgauggaggagagcguuugggauuagaugccccaccucucgacugcccucacugguaccugggagugaggccaggacagaagccgccuaaguacuguucuuccucacauuuguaaaagugaacuuucuugaggguugaugacauguuuuauaagcuacuucacacaauguccaacacccaguggguccacaaucaauguauaugucuguuguuaccugucaaaacguauagcuggggagugacaguauggacuugagccagaucacccagugcaaaugcuggcuuugcugcuuacuguguaacugacuucccagagccucaguuucugcauuuaugagauuauagugacuaugccauuguagugaugacuaaaugaguuaauauaugucaagcauacaaaacaguaccugguauguaguacaaacuauguauuuguuaaaugaauaccuuuuuuuuuuuuuuagagccauggucucucucuauuucccaggcuggagcacaguggcacaaucauagcucacuguagcauccaauaccuggguucaaguaauccuuccaccucagccuccugaguagcugggacuacaggugugugccaccacggcuggcuaauuguuuuuauauuuuuagagacaggaucuugcuauguugccuaggcuagucuugaacugcuggucucaagcaguccuccugccucagccuccuaaaguguuggauuuauagaugcgagcaaacgugccuggccuaaaugaauaaaucuuuacuguugccuccuuugagcuuuauugguugggauuuaguccacucauuuugcaggugagaacugagacccggagaugaaugcaguagccuugccucagguccacaucugagggacagacuccauccuacuuuucuucccauguauucuuuccugcuuguaccaguucacuggggugaccaagaaagacauuucugaguuuuccuccuggcuggcacaguggagacaugcccagccacguuuagcuagacuuaccauggcugggcuagaagagaggccaggagcuugucuggagguugcacagaccugcccuuggugaauguggaucggagcgccccggcagaggcuugaggugcuacagaggcugggggauccacugucagaccgggugcaucaccacuguuuuaugauauccagcaaauugcucugcgucucugagcuuaaggcagagagaagggccugagcuugaagaggggaucccagguuuaaaucggagcuggcuacuucccagcucuccacuguguaaucuggaggaaguuguuuaaccucucugagccucccuuuguuuugucauggguguuugcagggagagcauucaugagauaguuuguauagacauuuugcccuuggaaggcgcucagugauugcuguuuuucucugcauuuuggaccgagucccuucugcguauccagcaccuggcuuccuccugcauuucuuccucaggaauuuauugagcaccuauaugugccagagcaucggaccaaguccuuugcucuccugggguuuagauucuaguugagcauacaggcaauguacaaccaauacauauguucagaucggcagcuuuaucuguuauucugaaauccacgauuucugaaaaccgaaaguuuuucauaacucauuuugaagcuaaacuugaggcuuuuuagagucuucauccucuucggugugaugcucagaugucuuucugcagagauauuagugcaauugaucuuugggugcuuucccgcccugcaugaugggcaugucgguggguauuuuauacaaggugaccuuucuacagccugagucauccugaauucugaacuaugucuggcccccaggauuuuacaggagagaacauggaccugcaauauccuaucagguggagacugugcuaggaaggaaagcaaagcugggugcaaguggaaucagggagggcuucccugaggaggugacauuugagagggaugaggaagagagggccagguggagggacucacagaggacggaagacuccacuuccugacuggccugugcuuaccccucauucugcaugcacaguucugucuaaaugcguccguucuugccuuuccaagaagugcugaugucucuuacguuucaagucuagcucugacugacucauucucucuuuaggugcccccacaggccuccucaccucuucucguuugcuuaagaaaucugaggucugcgcuaaagccagccugggugcuguaaccucucggccgaggauggugcccagcugggcuugcaucuggaguuggaggaagugggucccgggaggggaagaggagccguggggccuuccaaggguuugguggaauugaguuccugguggggaggggcuguguucugggucuuagagccucucgccugcaaagcaaaguugaacguaacacgcgcucacauaucucgagugccagcccggggcuaggugcuuaacgcuugcuuagccaaagugccaggggcuggggacacgggaaugagugacccagaaaugagggcccucauggagcugaaagcauucugggcuuggugacuuugaggaaguggcuuuugaacugagaccugaaauaccaaggcauguggauaucuggggaaagagugauccuggcagugggaacagagagugcaaaggcccagaggcaugaaugagcuugguguguuugacccacagcaaggaagcuggugugguuggauggaaccaaacaagaaagaggucuaggagcagaggucagggagggagcuggggccagauaccugcauugucucauuuaacuuguguaauaacccuaccagauaggagcuacucucaugcaaauguuacagaugaaguaacagaggcacagagagguucagugacuuguccagggucacacaccugaagguggcagagcagggcugugaaccuagaagcuccagaguccucaguccucaccaugguguuuaaacacaauaaaaucuaugccugagugcugaagacacaccugccauuuagaucgauccacuuuuuuacauugucgguguacucccugccauccaucugcccagaaauacugugaaugugggcagcgcaggacugguuccuccaagccccauuuuacagacaguccaaucauuuuacauauuauuuuaugaaugagcaccuuccucagugucucagaccagggguccccacacagcagggccacacagcaggaggugaguggcgggugagugagcgaaguuuuaucuguauuuacagcugcuccccaucgcucgcauuaccacccaagcucggccaccugucaggucagcugaggcauuagaugauucucacaggagcacaaacccuuuugugaacugcacaugugagggaucuggguugcguacuuuuucuuuuuuuuuuaagacggaguuucgcucuugucgcccagacuggagugcaauggugcgaucuuggcucacugcaaucuccaccuccccauguucaagugauucuccugccucagccugguggcugggauuacaggccugugcuaucacacccagcuaauuuuuguauuuuuaguagagacaggguuucacuguguuggccaggcuggugucgaacuccuggccucaggugauccaccugccucagucucccaaagugcugggauuacaggcaugagccacugcacgcggcccugggugcgugcuucuuaugagacucuaaugccugaugaucugucacugucucccaucgcccuuggaugggaccaucuaauugcaggaaaauaagcucagggcucccacugauucugcauuauggugaguuguauaauuauuucauuauauguuaccauauaauaauaauagaaauaaaguacguaauacauguaaugugcuugaaucaucccgaagccauggccccaaccacggccucuggcaguggaggcuggaguccacaucacgcucugugcugggugcaggaauggagaugaguggguguccugcucauuucccugaggaggaaccugaggcucaggcuagagacuuaccugggugacacggcuccuaaguggcagaguccagauucaaacccagggcuacagacccagaagccugugcauuuaaccacgguucugagcuauccagcccaaagaggagaguuuaaaaggauuacauuucuucguuggaaaucagugagcauagucgcccagaaccauuuuugaaaaacucagagaaggccuauguuuuccugaagcggccagggaaguauucugccuuuuuaaaagggaagacugaauucuagggaggagaggcaccagcucucugggcugggcaggucuccaagcuggcagggccacagccucccgacggucuugccucuagcauauuucuuccagaagccacauuuccacaggugggcagcucuaacugggagaaaaucuuccugagauuuagccaaauuagcuuucuuucuuucuuuuuuuuuuuuugagauggagucucacucugcugcccaggcuggagugcaguggcgcaaucucagcucacugcaaucucugccucccggguucaagugauucuccugccucaaccucccgaguagcugggauuucaggcacacaccaccacgccuggcuaauuuuuguauuuuuauuagcaaugggguuucaccaugcuggccagacuggucucaaacuccugaccuagggugauccgcccaccucagccucccaaagugcugguauuacaggugugagccaccgugcccagcccaaauuagcuuucuaggagcuuccacuuucugagucuguuucugccucuuggagguagugaccaucucccuccaaacucggauacuucucuuauucagacuacacaacuguaguuauuucagguauucucccugacucaggaaauuauaaguuuggccugccuuggcacaugagucaacugguuggagucccacgcaaagacuguuuguuuggucaaagaggaaggagacuauuaccuccuuggaucuagagcuuauacuucuguugaugcaaccuggaaucauacuguguagcagccauaucccacuuggagugcauauugggcuugucagcuaaaaucuccauguuucucuucuauaugagcugcuguuaauccaaguuucuucuauucugagaguccuugucuaaagcuaagagguuccaguuuuucaugcucucuaauaaaucuacuucaggcuaacaugcuaucauuuuuucuuugaguacugcuuugguuucuuuccacaacuuguuacacaauguuauucacugcccaguuuagaauuucccuuuugguucccauuuuaagacuuauuuaauuauaugcuuuuuaaauuuuugagacagauagaauuuuuuaaguuaucuuuuuauuguugauuucuaaauuuggucaucaugguuguuguggucaauauaugugguuccuauaauaucagugguagagaauuugcugagaucuuuauaggauuuucuggucauuuuuuuccucuuguguuugaaaagaauguauauuuucuguuggguauaagguucuagaaauguaucuauuugaucaagcuagcuauuauauuaucuauauuuguuaugucacuaugugguuuuuuuuuuuuuaccugauuuaccucccaccguaauacaauuacaauucaccauaauagaggcuuuguuaaguucuccuuuugagucugucaguuuuuugcuuuauuuuugaagcuauguuguuaagugcauagccauaugaguagaauaaggguucaggauuuuuauaccuuuuuggugaauuguugcauuuucccgaguagcugggacuacagaugugcacuaccacgccuagcugauguuuguguuuuuuguagagaugggauuucgcuauguuucccgggccagucucaaacuccuagguucaagcagucugcccaccucagccucccaaagugcugggauuacaggcaugagccaccgcagcuggcugaauuguuccuuuaaucaguauaaaagagccaacuuccagccugggcagcauagugagaccccaucucuaccaaaaacuaaaaauuagcugggugugguggcgugcaccuguaguuccagcuacuugggagggcgaggugggagaaucacuugagaccaggaauucaaggccgcagugagcuaugauugcuccacugcacuccagucuaggugacagagugagacauucucaaaaaaacaaaaacaaaaaaaccauccaccuucucucuucuaauacuuacucaagacaucauugucaugaauucuauuuuauugaugucaguacuccuguacuaauaagccagaugaguuaaaaacaacagcagccuugcaaccagccaugaagcaagugaucuuauucucauuucacagaugaggagacugaggcucugaguggacuccagccugccacggucucccaccgagucagguuggagccugcacuuaggcccagaguuaugcuucugugucucagaugcuugggggucccugcccacaaagguggcccccaugucuguguguccccacccauccaggaaugguauggggugagacaacaggaagagcuccauggguaguccccacccacugccuuccauaugccagucugcaagcagaaaaugaacgggaagcucuuaccugugcccauguguuguccuggcuuuggguuugcccagggggcaaaguccuggucauuguugagacaaguucacugcugcugagggccgagcaaauggugacaaaggccagauucuaaauuccuaccugguuacuuccugcuccgucaccaucaccucgggcaaauucugaaccucccucagccucauuccuccaucugugcuugcagggagaauauuuuacuguaucuuccauagugagcuuuccaggagaagcaaaaaagagugguguauaaaaaagcaaguuuaugacugcuucugugccaggcacugugcugugcacuccagagccaaaggccuggguucaaaucccagcccacucacuagcugugcauccuuaggcagguuccugacccucucugggccucggcuucuccaucucugcaauggagaugauauuaauuguaucugcaaugcuccuuggauuggguccaugguuaagugagugagugaggcucaagggcuucuuuuuuuuuuuuuagagauagggucucacucuguugcccaggcuggagugcaguggcaugaucacaguucacugcagcugcgaccucgugggcucaagccauccuccugccucaucucccuuaguagcugggacuacaggcaugugccaccaugccuggcaauuuuuuuuuguauuuuugguagagacggggucuugccauguuacccaggcuggucuugaacuccuggacucaagugaucuaccugccucagccucccaaauggcugugauuacagguaggagccaccgcgcccagccuucaagugcuuuuuuuuguuagugagacugguacaaccaaugccaaggcuggugagcaaaguugcacccaguuggggaggggcgaaaccaagggcagaagggcccagggcauggccucucauggcugaaggaagaggggacacguggccagucacagugaccucugcagaccucaagaaggaggccagcuaggagccauagcugucacuaagacagucaaaaucuaaucagcacccuggcgccaagaggccauuguccgcugcucaggacagugagugauagucgauaaccagcucucuggaggucagggccccgagguggcugagaucugugccugcauuaggacauuuaaggggacuccaagccaggauuugcuaguguuugcccagcagggagagguggaaaauuggggaugaccaaccaggccucccugcucacagccaggggaauucauccugucguucuuccauucagcaaauauucauggagcaccugcugugugccaggcaccgugcuaggcucuggggagauggcugugagcgggaucgacacuggccuugugugagcuggccuugcaguaggggauaugagcaccaaacacauaaggcccgagugugcaauaugccacaaagauugcagagaaauaaagcaagauaacagguugcagaaagauggaggccaggcuggcugcuguuccuggguagguggcuucuggacacaguuuccucaggcucuguuuccuccuuugggccucuggaaucuucugaagacaggccuggcuuccaggaucccggauggaguugccuguugacuguguggacucaaaguguccacagugcgccggagcgcguggucuuccccagcaaaucugcuucucuucucggcucuccaucgugggaagggucccugggauccuccccaccaccccagccugaggccacuuucccucuguccccgcucuccccagccugcuuuccccaccaagcgccaccaagucccugcugccuccuccucccaaacaggcucaaaccugcccccucuucgccagcucucagcucagcccgcuccucuccugcuuaagagccuucacuggcuccccacugcccuagagacagaguuugagucuacugccauggcuuggcagacgguguuguccccggccugccaaccuuccagcugccaucccagccaguccuucucccccuugcuccagccaagggccccgcuuguagggugggaagugggccgugcccucccuccugccugccuauucgcugggucuucccucauucccucccucaccccgcccucucauaagaaccuucagaaucugccagacgcaguggcucacgccuguaaucccagcacuuugggaggcugagguggguggaucaccugaggucaggaguuugagaccagcuuggccaacauggcaaaacccugugucugcuaaaaauacaaaaaaauuagcugggcguuguugugggcaccuguagucccagcuacucgggagacugaggcaggagaacuacuugaaccugggagacagagguugcagugaacugagaucccaccauugcacuccagccuggacuacacagugagacucugucucaaaaaaaaaaaaagaaccuucagaaucauaaaauggguuuaauaauuauacuuaucucauagggagggcuuaaagcaccuaggccagugucuggcaccaaggaaacacuguauaccuguuaaaauaagaauaaaauaaaauacacaugcucacuuauugagugccugcuguaugucgggccccuccccgagagaacucuggugcauccccgauaaagaaaccugacccucuaggaugagggagggucuucccugagcgccugcuaacagccuccucugcuaaucugaaguccugcagcuugcccagcaggcuggcuugucacacgggcuacccccacaggccgccaucuuggaaaaggccaauggcuguggaaucauucuugacuccuauuagccuuccuguucucucucccgccccacagcauccauccugucagcaaauccugugggcucugucuucaacacagaucuagaauucagccccuucucaaccuccccaucuccgcagccuggugugagcccuggcaccucucucuggggccagugugguagccuccucacugcuacccacuucuacccgugcccccaccacccaagcaagagaggucuuuuuuaaagucucaucaugucacuucuuugcucaaaacgcucuggcaacuucuuccuugcucaaauauuuguuaaaagaagaaaggaaugaaugaaugaauggccuguuugcaucuguaauagccagcacauaggcaguacuuggaaaacacccacagcaagaauaaaugaggagauggcuggacacggcagcucaugccuguagcauguuggaaggccgaggcaggagguuugcuugaggccaggaguuugagguugcagugagcuaugauugugccauagcacuccagcuugggccacagagagagauccccaucucuacaaaaauuuaaaaauuauucgagcaugguggugugugccuguagucacaacuacuugggaggcuaaggcaggaggaucacuugagcccaggaguucaaggcugcacugagccgugacggugcgacugcauucuagccacagaaugagacccugucucuaaagcaaaaaagagaaggagaauaagugagguacuugagcaagugggugaggaugguugagccacagcaggcccacagggaggcuggugggugcuguugguggagggggccgauuuguguuccugguggcugcagagccagucuguugccuccccucccucccacuggcugggcuggggacggagccaaccaggcagaucccgggccauucuggggcccuggccuggccugccuuacuaucccaguggggccaccgacguggcugccauuucuggaaaccccaguucuagguagguuacugucccaggaagaagugcaugccuagcuuccugccagcccagcccagcugucccagaagccagaggaagcucugggcugguuucuuauaaguagcaugacuaacugauugcgccacaggagcugagguuucaggccaguuucugucguggaguuucaggggucagcggcuccaaagccccagcccccacccgaggccccugcugucccuggauuccucuccacaugccaccugucacagaggugcuugcauccugucugcagaaccagccccuccuccaagccagguuuccugcccagagggaagaagagcagaaggccuguaccgcccccugugcgcccccaguccuccgcccccugccccccugccacccgcuguggguucgggaagaguccugcugggucgcuuccaggcugcugcuggcuucugacauuucaaggcuuaaucacuuaaucucccccgaguuuuuuaaaaaaagugagucaaguguguucuccugguggcgggcguguuuucccaggcccaugcuucugcucauuuccuggcugcggccuucacugacuuugcugcuuccuaacucugugaccuuggccuugucacuugcugucucugggucucaggccaaugggucucaggccaguggggcuccccggacaaaguuccaggguuuuggggacugcauuucaagggucagcaaccacaguccuuaaacacguggauuuuggagugacaaugccuagguuaugguucugugaccaccagcaagugcucuagccuuuuugugccucagucuucucaucaguaaaaugggaauguuaauggcaccuaccucauagggucguugggagaaccaaauugauuaauauauuguaaguacuuagaacagggccaggcacaaaauaaguacugcauauacaguuaacuauggacaaaagcuugggaccugguucauguuuaaaaaugauuauugaggccaggugcgguagcucaugccuguaaucccagcacuaugggaggcugaggcaggcggaucaggaggucaagagaucgagaccauccuggccaacauggugaaaucccguuucuacuaaaaauacaaaaauuagccaggugugauggcgugcuccuguagucccagcuacucaggaggcugaggcaggagaaucacuugaacccacgcggagguugcagugagcugauaucgugccacugcacuccagacuggugacaaagcuaggcuccaucucaaaaaaaaaaaaaaaaaagauuguugaauuuauuauugcugaauuuuuuuuuuuuugagacagaacuuugcucuauugcccgggcuggagugcaauggugugaucucaacucauugcagccucugccucuuggguucaagcgauucuccugccucagccucucagccucccgaguagcugggaauacaggcacccaccaucaugcccggcuaauuuuuguauuuuuguagagaugugguuucaccauguuggugaacuccugaccucaggugauccaccugccucggccucccaaagugcugggauuacaggcgugagccacugugcccagccuauuauugcugacuuuuaaaccauucauucauuuaauauauguuuauuguacacaugcuaugccugugucaggcacuguuucaggcacuggggauaaagcagugagcacagcagacauaaagcucugcccucauggggcuuguggucucucagagggaggcaaacaaugcauuuauagacaaauacauaauuuaaauuugagguuaccuauuauacucccaacuugaaaaacuagcaguauauugagguggcuauuucacaucugauggaggaauaugucuuuugugaaccauuuauguucuuugccuauuuuucuuaaagggauguuugucuuauugauuuguaagaacucuucauauauuaaggccauuaaccguucauaauguagauugcuaccuuuuucuagucuuuugcuugcugauauaguugggaugucauccucucuaaaucucuuguugaaaugugauccccaguguuggagguggguccuggugggagauguugggucauggggacgggucccucaugguuugguucuguccuugccauagugagugaguucucacaagaucugguuguuuagaagugugcggcaccucccuccucucucuugcccuggcugucaccauguacgccugcuccccucuugccuuccccgugaauaaaagcucccugaggccuccccagaagccaaguagauacgggugcuaugcuuccuguacagccugcagagccauaagccaauuaaaccucuuuucuuuguaaauuacucagucucagauauuucuuuauagcaaugcaaaaauggacuaacacacuugaguucugucuuuuucuuauggcauauuuuaaucuaggccagacacaguggcucaugccuguaaucccagcacuuuggaggccaaggcggguggaucacuugaggucaggaguuuaagaccagccuggccaacauggggaaacccugucucuacuaaaaacacaaaaaauuaguugggugugguggcacacaccuguaauuccagcuacucgagaggcugagacacaagaaucgcuugaacccgggagguggagguugcagugagccgacaucacgccacugcucuccagcuuggggaacagagcaaaccuccgucucaaaaaaaaaaaaaaaaaucuagggaaguugaaaacauuuugcagucaaagcuaucuuugcuaucugcaucuugaaauaaaauaaacauucauacauguaaccucauuaaucugauuagagauagugauaaguacugggacagacauaaacagggugcugugauaagaagucacagggagggcccgcauuaguugaggggggucagagaaggcuucugaaguguuucuggugcaaaugcuuggaaaagggagagcugggaguguaucccagggcugaggccaauggaggauugcagaagagggagaggggauaggaggggaauguuagagggauaagcaggggaauuggcucuuuucuucauuuucuuaaauuaaacuuuuuauuuucagauaauuaaagauuuacacacagcuggaagaaaucauagagaagccgggcgugguggcucaugccuauaaucccagcacuuuuggaggcugaggcgggcagaucacuugagaucaggaguucgagaccagccuggucaguaugaugaaaccccaucucuacuaaaaauacaaaaauuaguugggcaugguggcuugccuguagucccagcuacuggggaggcugaggcaggagaaucacuugagccuaggagguagagguugcagugagccgagaucacaccacugcacuccagccugggcaacagagugagacuccaucucaaaaaaaaaaaaaagaaaagaaaaagaaaaagaaaucacagagagaccccugcuucuaugcuguuccccccgagggcaagauuguagaaaucuguaauacaguaucacagcugggauacugacacugauauaagcuacugaccuuauugggauuucccgauuuacuuguacucauuuuuguguuugcguacgcaugugugguuuagugcuaugcaauuuuaucacggcauagguuuguguaugcagccaggauccagcacaguucuaucaucacaaggauggcucaaauucuccuuuuauagccacauccaacucccuuccugacccacccccucagccccuggcacccacugauguguuuuccauuuccaugguuaugugauuucaaguauguuacauaaauggagucacgggguguguacucugggaacuggcuuuuuucacucuagggcuuggauuuuauucuaagucagagaugcuucucuaaugagcugugaacccccuggggaucuguggccccugugaagaagcccuuuaggagccagggggcauuggaugugugagcuggcccuggucucauuucugauuuuaaaauggcucuggcugugauguggagaagaggcagggugagccucaucugcagcaacugcuaacugcccacauccccccagacuucucaaaaauuugccacuccccugcucaaagacccucaaaagcugcccacugcuuagaggacaggccuuugaccugagguccucacuugggcuucagggauucugugaaccccuaaaauggaaugcagaauuaaguguaugcaccuugccagaaacaggguuugggguuuacauuagaugcucagauaggucauugauccccaaaacacuaaggucucugacuucuagacagauaguaguuaagaaccaaagcuuuggagcuugagugcuggauuuaagacccaugacugucacagcugugcaaccucagacaaaucacucagccuuucugugccuugguuuccucaucugaaaauggagaaaauaauauuaccuauuucauagauuauuaaaugcauucuuguauguaaaagauguaaaagaaaacuuggcaugugguaaacucuguguguuuaagugaauggugaggcugcccaguauaggagggcagagcuuuccagguaaagacuuucuaggccuccugggauuaucaggcccucucuguguugguuguugucauacaugacagcaguauuccuuccaaagggaugccaaguugugguugcacacugcacuuagauccaguugauugacagcacuguucaagucaacuguguccuuacugauuucugccugcuggaucugucgauuaccaaaagaguugaaguaauaguaauaauacuauuauuauccaauaauaguauuauucagaauaaucacacagauuucucuauuucuccuugcugcucucaguuuuugccuuacauauuuugacccuuuguuguuaguugccuacacauuaaggauuguuauuuacaucuucuuggagaauuaacucccgaaucauuauauagugccacuuuuuuuuaauuuaaaaauuuuauuuuuuauuuuuugagacaggaucuuucucuguugcccaggcuggaguucaguggcaugaacacagcccacugcagccuuaaccuccugggcucaagugauccuccugccucagccuucccaguagcuggggcuacaggcaugugccaccucuaauaacuuuucuuuaauuuacaauaguauuaguuuguucucaugcugcucuaaggacaugcccaagacuggguaauuuauaaaggaaagagguuugacucacaguucugcagggcuggggaggcuucaggaaacauauuaucauggcggaaagggaagcaaagacauccuuuuucacaugacgucaggaaggagacacgccaaggaaagggggggaaagcccuuuauaaaaccaucagaucucaggagaacucacucacugucacgaaaacagcaugggggaacugcucccguaaucuaaucaccucccaugagguccuucccccaacacguggggauuacaauucauauuacaauucaaggugagauuuggguggggacacagagccaggccauaucacauuauuauuaauuagugccuucucucucauuuuuuugauucgccuagguagagauuuaucaauuucauugaucuuuucgaagaaccaauuuuugauuucauugauuuuccucgauuaauuuucuauuuuuaauuucauugauguaugcuccaauuuuguauuuuuuucuucugcuuguuuuagacauauauugcuuuucuguuucuaguacucuagauggaaacagauuauugauuuuagaacuuucuuucuaagauauacauucaauaauauaaauuucccucuaagcacugcuuuugcuacgucucaccgauuuugauaggcuauauuuucauuuuuauuuaguuaaaaauauuuuuaguuucucuugugauuucuucuuugauccauauguuauucggaaguguguuuuuaaaucuccaaauacuuggaaauuuucuggcuuucuuccugcuagugacuucuaauuugaauccauuguggccuaagagcauauguugugugauuucuaauguuuucaaucucuuaagguuguuuuaugucccagaauguggucugucuuggugauuauuccacaugaaccugaggagaauguauauucugcuguugugagauguaacagucuauaaauggauaccucuguuaauaugaccucgggugacucuuuuuuuuuuuuuaaguugcugcuucaccauuggcuuuuggagauuuugcagaugauaaaauccucaggacuuuucugcugcucagucagauuuucuuauccuacacuugcggaacuguuguuugaaauugacaagcaggauggccaacucugcccggcucauuuuauuucaucuuauuggguucagccugcaguuuuaggagaugagauugaaggaacugguauacuggaauccacggugggcucggaagcaaacaaacguggguucugauucuagcucugaccuuuuaccagcugugggaccugguggauggguuauuuggccucucuggccucaguuuccuuagcuagacaguugggauaacagccuaccuuucaggauucuuguguggauucggugagguaauacuucuaaagcaccuagcaaagugucaaguacaagguaagugcugggcaagcagggauuuuguucacacaaagccuugacucaacauaaggaggcuguuuccaauggcucugcuuaacugagaccugagagugauugcuccaucugugguggcauaugggcugaaacugccuagcagcaugucagaagugggguguucgcaggacauccuuguccagguuggcaguugagcuuggcaggugaccgcugagaccccuuccaacuccaccacuucaggaaucucuuuuuuuuuuuucugagacagucuugcucugucacccaggcuggagugcaguggcucaaucuuggcucacugcaagcuccgccucccggguucaagccauucuccugccucagccuccugaguagcugggacuacaggcacccgccaccacgcccagcuaauuuuuuguauuuuuaguagagacugaguuucaccauguuagccaggauggucucgaucuccugaccucaugaucugccugccucagccucccgaagugcugggauuacaggcgugagccaccgcgcccagccaggagucucuugauuuagaaugggaacuugaaaucaucuccucuugccguguacuugaacgcgauaaccuggcacuuaucuuuuuaauucuuuuacucaccugcaucuuuguucuuuuugccucugauguucagggaagccucuucucccacugcaucugugaucucuccugaaauguagcacccacacaucccugagaagcuagcugcggcacgugugugugcacaugggcaugcguaagucugggcgugccuuccacaacagauuaaggauaucaauccugacgccaugcugggauguuuuagugaaucuugacaggguuguugacuccccuguuucccuggaggacuuuaccaugaaagucuucugcugugugacuuuggacaggcgucuuggccucucuguuucucuuuauucauaauugaggcuaaagugacaccuuugccaucucugccacaggauacugugggcaucuguguaguugugagaguaaaaguuacuaggacuugccaaggaaaucagugucaggaacccaccaccccauucccgccccuccuuuacuugagacuuuacuuuuguaacucucagcaaggaagacgaguucaaccuuugagccgauacagagccuuccccuagagagagcuuugcagccucaugcugagccaguuaggggccccacaucauguccaaaaugaauuuaaucaacaaacaguuacugaacacguccuaugugccaggcaccguuguagauacuggggacucggcagugaaugggacagacccuggcugucaggaugacagacaauuuaaaaagggacagaugucccacgcuggcuuguccuuugcaccccuggcacuucgugaggagcagcggccaguucuuguauauagacuggcccuugguguacauuugucugacguuuccaaaugauguaugcauccuuggcaggaacccaggaaaagacaugcugugcucuucucaggaauuguuucagggaggugauguuggggauuugucccauucuuguuggugaguuuagaucacuuggugaagguggugucugccagguuucuguauuguaacguucauugauauguauuuucacucauuaguuaauauacaauacaaguuuugcagggaguuacuuugaggcugucauaguaaaauagagcuuucccuucuucccuguuuauuuauuuauuagagaugaagucugacucuguugcccaggcuggagugcgguggugcgaucauagcucacugcagccuccaacucccaggcucaagccauccuccugccucagccucccaagaaguugggauuacaggcacacaccacacugcacccggccuccuccauuuauugaucuaugucaauacagacuccuggacuuuaacuccaaggguuacaaguggauaccauaauauucauuuugaugcucaaaaugugccuguuuuguccaggucaggcuagcugcugaguacuuccuuauugucuggcacaagaauuccaagccuaucugguacuuuuccuucuccuggaaucagcuauuucucuaaggcgcucugguuccuuucaguacagaauaguauuuagaagccaagaccuggucacuaggaaggcaugauaaucaaaugugaugaaugaucuuggauugcauccuggacguauaaagggcauuauugaggcaauuagcaaaacauaaauaggggccguggaugagauaguggugaugcaucacuguuaauuuccugauuucgaugguuguauugugauuaugcagagaauguccuuguuuuucugacaugcacacugagguauugggguaauuuauucauuauggagauaugugaguguguuuaugugucucauacacagauguuucuuaaugaugggguuuuguccccauaaacucaucauaaguugaaaauauuauuaagucagaaauguacuucauacuccuaaccuacugaacguuauagcuuaacuuagcucggaacacuugcauuagccuacaguugggcaaagucaucuaacacaaagccuguuuuguuauaaaguguugaauagcuuguguaguuuauggaauacugagagugaaaaacagaauggucguaugggugcuccaaguacugcuucuacugaacacccauugauuuugcaccaucauaaauuaggggaagagaggaaaagcacgcguaagggaggaagggccggguacaguggcucacgccuguaaucccagcacuuugggagaccaaggugggcagaucgcuugaacucaggaguucgagaccagccugggcaacauaaugagaccccaucucuaucaaaaauacaaacacuuagccaggccucauggugcacaucuguggucccagcuacucaggaggcugaggugggaagauugcuugagcccgggagguggagguugcagggagucgagguugugccacuacacucuagcuuggguaacagaguaaacucugucucaaaaaaaaaaaaaaaaaaaaggaaagggaggaagggaaggucccuccagguggaggggacagagagagaaaaggcauggaggugggacugaguuugguguguuuaagaagugcagguggcagccgggcucaguggcucacgccuguaaucccagcacuuugggaggcugaggcaggcggaucaccuggggucgggaguucaagaccagccugaccagcauggagaaacccugucucuacuaaaaauacaaaauuaguuggguguguggcccaugccuguaaucccagcuacucagaaggcugaggcaggagaaucgcuugaaccugggaggcggagguugcagugagccgagaucgcgccauugcacuccagccugggcaacaagagugaaacucugucucaaaaaaauaaaaugaaauaaaauaaaauaaaauguuaaaaaacaaaaaagaagaaguguagguggcaggcguaggaugcaugggugcugggcccagguggagagggagguggagcccugcuggggggagggccuucaagugugcccaagucacucggagagcauccagcaggggccuagagcuccugagguggccuuaaguucuuaugaugccccagacacugcacacagugcuucagaggcaacaccuccguuccuguuugcugcaagccugugagguuagccuuggaaccauuccugugccacagaaacacagccagagcaccaaaagagaaaugcuguuaauggcaaagaacuacucacuagcagaacaaagccugggagcugcuuuuuugaauaagaucccaggagagagacccaagcgggaagugaaggaugggcacuugaaauguugcagggaauauaacccagcgcgugcuguuuucuuuuuuucuuuuucuuuuuuuuuuuuuucucuuuuugcaacagggucucacugugucgcccagccuagagugcaguggugccaucucggcucaccacaaccuccaccuccuaggcucaagcgauuuuccugccucagccuccugaguagcugggacuacaggcacgcgccacuaccgcccggcuaauuuuuuuuuguauuuuugguagagacagguuucaccauguuggccaggcugguugugaacuccuaaagugcugggauuacagaugugagccaccacgcccggccccaguacacacuuuuuggaggguauuugacguuauguaccaggagugcuggggaaaaguacacacuugacuccgugagauucugcuucuuagcauuuuuuucuuuuccuuuuuuuuuuuuuuugagacagagucucacucugucacccaggcuggagugcaauggcauggucucggcucgcugcaaccuccgccuccuggguucaagcaauucucccaccucggccucccguguagcugggacuacaggugugcgccaccacacuuggcuaauuuuuguauuuuuaguagagacaggguuucacuauguuggccaggcuggucucaaacuccugaccucgugauccgcccaccucagccucccaaacuuucuguuuucuuuucuuuucuuuuuuuuuuaugacagggucuugcuggagugcagugguacggucuuggcuuacugcagccuugacaucccaggcucaaacgaucuucccaccucaaccucccaaguagcuaggauuacaggcaugcaccaccgugccuggcugauuuuguuuaauuuuuguagagauaaggucucacucuguugcccaggcuggucuugaacuccugggcucaagccauccucccuccuuagccucccaaagugcugggauuacaggugugagccaccacaccuggcuucugaacauuuuuuucuuaaugauaauagcuggugcuaugggcugaauguguucccccaaauucauauguugaaacuucaucccauuguagucauauuaagagauggggccuuuggagaagugauuaagucaugagggcucugugguuggucaugaaugggguuagugcccucaugaacgggcugaaggaaguguguuugccccuucugucauaugaagacacagcagcauggcaucguccgugaggaaugggcucucaccagaucuggaucuccuagugucgugaucuuggacuucccagucuccagaacuaugcauuagaaaauuuauuuauuuauuauuuauuuauuuugagauggagucuugcucuugucgcccaggcuggaguacaaugacgcgaucucgacucacugcaaccucugccuaccccaguucaagcgauucuccugccucagccuccagaguagcuggaauuacaggugcccgccaccacacucggcuaguuuuuguauuuuuaguacagacgggguuucuccauguuggccaggcugaucucgaacuccugaccucaggugauccacccaccuuggcuccccaaagugcuggaaauacaggugugagcuacugugucuggccugaauaauaaaauuuaaaacaauuuuucaaaaauucaccaugaggucucacuauauucccuaggcuggucucaaaccccuggacuccaagugauccaccccaccuucccgaguagcugggacuagagaugcacaccauugcacccaauagagcaauacguuucuguucuuuguaaauuaccugcucuaagguauuuuuguuauagcagccuauauggacuaagcugacuuguaacguuacuugagacuuuaaaguguuccggucacuguuggagggcucugucuguguuagcucauuuaauccccacaacaccucaaucagauggggcuauucuuagucccacuuuauagauaaggaaacugaggcauggaagcacagcuugcucaagguucacaucuagucagugacagagcagguauuuaaaccucaggaaauaaucagagaaacauguguagaggguuguccaaggaaggccacauccagaagcaucucccaggacaguuguuguguagcucacccucuggacuuugugggucuggguguuguuucaugauuauagagagagcucugugaacguggaggaccuguugucggcagagacacaaauggccagggcauggcugggcagccgcaguggcucaggccuguaaucccagcacuucgagaagaccagaggggcagaucaugaggucagaaguucaagaccagccuggccaacauggugaaaccccgucucuacuaaaaauacaaaaauuagccaggugugguggugggcaccuguaaucccagcuacucgggaggcugaggcagaagaaucgcuugaacccgggagguggagguugcagugagcugagauugcaccacugcacuccagccuuggagacagagcgagacucugucucggaaaaacaaacaaacaagcaaacaaacaaacaaauaaauggccagggcaggggaggguugcauauugaauaagaugagcucugcuggaagcacaggucagcacuaaccugcuuccucucucucugcaggugccuuggcaucucccaaugggguggcuuugcucugggcuccuguucccugugagcugccugguccugcugcagguggcaagcucugguaagucaccacuucucaaucauucauuuguuggcuauuaauggcgugccaggguccugcaguaugucaccuggccuuauggagauuacacugcagugggaggggacagccaaugacaaguggcccugauuaucaguaaauucuaaagauuguuagaaagugaugggagccgggugcaguggcucacaccuguaaucccagcacuucaggaggccgaggcaggaggaucgcuugagcccaggaguucgaggucagcuugggcaacauagggagaccuugucucuacaaauaauaaaauauuagccagguguggcagugcacgccuguagccccagcuacucaggaggccgaggugggaggaucccuugaacucaggaggucaaggcugcagugaacugugaucgcgccacuccacuccagccugcgugagaaagugagacccugucaaaaaaaaagagaaggugauggggaaagaacacagaacagcauaagaggggguuggggaagcuggguggagugggggggauugcaguugaaaguagggaagucagggaaggccucauugagcugacuuggaggaagcgggaaccgugcagaugucuggggaaggcucauucuuggcagagaggcccugcacugagccuggcgggaggguugagcacaggagggaaugugguggaggagagugagcagcaggagggagcagugaaggucagcaaggugacagaguggcugaaucaaaaaagaccuugcaguguuugagcagaggauccauaucauccauuauguuccaaaggacucuucaggaugccguguggagaaaggaagaggguggaagccaggaggucuggagggaggucuggaguggaggagaugagaggcuccggaucccucugggagguagauuugaggacagauuggaauugaggugaaagacagagaaagagaaguggccaggaugacuccaagauuucugaccuaaacuacugggaaggacgcgguugucauuucugaaaugcagaaggaugccagaagagaagguacuuuggggaggggcgggaaucaggaguuaguuuuggacaugagauaagcuuggaauauuuauuugcuaucuaagacagcuccuuaacaugguaagcccuuaugcaaguuguugucagcugagaugggcguggcacugagcaugggagcauggaggcgccugaguggucucaugcucaggugguuuagcaaacucaguguacauccugccaauuccaguccugccauggccacugacaagcuaggagggcgcugaaaggagaaggaccccgaugucuccuccagcccauccaucuccucucucccauuggccaaacccaaccggaaacuaaaggccaaggguacccggugaugaagacugugguaucagccuccugagcacagagagggcagaaagggguggagacaaagaggggcgcagauagugggcaaauggggaaguggcacuuccccuagcucgagggcagaggcuuggugugauggaauggcacuccuuaaacugcuacauauuuucccuuuaauuuggccaagaacaaguugucaaguuugugugagauaaaggugcacuugguucguucuugucuaauggcccccgcacccauggguauuucuucagcuuccacagucaucccgacacuagcugggaagcuccagcagcccugguccuggccccagcucugugggcgcuggcccucaacuuugccugcacugugcuuuugugcuauuccccuugguccuguuugggugcaagucccccucacgcauugaguuccugggccgcucaggcugcuccugugucuccccagggaacaugaaggucuugcaggagcccaccugcgucuccgacuacaugagcaucucuacuugcgaguggaagaugaauggucccaccaauugcagcaccgagcuccgccuguuguaccagcugguuuuucugcucuccgaguaagccugcgcuggagcuggagguuuggggagguugugcccaaaggguuugccccaagagugagcuggguccagguggugcgcuggagugcaggaugcugaguaugguuugcugcuguuuauaugguguuagaggggaggucccaucuccagggacauguuauguaagauacaguggagcgcauggugggaguguugguccacguggcacauggauacggcuggaauacuggacuagaccagcaguucucacacuuuuuggucucaggacccuuuuucacacuuaaaaaugagugaggacccaaagggcuuugguguagguaacacaucauucuauguuuaccuaauuagaacuugcaaugaagaaaugguguaauuuuuaaaaaauuaaaacaauuaaaaauuuuuuuucuuacugaaauggaggucucacuguguugcccaggcugcucucaaacuccugggcuccagugauccuccugccuccgccucccaaagugcugggauuacaagcgugagccgcuguauccggcccaaaauggagaaauuuuaagucccaacaacaugcaagcccgcauucaacaaaucuucagaucaauuacaugaucacaggucauguagccucuagaaaauuccacuguacgccagugagagagagugaaaaggcaaauaacgucccuguauuaugaugaaaagaguuuuaccuggugggcccagaccacacuuugagaaccacuggacuagacccuugauugaggaguacgguguugagaguggaguccucugugaugguggauggaccaggacacauggcauaggagucaggugguucccugggcuacuccauggugcacaggaugcuucguuacacuggugcccaggacauaaucacguacacaagacacacaguuacggggcagacuggggauauacggcacaccagcaugcagcguucaccaguaaaggugguauuccaugauuauucuaagguagaugggcugugcuuuguuuccauuggcuuaguccagggauuggcaaacuauggcccgugagccaaauccggcccacugcuuguuuuuguaaauaaaguuuuauuggaacacacuggcugcuguaguuguaacagaaacugcauggcccuccuuuauguuuuuuguuuguuuguuuguuuguuuguuuucuuugagacagaguuucgcucuuguugcccaggcuggagugcaguggcacaaucucggcucacugcaaccucugccucccggguucaagcgauucuccugucucagccucccgaguaguugggauuaauggugccugccaccacacccggcuaauuuuucguauuuuuaguagagaccgguuuucaucauguuggccaagcuggucucgaacuccugaacucaggugauccacccgccucagcgucccaaagugcugggauuacaggcaugagccacugagcccggccuccuccuuuaucuuaauugaaauaauucagaaauggaaagucaaauacugcauguucucacuuauaaguaagaguuaaauaauguguacacaugggcauuauuccauguaccauggaauaacagacauugaagacuugggagggugggagaggggugaaggaagagaaguuacuuaaugggcauaguguacaccauuugggugacggacccaccagaaccccagacuucaccacuaggcagcauauccagugagaacagaucugaggcuugccaucaaaauugcacuuguaaggccgggcacugugguggcucgcggcuguaaucccagcccuuugggaggccgaggugggcagaucacuugaggucaggaguucgagaccggccuggccaacauggugaagcuccaucucuacuaaaaauacaacaauuaacuggguguaguggcgcacaccuguaaucccagcuacuagggaggcugaggcgggagaauugcuugagcccaggagguggagguugcagugagccgagaucacaucacuguacucuagccugggugacagugagacuuugucucaggaaaaaaaaacaaaaacaaaaaacaaaaaacucguacccccuaaauuuauacaaauaaccaaaaaaaaaaaaaaaaaaggaaauuguguggccuuugaaguccaaaauauuaacuaucuggccuguuacagaaaaaguuugcagaccccuggccuagcccgugagauguggguuggcuguuaagguggaacauuggaauuaucuuacgauggccaaacugugcgaugcagagcuuauguuguucuaaauuaauuagugccaccgguucuucccuuucaugggcuuucaggaacaagcuaagucccaggaccagggccggcagcuaggcaggugugaggagcauccuuggugcaugugguaagaggcuguggccagcaagagaggcaacccuagucggcugccccagcacacccuggccgcucccaagcccccagaucuguccucacauccgugaucgggaagcuggaagagucugaugcgguuccuggaggcaugucccggacacagcuguggggcccagccagccuacaggugaccagccuaacccagccccugugucugcagagcccacacguguaucccugagaacaacggaggcgcggggugcgugugccaccugcucauggaugacguggucagugcggauaacuauacacuggaccugugggcugggcagcagcugcuguggaagggcuccuucaagcccagcgagcauggugagcagggcggagugcggcagggguggcuggguguguucccacagcugccugggcugaggguggggugggcaggggaggagguggggucauagcaacagcaggaggaagccgccuguauuuucccaaaucugaugggauuccugccccugccugggccucaguccucccaccuuugaaacggagcuggucgcaguagaccaccaagcccccuucagcccagcuguuuccaccccugaacuuaagugcccaggaaggcguauugagaugaggugugcuugcuggaaggcaugccugcugcugauugaaaaccgaacugggaacauuccuuccauucuguguccacuggucagcugcugcggcuuuggauggucuugaccguggaaggcugaccuucuucugguacccggagucccugcaggaaucccccuugagcuugcugggcuguggugacaggaguuuaaaacaugcguuguauuccagugaugcaugauaugacaugcaucacaggaauaaaaaccugaggucucauggauaugauugcuucaaaggagaccaaguuuuaaaacagaugaaucaaaauaaagaaaaauacucaguaaaucaucauaaaguacagagauguggccaaaggugugaaggaugcagcuguaaaagcugaaguuugaggccggguguggugguucaugccuauaaucccagcacuuugggaggccgagcccagcggaucaccggaggucaggaguucgagaccagccuggacaacaugguaaaaccccgucucuacuaaaaauacaaaaaauuagucuggcaugguggcaggcgccuguaaucccagcuacuugggaggcugagguaggagaauggcuugaacccaggagaaggagguugcagugagcuuagaucaugcuacugcccuccagccugggcgacagagugagauuacgucucaaaaaaauaaaaauaaauaaaaauaaaaagauuuuuuaaaaggcugaaguuuggguuacuuuggcucauacacuuugccuucacuguagaaaggugguuaguaaagaccaggcgcgguggcucaugccuggaaucccagcacuuugggagcccagcgcaggcagaucacuugagcccugggcuauugaggcugcagugagcugggauugugccacugcacuccagccugggcaacagagugggacccugucucaaaaaagaagaaaaaaaggguaauuaauaaacacuaaaguucuauguagaauuuuagcaacauuauuguuauuauaaucuucuuugcuauggcucugaaucuguguggugcuccagaaguaugcuauggagguuuugucgaccaaaaaucugggugguggcugugguuuguaggccggggcugggcugggugaugggggagucacugcauagauccucacauagaggccgcuucucccgcagugaaacccagggccccaggaaaccugacaguucacaccaaugucuccgacacucugcugcugaccuggagcaacccguaucccccugacaauuaccuguauaaucaucucaccuaugcagucaacauuuggagugaaaacgacccggcagaugugagugggcaugcuuugacguuuuucugugaccucuggggaacagggugggugaccagcagaggcccagucccuggagccaggagccugggaggcaagcccuggggcuggauagcaaaucccaggagcuagagaccuggcuucucaccuggcucugcacuaggcaagucccuuugcuuccuggccccccaccccucacaucagagaaggggaguuaucucugcaugccgcuccuccucuguaaagguagggcugugggccacaucuguguuucccaguuugggggacacaagugaucguagguggcacauugacagcucacuugaauaacccuauuauugaagagaauaauacugacucaagagacagugacccgugucaguucccuuuugaggccaacggguuaaggaggaaguccccauacagcugacucguuuacuaauuccucuuaaugaagagagcagaggccacaccccaggcuuagacuuucccaagaaaacaagaucaguuuguugguuguuccccauggaagcugguccugacauucccuucacaguaguguugguggaguuuuuguuguuguuuguuuugagacagagucucacucugucacccaggguggaacacaguggcgugaucuuggcucacugcaaccuccgccuccuggguucuagcgauucuccugccucagccuccugagcagccgggacuacaggcaccugccaccgugcccagcuaauuuuuguauauuuaguagagaugggguuucacugcguuggccaggcuggucucaaacuccugaccucagaugauccacucgccuuggccucccaaagugcugggauuacaggugugagccaccgcaccuggccaguggaguuccuucuuaaguacauguauugacaucuuuaaaaagggcgagaggauuuacaggaaacuaucaggucaguaauggcaggggccguccacaguggguggcugagucccccuauuuuucugcuggugugcagggaggucauuuccugccacccauguuuccccacccugaauccaccuuccucacauucccauuggagggacaaucucuggacauaugggaccuggggucccacagggcugcaauccaaugccugcugugccacucgccagcugugugauguugggcauaucccauaaccucuuugugccucaguuuccucaucuguaacacaggagugacaagagcacccgcccacagggcuaugacaguacaaggugugugauacagaugagcuccccuguuuggcccacauguguccuaaaagccaugugcccuuucucuugagugccccaggccacagagauccccaucugcccgcugucccacacacuggucugucauuuguuccuugagguuugugagggccggcucugugcaucccaggggcccaggcugggccugguuggcucucagggagcaggcacccgccaccuuaagcucccaugcuggugucugucacugcuuccucucaaucuggccaagccaggggugucgauuuauaucucucaggucugguuuccccuuuggcacugggccagguauggggaaagagcaggaauggggcaguuggcucacacagcagaggcucagaaagcggggggcauggggggaaggagugcacagaugcuagagaguggggcaaguuuuguuuggucaauaaaucuccuucucaugccccaggccugugcaagaccuacagagagucccaaggaugggcuggggggaagagaaagguaccaccuucagaguccaaagauauguuauuuaauauuuucauauuucuagaucugccuucaggcauggcuggauccagcuucuaggaaccuguccagcucugcgcccugcuuuauucuguacuggcuucguuuuuaggcaggcucuucccucauguaguggcagauaugccuacuaguugcuccaggccuacaucccaaagccacagugggaaaaggguuuuuuuucuugacgguucuaauaagaguccuaaggcugcugcucaguggccuggcuucgaugcugugccagccucugaaccaaucacuggcuguggguggagagagggugcugguggagggcccugcuuguccagggaggagucacauaccugccucuagggcugcaggugggcucagcuccauccaaaccagaugaacugaaaauaaggcaggaguggcuuccccaggggaaacuggggaagaggaagcaggacugugcuggcuaaaaugccagccagguuuaagacguggcaccagaugccagucaugggauuggauuggucagcaugccugggcuauggcuuagggguauguuggugcucagggaugccacaggccuccagauaccaggucugaggcagaagaaugaaguccagcuucucuuguggguggaacaguggcaacugagauaccccaucucucccuucccaagaacagagcugaacauaaagaauuuagugauuggccagagcuuggccacaugcuccccucugaugaaugauaggccaggugaugggauuggcacaauuggcuuagacuaaugaggguuggcccuggaguugcaggcaguggaguucuguccuaagcagugggcaccuaaacccgauggcauaaaagcugggcggguguccaccugcaucugccacagcacuauaggcaccaacuguggcucauacugagugggauaaauuccagaaagaaacauuaggaacuuacuauagaauuuuggggcuagagcuacucauucauuccccuagauaauuucuaggcaagguuccauaguggagggggaguuuuggcuugggcauugaaggaugcauaggaguuuucuagauggggaaagaagggaacgguagaccaggcagagggaacugcaugauaaaagguuuaugggugugaaaauucauggaauguuugaggauuaugggguugggggaugugggaauauguguagcgauaaagcaccaaacaaagccaaaaguuuaguuagagcccugaaugccugccucauaaugguuuccauauuuuauaugccuacuaugugccaggcacauugcucagggucacacagcuggaaauggcagggcugaguuuuuguuguuguuguuguuguugagacagagucucacucuaucacccaggcuggaaugcaggggcgugaucauggcucacugcauccuugacuuccugggaucaggugauucucccaccucugccucccagguagcugggacuacaggcacaggccaccacgccaggcuaauuuuuuguauuuuuaguagcgacagggucucgccauguuguccgggcuggucuggaucuccuggcuucaagugaucccccuggcucagccucccaaggugcugggauuacaggcuugagccaccgcauccagcccagaucugagauuugcacccaguauuugaacucccaagccugugcucuuuuuccucccauggacauuucucucagagauggucucccaaacaccuguccuucuuguuaaaaaacagacaaaccgcaaguaguucuuuggaagcucagauuucucuuuuguuucuuaguaaaacauuucccaguucccagcucccuuccaggguguaagauuucuucgguaacuuacaucuagcuguugcuucuuguuugcucauguuuagaaagaaagacaaaagagagugagaauuuucucucccuuccccagucuccccacaacucacaccccacccucagcucccucuguaauaggaaaaucucugaacucucuguaguugcuccagcaaucuuuuggaacuuugcuucuuucuugugaaaaaaccuccccuuggcucacuuugcaccagguuuccccaaaugugcuuccaaccacaagcagaaauggagcugccaguaaccaggaagaaacugccgggggcugaggaagaggagagggaggugcauagcccuggaucucgcagggagaggggugacaggaugagaacucagguugcucacuugccaucagggucagucaugaauauagcguucauguaucacuuuuuaaagcuuuuuuggaggguaaaaguaauaguuacacaaaauaaaaauacaaaugguacaaaaggacuuagaauggaaacauguuucucucccgacuccagccuccuguuuuucuucccagagacugaccacugcugucugucucuugccagaagggaaagggaggcaagguuagggcaggcagagggcaugugcauccuuuagagagagcuuaugucuauacaagcaaauguguguguucagucaucgcugucuuaguuuucuauugcugcauaauaaugguacuaccagcuucacagcuuuaaacaacacccauuuauuaucucauaguuucugugguugggagucuggacauagcuuagccagguucucugcuuuagagucucgugaggcuauaaucaaggugugggauggggcugcaguuucaucugaggcucaauuggggaagggucacuucuaagcucauacaauauuggugacauucagucccuggcaggcuguugaacugagagccucaguuucgugcuggcuguugguuguaguuaacccugaauuccuucccaugugcccuuugcaaagccaucaaggcagagagacuugccuagcaaguaggauauuacagucuucuguaauauaaucacauccaugaaauccucuauauaucccaucaccuuuaccauauucuguggguuagaaacaaguagcagguccugcccacacucgagaagaccagaugacacaaagaugugauucaaaguggggaucaucggggccaucuuagguuugucugcagugaucacugugccaucucucucucucucuuuuuuuuuuuuuuuuuuuccgagacgaagucgucacucugucacccaggcuggagugcaguggcaugaucucagcuuaccacaaucucugccucccagguucaaaugauucuucugccucagccuccugaguagcugggauuacaggugcccgccaccacacccagcuaauuuuuguauuuuuaguagagacagaguuucaccauguuggccaggcuggucuugaacuccucaccucaagugauccacccacuucggccucccaaagugcugggauuacaggcaugagccaccaugcccagccccaucucucuuuaaaaaacaaacaaacaaacaaaaaacauaaaaagaagcagagaacacauacacaucugcaucuucccuuguuuacuuaacaauagaucuuggaagucacuucucaguagaggcuagguugggcagagcauuggauucuaggccagugaguuuggacuugaccauggagacacuaggaagcccaugaaggacagagagagaugccucgacccugccaguccuuuagaaagaucacccagugcuuuuuguauaccaaacccuauuugaaauacuuacguauauuaacccauuuccuuaucaccacaacccugcgggaagggagauaggcacuuuuauuaucuucauuuugcagaugaggacauugagguccagagagguuaugucacuuacuuaaggucacacagccaggaagugguaguagggacucuuacccuuguuuuacagaugagauugaauuaucucacgaaaacucagaaagguuaaacaacuugccuaaguaacauacagcuaauuagucgaggagccugacgcauguugcuguagccuggucacaguuacagagguggcaagcaauggccugaacaggacgaacaaccaaauacccaggcugguggcucuuaaacaugguggggucagcuaacgacagcaaccagggugggcacuggugccccucgcccccggcuggugcccuaacaucucccuuuucucuaccaguucagaaucuauaacgugaccuaccuagaacccucccuccgcaucgcagccagcacccugaagucugggauuuccuacagggcacgggugagggccugggcucagugcuauaacaccaccuggagugaguggagccccagcaccaaguggcacaacugugaguaucaagaggccuaagcaaugguaaucuccacucuccauucuuccccuguggccagacacuuccccuggcugagucucugggcuuuuauaucauaggaugccucuaauggcaauccugccauuagauacaccugccgugguguaucugccagguaggcaggcuaggcugcaguaacaaacaagcccacaauuuccauggcuuaacacuaugggaauauauuucuugcucacguaacaagcuaacgugaauguugcugguuuguaggugguuucccucccuguagaaaucuggggagugagguucuuuccaucuuguggugccgucauucuccaggacaaagauucuuaccuacuuuuguguccugguuuccuuuggcagccuggugaagccuauggaccucauuucagaauauuuuuaaauacauaaaaucccagccugggcaauauagugaaacccccaucuguacaaaaauuagccaggcaugguggcaugcaccuguagucccagguacugggaaggcugaggugggaggaucacuugagcccaggaguuugaggcugcagugagccgugaucguaccacuuuacucccaccugggugacagagcaagagcccaucucuaaaaauaaauaaauacaaugaaauaaaauaaaauaaauagaacuacagaggaaacuaauuguauugaaaugcaguuauaaaacauuuaaacacauuuuuaaucuagagauauaugugcuucuuuauuaagaucuauaaauaauaaguucuagggguagcucgcauaaauacuguaauuucaaaguagauaagcauaaauaauacuuuaugauacugaaauugugaugugauaugagaauagcugugaguuuuguuuugcuggggacaggaucagugaugcugucauuacuggggucucuucccuccauucuuuuuuuaaaauuguauuuuauuuuauuuuuaaaauuuuaaaauaaauagagacaggguaucacuauguugcccaggcugcuuuugaccuccugggcuccagugaucuucccaucuuggcuucccaaagugcugggauuacaagugggagccaguguuccuggccccuuccuccauucuuaauggaaggagaugcuaggugugagagguuagggaaaguaaagauguaauuucuuucccauccaaguucucagaccccugaauucuaccugcagccauguugguccaucaaccccaagugaagaaucccugcucuagggccccaccauugucuguauccagccagcagaagaggcgugauuauggagaucacaucugcuucuugaaagcagacagcccggaagugggccgcaucacuuccucucaaauucuauuggugaaaauggucacaugacuacacauagccacaaaggaggcugggaacuuucucacuuggaaccuacaucccagaaacaacucuuuucagugagguaucccacaggucuuucgcaguagaaauauugauuaucucacauaaaaugaagucuuacaaauggaccuacuggguuuuguacagcagccaagugauaucucuucccuucugcugucuucccuucugccauccuucacaugguggcauuguauccuuagacuugccacccaugcccucagguuggccguugcacacugucuuacauaaagcaggaaggaaaggaaaggcugcuacgagagaguguaccuugugcaucucuuuuuuaaucaggaagcaaacaucuuucuagaagcuucccuagcaaaauuccccuuacaucucauuggccaagacuguuacauguuacaugguuacuguuauuacuugcucauugcaaggaagacugggaacucaaaugccuggaaaaaggaacaggauaaucgugauuggcucaagccuuagggugggcauggcucccugacaagggagagaggaaaaagcuguugagugaagaagacugcuucaguuuccccaucuguauaaugggaggaguaagggcugucguaaaaacucaaugaaagaagauucuucaacgugguaggugcaguggcagcuggcaguacccugacccugccaccgcacagcccucucagcauugcucauccugcacuguggauaucaguugagccacgugucuccugcccugggcugugagcuccauaggcagggucuccauggcuguaucuccagaacccagcacagaaccaggugcuugggaaaguuuugaauugauucucaucugccauuggcauggggaagggaacuagcuuguaugaaacagauaacaauguaugggacccucauucauuauuucagcaaauauuugcugaguuccuccuacauggcuagcccugugcuagacacuggggaaucggcgaugaacaaagcagauagaaauccccacucuuguggagcugacauucuggagggagagacaaaaagcaaacauauaaagaaagaaagaaaucacauggaucuggaugacagugagugcugggaagaaaauaaaagcagaggaaggggauggagcgaugggcagggggcaacgguagggagggugucggggaaaacuuuuuggagaaugugacgaugaaagugaacaaggagaagucaaccguguugagaugauggcagcuaaugauguggacaggccacucuguucugagugcauuaucuauugauucaucaugucauccucgcaacagcccugcacgaucaauucugucauuaaccccauaguacagaugaggaugcggaggcacagagaagauaagggacuuguccugugucacacagcaaggagccauccggcuccuaaguuggugcauuugacuucugugcuuccggaaagaaagagcagcaaguuuaagaucuggagguggcacugagcuuuggaggagcagggggcaaugagguggccggugugacgaggacucaaugugcaagagggagagugguggggagaugagguggagggguggucggcggucagaucguggagggucucggacgaggguccugacccugggucuccaguccugggaaguggagcccaggcuguaccauggcugaccucagcucauggcuuccccucccacuuccagccuacagggagcccuucgagcagcaccuccugcugggcgucagcguuuccugcauugucauccuggccgucugccuguugugcuaugucagcaucaccaagugaguccugggcccagugcugccgagcagucccucuggagugcaggguggcagggacuugccccucuagucugccccuuugcaguccucucagucaauaauacgcauuuacugagcagcuacuacacaccuugagaguagagcugagaacauaucgacaaggaccccacuuuuuucuuuuuuuuuuuuuuuuuuuuuuuuugagacggagucucacucugucacccaggcuggaguauaguggcacaaucuugccuaacaguaaccuccgccucccggguucaagcaauucuucugccucagccuccagaguagcugggauuacaggcgcaugccacuaugcccggcuaauuuuuuguauuuuugguagagaugggguuucaccauguuggucaggcuggucucgaacuccugaccucaugaucugccugccucagccucccaaagugcugggauuacaggugugagccacugcacccaaccaggacuccacauuucuaaaaccggcauccuacuggggagacugaaaauacauaucaaucacaaacaggugguuuuccauagugacccacucucugaaugcacuagaccagggugcaggccagagaucuucuggggugcuuuuugcaagggggaccaggauaaggcucuccaaggagggaaaauuugaggggggcccugacuggggagaaugagcuggccagggauaagcaagauggagucaucccacauccccuuacaacgcugggugccugggcaacugggggcaucugggggcaugugguaggagccagaggaauuugcgacgauugcccugauggagucaggagaccuggguuugaauccuggccuuggagcuugguagcuggcggccgacaaguugcugaaaccccugagccugggguuccugcuuugcagagugacagugauggugagaacauauuucaucagccagaagaggccaaaucacaguaaaggcugagggaggagaugaguggcgaguggcugggaggugguggaaggagccucguuuccagagagcucuugccagcccuuggaaucauggugucucagagccucaguccucccaucucugaaaugggacuagcaagcucaaccucacuaagucaggauuagagguggcuaaggauuauuaacaugauugaugaaagugcccacucuuggcccagcacacacuagguaggcagggaaugcaaauuccccuccauaucuugucacugaugccuccgagcaaccuuggacugaucgccuugcucugagccucaguuuccccaucaccuguaccucuucccacuccccaucacuauaucccagcaugccagccucuuugcuguucuuugucuuugguuucuuguuuuguucuguuuuuuagacagggucucacucuguuagccaggcugaagugcaguggcgcgguuacggcucacugcagccuccaauuccugggcuaaagagauccucccauuucaacuuccagagcagcugggacaacaggcgcuugccaccacaccuggcuaauuuucuuauuuuaauuuaauuuaauuuuauuuuuugggacagaguggagucucaaaaaccaagcuggagugcaguggugcgaucucgacucacugcaaucucugccucccggguucaagcgauucuccugccuuagccucccgacuagcugggauuacaggcgugugccacgacacccagcuaauuuuuguauuuuuaguagagaugggguuucaccauguuggccaggauggucuugaacuccugaccucaagugauccacccaccucguucucccaaggugcuggguacaggcaugagccacugugccuggccaauuuucuuacauuuuguagagacuggcugucacuuauguagcccaggcugaucuugaacuucuaccccuuuaucuuuauucauggcacuuauuaccaugaaugaaugaccucauauaagcauuucuuucguuuuuuuuuuuuuuucuuugagauggagucucauguugucccccaggcuggagugcaguggcgcgaucucagcucacugcaaccuccgccuuccggguucaagcgauucuccugccucagccuccugaguagcugggauugcaggcgccugccaccaugccuggcuaaguuuugcauuuuuaguagagacgguguuucaccauauuggccaggcuggucucgaacuucugaccucaggugauacaccugccuuggccucccaaagugcugggauuacaggcgugagccaccaugccuggccucauauaagcauuucugucuccauuuaucauccaucuuucccucuugaaggucaguuucaccaaggcaggcaucuuugucucguucacuguuguggccucagggccaggcacagugagucaaacauagaaggugcucaauaaauauguguuuauuuauugaaaccaugggcagaggcuaauucagaagcggucugaggaccuuaccucccagugaugaugcaccauggccccaggcaggccaggaagagagaaggguuguguuucuccguaggucccccagcuucccaggccaucccaggccauucccuggucauuugcccucagcugcucugaaaaagggauuguugaggggaaccuagaauccucucucugcaguuugagucuuuccuaauccccuggggucucauucccacugaggacauagguggccuccucaggaacucugugcuggguaacagaaugcgggagugugaaccuggcucugccaccuaccagcugucacuccaccuccuugggccucacucuccucaucuguagaauaggguuagcaauagaauccaugucaccagguuagaaugaugagucagugguuugaccuccagaaacuaaucagccugaucucugaugccaaauaaguauuggugauaacgaccacuuuuaugggaggagcguucaccugucaauaauucagagaucaacaccuuuuccuuuuguuuuucaggauuaagaaagaauggugggaucagauucccaacccagcccgcagccgccucguggcuauaauaauccaggaugcucagguaggaguaggcguggaugaggacaugugggacuguguacaugaagaagugugguucagaacaccugggcuguuaaggaccuucacuggcuucuggaauggcaaauagacagucaggaggguugcaggggagacagagacagaagccgaaugaggucauuagcagaccagaggcuuucccgcccuuccccuuggcaaucccagccuggggugggcuucucugggguugguuuccuguuuuuuucccuccccuugggagaaugacccuugggucaucaucacugugucauucccuggggaggugccaguaccagggcuagaggccagaaggaguggaggaaggagagggugacaggcuuucugugucuucuucuuaagcauaggaaacugcccccgaagcacuagcaaaucccuuccggguucucauuggccugaaauguaucccaccccuaagccagggguggagucagcuuccccaaggcgaugguccugugggugagugggugggguuugccugagcaagaugagaguucucuagguaggagaaagggggauuauagguccugucuagaagagaaggucugaggguccuugcuuuuccagggacucuggaaucuagugguguuggcuuugaauccugacucugccacucacuggcaguguggacuugagcaaguugcuuaauucucugagccucaguuuccucuuguggguuauaacaguguuuaccugguaggacagauauuggaauuuauugagacaauacauauaaagugcauauuccagccucuugcaaauaccaagugccauuuauguaucaguuaguguuugcuguguaacaaacgaccccgaaauguagaggguuacaacaacuuuauuuagcuuaugcuucugcaggcuggcauuuggggcugggcucagcagugaggguggcgggggaggcugggcugggcugggcugggcagaucugaauugagcugacccguccccguagccucccuccgugucugacaguuggcuuuuuuuuuuuuuuucuuuuucugagacggaguuuugcucuuauugcccaggagugcaauggcgugaucuuggcucacugcaaccucugcuuccuggguucaagcaauuuucuugccucagccucccaaguagcugggauuacaggcaugugccaccacgccaggcuaauuuuguauuuuuaauagagaugggguuucuucaugucggucaggcuggucuggaacuccuaauaucaggugauccacccacuucagccucccaaagugcugggauuacaggcgugagccacugcacccagccuaguuggcugacuuuuaccugggacagugcaggugccugagccaugugccucucacucuccagcaggccggcccaggcuuguuuacagaguggcucaguuuucaagggugggaagucccaaggcuucuugaggccuaggcgcagcacuggcaugauaucacuuccaucacauucuaugggcccaagcaagucccagggccaguguagauucaagggaugggaggagauucagagcacuccucuguggccacuuuugccaucgaccacagucccuguaaauauuaggacaauguaauuaauucccaggaaucugaagcucagaaagcguaagugaccuguuggacuucugaucugugugaugucgaggcuuguaccccuuccugagcauugccguacuccaggccgggcugcaaggccacucugcucuuucauuggcugucucuguauuuuaggggucacagugggagaagcggucccgaggccaggaaccagccaagugcccguauguaucugaacuuaggucacagccugcaugcauugggaaggugauagaauuggagaggcaagccccuagcuccaugucugccuucucuucccugcauucgguaauugcccugugacauuagccuucaagggacggcaggaggagggguguucuggaaacguggacugcuggccaagcccccugaguuucacuggugugucagguacauggugauaccccuugggagugcuguuauaguuaacaaccagagcagccgugccuguuguuaaaaucuugaccuaauuguauacuugucggcaaauagccacuauccugaacacuccccuccuuuuuuuuaauauacaggaucucacucuguggcccaggcuggugugcaguggugcgaucauagcucacugcaccuucaaacuccugagcucaagugauccucccaucuuagccucccgaguagcugauacuacagaugugcauuaccacgccuggcuauuuuaaaagguuuuugccuguaauuccagcuacucaggaggcugaggcaugagaaucacuugaacccgggaggcagagguugcagugagcgcagauugugccacugcacuccagccugggcgacagagugagacucuugucucaaaaaaaauaauaccaaaaaaaguuuuuguaaagacaagcucucgcuguguugccccgccacuguggccuccuuagcuucuucccuggggccugcuggaccuuuccauacuccagaaacuaaaggggguccaggacccugcuucaacccuaggaucccgcaucuuuuuuuuuuuuuuuuuuuuuuggacgcagggucuugcugugucccucaggcuggagugcagugauucacugcagccucaaacucgugggcucaagugauucucuagccucagccuucuaaguagcugggacuacagucauacaccaacaugcccagcuaauuuuccuuuuuuuuaauucuuguagagauguuugagacggcuugggcucuguugcccaggcuguucucaaacuccugagcucaagcgauccucccuccucagccuccuaaagugcugggauuacaggcgugagccaccgcacccggcuuccauauccuuucuaauuggucauggcuugggauaaugguguugcuuuuaauuaucaucauccauaaagacuuuuucuuacucaacagaucugagcuuguauuuggugcccaggacaugugcuggguucccgaaaucccaaagacacagacccuacccucagggauuucucauucuagcaacauagacugaucaauuacugauuauaacguuagaaggcaugucugaaguagacagccaucaggacauggugauuucaggcugggcuuugaagaaugaauaggaguuuuucaagugucgaaacugaacccugaccaaccuuugcuuuugcagacacuggaagaauugucuuaccaagcucuugcccuguuuucuggagcacaacaugaaaagggaugaagauccucacaaggcugccaaagagaugccuuuccagggcucuggaaaaucagcauggugcccaguggagaucagcaagacaguccucuggccagagagcaucagcguggugcgauguguggaguuguuugaggccccgguggagugugaggaggaggaggagguagaggaagaaaaagggagcuucugugcaucgccugagagcagcagggaugacuuccaggagggaagggagggcauuguggcccggcuaacagagagccuguuccuggaccugcucggagaggagaaugggggcuuuugccagcaggacaugggggagucaugccuucuuccaccuucgggaaguacgagugcucacaugcccugggaugaguucccaagugcagggcccaaggaggcaccucccuggggcaaggagcagccucuccaccuggagccaaguccuccugccagcccgacccagaguccagacaaccugacuugcacagagacgccccucgucaucgcaggcaacccugcuuaccgcagcuucagcaacucccugagccagucaccgugucccagagagcuggguccagacccacugcuggccagacaccuggaggaaguagaacccgagaugcccugugucccccagcucucugagccaaccacugugccccaaccugagccagaaaccugggagcagauccuccgccgaaauguccuccagcauggggcagcugcagcccccgucucggcccccaccaguggcuaucaggaguuuguacaugcgguggagcaggguggcacccaggccagugcgguggugggcuugggucccccaggagaggcugguuacaaggccuucucaagccugcuugccagcagugcuguguccccagagaaauguggguuuggggcuagcaguggggaagagggguauaagccuuuccaagaccucauuccuggcugcccuggggacccugccccagucccuguccccuuguucaccuuuggacuggacagggagccaccucgcaguccgcagagcucacaucucccaagcagcuccccagagcaccugggucuggagccgggggaaaagguagaggacaugccaaagcccccacuuccccaggagcaggccacagacccccuuguggacagccugggcaguggcauugucuacucagcccuuaccugccaccugugcggccaccugaaacagugucauggccaggaggaugguggccagaccccugucauggccaguccuugcuguggcugcugcuguggagacagguccucgcccccuacaaccccccugagggccccagaccccucuccaggugggguuccacuggaggccagucuguguccggccucccuggcacccucgggcaucucagagaagaguaaauccucaucauccuuccauccugccccuggcaaugcucagagcucaagccagacccccaaaaucgugaacuuugucuccgugggacccacauacaugagggucucuuaggugcauguccucuuguugcugagucugcagaugaggacuagggcuuauccaugccugggaaaugccaccuccuggaaggcagccaggcuggcagauuuccaaaagacuugaagaaccaugguaugaaggugauuggccccacugacguuggccuaacacugggcugcagagacuggaccccgcccagcauugggcugggcucgccacaucccaugagaguagagggcacugggucgccgugccccacggcaggccccugcaggaaaacugaggcccuugggcaccucgacuugugaacgaguuguuggcugcucccuccacagcuucugcagcagacugucccuguuguaacugcccaaggcauguuuugcccaccagaucauggcccacguggaggcccaccugccucugucucacugaacuagaagccgagccuagaaacuaacacagccaucaagggaaugacuugggcggccuugggaaaucgaugagaaauugaacuucagggaggguggucauugccuagaggugcucauucauuuaacagagcuuccuuagguugaugcuggaggcagaaucccggcugucaagggguguucaguuaaggggagcaacagaggacaugaaaaauugcuaugacuaaagcagggacaauuugcugccaaacacccaugcccagcuguauggcugggggcuccucguaugcauggaacccccagaauaaauaugcucagccacccugugggccgggcaauccagacagcaggcauaaggcaccaguuacccugcauguuggcccagaccucaggugcuagggaaggcgggaaccuuggguugaguaaugcucgucuguguguuuuaguuucaucaccuguuaucuguguuugcugaggagaguggaacagaagggguggaguuuuguauaaauaaaguuucuuugucucuuua

SEQ ID NO: 191800 - RNA, 8748 nt, Homo sapiens
cccacacuggcuaggcaggcagcacagucccgcggacggcugagcguguggcugcaggagcuucugugggaguacggucaugagccuuuugcuguacuaugcccucccugcccugggcagcuaugccaugcucuccaucuucuuccugcgccggccucaucugcugcacacgcccagggcucccaccuuccgcauccgccugggggcccaccgaggaggugagccggguaggggugagaacaggugccaaaguggacagcacagagggguagguccaagggggcaugcuagaaacggggcagggaccaagagagaaggagagcgaaguggcagggcaggguguggacgaggaagaagaugcuggcgcagccugggcuggcuggggaggugaggccagagggaggauggagcccagagagggaaugugggugaugagguugggccaggccccuagaccccaagccccagaggcccacuccagugccccccacaggaucuggagagcugcuggagaacaccauggaggccauggagaagugaguguaucugccccugcccaggcugccaugugagggugugcaggucguggacugcaucacagcaagggacgccauucacuuccuagcugggugacuggcgcccccuggagguggccugcacaucccgccacgaacuccgcucucacauucccggccaccucccagccaccaugccccucaucccaguccccugccccugccccccgcugaccuucacccccacagcuccauggcccagcgcucggaccuccuggagcucgacugucagcugacacgggacagaguggugguggugucacaugaugagaaccugugccgccagucgggccuaaacagggaugugggcagccuggacuucgaggugggcccugcccugacaccccaacccccacccugagagucaccaugcccaaugcgggccucuagugacauccuuccuguccuccccaggaccugccccucuacaaggagaagcuggagguuuacuucucuccaggugagagcaagggcuucgagcccugccugggccaugccugccuuccuuggaccuccgccuuggcuucccucugaccccuuuucccacaccacccccaggccacuuugcucacgggucagaccggcgcaugguucgucuggaggaccuguuccagagguuuccaaggacacccaugagcguagagaucaaagggaagaacgaagagcucauccgugagguggugcugcaggcagggcuagggcggccaccgggggcgugagagaggccuggcucucccuucaccuccuucuccuccucccagauagcaggcuuggugagacgcuaugaccguaaugaaaucaccaucugggccucggagaagagcucggucaugaagaaaugcaaggcugccgugaguccccccaccccucccccguccucuuccuccuccaggggccccuccuccccagagcuggagcccacccagcauggggacccgagcuagaggggucugggagaguucccaguggcguggcgguggcaaugaaaagggugugaacucaggccucgaacacagagccaagaugugacuuuuguuuuuuuucuuuuuugaaacacagucucucucugucgcccaggcuggagugcgguggugcgaccucggcucacugcaaccucugccuccuggguucaagcgauucucaugcuucagccucccgaguagcugggauuacaggugcacgccaccacgcccagcuaauuuuuguauuuuuaguagagaugggguuuuaccauguuagccaggcuggucuugaacuccugaucucaggugauccaccugccucagccucccaaacugcugagguuacaggcgugagccaccacacccagccccaagaugugacuuggauccugcagguaguagggccucuggaaugcccaccacggcuccccugcagcucaugccuccucucugcuuccccagagcagacagauucucaugccucuccuugccuccccagaaccccgagaugccccuguccuucacaauaagccgaggauucugggugcugcuuuccuacuaccuggggcugcugcccuucaucccaaucccugagaaguucuucuucugcuuccugcccaacaucaucaacagguaccaguggggggcggaccucagaaaaacuccccacugcuuagggucuccguggagaaggagcccagaucuucccagcuccccagcuccccucagagauaacccccaaggucuuuuaaggacagugguucuuacccagcauucaugaauacuaagggaacugugaacacccugaaauucugugcauauguggaguuuuaggauagagagguaauuuauccaucucaggccaucuagcauauuuuauugaaugucuacucugucccaggugcaguuauaauguguaaaugagaccagugaggguggggagagguccuuggugagcuuacagucuggcuggggagacauucguucauuaauuauagcacggcugucucagacccucagcaggaaaaggccaagucaguguucugcaggaaggcagggguuaacaaaguaacagcuggggaaaggaucaggaauuuggauacuucgcuggcacuuaagccuagucccucccuuugcuuuacaauuuuuuuuuuuuuuuugagacagucuugcucgggcuggaaugcaguggccagaucaugacucacugcgccucgaccuccugggcucaggagauccuccugccucagccuccuaaguagcugggaguauaggcgugcaacacugcaccuggcuaauuguuaaauuauuuguagagacaaggucucacuauguugaccaggcugcucuugaacuccucagcucaagcgagccucccaccuuggucucccaaagugcugggauuacauaccugagccccugggcccggucucccuuugcuuucugacagcuucucugugguagucccagagcucucugcuccccucuguuguccagaaggaagucccacucagcccccacaauaccuugcuacaaagagaucaaugauauuuguguaccaccuuuuuauaccggauuuuuuuuguguuuuuugaggagucuuccccuguugcccaggcugcagugcaguggcgugaucucggcucacugcaagcucugccucccugguucacgccauucuccugcuucagccucccgaguagcugggacuacaggcgcccgccaccacacccggcuaauuuuuuuguguuuuuaguagagaugggguuucaccguauuagccaggaugguaaucugaccucaugauccgccugccucggccucccaaagugcugggauuacaggcgugacccacugcgcccggccuuauacaagauuuauaaaguguuuuaacauauuuuggguugacuuuuaccuugcagcacccccaggagguauaagaaucaugacucccaugguacccuagagaaucugaggcccagagagguucuguaauuugcccaaggacacacagcuggaaauccagagcuuagguuuucccugggucugacuccagagccugcccuaggacacugucaagggucucuaaagucaccccuggagugggauaauuaggggucgucccacuaagugcugucuggucucaagaagcuggccaaugggcacaguggcucacgagguuuuuuguggguuuuuuguuuguuuguuuguuuuugagacggaguuuugcucuuuuugcccaggcuggagugcaauggugccaucuuggcucaccgcaaccuccgccucccagauucaagcgauucuccugcuucagccucccaaguagcuggcauuacaggcaugcaccaccauccuggcuaauuuuguauuuuuaguagacacaggguuucuccauguuggucaggguggucuugaacuccggaccucaggugauccacccgccucggccucccaaaguguugggauuacaggcgugaaccaccgcgcccggccauuguuuuuuguuuuugagaaggagucucacucuguggcccaggcuggagugcaguagugcgaucuuggcucacugaaaccuccgccuccuggguucaagcaauucuccugccucagccucccaaguggcugggacuacagggucugccaccacgcccggcuaauuuuuguauuuuuaguagagacggcguuucgccauguuggccacgcuggucuccucccaccucagacuuucaaagugcugcgauuacaggugugagccaccacacuuggcuggcucgugcuuauuauccuggcacuuuugggaggcugaagcgggaggauugcuugaguccaggaguucaagaccagccugggcaacauagugagacaugucucuacaaaaauuuuuuaauggccgggcacgguggcucacgccuguaaucccagcacuuugggaggccaaggcgggcggaucacaaagucaggagaucgagaccauccuggcuaacagggugaaacccugucucuacuaaaaauacaaaaaauuagcaggcgugguggcgggcaccuguagucccagcuacucaagaggcugaggcaggagaauggugugaacccaggaggcggagcuugcagugagcugugaucgcaccacggcacuccagccugggcgacagagcaagacucugucucaaaaaaaaaaaaauuaauuuaaauuaauaauaagauaaauagauaaauaagaagcuggccaggcccaaccaggagggccugcagccuggauguccagcuuuggaaccaagcgaggcccuggcccagccccaccaccacucugcuuugggucuggcaagucccuuucguucucuaaggcccagauuccuuaucuggugaauggugacuggagggccacacccuugaagcgugguggucagaguaggcucucugaacaaugggugaauuguucacuggggcaacuacaaagguuauucugggggauucuggggggugggagggcagcgcuacccuaguuggcgggggcacuaccagcccaccccaccucugggacaggggagacccuaggagcuaacccccacuuccuucucucugcaggaccuauuucccauuuuccugcucuugccugaaccaguuauuggcugugguuucgaaauggugaggugggcaagauggcuggguggcguguccccauagagaccuacugcugcccuucucccagguccccucucaucaucaccucccacguccccaccccacccccaggcugaucaugaggaagagucugauccgacacuuggaggagcgaggggugcaggugaggccgugaccaccacuuccaccgcacacagaccuggcagcaggguuccggucccacucugcugccaacuagcugcaucacucgggcaggugaccucaccucaguuucuucgucccuaaaaugggaaaaugguauauuuaacucucuggauacacacacacacacacacgaacacacacaauuuucuucuucugugugugugugugugugugugugugugugucaagagucucacucugucacccaggcuggagugcaguggugcaaucucggcucacugcaaccuccaccucccggguucaagcgauucuccugcuucagccuccccaguagcugggacuacaggugccugccaccaugcuuggcuaauuuuuguguuuuuaguagagacgggguugcaccauguuggccaggcuggucucgaacuccuggccucaagugauccaccugccucagccucccaaagugcugggauuacaggugugagccaccacgccuggccacgcacauauuuucuuaaccugacauugccaacauauggauauguaacuaguacuuauuaagggcuugauaaauguuagccauuaugaugacaacaaugauguaucaugaucccugaugagagggggcuggggaaagaugagagaugggagaaaccaggcccagcccaccccccucuccccugagcauuggcuuccaccagaucauuuaauuaguaaacgauccuugagaauguuccaggcacuaugguacuaggggugggagcuucccaucaaggguacagggaagaaaugccauaggcagaggcugggcacggcucccaccuguaaucccagcccuuugagaggccaaggugggaggaucacuugagcccaggaguuuaagaccagccugggcaacauacugagacccucgucucuacaaaaaauuuaaaaauuagccaagcgcagugguuuacaccuguagucccagccacucaggaggcugagaugggaggaucaccugagcacgggguuucgagggugcagugagcuauaaucagaaucacgccacugcacuccacacuccagccugggagagauagccagacugucucaaaagagagagaggaaagagcgugagagccagagacagggagagggaggagagggagggaaacaggaaaaaggaaaggaaaagggaaagaaaagaaaaaugcagaggcagggugcaguggcucaugccugcaaucccagcacuuugggaggccaaggccagcggaucaacuaaggucaggaguucgagaccagccuggccaacauugugaaaccccaucucuacuaaaaauguaaacauuauccggguaugguggcgcaugccuguaaucccagcucuacuugggaggcucaagcacgagaaucacuugaacccaggagcuggaggcuauagugagccgagaucacgccacugcacuccagccugggcgacagagcaagacugucucaaaaauaaauaaauaaauaaauaaaauauuaacugggcaugguagugcaugccuguagucccagcuaguuaggaggcugaggugggaggaucacuugagcccaggaggucaaggcuacagugggcugugauuacaccacugcacuccaguguuggcaauacagagagaccucgucucaucuguauuuuuaaauaaaaaauucccaucuccgccuaccucagugcccacucaacgggcagggaaggggcagagcugcaggagcuggggcagguggcaguggaauggggguuugggggaggguggugcuguuaaguggucaacaacuagcucucagagaggaacaaaugaaagcccugauuugaggauuaauuuuccugguuuaaauacucccaucuuggccaguuucaggcugccgacaugaagccacuaaaugcagaaugggaagagaugcaugguggcaccccaucauguaguauuuccaucuugcagccucaacagacuuaaucacuucaagaacacaguaauaggaaacugauuagcaagagauaugcuuugaauauuuauuacuggauuuuuguuuguuuuggguuuuguuuuuuguuuuguuuuguuuuuugagacagagucuugcucuguugcccaggcuagagugcaauggcgugaucucagcucacugcaaccuccaccuccuggguucaagcgauucuccugccucagccuucugaguagcugggauuacagucgcccgccaccacgcccagcuaauuuuucuguuuuuaguagagaugggauuucaccauguuggccaggcuggucucgaacuccugaccuuaguugaucugccugccucggccucccaaagugcugggauuacaggcgugagccacuacgccuggccacuuguuguuuuaauaauuuauuuagggccgggcgcgguggcucacaccuguaaucccagcacuuugggaggccgaggcggguggaucacgagguuaggagaucgagaccauccuggcuaacauggugaaaccccaucucuacuaaaaacagaaaaauuagcugggcgugguggcggacaucuguagucccagcuacucaggaggcugagacaggagaauggugugaacccgggaggcagagcuugcagugagccgaguucaugccacuguacuccagcccgggugacaaaccaagacuccaucucaaaaaauaaauaaauaaauaaauaaauaauuuaauugucaguauauauaauuuuuuuuuuuuuuuugagacgaggucuuguuguaucgcccaggcuggaguacaguggugcaaccauagcucacugcagccuuagaguccugggcucaagcaauucuuucaccucagucuuccaaguagcugggagcacaggcgcauaccaccacaccgggcuaauuaauuuuuacaaaguuuuuuguagagaugaggucucacucgaucuuaaacaccuggccucaacuccugccucggcgucccaaaguguugauauuacaggcgugagccacugcacccaggcuaugauuuaauuuuuaauaauggcuggguuuaauaaccacuuugcaaaauuccugagaauuuaacaaucagcuccagccuacugcugcuggggagucuccauagaggaggagguggguccccacucuccagauguaaaauuguucagaaucuacaggcccccucccucccugcucagguggucuuuuggugccuuaaugaagagucggauuuugaagcagccuucagcgugggagccacuggcgucauaacggauuaucccacagcccugcggcacuaccuggacaaccauggaccagcugcccggaccuccuaaguccagaagccucgaggucuccuguuucucuuccugaaaaauaaauauuugccuuucgauca

SEQ ID NO: 191801 - RNA, 6983 nt, Homo sapiens
ggaagccggcauggcgcuccggucaauaaaaucgauagcuggaagcugccuguguuccaggcaaaggcggugcgguagcagcgccgccauuuuccccgaaggcaucuuccggugccuuucacccaaguucgggcaggaguuuccugaauaacagcaaaagguuuccguuagccccgcgggcgaccaauuccgauucccuccgggccuccccggccacgcucagcccugguccggcaggggcuccucgaucccaggggccgccagcgcccgagggccgaggccuggacacggaaggccguggcgccggcuucucgggucccauggcgccaccuucggcuccgcucccugcgcagggaccaggaaaggccagacccagucggaaaaggggcaggaggccgagggcucugaaguucguggacguggccguguacuucuccccggaggaguggggcugccugcggcccgcgcagagggcccuguaccgggacgugaugcgggagaccuacggucaccugggcgcgcucggugaggccggccccauccgcugccgcggggcgcgaagggaugcaggagccggagaggguguaggcagggaggccacgguccuggcaggcgaccagguugucaggggaggugggcaggggcuuagcaggaggugccgucggggagauacuacucggcgugaucuaggagcuggccuucugauuuguucucuuuccccagggugcgcaggucccaaaccagcccucaucuccugguuggaacgaaacaccgaugacugggaaccggcugcucuagauccgcaggaguacccgagagggcuaacaguccagagaagugagugcuaaauaaccacgcagagccugcagcccuccuauaacguucuaccucuaacggcucuguccagaguuuugguugggcuaggggugggugccgcguauuuaguauauucaucuucccagccucuugugucuggugguguggggccgguccaccacacagagauuccuaugucagucugcaagcugcaguuuuccacugugugaaugaaucagugggcuuauucuucgucuuuuuuuuuuuuuuuuuuuuuuguagaaacauugucuugcucaguucggucuugaacuucuggccucaagcgauccuccugccuuggccucccaaaaugcagggguuacuggcgugagccauugcagccagccagaaucagugagcuuuuaacaggugcuacccucugccuccuuuccaggaucucugccucuagccaccuuugaguuggaccaaagagauccuaaacuucucagaguuuucuggguuuugguugaagggagcucauggggaacagcugccugggaugcaggggccucuuucugcucuuacggcaggaugacccuuaucagcgaaggacauacugcaaucuccucagaauccaacaaggcucugcuuaaccccauucagguagaagggucccagauccacccauaguagaagauggagcugucugggcuggaauuucagagccagauucuucaagaccagggauagcuguccaagauucagaucugaccaugauauuuccuugcuuaaaacuuuucaguuaauuuuugccaagguuguuaaauggccauugguuauaucuaaaucacuuggggaacuugguaaaaacgcagguuccaggaccccaucccagagcuauucauucacucgugugaauguuuaggaacuuccauuuuuuaaauagccucagcugauucagaugugcaucuagguuugaaaaccggccggcugguggcucaugccuguaaucccagcacuuugggaggccgagguggguagaucacuugagguccggaguucaagaccagccugaccaacaucgugaaaccccgucucuacuaaaaaaauacaaaaauuagccgggcacuauggugggcgccuguaauuccagcuacucaggaggcugaggcagggagaauugcuugauccugggagguggaaguuacagugagccgagaucaugccaguguacuccagccugggugccacagugagacuccaucuugggggaaaaaaaaaaagaaaagaaaaccauuggguaaaauacaguccaaggucuuuaacaaugcuaacagcagugguucucaaagcguggucucagaccagaagcagcauuauuuggaaacuuguuagaaaugcacauucuuggacccuaccccagaccugcugaauccaaagcgggcacuagggccuggcauucuguuucaguaaauccucccaaugauucugaucacaguggaguuugagaaccauuggcuuagagggccuuuugacccagucacugcuagcucauaccucauagguuuccauaucuugccuuacacucuuuugugugugugugagacggagucuugcucuguugcccaggcaggagugcaguggcacgaucucagcucacuguaaccucuugcucccgguuucaagcaauucuccugucucagccucuggaguaggugggacuacaggugcccacgaucacacccggcuaauuuuuaguagagacaggguuucuccauauuggucaagcuggucucgaacuccugaccucaggugauccgccugccuuggccuuccaaagugcugggauugcagguguaagccaccgcgcccagccugucuugcuuuuacacuuugugucuaagaagaucuuagggccugugcacacuguacacugagccuugggacuuauguuucuuuucuuuuuuuuuuuugagacggaguuuugcucuuccacccaggcuggaguguaguagugcaaucuuggcucacugcaaccuuugccuuccgguuucaaguaaucaucuugacucaguuucccaaguagcugggauuacaggcgcccgccagcaugcacggcuaauuuuuguauuuuuaguagagacgggguuucaccauguuggccaggcuggucucgaacuccugaccucacaguccgcccaccuuggccucccaaagugcugggauuauaggaaugagccacugcgcuuggcugggacuuacguuucuaacacugcauaauuuuaauucuuuuuuuuuuuuuuuuuuuuuuuuuugagauggagucucacucugucaugcaggcuggagugcaauggcgugaucuuggcucacugcaaccuccgccucccaggaucaagugauucucccaccucagccucuggguagcugggauuauaggcaccugcuauugugcccagcuaauuuuuauauuuuuguagagacgggguuucaccauguuggccaggcuggucuugaacuccugaccucaggugauccgccugccucagccuccuaaagugcuaggauuacagacaugagccaccacgcccagccacauuuuuuaaagaaucagcuaagucaaauaaaccauccacaauggaauucuguguagcuguaaaauagaaaaaagauuugcugacauaaaaugaucuuuagaauauauuaagugaaaaaauguaaaguguguauaagguguguauauguugucuuuuguauaagaaaggugagcugggcaugguggcucacgccuguagucacuuugggagauagaggugagcagauaaccugaggucaggaguucgagaccaaccuggccaacauggugaaacccugacucuacuaaaaauacaaaaaauuagcugggcauaguggugcaugccuguaaucccagcuacuuaggaggcugaggcagggagaaucacuugaacccgggaggcggagauuucagugaacugagaucacaccauugcacuccagccugggugacagagcgugacucugucucaaaaaagaaaaaaaaaaagaaagguggggaagagaacauacgcuguaaagcauguguaugcaaucucuuaugaaagaaagauagggaaggugacauuuguauugcaucaaaaaaaugggaaaaaacuaauaugguuucuacaagguagauuggaaaaagguggcagcaagacuucucuguauuccuuuauuaauauuuugacuuguuuguuuuuugagauagggucuugcuguguugcccaggcuggaguacaguggugccaucaugguucacaguagccuugaacuccugggcucaaguaauccucuaccucagccuuccaaguagcuaggacuacaggcaggcacgcgugccaccaggccaggcuaauauuuguauuuuuuguagagauggggucucacuaugcugcccaggcugaucuugaacuccuggguucaagcgaucucuugccuugggcucccaaagugcugggauuacaggcaugagcaaccaugccuggcugauauuuugacuuuugaaugauguaagcuuaccucuucaaaaauauuccuuuuuuuuuuuuuuuugagauggaaucucgcucucucgcccagguuggagugcaguggcacaaucucggcucacugcaaccucugccucccgggcgauucuccugccucagccuucuggguagcugggauuacaggugcgugccaccacgcccggcuaauuuuuguauuuuuaguagaaacaggguuucaccauguuggucaggcugcucucaaacuccugaccuugugaucugcccgccucggccucccagugcuuacgauuacaagcgugauccacugugcccggccucaauuuuuaaaguuaguuuaaucuccgagaaaucuuccuagacuucuccaagcuggguuagaagcuccuguaaugcacaccguauuugcaugacaguaugucacacuuagcugucuguggcacuaggaauugagaccagggggugagucuauuggucuuguaaccuauaauguaauugacaagagcaggagcccaguauuuguuaaauuaaugcuucuguauuucuauagaaagcagaaccagaaagaagaauggggagaaggaaguauucccgccuaaggaggcaccccgaaaggggaagcgaggccggaggcccagcaaaccccgacugauuccuaggcagacguccgggggccccaucugcccugacugcggcuguaccuucccugaucaucaggcccuggagagccacaagugcgcccagaaucuaaaaaagccuuacccuugcccagacugugggcgccgcuuuuccuauccaucccugcuggucagucaccggcgggcacacuccggcgagugccccuauguuugugaccaguguggcaaacguuucucccagcgcaagaaccucucccagcaccaggucauccauacaggggagaagcccuaucacugcccugacuguggucgcugcuuccggaggagccgguccuuggccaaucaccggaccacacacacaggugaaaaaccccaccagugcccuagcuguggacgucgcuucgccuaccccucccugcuagccauccaccagcguacacacacgggagagaagcccuacacuugccucgagugcaaccgccgcuuccgccagcgcacggcccucgucauccaccagcgcauccacacgggcgagaagcccuacccgugcccggacugcgagcggcgcuucuccuccuccucucgccuggucagucaccggcgugugcacucuggggagcgucccuaugccugcgagcacugugaggcccgcuucucccagcgcagcacgcugcuccagcaccagcucuugcacaccggagagaagcccuaccccugcccagacugugggcgugccuuccggcggagcggcucccuggccauccaucgcagcacgcacacagaggagaagcugcacgccugcgacgacuguggucgccgcuuugccuaccccucacugcuggccagccaccggcgcgugcacucgggcgagcggcccuaugccugcgaccuuugcuccaagcguuuugcucaguggagccaccuggcccagcaccagcugcugcacacgggggagaagccuuuccccugccucgaguguggccggugcuuccgccagagguggucucuggcuguccacaaguguagccccaaggccccaaacuguagcccuagaucugcuaucgggggcuccagucagaggggcaacgcccauuagaaggggaaggacugccuacguucauuucauuuuauggagggucccagaaaagggaaggaggagccccaggucauacagggcagagucagaacuaaacccgggucuccugcugcacagagcugaacuuuguaucuugcaaugcgcuggcugccucccugugcgugucuggaacagucccauuaggagaggugacgucauuugcuuaaaguuuuccaagcuacccuauccuaaaauaguuuguguggauaucagggcuaaaaguucuccccaucuauuuuaggggcugucugcuuuucuagucuguccacacagggauuaccugucaucuugcaugcaaucaggagaaucucauaggggcaggaccuuccccuacucugccucuuccuccauacuagguuggaaaaaucugguuuagcccacuuuuugcaacacuccugccaaguggucuucuacccauugcuugaaaaucucucuugacagggagcucacuaccucacaaggcaggucauuucauugugggaucuauagaagguuaaguaccacauucuccucuaaaccuugccuacgacauguuuaauacuucaucuacauagcagcccuucagauaaucacaaccacuuugcccccaaguuuucagguuaaguagcaugaauuuggucauuccuuaaagacaggguuucaauuuccacacaugaucucugcaaacaggcacuggguuuucaguguccuuuuugaagggucauauaaaaauaagguaacaccacagugccacuacaccuucuggggcuggacuuguuucagcagcuuugguugcacugaauuugggggagcugcaugguaccagggguuuauuggguugcagauauauaaaugcccuaaacuuaa

SEQ ID NO: 191802 - RNA, 5494 nt, Homo sapiens
ucagaaacauaucgaaaacuuuacuagaaauauagagaaaaaaaaauaacugccugggagguuuccugucccuucaggauggaugaccaacagauggggcaccuagguccaguggggcugcucccgaucuacuguuucuuccuccaggagcaaggcaucuagcuccuccagccgcugcuggagcagggggcccacaucagggcugggggccacauugggaggaacaguccugcccccugcagcccggaccccacgggacggucuucgugaucgaggaaggcugcugucccgaaauuccacagcccgccggagcuuccuugagcuggugaaaaucagagucccauugcgcucccgggguuccucaaagauggucucaaagguccugaacaaggcagggagaggagcugguuuuaucagggugcuccacagcuccagauuucccucugccacccucuagccuuccaagugucucaccuccugguugugggugauugguaauucuuguugguguaaauuucuuccaagcugaacuccuucuuguucaaccugugagcaaagagcagaggccacugagaaaccuugggccaguggggccugaagggacagguaaggccuggucuguauuucaguuucugggacaugucagggccaggagugcuacauaaggcagacaggcaauuuugagcacaaaccauccccacaccgaauugaaucuuucaggcuggacugugcucccugaggggagacaaagcuauacuucaggggacauaagccugcaucuguuuggccaagauggcucaaugcccagugagccccucaccugauuggucgaggcagucccauugguguaagguuuagcugaggacgggcugguguucugcguauucugaaucgagaaaccuuucccauggucugcaaaaauggggcagagggugaaagagugacaugggcucaggcccccacuagucucuucuacccgaucugaaugccuaccuuggucucagguucugaaagcaccugguccuuugaggcucuuggcuccuucccuuugguugaacccaaccugccaagaaggucaaggcucagggacaaacaggauucacugcauuaucccccgucuccugcccacuggauacucagggaaggaggcugggaccaggcugcagccaggcuucaaggggguuuuuugagagcacuaccuggguucugcugguucggagaaggaaguggaugccguggacgagcaagauguggugagagaaggggaggcucccacuccuccgagagggaagaccucuuuccggagacagggccgaggggguggcggggcucgggccauuuccccaccacccacagugugccgccgcggccguggucggcuugguugggguggagcagguggccaggugcagguaccugggccagggggccccagaucagggcaggaguagcuucggcccagagagggcuuagggagaagugcugggguauugugguccugaguucgccacuggcggauugggggccgggggcugacagacgcagugcccucagcagccccagacugcucggccucugagauggcgaucuucaacuccagcuucauugggggggacgggggugggggcugugggguuuuguugggcgugaggaagaugucagcaaagcucuccagcuuggagcggacggaacggaagagcggggccaagccccagggacugaggcgggggcguaaaaggcuggacgguggugggguggaugggagcuccagagcaggaucuggggcugaggaaaggagagggucacagguggauauuccuuggcugcagugucucagccccuccccacaugcucaacuuugugcacaggggaauuagcccacccuuaaaacacuaaguucugcauuuaagaauugaacuucaagccucugacaucaacaucccaucuuuauauaccaagcccugcccugggagguggcuuaagcccuauccccaacucuguaccugacacuuccaagcucaacuaggaugucccagacacccaagucucauccgaucucuacccaaguccuuaccuguuggugggcucuccagagggucugcaggcagagcagauggcuggaauggggguucuagguccccagguggaggcguuggcuggcgaacuauccucaugggcucagcucuggggugaagggcaagguaaaggcuaggggaacuuccagguaucccaccugagccagcaacuccccuaucccuuaaggcuucuucuuuuuuuuuuuuuuugagacagagccuugcucuguggcccaggcuggagugcaggggcacaaucucagcucacugcagccuugaacucccaggcucaggcaguccucccaccucagccucccaaguggcuagaacuacaugcauggaccaccacauccaacuaauuuaaaacaauaucuugucugagcaugguggcucucgccuguaaucccagcacuuugggaggccgagguggguggaucaccugaggucaggaguucaagagccuggccaacguggugaaaccucgucucuacuaaacauacaaaaacuagccgggcauuguggcggaugccuguaaucccagcuacucgggaggcugaggcaggagaaucacuugaacccaggaggcagagguugcagugagcugagaucgcaccauugcacuccagccugggcaacagagcaaaaacuccaucucaaaaacaaacaaauaaauaaacaaaacguuuuguagagauauggucacagugaugugguugcccaggcuggccucaaacuccugggcucaagcgauucuccugccuuggccuccuaaagugcuggcauuaggcaugggcgugcccggccccuuaaggcuuuuuaagaugccacaaggaaggauuggaucagucagucccgaugccccuagcucuggcuaccuggaugauggcuguugccuggauccuuugauaaucccuacuccagcccucucaccuuugugcugggaugaugaaguugggggucucaucaaugaagcccuggauaaaaauaggggauguuuguggggaggcaggaaagcccccuuagugccccacauccugacucuuucaguucccggauagcugcuuggguucacgccaaagacguuuuuauauagucuuugcucaggcagugucugccgccuaaaaugccauccuccucaccccaagaaaaacccaccuaagacucaggccuccuacccuucuaucccugcuggaacccagcagaacccuugacauccguacccucaguucccauaccucagcggggggucuaggacuggcgaugucuuccagcaucaccaccagggugggcuggggggcccgguccaccuuuugugaagggcccuccucugggccagggguuguccuugaucgccgccucaggguggaagagguccgguggaugcggcucaagggcucgcgacacaaacacagagggucgggaggccuagcgagggaacaggaagauuaaaauggcucagcugggcccucggcuuacccccauccugccaugcucaccuggccugcgaggaccacccggccugccgggguggcgaggcaggcggcugccuguggacaggauccugaugguagcuguggugcugugguauggaggucugcuuugagggcaccacggggaccuggaagagaaagaggugucaagagcaaggugauagaaugaggcuggacgggacaagguuucccugugccucacagugcccugagccacaaacauaacagagauuggggcuagaauucacucggaucccaagagaagagaugaauuggacugaauuaggggccagauauuaagaguccuaaacugcagguguaggaccuggguaaucucauccacgcuguuuagagaaaugaaaaagacagggugagcuagggugggucacugccuuuuuugggccaguuuuucuuaucugugcaguggagucaaagaccucagccugcuuccuaaggaggcugggcugggaagaaagcagaagaguuucggcccagcgccguggcucacgccuguaaucccaauacuuugggaggcagagaugggaagaucgcuugaugccaguuugagaccagcuugugcaacauagcaagacccugucucuaaaaaaaaaaaaaagauagaaaaaaagaagcagaagaguuucucagaguuacagggaugugguuccagcccaaaaucguugguggguggaaugggcacugcccaauucuagguuggaguaagugggagccaagcaggacucuaccaugagggaggcugccugagggcugaguacaacaaugauggauuuggacuucaguuauccucaguagggaucuggcccgaguuugguagugaggaaagucaugggggaauagagagucucuugguucagggggcucaccaugugaacagccaugacaucuucuagcaccacggccaggacccgccgagaggccuuuuccaggggagaaggggcccccgggagcugcagccucggccguuucgggcuccuggcuccccauaaugcucgagucagaggcuggcggcacagacgcggcuggccaggcgggcuggagggugaaagaagcagaggacggucgcccgaaccugucgcuggcucuguaguuucccggcacggucgccaggauccccaucucccggggucaagacaggcgggccgcccggguacgcucucaccuggaguccccgggcaaguccaugggagacgcggcggcuccgggggggucccuggggaaucccaggcugcggccugggguaaggggggagcgggggagcggggggugagggccggccccuucccuggggcuccgcccuucaugguccgcccgcggcuccccguagcccagcggccgcagcccuggggcgcgaaagggcgcccccggccggucgcccggagcggguguccucccgcugccaccgccucgaucagcggaucacucgcgcccugccuggcaccugccgccagaacccagaaugcagcggccccaguucucccgcggcccgagccucccgaggccuuugucccugcagauuaugccccgagaucccccgggauccacggggaucccgguccugggaggcuauuuccgcuggaucccucugcgauccuccuccucucccagcgaguggccgaggacuccaaagcaauacuccauacaucgacgacccuccaucccaccagauccccuagacuggaucccugaggaaagaauccuacagcgcgguuccgccaaucagacgccgggcgaggcuuuuccuuccccuguaagcuucagcgccgcaaagcuccgcucagacaggggcggcccgagcuggagcaucuccgaacucagcguagauccccagggauccacugucaagcagauacccucuucacuccaaucccgggaggucccgcccacagacgccccuucccuccucgcguc

SEQ ID NO: 191803 - RNA, 14762 nt, Homo sapiens
acuuaagcuucgacgcaggaggcggggcugcucaguccuccaggcgucgguacucagcgguguuggaacuucguugcuugcuugccugugcgcgcgugcgcggacauggccucaaacgguagguaagggcgcgaggcgacggcggcggcgcacccggccgaggccucccagcugggcuuuucguuuucagugggaccggggcggcgaucccgugugggauuuuuuggcgccccuguggcgggaagccgcggagaagaguaacuggaggaggcuggugucgccauuuuguuucgcuccucuggcccucgcgcgcggggcgggaagucuuuucuuugcaguccguuugcuuggggugggcguugggagggacgcuucuuagggguuugaagcgucaggugaggguggaaaacgcccauucuccguggccucgccucccccaacucccggccccgcgcucgagcccgcuuugucgcagugcugcauccgggcacucgcggcgcgcacgcgcucugcgggccccucccccuucgcggcgcggguaccccuuccccgccucguguugguucagcuuucugucgcgagacccuucgcggaagacucggcggcgcgcguccggugugagccuugucccucagugguccuucgcgaaugggcgggaucgcuccguucccgccuggguugccacgcggcugggggcggaggcucgggaucggggccgcccucuagcuuaacgguuuggcggcgguggucaggguucgaccaacggacuuggggacggcccgagaguuuuucccgccuaaauuucuuucuuuuuuuuuuuggagacacggucuuccucugucgcccaggcuggagugcaguggugcgaucucagaucacugcaacguccaccuccuggguucaagugauucuucugccucagccuccugaguaguugggauuauaggcgcccgccaccacagcccggcuaauuuuuguguuucuuaguaggggcgggguuucaccauguuggucaggcuggucucgaacugcugaccucaggugauccgcccgccugggccucccgaagugucgggauuacagacguaagccaaccacgccuggucuaaauuucuuuuuucugagauagggacggagaagaacggccgcccgaggccacacccucuccugguccucuuucccuuuuccugcgggggaagcgccgcguuuccugugcugggaggaugaguugaucuuguucguguaucuuaaguggggcuuuucaaaagcgcuuuuguugcuuuuuguucgcugggggaaggcaggguaggugagaaaacggaaccaucuggagucccagggcuggggacucgaguaccuguugacuuucgccuccuaaggcgagcaguugcaugaucucugucauuugggguccaagggcucuuuugauucucuggcuuugcacuaaaaagcccacuucaucuccgggauuggucaaagagugaagaauggccuuuuuugagacuuucuuauucugugggucugggcugagagagcagaggccacaaucugaacacuguucgaauucaaaccugugccacuuugguaguucugcgacguugggagaguuagucucuugacuccuggcgauaauggcuuucucauagaguggaugaaacgaaugcgcgauguuuuagagcaaucacugacaugaauugggcuugcagaaaauuguggauguccaccaagaccuugguuuuuccaaugguuaaggcuucugggacucuguagaaacuugcauuuucuucacuuuuucuuuauuguaagaacacuuggcugauaacgccaguuuguuccucuucucaaccagugucucauggaggaauuuuaugcccuuuguugcaacaugguccuauuuuuauuuuuuuuuuugagauggagucuugcucuguugccaggcuggagugcaauggcucacugcaaccucugccucccggguucaagcgauucuccugcuucaccucccgaguagcugggauuacaggcgugcgccaccaugcccggcuaauuuuuuguauuuuuauuagagauggggcuucaccauguuggucaggccagucucgaauuccugaccucaagugauccacccaccucggccucccaaacugcugggauuacaggcaugauccaccgugccuggccuacgugguccuuuuuauucaucagugcuugaguuaaggaauuuagcuuuaauucaacucuuucagaguggcagcugaagauaaugugauuguauuuuucuuuugcagauuauacccaacaagcaacccaaaggugagugcuauuuuugggcuuccagaguuuguagagggcaaggguggucacgccauguuuucugaucacgcugguuuuccuuuuauuuagcuauggggccuaccccacccagcccgggcagggcuauucccagcagagcagucagcccuacggacagcagaguuacagugguuauagccaguccacggacacuucaggcuauggccagagcagcuauucuucuuauggccagagccagaacagugagucuuucucagcgggucaccucuuccuacucuuucugaauauugcuuuucuuuuucuuguuuuuuggagacggagucugguccuguugcccaggcuggagugcaguggugcugucucagcucacugcaacaucagccuaccggguucaaacgauucuccugccucagccuccugaguagcugggauuacagguaccugcuaccacgccuggcuaauuuuguguuuuuaguagagaugggguuucaccguguuggacaggcuggucuggaacuccugaccuccugccugccuugaccugccaaagugcugggauuacaggcgucagccacaaugcccugaauguugcuuuucuuaaaccugagcagcacugagauguugaaacuguuccauauuucuuuuccgugaaacaguguauaagucuuaaaacuuuuugggaucugaguccuuuacagggcauuguggcacaccuguagucccagcuacugaggaggcugaggcgggaggaucccuugaauucaggaguuuggggcugcagugagcuaugauggugccugugaacagccacugcauuccagccugggcaguguguugaggccccaucucaaaaacauaaaaaaaaaaacaaaaaacaaaaauguuuauugguuugugauucuguuuccauuuauuuucuuuggcuuuuaauuuuuuugacucuucuuauuuuccaucagcaugaaagagagcauauuuucuaaaggaagaaccaguuuuaggccaauucugaaauggagaaaaugguuuuguuugaaaauguaugaaaucaugugauacauaaggaggugggauuugccccaagguccugaaguguaacuaagaaaggugguuguccuguagauacugcacgcacagcugcauauuacagugcuguuaacagggauccuugggccuggguuuagaggguggugcuggagaugguguugggauuggcggggugaaauuggaacuguacuaaagaguugguagaaguugaagcauuaaauuuaggcuuugaaaggaggguaacuaucuuugccuaugaguugcaacaucacuaacagcuucugagaggcuggcuuuaugaguauagguauuauguuuucuuuaacccauuccuuacauuuucucuuuccugguggcuuuugugacucccuuuuucuuauccugguagcaggcuauggaacucagucaacuccccagggauauggcucgacuggcggcuauggcaguagccagagcucccaaucgucuuacgggcagcaguccuccuacccuggcuauggccagcagccagcucccagcagcaccucgggaagguacggugguguugaugucggggaaggcuugaaaagaggggugaauugaugaggaaugauaaagggaccagcaguaggagcaguucagagguguaauugggguaggggagccuguguuggguacagagaauggacuccacuaaaagugaaaggaaauugggggcuaugcugggauugugauuguguuuuuuguuuguuuucccuaguuacgguagcaguucucagagcagcagcuaugggcagccccagagugggagcuacagccagcagccuagcuaugguggacagcagcaaagcuauggacagcagcaaagcuauaaucccccucagggcuauggacagcagaaccaguacaacagcagcaguggugguggagguggagguggagguggaggugagaugucuucagcuuugucugcagcccauuuucuuuuucuuuuuuuuuuuuuuuuugagacggagucuugcucugucucuguugcugaggcuggagugcaguggcacaaucucggcucacugcaagcuccgccuuccggguucgcgccagucuccugccucagccucccgaguagcugggacuacaggcauccgccaccacgcccggcuaauuuuuuguauuuuuaguagagacgggguuucaccauguuagccaggaugguuucgaucuccugaccuugugauccgcccgccuuggccucccaaagugcugggauuacaggcgugagccacugugccuggugucugcagcccauuuucuauaaggauuuguauucuccuguuuuagcuuaaaagaggguuccugucuuguuuccuagcugucuuuuuacuuucuuuuguccuucauugccuggcacuugucaaaccuuuucaaaccuuuuagugcuacuuuacaaucuuuuuguuuuuuuuuuuuaaucauucuuucuuuucucacagguaacuauggccaagaucaauccuccaugaguaguggugguggcagugguggcgguuauggcaaucaagaccagagugguggagguggcagcgguggcuauggacagcaggaccguggaggccgcggcagggguggcagugguggcggcggcggcggcggcgguggugguuacaaccgcagcagugguggcuaugaacccagaggucguggagguggccguggaggcagagguggcaugggguaggugucucaugagccagggaguaucuuugguggggaguguggaggauugcaugaaucucccugaagccagucccuagugcaugguuuaguauucuuguugucuagggaucugugagggcuuugauuugggggcagugacuuucuuuuuacauccccauuuuauuuuugugagaacuugggagccugaacucccauccauaccacugaauagagauuuugaguaaugauacuuguuuccaaaaaaaaagaaaccauacauagauacguauggauuggagucauuaauauccuaggcaagaaacauggaagugaagacuucuuucucugcaagggaaaccgaugaucccacuccugggaaauaguagggaaacuugguauguguauucccauguguccucuagggaguugguaaugguuaaccugacuucagcuuccaggaauuggcuacucuucccguuuucuauagucauuugaauccacgagcuugauuugcacuaauuugaccgacauugauuuugugugugacuugguuuauggggccagcugacugaaguaagcagaccuuuugggcaaaaauaugcuuugacaguggucucccaccuauuuguuccacugucugccuuccccugguuacuuaaaauucaucagcuuguccaacuggaccuucuuuccuuccugcugaaguugauuugaaguaaaaccuuagauuugauguuaaaacaguugucaaaucuguugguaaauaagauuugaaggacccuacucugucucccuugaaaaaggggaggaaugucaguguuacuguuuuuggaaaaaguagauuuuuaaaccgaguuuggaaaugguaaguaugcagaggugggugggggcaaucucaaaaacgugcaaaaaugaggaaaacaaaaaugaggaaaugugugcguguguuuaaugcaaaacuuuaaaaagaaaaacaacuguuaugugacuguuaacuugcucugcauuuuaugugccacagguaugaaaggugacauugcaaaauacuccgcucuucucgcaguguagaaggggugaccccggggguugggggagaucaaaaacagcucaguaguuaggacagagcuuagcuaaguuugucuugcuuuaaggggaaguugccuuugguuuugacuuuuuauggaaugggguugggucugcuugcugcuuucaaagcaaaaaccacaaaaauguguucaaggcuaccccagccuggugugaaaugucuucuggguaaauugggguaggguuuuuaaaccaacuacuugguugucaaccacuugcgacaagaggaaaaaaaaacaucugcuccaucggaagaacgaccaaggaaaauggguuauuuuuuuuccagaggaaauagauaacguaaccuuuuaaagcaaaaucuuuauaaacugugucugagaaauugcacacgugugugugacaugcucaaaggucagacaagggguggucaggaagggauguauuuuaguagccacuuguaucuuuuuccaaaaacaccuacccauguuuggggaauguuaaacaaaaucaaaaaacaaccuuuuguagccguuggaagcuucauguccuuucuucuaacuugucuucuccagcggaagugaccgugguggcuucaauaaauuuggugguaagugaacagaguuuccaaaauucccaacucccagcaaugcuuugucugauuguucauuugcagaugucuuagcguguuaauuuaaaugucaaagguuuugagguguccagaaccaccuccagaaagggguaggguagaaugccaccuguugccuggugugugcuaaccuggagcagguagggguaagacucaauagucaucuuuuaccaaauggguuugccccagguuaauaagaggggucuaguaggccuuggacugggccguugccacaccuggcacuuagugaccaucaucaugagaaacuggagagugcgugcuggaacacguggugccaucuuggcuuuaggauccuuuugaucguuguguccaaggcuugugugugugugagugugugggagacaacuccgaauguuuaauucuggaagagggauguaacauugcccugaggauggugaaguugguauacauuuauaaaguacggaauggugucaaugaaugcaauucuauguauauggacuuaacugagaugggcaaauagaaacuagcucugggaaggaacaugugcacuacuucaagaaagauuggaagcauguguggcucaugggaaauaaccaggucuuaaacagcacaaacugaauucguggaccaggaaggucuuaaacagcacaaacugaauucauggaaaaaugacaaauuugagaagucucccaguaagcuggaacuuuucugguuugguuaacaaaagguuucuugauuuguuucaagauuuaaagccaaagguguggguucaugacuuaggugucauugcguguggguacaauauuuauauauggcgaauucagauaaacauuggucaaagauggucucuggaaaaacaaaauagaggcugcauuacggaaauaagauuucuggucuguucccugggacaugcuuaaaaaauacaauagcuauuauguaugguuuuuauuuucaugugguuucggggaaacaacacgguuuuaaggaugguuucuaaagaugaaauuaaaaauuguuccacaaggguuaagugucuggugguaaaguugggagaaacuggauggaugcacaucgcauggcugguggcgagcccaucucucuucucucgggugagagaaccgggccaagcugaguugguuuguucacuuuaaugggucuccguuuccccugccaccugugcugaggacauuucccagccugagcugggggaggcagcauuugcugaaguguggaguugucucuguggagacucaaguuacagaucuuaaggggccugccuagaauuuucuccucugggcaggcgacccaggaaaggguuuggagugaggcugugagcacuuacuugauauuuuacaaguuuggauuugguguuaauuuuuuuccuuguccguuuuuuccuguugacuaacggcucaucuuuuccuuguuuuuguuuuuuuuuuguucuuuuuuuccaugucacuaaaggcccucgggaccaaggaucacgucaugacuccggugaguucacacgugguggcaugaaaagaguggcuaaagugguaucaagacugccuggauguucuuugaaacuauuauaaaaaggaaacugaaaaaaauggggauagagaaggaagggaguuagguguguccuuaguuagcagugagaaguauuuguuacgaaguauuucucagaaauaccuggcuuguggguuccacccccagugauuuaggucugagaggacccugaaaaucuaccuuucuaacaaguccccagugaugcugaugcgucuggaccacacucagaugguuuacagcagugguucuuucaaaauguggaucauguccaaguuggugaacaaaacuagugaaagaccugaccacaugaaguaaagcauugaacuccuguuuagguuguauugauguuuguguacuagauuugaauguaaaauggguuucuuauuuaauucggggaccuucaacugaaaguugauaaauacugauggacuuuucuguguggucuuguugggcauuucacuccugagcccugguuuccauacuguauacuggguguuaacauguuucaaaggauaauugucaaacugaaucugaaauuuaucagcauggcuggcauauagggacucaaaagggauguggauuucuuuuuaguugucuuccauaaaccaaaugauaccaguugcuugauggauacuaggugcuuuagguuuuuuccuguguuuuuuauuuuaccuuuucacauuugcauuuucucuguucaacaagcagaacaggauaauucagacaacaacaccaucuuugugcaaggccugggugagaauguuacaauugagucuguggcugauuacuucaagcagauugguauuauuaagguacuuguggagaggagugggagcuuucugucaguguuguaggcuuguggauuucacacauuaguaaaagcaagucuuuaaugguugccagcaguaaaaacaagucuuagugguuguugccagcuuaauuuguugaggaaagagccuuaguuacuguuuucuaaaagagaaguucuaucuuaacacaaaaaguauaacuuaucagaguacccuaaacucuugagauuuguacucuauaguaacuuuuaguuuuaucuuucaauauuggagugagagacaguuuucuuuaauggagguuuacaugugagguaggaagaaguaacugggaagaggggagcugaaguuugggaauuauaaaccucauguucuagaggaagaagauggaaagggaguacuguagccuuuaaaauugauguuaccucauuuugcuuucuucagacaaacaagaaaacgggacagcccaugauuaauuuguacacagacagggaaacuggcaagcugaagggagaggcaacggucucuuuugaugacccaccuucagcuaaagcagcuauugacugguuugaugguauguaugagaaggcuggcagagguggggcuggggauauagggcagcaagccuuaggaaacaagccauaguuugaggguucuuuugagucuuccaacacuuacuuuagcugcgguuucagguagucucauuuuugcuuaugugucagcagauuauaaaccauuugagaaaggcacgcuucucuuguauuuucggauuaaugugucuugcauuuaaagucuguugaugauuuuuuguuucucuagguaaagaauucuccggaaauccuaucaaggucucauuugcuacucgccgggcagacuuuaaucggggugguggcaauggucguggaggccgagggcgaggaggugaggagcuaccugcuaguggugcagagggguaauggggagagugcagaagaugguaaaggcuugcauggaauggguuagauuuaccaaacuuggagagggagcagacccauacuuggucuaucugcauuaggacccaugggccguggaggcuauggaggugguggcagugguggugguggccgaggaggauuucccaguggaggugguggcgguggaggacagcagcgagcuggugacuggaaguguccuaauccgugagugaaacuuaauuuuuuucuuaguucucuugcaugcgugcucuuugauauauugguacugagguaugugcguguuuuccaaagaaguaaaugucaaggccacacuguuggggucagauuuagccaaaagcuuaccuagguaagguugauguaaugggaaagguaauggauuggguucaguaauacugauuuuuguuccugacucugagaagcaagccguuuugucuuucugaagcuucaguuuccucacuguaucucuaaagucaccguaguuucuuccuaguucuaggucuugccuauuccccaucgcuccagacugauugucuuccuuucuccuuagcaccugugagaauaugaacuucucuuggaggaaugaaugcaaccaguguaaggccccuaaaccagauggcccaggagggggaccagguggcucucacauggguaagaaaggcagaccuggugcuagggagcugggaccaaagaauccuuaauuuuucagcggggaggcucggggaacauaggggaaugggaauaugauagaucuuguuucuuuuguccuaggggguaacuacggggaugaucgucgugguggcagaggaggcuaugaucgaggcggcuaccggggccgcggcggggaccguggaggcuuccgagggggccggggugguggggacagagguggcuuuggcccuggcaagauggauuccagguaagacuuuaaaucagaauaaaaaaguagagcaguugaacagaggccauaggauaacaggguuuuguugagaaagugguuucauuuugagggcuagguggaaagaccugagguuguaaccaguaguggagagggaaggaaaauuaacucagggggagugaaucuguagacccacuugagauaagauacucgcuggguuagguaggaggggcagauaggauaucuaggcuuggagaggcugguaacucaaauauaauggauacuuaauuuuuuuuuuuuuuuuugcaggggugagcacagacaggaucgcagggagaggccguauuaauuagccuggcuccccagguucuggaacagcuuuuuguccuguacccaguguuacccucguuauuuuguaaccuuccaauuccugaucacccaaggguuuuuuugugucggacuauguaauuguaacuauaccucugguucccauuaaaagugaccauuuuaguuaaauuuuguuccucuucccccuuuucacuuuccuggaagaucgaugucccgaucaggaagguagagaguuuuccuguucagauuacccugcccagcaggaacuggaauacaguguucggggagaaggccaaaugauauccuugagagcagagauuaaacuuuucugucauggggaaaguugguguauaaaugagaaaugaagaacaugggaugucaugaguguuggccuaaauuugcccagcuauggggaauuuuuccuuuaccacauuuauuugcauacuggucuuaguuuauuugcagcaguuuaucccuuuuuaagaacucuuugaucuuuuggcccuuuuaauggugaggcucaaacaaacuacauuuaaauggggcaguauucagauuugaccaugguggagagcgcuuagccacucugggucuuucacaggaaggagaguaacugagugcugcaggaguuuguggaguggagucaggaucuaggaggugagugacucccuuccuagcugcccuggugaacagcgcuuggguagauaccugcuauaaggagacuggucuggcuggguuacuuucacauccugccuguacucagagggcuugaggucauugacauuaugagauuuuaggcuugaucccuuuuugauuggaggguggaaggcccuccuaagggaaugauaagugauaagagggggaagggguugcagccaaugaguuaaaaccuuagagcagugcuccucagccucuuaccaugugguuguaaacuugcacguaccugccaaccaguuauuuagcaugcuuuuuauuuuaguuacacagagcguaacauuaacccaagagcagaaagguuuuauuuacaggguuuucgaacuugguuuguaagacagcugccaucacaagcauagcuuacaaaugugcuggggaccccuaauugggaagugcuuuccucucaaauuuuuauuuuuuauuuuuagagacagagucuugcucugucauccaggcuggagugcaguggcgugaucucggcucacuguagccucugccuccugaguuuaagcgauucuccugccucaggagaaucccagcuucugaguagcugagacuacaggcgugggccaccaugcccaccuaguuuuugcauuuuuaguggaggugugguuucacuguguuggccaggcuggucucuuaacuccugaccucaggugauccaccugccuuggccucccaaagugcuggaauuacaggcaugagccgcugcaucuggccauccucucaaauuuucaaguguuccacaaguauguucucuacugaagaguugcugcauccuugaaucuugggugauuugaggcacagaaacuaugacuuuauuuuuugagauggaguuuugcucuuguugcccaggcuggagugcaauggcacguuuuucggcuuaccgcaacugccgccuccuggguucaagcgauagcugggauuacaggcaugcgccaccaugcccagcuaauuuauuuguauuuuuaguagagacgggguuucuccauguuggucaggcuggucucgaacucccgaccucaggugaugugcacaccucagccucccaauaaaccaugacuuuuaagaggaauagcagguuuacuuccccugccagcauuggggugcucucuaagcaacaguaggcggagaguggucuggcguauuaaaaacaaaggaucgucaagugggccuucccaggcauugcuuugacuuaguacauguagaggauguggcaguucucuccgucccugccacugcugguuucuuuguuaaauguuuaguugaaauggccugauacgauauuugaguaguucacuguuggugcuuugccuagcaggauucuaaucuugcuuugguugugguccccugaugcccuccuguuaggaguggaggaggucgaagcuccuuguaagauaugauuacugggaccauuagugucaaguuccuguguccuucaaauggcauaugugauuggccuugaccuuaaaaggaaauagggucccaggugacuguuuaguggguagguccaguuuggggggaucuuccaggagaauggauagagacaccuagcagcagagagaacauuggugccucucaagccaaccucccaccucagccucccaaguagcugggacuacaggugcuuccucgcuaccacaccuggguaauuuuuuuuuuaauuacuuuuuuuuuuuuaagaaacaggguuucacuggguugcccaggcuggucuugaacuggccucaagugaccugccugccucagccucccaaagugcugggaucacaggugugacccacugcguuuggccagaauacucuauucuuacugaaugauugaaaucugucuugaagcauuaggugucccauuuuugugaguuggaauugggacaggcuaaguaggaagugaggaggguggggagagcugugcuguaggucuguuugucccuuccuugauguagccuucaguuagcccuuucagcuuuuuuccccaucuugugccgggccuuccuggguuucaguacuuggauguagggcugcaguuaugucagugguggguagauugaccaggaauuaaggucuaggguccagcccaugugagacuugacucacugaucuaccuuuaggcaugucuuccuuccagucucauccuuuuuaaauuuuuuuuuuuuuuuugagacggucucacucucacccaggcuggauugcaguggugugaucucgaccaacugcaaccucugccucccacccgcaagcuaucugcccaccucagccucuggaguagcugggacgggacuacaggcaccugccaccaugacuggcuaauuuuuuuuuguauuuuuuguggagauggggucuugccauguugcucaggcuggucuggucucaaaacugcucugggcucaagugauugucccacuuuggccucccagagugcugggauuaaggugugagauacuguguccggcuaugaaaauuuuauuuuuaauuaacuuguauauauuuaugggguacaauguccuauuucuguacauguacacauuguggaaucaaaucaggcuaauauauccaucacuucauaucauuagcaugaaugagaacauacaaagccacucuuagaaaauuuugaaauuuauguuauuucagcccuuuuaugcuggagguugcaaauguuuugugaauaaucagaccaaaaauaaaaacaaaaaaugauugacuucagucauucaguaagaa

SEQ ID NO: 191804 - RNA, 1291 nt, Homo sapiens
uucaagcuggcuuuucguauauuguguauaaaaagaucagauucaggaugauuuggugggauugccaggggcugaccggaguguugcugggaaggagccucagcuccgcuccagguccuccaccagguaggacugggacucccuuagggccuggaggagcaaguccuugcagguccaguuccaggcuggugugaaacugaagagcuuccgcaucuugcuuggguuggugggcucggcccgcacugccugguacugcucauccgucaggaccuucccguacagagcauccagcagccacucaacguuugugacccucgcgauaagcgcagcccggugcuggucuauaaagugcaggccugggggugggaggagaacaugagccagcagccaggguguggggccugucccugcugaacuugaguucuucaggaauuccucugcaagccuaggggcagggcuccagggggcggccaccaggaccccacaugcagugggaugaggguaauauugucucccuucccccgcaggguguggguugguggguggggugcgcaggguugccaagccgugccugcccugcccugcccugcccugguugcgggagcacagaugcaggcugugcaggagugcgguggggccgggcuggguguggaggccucaccuggcuuggcugccgacugaggaggggccuggaucccagcuggcgcggcuccagagccuggaaggauaugggccaagugauccccuucccuucccuucccgccguggggccggggucccguuggucgguaggccaagcguggggagccuccuuuccgguagagcagcuuuguuuagggguaggaggaacagaaagcggaagagcccgcgggguaagcgcugguguggguggaggggaaagacgggguggaggggaacgggggcggcucacccuggugcguggccgccugcagcugcccggccaucuccugcaggcccaugucgcgcagcacguuagcggugagcucggcgccguaggucuccagguagaagcugaccagcuugucggugagguccaaggcguccauggacagcagcgcgccccgcgggaugcgcccguagcccucgcgcagcggcaccgacagcagcuucagcuugaacuucuugagcuccucggcggucagguucuccagcgcauccaggauggcgucgcgcgcgcgccccauggcuccaggauccccggccgcugccgccgcucaccccgcugcagccgccgaccaggaggaagucggcuccggggcggaaccuggac

SEQ ID NO: 191805 - RNA, 1291 nt, Homo sapiens
guccagguuccgccccggagccgacuuccuccuggucggcggcugcagcggggugagcggcggcagcggccggggauccuggagccauggggcgcgcgcgcgacgccauccuggaugcgcuggagaaccugaccgccgaggagcucaagaaguucaagcugaagcugcugucggugccgcugcgcgagggcuacgggcgcaucccgcggggcgcgcugcuguccauggacgccuuggaccucaccgacaagcuggucagcuucuaccuggagaccuacggcgccgagcucaccgcuaacgugcugcgcgacaugggccugcaggagauggccgggcagcugcaggcggccacgcaccagggugagccgcccccguuccccuccaccccgucuuuccccuccacccacaccagcgcuuaccccgcgggcucuuccgcuuucuguuccuccuaccccuaaacaaagcugcucuaccggaaaggaggcuccccacgcuuggccuaccgaccaacgggaccccggccccacggcgggaagggaagggaaggggaucacuuggcccauauccuuccaggcucuggagccgcgccagcugggauccaggccccuccucagucggcagccaagccaggugaggccuccacacccagcccggccccaccgcacuccugcacagccugcaucugugcucccgcaaccagggcagggcagggcagggcaggcacggcuuggcaacccugcgcaccccacccaccaacccacacccugcgggggaagggagacaauauuacccucaucccacugcaugugggguccugguggccgcccccuggagcccugccccuaggcuugcagaggaauuccugaagaacucaaguucagcagggacaggccccacacccuggcugcuggcucauguucuccucccacccccaggccugcacuuuauagaccagcaccgggcugcgcuuaucgcgagggucacaaacguugaguggcugcuggaugcucuguacgggaagguccugacggaugagcaguaccaggcagugcgggccgagcccaccaacccaagcaagaugcggaagcucuucaguuucacaccagccuggaacuggaccugcaaggacuugcuccuccaggcccuaagggagucccaguccuaccugguggaggaccuggagcggagcugaggcuccuucccagcaacacuccggucagccccuggcaaucccaccaaaucauccugaaucugaucuuuuuauacacaauauacgaaaagccagcuugaa

SEQ ID NO: 191806 - RNA, 9894 nt, Homo sapiens
ggguggggagggaauuaaauauuuacugcagcuaagacuucaguaaaauuggggguggggggaggguugacauuuuccgacugccuguuacgugccaagugcuuuuuguuaaggacauaauguuuuugacuggggaucauguuuggcugauguaaauauuaaugccaaaauaggagcuaggaugaaaguaacacuguaauuaguaguagaauuuauuucauauuaaaaugugucaugacguaauuuuuauggcuuggcucaagcaacaauuuucagagugcacguaaguaucaacgcguaaaacuuaacauuuuacaguguuauuugguauuauucucuaugaagcugucuggaucggucuccuuuucccauugguuaauugguuaaugcucagauuuuggcuccuagaaucgaucuguguguucccggucuuggcaucucauuaugucauuugcuguauuuuuugauauauuauuguacgugcaaauugaggugaauuuguuguuuuagauuaagacuguuggacucaagcuacaacgaggugucucugauguaaaaaacugcaguuuaagauuaugguaaauccuucccugcaguaccuguuaaacaaugaccucauucuuacgcagauuuaauaaauuuuuuuuccacuauuauuuucugcuuguuauuaguagcauuuugauaaggucuagggaauagguaugaaaucccaagggagaaaugucggcuuucuuacaguggaauuuggagaccagcauaagaaugcagaaacaucucucuuuugcuggaaaggcuauuauuguuagauuaauauuagacuaaaaguuucaccuuaauucagauucugccuguguuguuaauuauuuguagauuuuauacuuuaagaauuuucuuauugguaauuuuacaaggauguacauuuuacuguaguuuugguuucaugguucaugaacacuaccuggauucuaauucuuguuuucaucauugauuuuagaauggguauaaauauggcaaaauggaauaaggaaguguuuguuuauugaaagccaaauaaucuauaaugacaaaaaugcaaaaguagcuuggacuuguuccauuuuugcacauaaauacuguauuaauguaaaagucuuucaaaagaugccuuccacaugaauguaaagauauccugaauguauaguguguuauuuugaagauuagauaaugugagauaguuuagaugauuucucccuucucacucucacguauuucuuucuucuucccuuaacugcuucucuaucauccuccaauaccaccagucccccaccucaaauuaucccauuuccugagggacuccuuccuccuuuggcugccuuucucuacgcuccaucccucacuucccacaucugcuuuuccuuguuuuuuaaagacuguccaaauggauagauuguauuacaucuaacugcaguagaacucauugauuaccuucuucuuuucccucccccuggccaauuuuuuguccuaaguagcucugcuguagaaauaugcuuggcaaaaaaugcagauggaaaugaaaauacuuaaucuccugugucauauuuguuuagccucauugaugcuacucacagagacguggaugugcuguuacugcuuucuaacucugccuacuacguggccuaguaaguugcuuauugauuuaaagguuuugauuuuguuuuuuaaacuugaguaaauuuucuuuuuagaauucguaacaaaaaaaugugagaauaugguuuuguuauguauuuuaugaaacuucauugaaccccuuuaccuuauauaacuguuacgucauucuaacuuccuuuuaucuuuaucgguuugaaagcaagauuuuacaguuaaauuaguauguuuauguuauaguguauucuuuuggcauuugguguuauuuccuauauauuucccagguuuugauguauuccauacguuuuuaucacuaaugaccacguaucauuguuugcauuacuauagugaaguuuuuccucacuguuagguauuaaauuacuuacaauuuuuuguuacuaccaaugaugcaguugucuuuaugcaauaacgugugugugugugugugugugugcaugugccugcgcacuucuuugguuacaaggguaugaugaauuaugacuuuugugguuuguugucagauugaucuccagaaagacucucaaugaacagugcuaguagcaaaauacaagcaccuguuuccucacaccuuaccagaauuguucuaauuuguauuuacuaaguaaauauucaauuuauuuuuggcuuuguguaaacuauuguuuuuuagucauuugcccagaugccuguuggcauauaucauauggauuuuucauucucgauuuuggauaucagauuuaacagcuguauuguucccaaauacauaguuuguuucucuuucugucuuucucccuccucucucucucucccucccuucaucucugccucccuccgucucuugcucugugugugugugcacacgcgcgcgcauguguuugccuuguaaguuagguuuuagguuuguuuucauuuuauaugaguuuuuauaaaacuuaaaauauuuuaaccuuguaguugcuuuuuuuuuuuuuuuuuuuuugagauggaguuucgcucuuuuugcccaggcuggagugcaauggcaugaucucugcucacugcaaccuccgccucucggguucaagugauucuccuccuggguucaagugauucuccugcuucagccuccugaguagcugggauuacaggcgccugccacgacgcccagcuaauuuuguauuuuuaguaaagacgggguuucuccguguuggucaggcuggucucgaacuccugaccucaugauccacccgccucggcccccuaaagugcugggauuacaggugugagccaccacgccuggccguaguugcuuuuuuuaacuguuagauguguaaacuuauuuucccuuagcuguugaacuauauauauguuauucuuguuuaauuuuuaacagaguucuuauguuuaacauuuuaccccagaauguaugugcuguggaagauuuuguuaacuguauguaacaguuugcagcuauuaugccuucccugacaagccaaauaugcuuuugauuuaaauccucuuuuaacuucauuuccuuuuaucuaguuaugaugaugaaguugauaaaguaaaccaguaucaacgacuaagucuagaaaaccuggaaaaaauugaaauagguaaguuuuaacauacuaaucaagucaucaaaagcaaaugcuguuguuuccaagagggggucaaauuauuuaagcaagaaccugguuuaaguuucaccuacaaaugcuuuucuucacuauuauuuuccauuuguuguuaguagcauuuugaugaggucuagggaauagguaugaaauccuaaggcagaaaugucggcucuucuuacaguggaauuuggagaccaguauaacaucuguuagaaaccagaaagggauauuccaagcugucuacuucuuagaacuuccuuucuauucauuauagguuagugauagauauggucuuaucauaauaacuguguuccuuuuauuauuuaccuugugaagauuaccccagggaucaagaaagcuuaaaugauugaaauugaaagaguucuucuagccuuaucaaaccaaauggucaccagaaguuuguauuuugugugcugucauuuauauuaugaagaaaaauguguugggucuuuuuaagauaauagaagaaaauguuaugugaaacauuuaacuuuauacguauucauuugggauuuuaggcccugaacccacucuuuuugguaagccaaaguucuccugcaugcgacugcacuacagauacaaagaagcgaguggcuauuuccacacauugcgagcuguaaugcguaauccugaagaggauggaaaagguaaaaagaggaagagaugaaaguauucagugaaaacuuucuauuuauucuuaaaagcccaaauggaauuggggacauuucauaucauaaccaacugaaugagagaggguccagggaauagcuuuggaauaugagaccuugaaauagcaacucuguuuccagcaacccagggaaauuaucugaauguauuauuuagucuggggcaagggaaucuuuagcggggauucucagggaguuuggccccaucagugaucguaugggugucaaggcucuucacaugucauguucuuuucauuuguagcagguaggaaucaugccugucucauucauggcuguugccuuggcaucugucacagugcuugaacaaacaugaacuagaacaaacuuuuauuccccgauuucauucuuuugcuuuuguucuuuuaaaauguuagaacauugugaauuaagugggggagacuagugaacagguggcaguuuucuauaaaucgaagcaaauaaauuuguauuuaauuauacgacgacaaauuucauucagcgcuaaauggguuagaacugcuauuuuuuuuaguauguuuauggagaaauuggcaggcaguuauauuuggguugcagauacccuucagugcauugcagagaugcugcagaucaccaagcaagccaugggaucggauuuacccauaauugagaagaaacuugagaggugaguauacugcuucucucaagaauaaaggcauucuuauccaaggucuuauuuguuuaaaauuauuugcagggggaaaggggaggagaucacauuaugguaagguguugguauuuagagagguaaggaucaaauuucugcagaucaaaauacuuucaacauucuucauguauacaauuuucagguaaguuuuagacuuacagaagaguugcacagguaguuuagaggguuuccauguacucuuccuucggcuucccuuuauauuaccgacuuauaaccauagaccauuuaucaaaacuuaagaaaguaaccuuggcacgguaagauuaaccaaaguacagauuucacuagguguucacuagcauccuuuuucuguuccaggauccagucugggauuccacacugcauuuaguugucucuguaguuuaauguuauuuccucaaucuugucuuuucuuucauaacuuugacauuuuuuaagaguacuggucagcuguuuuguagaacaucccuccauguagguuuguccaguguucuuuccugaugaagcuaagguuaugcauggucaggaaggacaccacagaagccacgugcacuucuuagugccucgugcuguggggagggagggcgugauggccuguguaguauuguugagguuaagcuugauuacuuggcugggguagcaucugccaggauucugcacugcaaacuuuguguuuuccucuuuauaauugcuaaauauuuaggggaaauuacuuugagacuauguaaauauuguuucuguguaaaccuaagacuauucauuuucauaaccauuguggaucuuuucuauaauaauuauuccugucaugaucuauggucauuuuucuaauuuucauuccuucuacacuuguuaauuggaauucuucuguaaagccacugcacccagccucuuguacacauuuuuaaccuauacagauuaauaaccuuuuauugccaaagauuguauuuuaugcauuuuccacauuacuguagaauucauaacuaccauuuaaauagaugccuccugugaucaguuuggaaauguauuguguggguucagaacauggacucugagacuccugguucuaucaauuacucuuuaaccuuggaaaacauacuccuuuacuucaguuuuguuaucuguaagaugagagaaaauccaugucagugcauugcaugaacugaauaacgcacucagaccuggcacacagcuauuaaacucaauugccaagaauuuugguugcuaagcauuuuuuccuuuuauaaagaagucaugacagauaccuuugucauguauuacuuuuucauguuuaggaugauuucuuuagaauagcauccucagguugugaaucuggauuaaaagauguggguauuucacuugucccuaacagugccauacaaagguuauugcuuauccucaguuucaagaaaaacucugaagacccagaguuucauuaucuugagugauauggcauuuaaaauaugcuuaggauaucccucuagguguguuuaaaaguuuugauacagaguaacacugacugucuccacaaguauuuacguaggugguauuuugccaagagaaccggucugagagcaagggcccugcaaggauuuugccauccuugacacaacucacguggccacaagugauacauuuuuaacuccuaaguaaacugaugagaggaaacauugaaauuuuuucuaaauacuuuguagagaaaauaguauguuuuaaacacuaggcuuuugaauuuggaaaaagaaugccuaucaacagauuauuucauauuuaaaaaguguggcuuuucuuucuaaugagcaucugucagguuuugugguccacauucugcuagugaagagagccauuuggccggaagaaaauuguucaggcuuuuguuaaagaauuacuuuaacccauaauuuuucugcaguaugcucaugaucagugaucuugcaugauccaacaguacaaaugcacacacugagacauuuguggcaaauagcaucaacuuuucuuucuuauuuauagcugucaugagggauaccaaaggagagaagacacuaauuguuaaaugucccaaaucuuuuaaaaucagguaacccacaggacauauaagaaaauggaagucuuacuccugucuccccccacuaucugaauuugagccacacugggauguguauagauaaccuuaguuaaggugcugcagauucccauuuacagucagagaugucuuugcugauuguacagaugguggcugugcuagacccgcacugcucacaaugguagccacucaccacaugugguugugaagccuuuuagaaugcgacuaggcugaauucaggugugcuguaauuauagaacaccacacauugccuauauugaauuaguccaaaaaggaauauuaaucaucuuuuaauauuuuuauguugaaauauuuuguauauauuggguuaaaugaaaugcugcuaauuucacugcugcuuucuaauguggcugcuagaaaaauuguaauuaugcauguauuucauauauuucuauuggauagcacuguuuuaaugucaacucugaggguuaucugucaguuagcaaugcacuguuuucaagaaguugggaccaauuugaauaacuguuuucacuuauguuaauaacuggaacuggcauauuggauuccauggggaauuaacuuuuuuucucuucuaauuuguaggaagagcaguaaaccucacgaagacaucauugguaucaggucucaaaaccaagguucuuuggcccagggaaagaauuuuuuaaugagcaaauuuucaucucuaaaucaaaaagugaagcagaccaaauccaauguaaauauuggcaaccuccgaaagcuaggaaacuuuaccaaaccugaaaugaaaguuaacuuucuaaaaccaaacuuaaaaguaaaucuuuggaaaucagauaguagucuugaaacuauggaaaacacaggagugauggauaagguucaggcagagucugauggggacaugucuucagauaaugacucauaccacucugaugaauuccuuacaaauucuaagucugaugaagacaggcagcuagcuaacucauuagagaguguagggccaauagauuacguucuuccuaguugugguauuauugccucagcgccucgauugggcagucggucccagucucuuagcagcacagauaguagcguucaugcuccuucagagauuacuguugcucaugggagugggcuuggaaaaggccaggagucuccuuugaagaaaaguccuucugcuggcgacguacacauauugacuggcuuugccaagccuauggauauuuacugccacagauuugugcaagaugcacagaacaaagugacccaccuaucagagaccagaucugugucucagcaggcuagucaggaaagaaaucaaaugaccaaucaaguuucaaaugaaacccaaucagaaucaacagaacagacaccuucucggccaucgcaauuagaugucucucuuucugcaacaggcccacaguuuuugucaguugagccagcgcauucaguugcaucucaaaaaacccccaccuccgcuuccagcaugcuugaacuugagacagggcuucauguaacuccuucuccuucagagagcaguagcagcagagcagucucucccuuugccaagauucgaaguuccaugguccagguugcuaguauuacccaagcuggauuaacccaugggauaaacuuugcagugucaaaaguucagaagaguccuccagaaccugaaaucauuaaucaaguccagcaaaaugaacuuaaaaagauguuuauacaaugccagacacggauaauucagauuuagcuuuuagccauaagaauccuuccauggcuuuuauuuaaaaauaugaaauuuucaccucuugggguauuuuaauuguacugucugaacccagggaucacaaauucuguucauuggaaaggguuuuaaacggagucggaaccugaguagauuuccaaauuuuacagccaggacuacagaagugcaucauucuagaauguguagaccugaguagcuuauacacuacagagcacuuugcuuauuugaaaguaauucagcaacaggucacuuugggauauaaccugaaccuuuuuuuggagugggguggguagacuacaguagacacaagggcuggacaugcagaugcuuaggggauuagcguuuuucauaauuuguucuguuugucaguucauuccuguguguucuuaccucuacaaaguaaauuacacauuuaguuuuuagugacuuuaacauguuacugaagcauuugaauauaaagcuauuuuaguuuugauggcuuaacuguucccugaggaguugaggguuauugacacuagagaaaugaauucucauuugauccuaauuuuccccguauucuacuugaacacauuaaaaauacucugcugccuauacaauguaaaccuaggagcauuaagacuugucacacaguaaaccugauacaucagaggugaauaccagcaccuauuagguuucauuuugcuguuuucaggaauguaagaacacccauauuggcuacuggaaauucuagaagucagucagguuuuaauuuauuccaggaggggcauccucgacaucuuauguagaugauccacaacuucaaaauuuagucugggccuagugcaguggcucacaccuauaaucccaacacuuugggaggccaggaguuuugagaccagccugggaaacaucugucucuacaaaaaaauacaaaaauuagcugggcauaguggugcaugccuguguuucuagcuacgcaggaggauugcuugagcccaugagauugaggcugcagugagcugugaucgugccacugaccuccagccugggggacagagcaagaccgugucucaaaaacaauuuagucugaaacacaauugugcugaaucugucugacuauaacucugaccacacagaaccagggcugccccuguaauccccacaguaagaaaguuguauggcauauuccaacaaguauugguucgucuggugucuuuagagcuuuacucuguugaagugacugauucucaacugaacauuaugucguuacuuugauaagcauuccacuuuuguuauuuauuagugcuaucuuuuuuuuuuacguguuaaaucuugugauuauuaaaauaaaguaccauuguaauuuaaagugacaa

SEQ ID NO: 191807 - RNA, 43423 nt, Homo sapiens
ggucgcaggcagcgcggucggcggcggcuauuucccgccauugugcgaagugaaggcuaggggcccguacgcgcccgccugacugucgccagcagcuccucggcggccccaccgcagccgccgcucccugaggcgcgggaggcccgcgccccgcggcucgcugugcgugggagggcgcgagcgaacgcgggcgaggagcggccgagccgcugaagaggagcugggcgccggccgcccggccgcgcucggcccgcggaucgccuccgcccggucuucgccggccccggccccuggcgagaugccguguggggaggauuggcucagccacccgcugggaaucgugcagggauucuucggugaguggcggcgccggggggcgggccgggcgggcagccgaguuugccgggccccggggcagggccccgccgcgcggcccccacgcgguaccaucucgagggcucgcguggcccgagacggggccccggggccugcaccggccccagcugggacagccucucccccggucgcagcaggcaggggcaggagccgggccgcagguaccucccaccugcccgagucgcagcuugggagccgccaaggugaagucguggggcgcgggcugugauucgcgggcugugauugacggccucgcucccagccuguggcagggccagggccccggccccgggcgcagcaaacucggagguccucgaacccuggggagggcccgcagagccgcggggagggaaaaccacuuugccugugggaagcccacaggauauuucaaaacuuccggugcgucggggagugcucgcuugcacagaaguugguucuaacuccugugcuacccucauucucucuuucagagauaagauuuaauguucauagcuuaguuuuccuguugggaugacuuuagaacccaucuagucuggaucugcuccugugccagagccagcaagaaauauugagcuacuugaguuuguacacagggcugagaauccugcaggcgagcuuaguaaauuuugguugcgauugcuguugcuacuuuacugcgaaggguauacgaagaaaaguuuauauuuguugucguuaacugggcauuuugacaaccguuccauuccccagugucuuuuuacacguaaugaguggcggagucagauccagcuagaaaucacuguagauggcaacaccugacuugucuggaguuaacuuagaguuguagagcggccuuagcucauugaaaaaaacaucuugggguacuagagagaaaaggcagugggaagcuaaaucauccucagcagccaaaaucgacggcaaacaauguaugguauuucuuauaggagggccucuagugcuuacucaggaaguccuuauuaauuuaccuguaauucuaauuaguuuaguuaccuggcuucccaggcuguaacuaauggcauuauauuagaaaaaagccuggauagacguccgaacuuagccagugaacacugacagccugaugaagaaauuuaaaacuaccuucauacuugaaaaaaaaaaaaauucacuauauagcagucaagggugcuuugaggaaggggcauauauuucuccacuaaauccuaguaauuuauguucauaagaauucuagaaaugauaaucgauggucaacacaauggccccaaaaugucaagugaagauucaauuguagcauugguuuaagagggugcagaugcauagauacuuuuuaggaaaaaucccuccaaaguaaaaagguuuggugcuuaaaggguuaaauuucaguuacuaauauuagaaaguuuauuuauuagaaauaccccauacucugauuuugcuggauaaaugagaugauuucauauuugauagagauuugaauguauuugugucaaauuuugucuucuaaauguaugauccuaagggacacaucucaucauaguacaggaaggauguaacuuagauauaaaauaauagcuucagaguauuuuauaaauuauguggauuguugugggaaccugagaaguuucuugauguguuucuccccagaaugucuuguucccguguacguugugucuuauagaaaagucauaauguguucguagaagcuguugcuauauuuucguaucacugugauuguauugcauaucuuuauuauaacagcauuacaaguauguuugugugauaacuuauaggcacuuuuugguuuaguaggaaauuguuuuccccccagauagguaaugcauaugcauuguacagaaagaaaaaagcaguucagcaacauauagcagaaaaggaaagaucuuugaagauccuucaccuucaagauaaccacugguucgugguuguguaguuuauuuucucugcauauauuuagacaguuuuuuuaaacugaaaaguuaaguuuuguuguguauuuuauuuugaaauaugcauuuuuuuuuuuugagacagucucgcacugucacccaggcuggagugcaguagcgcaaucucggcucacugcaaccuccgccuccuggguugaagcgauucuccugccccagccuccggaguagcugagacuauaggcccgcgccaccacgcccggcuaauuuuuguauuuuuaguagagacgggguuucacaguguuggccaggauggucuagaucucuugaccucgugauccgcccgccucggccucucaaagugcugggauuacaggcgugagccacugcauccagcagccugaauuuuucccuuucuuacuguccuugucauauaguauuguauaaacuuauuaacccugucauauauuuuaaguuaggugucacaauaaucuagagugugcuguccagggcaguagccauguguggcuauuuaaauguaaauuaauuaaaauuacacaaaauuaaaaauucaccuccucgguguuagcacauuucaagugcucaguagcuacauguggauaggggcuauuauauuagcacagaucuagcauauuccuaacaucaggaaguucucuguacagcacugaucuagaggacaccgcuuuuuaguaugugaugcuaguuuuuuuggauaaccagcuacucacugacucucuuucaggaucugaauuuggucacuguaucuuauccguucuagggguuuuguuuuuguuuuugcuuuuuuuguuuuugagauggaguuucguucuugucacccaggcuggagugcaacagugugaucucggcucacugcaaccuccuccucccagguucaagcaauucugccucagccucuggaguagcugggauuacaagugccugccaccaugcccagcuaauuuuuuuuuuuuugagacugagucuugcucugucacucaggcuagggcgcaguguuacaaucuuggcucacugcagccucugccucuuggguucaagugauucuccugccucagcccccugaguagcugggauuacaggugcaugccaccaugcccagcuaauuuuuguauuuuuaguaaagacaggguuucaccauguuggccaggcuggucuugaacuccugaccuagugauccgcccaccuuggccucccaaagugcugggauuguaggcgugagccaccacaccgagccgcuaauuuuuguauuuuuaguagagacaggauuucaccauguuagcaaggcuggucucgaacaggugaucugccugccucggccucucaaagugcugggauuauaggcgugagccaccgcgcccgacccagacccucaucuccaaugcuacugucaaaauuaaagccaucguagucucuuuccuggacgcuggaacagcccucuaacugguuucuugccuccagucuugcuucucuuccaccugccauacuggaaccaaguccuucagugacuucuuguuacccuuacuaucugauccaggacuuuuaaagugguuuaugaggcccuuguuggcuccacccuugccuugcucugagacuuuaucacugcguacccccuccucauacuccaucccagccgcacugaaccuuuuuucaguucuuuaauuuugaaccugugucuaggccuuuuugcaucugcugauuucuugugccugauucccccucccaucccauguccacuuuucuggcuaagucuuacuuuuccuuugggaacuuaaguuagguaccaaaguaggguaccccugcuccauguuacugcaggauccuauuauauaugucuuugaaaaauaguguguaaagugcauuguugaaauuccuuguuucggaaguuccuuugcuggauuuugaccccgcgaauucagggccccuguaucugcauuauucaccacuguauccuaauuucuuagaauuugccuuguacauugaaagugcucaguggacacuuguugaacaaaagcagugaaaagacugauuaaucagaaauguuguuaauugaaauggcuagugagaucacaaaucucaaaauuuuucuuuucuuuuuuucuggagucagugucuugcucuguugcccaggguggagugcaguggcgugaucucggcucacugcaaccuccgccuucuggguucaagccauucucaugccucagccucucgaguagcugggauuaaaagugugcaccaccaugccuggcuaauuuuucuauuuuuaauagagacaggguuuugccauguuggccaggcuggucuugaacuccuggccucaagugaucugcccccacuuggccucccagagugcugagaucucaggugugagcugcugcgcccagccucuuuagcuguuuucccuucaacuauugguuagaccaagaucauuauucucguuauauuuaagcuucuuugguuguaucuaacagaacuagacuagcucaugcaaaaaagagcaggguugggugaagaggggcagagcagacuauuuuaucacuagcauuuuagagaauuuaaagcaauaauaaaaugaacuaaaaguuaguuggucugcuuuuuauuaucaccaugaaucuaaacagacaaucugugcccuuauugucuguacccagcuuggaccucuucuaccacucuguccuugguaggccacugaaaaaaguuaauuuauauuaaggcuauaaaacccaagaacaggggaagugguuggguauucgaagagacugaguggaaucaggaacuggaaagcuagcaggaauccaagcaacucaguauuucuucucuugggauacauuaaucucugcacacuuucucuuucucuacuccaugucucccaaauuuacuuguucucgguuccaacccacgcuagcuagcaucuuuauuuucaggcauagaaaaucugauuggcacaacauggagucaggaauccauucacucagggaucagucaucuguggccauggcacagaguuagguaggacaaucgugacuguuauccacaccucaacauugggggcguucucaaagaagaagaauagcuccggcagccauggcagauggcauacguaggaguuuuuaaguuauaauaacuuacacaugguuuuaaaaaaaaucaacaugaugguaugaacugagugaaaguacgugcucccuccauugaaguaaccacuuuuuuuuuuuuuuuuuuuuuuuuuuuuugagauggagucucgcucugucgcccaggcuggagggcaguggugcgauuucggcucacugcaaccucucccucccagguucaagcgauucucaugccucagccucuugaguagcugggacuacaggcgaccaccaccacaccuggcuaauuuuugcauuuuuaguagagucggggcuucaccguguuggccaggauggucucgaccuccucugcccucgugauccaccacccucggccucccaaagugcugggauuagaggcaugagccaccgugcccugccugaaguaaccgcuuuuaacuguuuuugcuuuuagagguuuuuuucuuugagacagagucucgcucugucacccaggcuagagugcaguggcacgaucucugcucacugcaaccucuaccucccagguucaagcaguucuacugccucagccucccgaguaguugggacuacaggcgccugccaccacacccagcuaacuuuuuguauuuucguagagaugguguuucacuauguugcucaggcugguccaaaaaaauuuuuuuucuuugaaauaaaauucacauaacaaaauuuaacauuuuaaaauguacaauugaauuuuuuuuacuguauucauaaugauguugugcaaccaucaccaccacuaucuuuuucucuuuuuuuugagacggagucucacucuguugcccaggcuggagugcaguggugcaaacuuggcucacugcaaccucugcuuaccggguucaagcgauucucuugccucagccucccaaguagcugggaucacaagcaugcaccaccauuccuggcuaauuuuuguauuuuuaguagagacggaguuuuaccauguuggucaggcugcucuugaacuccugaucucaggugauccacacgccucggccucccaaaguguugggauuacaggcaugagccaccacgcccggccaccccuaucauuuucaucacuccaaaaagaaaccccauaccuuuaguagucucucccauuucuucugucuuccaucucuggcaacaacuauacuucugcccauggauuuaccuauucuggacguuucguguagguggaauuauacaacauguggccuuugaggucuggcuucuuuucauuuaccaugauauuuucaugguucauccaugucauaguaugcaucaguacugcauuccuuuuuuuuuuuuuuuuaagagauagagccuggcucugucguccaggcuggaaugcuguguggcaagaucaugguucaccgcagccuugaacuuccagucucaagugauccugcagccucagcuuccugaguagcugggacuacaggcauguauuaccuguauuaccacacccagcuaauuuuuaaaucauuuuuuguagauuuggggucucacuauguugcccaggcuacacucaaacuccuggccucaagugacccucccgccucggccucccaaagugcugggauuacagaugugagccacuguacccagucugcauuccuuuuuauggcugaaaauaacauuccauuguaugucuauacugcauuuuguuuauccauauauuugcugauggacacuuagguuauuuccuggcuguuauaaauacugcuacuauaaacauucauguacaaguuuuugugugaauguaagcuuuuugguucuuucccagauauaccuagggauggaauugcaaggucauaugauaauuuuauauuuaacuuuuugaggaauugccaaacuuuuccacaguggcugcaccauuuuacuucccagguucaagcaauucuccugccucagccucccaaguagcugggauuacagguaccaccagcaagcccagcuaacuuuuguauuuuuaguagagaugagguuucaccauguuggccaggcuggucucaaacuacugaucucagguaaucugccugccuuggccucccuaagugcugggauuacgggcauaagccacuacgccuggccuaaaauguuuuuaagaaagguugugugagaagagaacaagaggcacauuauauaauguuaaaacagucaguucaccaagaagaccuaacuauauaugcaccaagcaacagagcuucaaaauguaugaugcaaaaaccagcagaaauaaaagaagaaauaggcaaaucugcaauuguaguuagauauuuuacuacuccucucucaguacuugacagaauaguggguagaaaaucaaaaagaauacugaacaacacaaaacuacacaacacugucaaccaaguagaucuaauugacauuuguuuaccuaaugacagcagaauacacauucuuuucaagugcacauguaaauucaccaagauaaaccacauucugggucauaaaccaaauaguaaacuuuauauauaagaagaacacuucuaaacaauccauggauuaaaaacucucaaaggaaagcuuugaauauugugaacuaaaccaaaaugaaaacucaacauaccaaaauuugugggauacagccaaagacaugcuuagaugcauuagcugccuuaauuagaagagaaggucucaagugaauaauuuaagcuuccaccuaugaaacuagaaaugaagagcaaaauaaacccaaauuaaacagaagaaagaaauaauagagaacaaaaauccaugaaauagaaaacagaaaaaaaagaaaaaaucagugaaacucaaagcucuuuaaaaaaaaaaucaauaaaauuguaaaccucuagccauacuggcaaaggaaaaaaaaaaaggaaaacaaauuaccaauaguagaaaagaaaaaaaggaagacaaauuaccaauauuagaaaagaaagaggagauaaccaccguagacuguacaggcaugaaaaggauaauacaaacagcucuacagauagaaauucaucaacuuagaugaaauggaccaguuccucaaaaaccacuguauuagcuuucuauuucuccuguaauaaauuacaaauguagugacuuuaaaacaaaagguuuuuauuuacaguccuggagacagaagucugacaugggucuuacugggauaaaaucaaauuguugacaggacuugcauuccauuguggaggcuuuaggagagaaucuguuccuuuucuuuuccugcaucuagagucugcccacauuucuuggcuuguggcccccuuccguuuucaaagacaacaagucgaguuguucucacaucuuacucuaacuuccucuuuugccacauccuuccacauuuaaggaccguugugauuacauugaacccacccagauuguuuuuuuuuuuaaguucaacugauuauuaaccuuaauuccaucugcuaccuuaauuccuauguaacauaucuuuacaaguucuggggauuagaacaucaguaucuugguugggugggagggggucauuauucugcugaucacagccacaaacuauccaaacucacccaaguagaauaauauuucaccuuuuacgucuggcuuaucucacuuagcauaauguuuucaagguuuauuccugugucuucguugcuuuuuuuuuuuuuuuuuuuuuuuuuuuuuuuuuuuuuugagucugagccucacucugucucccaggcuggagugcaguggugcgaucucagcucacugaaaccuccgccuccuggguucaagcaauucuccugucucacccucccgaguagcugggauuacaggcgugugccaccacgcccggcuaauuuuuguauuuuuaguagagacggggguuugccauguuggccaggcuggucuugaacuccugacaggugauccgcccgccucggccucccaaagugcugggauuacaggcgugagccaccccgccuggcccucgcugcauuuuaauaaagauacaaaagcuaauucaaauggaaaaaggauauucuuuucaucaaagacaugaacaauuuaacauuuacauggaaaaauaaaauccucaaccuuuaccucauauuuuauauaaaauuaacucaaaauggaucauacaucugaguauaaaaccugaaacuauaaaacuuuuagaagaaaacagaucuuugugaccugggguuuggcaaugaguucuuaagacaugacaccgaaggcacagugcguaaaacaaaaauuugauaaauugggcuucaucaaaauuaaaaaccuuuguucuguaaaaaaaaauucuauuaggagcaugaaaagacaagcuauacacugggagaauauauuugaaaauccgguaucagaaaaagaacuugaauccagaauauauaagaaaacacagcaguaauuuaaaaacucaauuuuaaaaggggcaaaagauuuaaguaggcuuaaauagacauuucaccagauaggauacaaggauggcaaauaucccccugagaagaguucagcauuguuagccauuagggaaaugcaaauuuaagccaugauauugcauauuagaacagcuaaaauuuaaaaauacauagugauaguacuaaguacuggcaaggaugggaacagcuggaucucuuagcaaaauggugcagccacucuggaagacagguagaaucuuaaucauacauuuaccauguacucaacugugucauaucuagauacucauucuagagaaaugaaagcucauguucacaugaaaaccugcagacacguguuuuauaguuuuguuuauaguugucaaaccugaagacaaucuaaauguccuucagcaagcaaauacauaaacaaauugguuguuauucagaggaauaauaggaauaaaaagaaaugaaguauugauauacaaauguguuggggaguccuauaaccacccauaugcuugaagauuuacuaggacuuauaugauucacuguauaguuguacuccuccuaagauuuauugcagcaauaugguaaggauacauaguuggauccuaaggacacacauggagucuggaggaauccagugucuugauaauuuuuucuuuuugcgugguggaggaggugguguggggggggacgaagauucacucuagucgcccaggcuggagugcaauggggcaaucuuggcccacugcaaccuccaccucccagguucaagcgauucuccugccucagccucccaaguagcugggauuacaggcgcacaccaucacgccuagcuaauuuuuguauuuuuaguagaaaagggguuucaucauauugaccagacuugucucgaacuccugaccucaggugauccgccugccuuggccucccaaagugcuggaauuacaggugugagccaccgcacccagccaagaggauuuuuucauuuuaagugcagaggcaggaggaucgaucacuugagcccaggaguuccagaccaaccuggacaacauagggagaccuccaucucuacaaaaagauuuaaaaauuagccaggcgugguggcccgugccuguggucccagcuacgcaggagacugaggccagaggaucacuugagcccaggaaauuaagguugcagugagccaggaucacaccacuguacuccauccugggugacaaagcaacacaacacccugccugaaaaaagaaaauugcauuuauauacauucaaguaacuuagaaauaacuugcugcuccccagucacugcuugauguagcuuuacuauuuguuaugugguauucucacgucuuuuacacaauugcaggcagaauaguugguguggcagucguggcuguguaauagucuuuucuuuaaacauccauuuugaauacaagcgaaaauacccacuuaucuuuuacccaauucacuguaucuaguagagcagcgauucuuaaacuucaaugugcauuauagucagucacauagagggcuuuuuaaaauaugaauugcuaggccccaccccuaagaguuucugauucugugguucgggguugggcugaauaauuugcauuucuaacaaguacucagaugaugcuaaugaugcuggucagggaaccaacuuugaggacuaguuuguuaguggauuuaacgccuacacauuaguaucaccugaggagucccccaucccuacuucuuuuucacaacuggcccuuguccaguuaaguaaacguguuuggaaguccugcucaaacaugguguuaggauuuuaugguccuuuucaacagaugcagcuccauaacaaguguagacuuuuuauuuuuuacuccaaaucuucauaacacuugugugaugaauauaaacagcaggauuggccagcugugugguuuggugguuuuaguucacauaaaucuguauuccgucaauagcucacuuuuuggucuuggccaguucccauaagugccugcuguagauggcuuguuaauuguaaggaguaaauaguaacuacacaguagaguaauuggcugucacuuugggugaucaaaauuaacaucaccaaugaagggaagauggacaucaugucuuuucagacaucuggaaggauaaacaucacuuauacaguaguuugacaacauuguuuaaacagcaguucgguuauacuugauuggaaucugaucauaagggaaccaacagauccagauugagaagcauucaauuuuuaaaaaaggaccuuauucuucuuaaauagcaaugucaugaaauauaaaguuugcagaacuauuccauaugaaaggagauuaaagagaucugauagcuaaaugcaaaagugauccuaagcuggguccuguaacugaacggaaaaaagugcuauagaggggauaguauugggucauaugauaaauaggaauauagaugguagauuaaauaaaaaguauugugccaauuuugaauuuccugagguugauaacaguacuaugguuaguacuguuccuuaggagacacgcugaaauauuuguaggcaaaaauaccugauacugcaacuuaaaugagucagaaaaaauaugagauggagcaaauggggcaaagcauacagguguucuuuccaacuuuuuugaaucuggaauuauucccaaaugaaguuauaaacaaaaaaacuuaggcucuuuauuucaggauaguuguaaagauaaaaaaacuacauaaaaauguauugaaagaacagaaugcuuuacaagcagugcuucauaugcugcugaaucuagguggccuuguagcacauucuguagguguccccagcuacacugugggugcuagagagccugcaggaggucagcauccuccugauuuguaacugccccuuccccugcucaguacagcuucuugaaugugucuugugcaguacuucagacacacugaagcauaaaauacacccuaucuaaaaauucauucuaucauaguagcuaauuuuaguuuguuuuuugcugacuaaacuauugugugacucaccugaucauagucuuuuauuauauauugcauguacauuagcuuugaaaaguauauuucucuuucagcccaaaauggaguuaauccugacugggagaagaaaguaauugaguauuuuaaggaaaagcugaaggaaaauaaugcuccuaaguggguaagcuuauugcuauuuucgagggagaggguuggacagacuauacaguuucucuuaguagaguaacuaaguaacccacauguaauuuaaaaauauguaaauuaauguacuucugcuucaaguacauuuguauuaaaagauuuuggucuuuugcuaauuaaguuuaagcauguaaauacuuauacauuaugccucuagguggcaguaacugacuguuacuuccugagacaaaucuuuaguugcaagagugucaguuaccuuuguuuuauuaccuucauuuuaaaagaauuggcaugugcuaguuuuaagagaagagcucaacaaaguaaaugccuuuuugaucauugaaaaguguucugaaugaaaagcauuuuuuagcauucuuuuacauuguggucaaauguuaucuaaaacuugaaagaaauggaagagaacuuggguuccagcaauuauauugaccauugagaucauuuggcucucugauguggcauggguguguguguguguguguguguguguguguaacaguuugagucuggauauaaaguuuguguauauaugcuuaauguuguauagacaggauauuuaguugacugacuugauuauuuuccuuuaagguaccaucacugaacgaaguuccccuucauuauuugaaaccuaauaguuuugugaaauuucguugcaugauucaggauauguuugacccugaguuuuacaugggaguuuaugaaacgguuaaccaaaacacaaaagcacauguaaguauugcuguuuucaugaauuugugguauuaauuuuguccuuuuacuguuggugguaguuuugguucagauauauugauauaauucuguuuuucuauguuuggggucauagguucuucauuuuggaaaauauagagauguagcagagugugggguauguaucuuuaauauauaugaaacauuuuuaguaagaauuuuuuccuaaacagagaauuuguuuagcuaaucuuaaauuuauuuaucuuguguauaaguuacaagaaaucaugugaaauguuuuccuuauuugguuuuauuuaggaguuugaugugacuuuuuuuuaauccucuaaagaucuuuugaaggggaaauacuguuaaugccaaaauuaauuccucucuccaauaucuguauauaauauauguaaaacaaagaacccuagguugcaaaauuaaauccuuuuuaauuccuucaaagacaaagccaaugguaaucucacuguuucuuucauagaaagcugucagaaucagccuauaauacagaaauuuaaugaaauauucauuccuagguagcucggagaugagauucaaaagucauauauuauucccuaggaaaggcauguucucuuucagauauacuuagaaaacucuaagaaguggaaaggacccaggagacaucaaauuugagccuaauacauacaagcaaggauuuuuuuguuugccuuucuuucuaggccuaagguaccuuucuccuagaaugagucuuuuauuuaugacucuugagcaacauguguaccaacucucuguuagccuuugguagugucacacauggacagccucaucuauuuuauugacccauuuccagaugcugggauuaccgaguuacauuaauacacagcuuuuuaugguauacaguaauguaauauauuagccuaauguguuaggacuccuuaaacaagggauacuguaaucauuaauacaguugauccauuaggcuuggcacaguguuuauuuuauggaaacacucuaaaagaaaaacagaccugaaguucaucauguguaagguuacacaaaucuaucuuucaaaugaguucauuacucuaaauaauugucagaaguuacauuuuuguuuaauauaaucuuugcaguaaccuuccaaauuagggcaauuuuucuguccagaucugccuacugaacuagaauauuuaaugagcaacaacuucuguugugaauuaacggacugauauugggguuugauaaaucaguuuccuaagguuuggauaagccaagaguuagacucuaagaauauaaaaaggccuagauaacaucauaaaaguaagguucuagauccacaaagcagagaacuagacccagauuauaagucacuccagaggucccauuuuucuggauuugagggaggaaguguuugaugacaguauuugaagugauuuuauauccauuuucuuuuaaaaaguaauaguuuggaauuaguuacuuguuaauuaaucuguaaaauauuugcugugguguuauaaugugaaaaugugguugcuaauuuuaaaauaaauuuuggguuuuuuaaaguaaauuuuuaaaaacacuuuuuauguauaucacagccucaacaagaacuugauuuaaacucuccacgaaauaccacuuuggaaagacagacuuucuauuguguuccggugccuggggaaucuacguggguaaaagaaauauccuuuaucugaacuuucuuacuguguugaugguuucuaaaaacuuagccuuuaauuauucuuccuuugcaaagcuuggcuuuauuuuaauaaaguguguuucauuuguucuaauugagaaaacccauaaaacgggcuaaguauuugucacugaguaaugcuaaaauaacaguacauuccuauagugaaauacuguuaaaaugauugaaguaauuuuuuuuuuuuuuuuuuuuuuuugagauagggacucacugucacccaggcuggagugcaguggcacaaacauggcucauugcugcuucaaccuccugggcucaagcaguccucuugccucagccucccaaguagcugggaccacaagcgugugccaccaucccuggcgaauuuuuugauuucuuguaggaacaggguucacuuuguugcccaagcuggucuugaacuccugggcucaagugauccucucaccucagccuaccagagugcaugcuccgccuaaggcacauuuaaagguacugaaaaaauaugauaauuaaaguaaaaaaauaguuucaaauuggaauucauucuaauuaagggaagacaacguguuggcucuuuugagaggggauuguagaaacauuuccuuuuuauuuacgauaguaauuuuuuaaggcauggcccaccuacacugaaaugcacagauuuuaagguaaugcacagugauuuggauaaacacauacaccuauauaauuuauaccccaaaguaaagaacuugugccuaaaaauuccuuucugccuuuuucuagucacuaccuccuccccugcaagcacaauccugaauucuugacuauggcuuggucuugucuguugaaugacaucuaaauggacucauauaauauauagucuuugugucugacaucuuguguuuaacaucaugcauuugagucauguguguaucaguaguucuucauuucuuucuuguuuucuuuugcuaaguauuauuuguuuauacagucuccaauugagcauuuagguuauuuacgguuuuaagcugggcauuuucuuugugagaacauuuuaaacuaccaauucaguucuuuuuguuuguuuuuuguuuguuuguuuuuguuuucuugagauggagucuugcucugcugcuagucugaagugcaguagcgugaucuuggcucacugcaaccuccaucuccuggguucaagugauucuccugccucagccucccgaguagcugggacuacaggcacacgccaccaugcccgccaguuuuuguauuuuuaguagagacgggguuucaccaugcuggccaggauggucucgaucucuugacuucgugaucugccugccucggccucucaaagugcugggauuacaggagugacuaauucaguuuuuuaacagauauuuugagucaguugugauaaauuguaucuuucaaggacuguuuugaagucauuuaaacccaguuguugaauuuauugacauaaaacuugucagaguauuuucuuuuuaaugucugugggauaucuagcauugaucucuuucauucccaauaauguuagucuauuuuucacuucaauuuucuguuuucugcuucauccauuucugcuuuauuuuguucuuuuugguuugguuuuaauuggucuuuuucuagccuuuuuuuuuuagacggggucuugcuggcucugucacccaagcuggagugcaguggcacaaucucggcucacugcaaccucagccugccagguucaagcaguucucugccucagccucccaaguagcugggauugcaggugccugccaccaugcccggcuaauuguuuuguauuuuugauagagacgggguuuuaccauguuggccaggcuggucuugaacuccugaccucgugauccaccugccucaaccucccaaagugccgggauuacaggcgugagccaccgcgccuggcccuuuuucuagcuuuuuaaaguagaugcucagauuauugauuucaaauuuuucuuauuuucuaauguuagcaacuaaagcuauaaauuucuccccagucacugcuuugguugcaucccacaaguuuucauuuguuagguuuuuacugucauuuaauucaaaauauuuucuaauuucccuugugauuucuucuuugauccuucgcccuugcaacaaucugcuucuguguagucucauucuucgugcuauuuuugucauagauuucacucauccuuagauuauacagcucacaacauacuauuuuuguuuuuaacagucguuugucuuuuauauaaauuaagaagcaagaagaauucaucuuuuuuuauauuuggcaucauuuccuuuagcgauauuauuaugauuaugauuuuauuuuauuuuuuuuuuuuuuuuuuuugaggcagaguccugcucugucaccaggcuggagugcaguggugcaauuucggcucacugcaaccuccgcuucccggguucaagugauucuccugccucagccuccagaguagcugggacuacaggugugugccaccacgccaguuuuuuuguguuuuuagucgagacgggguuucaccauguuggccaggauggucuuaaucuccugaccucaggugauccacccaccuuagccucccaaagugcugggauuacaggcauaagccacuaugcccggccagcaauuauuuuuuuuuuaaauacagaucuguuggugacgaauucugucaguuucuguucaauugaaaaugucuuuuauuccaccuucauuuuguuuuauuuauuuauuuauuuauuuauuuauuuauuuauuuuugagacagggucucucccuuuguugcccaggcuggucucgaacuccugagcucaagugaucuacccgccucagccucccaaagcacuaggauuccagaugugagucaccacacccggccucaccuuaauuuuugaagaacauuuucauuggauauagaauuuuuauuuuuuauuuuaauaauuuauuuuaaaaaaacagaccaggcacaguggcucaugccuauaaucccagcacuuugggaggcagaggcaggaggaucacuugaggccaggaguuugagaccaaccuggccaacauggcaauacucugucucuacaaaaaauacaaaaacuagccgggcuugguggugggcaccugugguuccagcuacucccauggcuugagacgggaggaucaccugaacccagaaggcugaggcugcagugagcugaaauuguaccacugcacuccaaccuaggcaacagaacgagacugucucaaaaaaaaaaaaaaagaaaaggaaaaaagagaugaguucucacuguguugcccaggcuacucucaacuuccugggcugagugguccucccaccugagccucccaaaguguuggauuuacagauguuagccacugcauccaccugggauuuguuaggggugguguagaacagcccuuguugaacaguagaucauccuuauucaugaggucugcuauuucugggucuuacccaaaugccuaggaugacuaguaggguccauuauaguauuauacuacuuccagagucuccauuuaacucucugccaacuagcagcuguucucugcuaguccucagggagucuugacuuguauauccacaauuuaguguuuugucagagauccaaauggaaccuucagggucuuuuauccguaacuacuuccuuucuaguacuucucugcaaauuccaguugcuucacuagcccugaaccaugugcucugucuucuccacccaguaagagagggccucuacugcucuuuguugcaguuuggagaacgucuccaggagagagcugggagaauuuggaguuuaccugcuguguuucuccucauucaaggaucauaaccuuaugcucccuguuguccagugacugaaaacaguugcuucacauauuuuguccaguuacauuguuguuuacagcaaggauagcagcauaagguugauaccuguuauucucaugaccagaacuggaagucuagccuccuuuuaugaaaaugcauucuauuuuaacugaauugccaaacuaguaauuuuuuauaagucauauaauuagcaaaacuuuaggauauuccucaguuuaugauagucuuuucuuaacuuuucguuuaacgccuauguuaaugcaaaccaagcucgagucagucccucaacauccuacacuccuagucgccacaagaggaguuaugaagaugaugacgauauggaccuacagcccaauaagcagaaagaccaacaugcaggugccagacaagcagguagugugugccaacagguuuucucuagacuuugcucucuuacaguagauugguuuucagagugaauuguuacauaauauagcucuauauuuaggagcuggcaauuuaucagaguuacagacauguugagaguuuuuacaguacucugaugagacugugcuucgcaaaugagcaauuaggcaucacuuugugacaaguggcugcucugauguauguguuuggagucucaagugacuaucuggaaaggucuuuucuaucuucauauuuauuuuuaauacagaagccugguacuuuacccuaaaaaugaguuauuuuuaucugaaaacaugcuuucucauuuucuuuuuaauuuucuuguuuguuuguguuuugagacaggguuucacucccaucacccaggcuagagugcaguggcauaaucauggcuuauuguagccuugaccuccugggcucaagugauccccugucacuucaaccugccuaguagcuaaggcuauaggcgcaugccaccacaugcagcuaacuuuuuaaauuuuguguagagaugggaucucacuauguugcccaggcuggucucaaacuccugggcucaggugauccuucuauaucagccucccaaagccauuggcauaacaggcgcgagccaccacgcccaaccagucuuagcuuuuauaagcaguggauuucuuuguuaugguggguauauaaguuugucuuuauauuuguaauauauucgaguuuguaauauauucgaguaugugcuauccacuucccuucagcaccuuuaaucagaaggaaaaauuaaaggacaaggaggcaaaacaaaucagucuggucauuuacuaucugcaagauuggguagagaaggcuuuuuuuuuuuuuuuuuuuuuuuuuuuugagacagaguuucgcucuuguugcaguggcuggauugcaguggcacgaucuuggcucacugcaagcuccaccucuuggguucaagcaauucuccugccucagccuccugaguagcuggaauuacaggcaugcgccaccacgccuggcuaauuuuguauuuuuaguagagacgggguuucuccauguuggucaggcuggucuugagcucccgacaucagaugauccacuugccucggccucccaaaguucugggauuacaggcaugagccacugugccuggccaaggcaaauuuaacagucagugguaaacagggauuuacuaaugaauuuuauuuacccuuauauuacucuacuuuauaaauugauauuuccagauuuucuuaaugcuaagauauauuuuaauguguuuaaaauuggaauguuuuacuauaaauacauauaaaugucguaguauucuuuuucuccaccgauccccagaauauauuaaaauuaauggucuaucaucuagccuggacagcauggcgaaaccccaucucuacuaaaaauacaaaaauuagccaggcaugguggcaggcgccuguaaucccagcuguuugggaggcuaaggcaguagaaucacuugaacccagaggggcggagguugcagugagcugagaucaugccauugcacuccagccagagugacagagagacuccaucucaaauaaauaucauaguaacuuauauauuguaauauauucgaguguguauuuaaguccaggaaauauguuaauucucuuaucacuuaagcaguugaugcuacuuuuuauuucuuaccauucuuguuugaaugucuuaaugcaggcuuuuuaugcauuugaguacuuuauuuauauaaaguaacacuuguugguguuuagucaauguuuuaggcuauacauauuuuuaaacuuuuuauuuugacacaguauagacuuacaugcaguuguaagaaauaauacagagaggcugguugcgguggcucacaccuauaaucccagcccuucaggaggccgaggcaggcacaucacuugaggucaggaguuccagucuggcaaacauggugaaaccccaucucuacuaaaaauacaaaaauuagcugggcaugguggugcacgccuguaaucccagcuacuugggagacugaggcaggagaauugcuugaacccgggaggcgaagguugcagugagcgcugaucgccaccaugcuccagccugggugacagggugagacucugucucaaaaaaaaaaaaaaaaaacagaucuuguauaccuuuuagccucuacuucccccagugguaauaccuuacguaauuauaguagaaugucauaaccaggaaguggauauugauacaaucauuuuuuuuccuuuuuuuuuuuuuuuuuagacggagucuugcucugucacccagacuggagugcaguggugcaaucucugcucacugcaagcuccgccuccuggguucacgccauucuccugccucagccucccgaguagcugggacuacaggcccccaucaccacgccuggcuaauuuuuuguauuuuuaguagagacgggguuucaccguguuagccaggauggucucaaucuccugaccucgugauccaccugccucagccucccaaagugcugggauuacaggcuugagccacugcaccuggccuguucuuugcaguuuuaucgcauagguagauucaugugaccaccaccacaguuaaaaucgggaauauuucauuacccagaucucucauguugcccuuuuaugcuccuaacuaccacucuccugccuccuccguccccagaagucucuagacccuagcaaccacuggucucuucuccaucucuuauaauuuugucauuuuaagaauggaauuguauauuacauaaacuuuggggauugucuuuucuucagcacaauucccuugagauccaucccaauuguugcauguaucaguaguuuguccguuuuauugcugagugguguuucgugguauggcaggcuauaauuugauucucauguuaucagcccuaaaguguaacuacuucaggaguugggguuauucuuuuaaugaccuguauauccccaacaacugguuugauuccugguacauacuggauauuaauaaguauuugguaaauuaauuuauugcuguaugguuuuauucugcuuaauuaauagaaaaaguauguucuaccaaggaguuuugcugucgguagaccauguauuccuuaaaucaaagaugucaaaguaaccauauugcaaaucaacuuuugaaacugguuauacaugagauuugaugggaggaauuuguugauaucuuacaguaagggaaaaaaaaguaaaauuuuuagaucuucauguuuaucuuuguccucuuacagaucaaacaaaagacuuuguuaguaugugcuguuuccuuaaaaacuguaacaacuugaacuuugcaagcucagaagcaucacguauaucaaacuugaaaggcacuuauggaauguucuuuuucuccaggaggccuuagaaaugacuaagugcaaugcuauccuuugaauuuagggaguguugguggucuucaaugguguggagagccaaaacguuuagaaacugaagcuucuacugggcaacagcugaacucucugaacuugucuucuccuuuugauuugaauuuuccauugccaggagagaagggcccugcaugccuugugaagguaauaaaaccuuucguagauccaacacugaaauguuaugugucucagaaaguagcuuagugucugagcauuugcauuuguucccuugugcugggcuagcuauagcaaaucacugcaaauuuaauagccuaaagcagcaaaaguuuaucaucuuacaggcuuuaggucagaaauccaacauggucucacugggguaaacucgaggugccagcagggcuacauuccuuucucggagccccuaagggagaauuuccuuggccuuguggcuccuucuuccauauucauagccagcaacauugcauuugucugaccauuuuuuucauguugacaucucaucugaccacaaccaagaaaguuuccccaauuuuaagaauccgugugauuacauggggcccagccaguuaaucgaggauaaucccccccauuucaagguuauuaauuuaaucacaccugcacauuccuuuugcauguaagcuaacaaguuaaaagaaucgaagaacaucucaaaugcagaagcagaacaacuuuuaaauuaugucuguucccuuccuguaucauuucuaacauaauaucuucuucauuuuugucuucuuccuucucucagcaaaaccuauuuuucacuuauauuuaaaauaaaacagaaggaagaaaacuuuuaauaguuuguucuuccaucuuacuuauucuaguguuuugauccugauaaaugagcaagugauagaagguucagaaaugauuguuaaggauuucuauccuuauucuuugugcauuuuggguuuuuuuguuuuugggggguuuuuuuguuuguuuuuuugaggcagucucacucucuuguccaggcuggugugcaguggcacgaucucggcucacugcaacuucuaccuccuggguucaggcaauucucgugccucagccuccugaguagcugagauuacaggcaugcaccaccacacccagcucguucuuuauauuuuuuguagagaugggguuucacuauguuggccaggcuggucucgaacuccugaccucaagugacccacccaccucagccucccaaaguucugggauuccaggggugagccacugcacccagauucucagugguuuuaacugaaaugacacuuaagucauauggcacagggaccaaaauuaccauuuuuuccccugccuugcuucuaccaggucuaaucaguaaauggccuugacuauuacuaaguccaucaugacagacaauuuugaaagguuuuuuuuuuuuuuuaaauugugaaaaaucuucuggccauuccaaguuuuguguuaauccgauguugcaguuuaugaauaaaugcaaaguuaaucaucuuguuuuuguuuuuuccuuuucuuggugugguuuaauagguuuugagauagugcacaguucuaguuuuaacugucagccuuugggaaaaggcuuuuuuuaauuuuaggaaaagccuuuuuuuuuuguaguacugugguauauugaaaacagacauuagucuggaaguuaggcauccuguguuuugguuuuucacuuauuugcuaacuagcagaaugacucuuggucucaauuuauaaaaauuuauaaaauaaaggacuugcuuuaaggucuguuuccugaucuaaaauuccaagauauugguacuucaagacuaauaucuuaagcuuugugucuguucuaacagugugauuucauguggucucuuguuagguuuaugaagauugggauuguuucaaaguaaaugacauucuugagcuauauggcauacugucuguggauccugugcugaguauacugaauaaugaugaaaggugagucugugugcucuuuuuuuggucuccuuuauuuuuauauaauuucaaguuuucaggagaguuacaggaugguuuuaaagaacucccuuuucccuuucucccagauguaccaguuguaaacacuugcaccccauguguuuugucauucauuugugcucucuaugcacacauuuuucugaaacacuugaaaguauguugcagaaaucaagcccuuuuaccccuaacugcuugucaacauuuccuaagaguacugacuuucucauauauaauuagaguacagguaucaaaacuaggaaauuugccacaaauauacaauacacuaauccacaaucuauacuuaauuucacuaauugucuuaaucauguucuuucuuacacgucucccuucugcaucccccaguccaggguucagaagcucgcucauucucuauuucuacugaguucauacuguauuucugauuccaguucagcaccacaggugucguucugcuuguucuccuuucuguauuaguguaacucucuuaaacuugauucccauuuuucacaaucuuaucauuugcacauuuuuacaacauagagaagggaauuucagaauuguuaacucauaccuuuacaaaacauaaaccuaaauaacuagaguucaaucugaaacaguccucagccuuugucuuucauggucuugccacuuuuuuuuuuuccuuaaacaacagaaauauaugucuuccaguaguucuggaggcugggaaguccaaaaucaaguucccagcagaucugguuucuagugagggcccgcuuccugguuuacagauggcugucuucucacgugguagagagcagacagccuugaugcuuuugaagaguguaagccaguuaccaguuacuuguuuccucaugguuagacucaauguuuugcauuuuuggcaggaauauuacagaauugauguauccucaguauguuacagcaggaggcaugcgaugucaguuugucccuuuacuggugagguuaauuuucauuaguugguuaagguggugacuuccagaugucucuucuguaaaguuacauuucucacuuuguaauugacaaguaacuuggaggaagguacuuggggacauaaauauccaguuucucauuaaacuuucaccaauuuauuuuagcauucauugaugauucuugcuugaaucaguuauuacuuuguuggcaauuuucuaacgcaguacauuuauuuauuggcauucuacuauaaaagauaccucuuccauuuguuuauucaaguaauguauuuacuuauauuuaguauagacuaauagauucugauuuuauucaauguuaauaucauuauuuuauuucgagacccaaauuuucccagauuuggcuagugggagccacuuuaagcaggugccggguccuuuuuuugagaugauguuaucauuuuuuaacauuuauuuucuggcauauuaagcuguugcagcuucaucguaugcuuugaagaucugaguccuagaugugcucguugguacuggauuagauuugcaucuaggcccuuaaaguagacagagcuaggauacaugcagcauauggauacauauauacgcacccacauuuaaaugcacacauacacacucacaugcauguuuuguguauuucuaaugucugugaaaaaccauggguucauauuucugauuccaguucagcacagcaggagucacauguucuaguuguucuccuuucuauauuuaugacuucuuuuucuaacaaauuugauucccauuauucacaaucuguuguuuccccauuucuaccauauacagaagggaauuucagaauugguaacccauaccacuacaaaacagaaaccuaguaauuagaguucaauacauuuccaguucauuuuuauuuuagaaugcagcuguguagucagagcuauguuccacuuacucagguaacuuuucuuccccuucagugugauuucauuauuuauuuuacuuagaaagauucucagaggugucauucucggcuauccccauuccugcugucuguucccacccagccuccuuagggaaccacaguuucugguuuauccuuccuguauuuauuuuuuuacaaaaauaugaagauacguauacauuuuauuucuaccuuuuucuucuauaaaagguaacaugguauauauacucuuacacuuuuuaauuuuuuuuauuaacaacauaucuuggaaaucuagaccuuccucauucauuuuuguuuuguuuugagauugccaaaagcaagggcugaugucccucaucuacaccagaguccucuuguugaauaccggacauuaaucaucuuaguuucuguguaggaugaacuuaacauuuuucacaguuaaaaaaaaaugguacaaaacaaaaauuuuaaacaacuuuaaauaagcuuaaccgucccuuaauaauaguauaugagauuguucaucuuggcaauuucugauugugaugacuuuccugcuuuaguuacuucacuauugauguaguuuaguuuagagguuguauuaggggucucuaaagggucagaacugauaggauagaugaauauaugaaggggaguuuauuaggagaaugacucacaugaucacaagguaaaaucccacaauaggcuggggagcaaggaagccagccugagucccaaaaucucaaaaguagggaagccaccaguguaggcuucaguccguggcugaaggccuaagagcuccuggugaaccacugguguagguccaagaguccaaaagcugaagaacuuggagucugauguuugagggcaggaagcauccagcaugagagaaagguggaggcggaagacucagccagucugcucuuuacaugccugccuuuaugcuggcagcugauuagaugcugcccacccagacugagggugggucugccucucccagcccgcugacucaaauguuaaucuccuuuggcaacacccucacagacacauccaggaacaauaauuuucauccuucaauccagucagauugacaaaguauuaaccaucacagagguuaagagcacagacaggcaggcagccuggguuggaguccugacuuggccacuuacuagcuaugucaccuugggcuugguuuccucauuguaaauaaggguagaugugagguuuuggugaauuuguacguguaaggcauugaacguugucugucacaugguacguacuauggaaaagguuauuaugcuuguauuaaaaaauacaggaguaugaauuuauuacuucagugucuauagauucuauaaagucaagaucuaaaagauuagcuauuuguuuuggucgucucacaaaucuaucaucugcagauuuauuuagcaagucugaaaaauucauacuuucauugcuugucuacucagucuucgagggaucauguaagaauuaaauuuaggaaaaacaauuagcaagauaagagaugaauggauucuccacacgcugaauaauagauaccagauggcuuuugagaaaaagaccccaguuuuugagaucugcugucaaguauucgaugucccggccaauaguucaaggaguaccuguguuuugaaauagccuuaugagugacauccuacauuccauuuauugaagugcugaauaacaaauauuauuguuucuggccaggcaugguggcucacgccuguaaucccagcacuuugagaggccaaggcaggcagaucacuugaggucaggaguucgagaccagccuggccaacauagugaaacccugucucuacuaaaaauacaaaaauuagccaggcaugguggugugcaccuguaaucucagcuacucaggaggcugaggcaugagaaucgcuugaacccaggaggcagagguugcaaugagccaagaucgcaucacugcacuccagccugggcaacacagugagacuccauccaaaaaaaaaauaaaaauaaaaauaccguucuugaaaaauugaauaaaugcauuauuucaugauaugucuuaacaagccugaagucugugugauguaacacuuuagaaugagaggccacuuucuguucuuuaaggagauguacagguggaaauauucuuggcuuuaacucuaauuuuguuuuccaagaugcacauuauuuuugcaucugugcaauugaugucucucuaaauugaaacuuuaucaccucuccacagggaugccucugcacugcuggauccgauggagugcacagacacagcagaggagcagagaguacacaguccuccugcuucauuagugccgagaauucaugugaucuuagcccagaaguugcaacacaucaacccauuauugccugccugccuuaacaaagaggagagcaaaaccuguaaguguaaguguuacagccuagucaacuaucgacuguuagccucaguguguccagagcugccuguaacgugcucauaguggaauugagagucaggucuucauuccucacaauaaguguuuucaguaaucucucucucguugccccauuuuucucuuacauuaauucucuucacugaaaugaggacaaaagaguauacaaggcugggugcaguggcucacgccuguaaucuuagcacuuuaggaggccaagguggguggaucaccugaggucaggaguucgagacuagccuggccaauauagugaaacccuggcucuacuaaaaauacaaaauuagccaggugugguggcgugugccuguaaucccagcuacucgggaggcugaggcaggagaacuggaggcagagguugcggugagcugagauggcaccauugcacuccaggcuaggcaaaaagagcaaaacuuggucucaaaaaaaaaaaaaaggaggaugcaaacugccuuauuuuuaagauuagcaucacuuacugacggauauguuaagcuuuaccuacugucgacugaauugugcuuugcucacguaguuauuuuuuuaccuaagacacuugagaggaacuggaguguguguccugacucaggucuuccuuucuccuucaguuguuucaaguuucauguccgaauugucuccagucagagcagaacuucuuggguuccuuacucaugcccuucugggggauaguuuggcugcugaauaccuuauauuacaucucaucuccacaguguaagugcuguauccuggugggaauuaggggaguuugguguguguggaaguggaagagcgggaagauugcuggugucauuuguguguuuuccuuauugggcuucaucacaugguuuuuaucuguccaguguuaacuguuauaccaaaucacagacaaauuccuuuucucacaguucacauuuagcauuuugauuauguccccuuaaauuuuagagccaaaaucagauaaagcagugguccccaaccuuuuaggcaccaaggacccauuucauggaagaccauuuuuccauggaccggaguggggaugguuucaguaugaaaccguuccaccucagaacaucaggcauuaguuagauucucauagggaacacacagaugugcaguucacaauaggguucgcgcuccugugagagucugaugccacugcugaucugacaggaggcggaacucaggcgguaaugcccacucauccaccccucaccuccuauguuguggcccgguuccuaacaggccaugaaccaguacugguccacggccugggcguuggggaccccugagauaaaggaccuggcugaugaguaaaaugagcuguuuuaucccuuuugcauucugaacgcucuguuuauacaucccaaggcgcccacgucaugugcacguuuaacguggacauugacacuagcaccgcaucccuugacuccacuguauuucuuuguuucucauuuuaaaacuagugugggccuuugacaaguuccaagaacauaaggaggaaaaugcacaucaucuguaauuucaccacuuagaaccuccguuaaccuuuagguacauguucauugguuuuuguuuacauauguauacauccuugcauaggucuuaguuacacucuaagcacagaugcgugucuuguuuucagcaguugauauauauuaaacauuuucccaucauaaugcuucaugaacuuuguaguggcugcaaaguauuucacuaugcaguuguaccauacuguaaccauuucccuaaauguuagcuuuuccuagcuuuucucuauuauaaaguugcaggaaacaucuuugugcuguaaaucuuaucuuuucucaaaucagucugugacaguaguacauaaugguugagagcacaggcucuggaaccaaacuacccggauucauaucccagcucugucagcuuccauuuagaugaacauguugcuuauuaucaucucugugccucggauuucucaucugugaagcaaagacaacagcaccuaccgcugaaugguuagggguuaaaugaggaagcauuuacauacucagaacggucuuuggcacgugaccagcagcacuuacguacaaauauuggcuauuacuuuuauugcuguuauucugauaaaauaacuggucagaauauucugguuuauuuuuaaugacaauauuaagcuaauuuuucuauucuucgcuauuugauagaaaucaggaagucacuucagcaucuuauugauugauuucuuucuuuucuagauauacaagaagagauguccuuccacuaggaaaauuuacaguuaacuugagugguugcccacggaauaguaccuucacagaacacuuguaucgaauuauucaacaucuuguuccagcaguaagaugaauauaaauauguauuauaaaccuaagcacacuuaaaaaauccaucuaacugucuuucauucacuucaaauauuuaacuuagagauuuuaauagaucuuauuuaaggggaaacaaagccugccaaauuacauaauuuaaaauguacguuccccuaaacauuucacuuuuuuuugucuuuuugccuaagcacaaauuucuguaagucuaacaaaacaauuguaguaacucccuuaaaauuacacucucuugauaccaauuuguccaauuugguauccuuuuuguacacuaaagucuuaaaucuaaauaaacucuaaauuguaggagcauaauucuuuuaguugagguaauaaaguucuuuaucuccauugccucaauuuuaauuccuguuuggaaaguugagcucacuuuauuugccaggguaucuggaaugcaguauuugcguggugguaggaucuugggaacaggggaauugcuucugauuaguugugugacugaaaauacugaucacuucuuuggaaauugaagagggugcacuagaucuuuauugaaccgaauguauucagugucucagugcuaacacucguccaggcccucaagaagcagaaguggacuggaauauaccagcaguucucagucuccuuagacucacuuuacacucugaaaaauguguucauacucaaagagcuguuuuucacguuaugauuauauuuaucauuaauuuaccaaacuagaagauaaaguaaauacaccuauuaaaaauaaaaaauuacauauaaauauuuuuauaaaaacaacuuuucccaagccaaaaaugauuagugauaaaggugacauuguuuuacauucuugcaaaucucuucaaugucuggauuaauaggagacaauggaugcuuguaucugcuucugccuucagucuauuguagucucagguuuugguugaaguauaugaaggaaagcuggccucacacagauggaaaaguagaugguaaaggaaggaugguuucgauagccuuugcagauaacugggugguggucuuugauacuagaccaaaacuguccacaugagauuuucuuaaagauaguuaaguguggaaucugaaauccuauucguaaacuuuccauagucugcuaugguaaaauucauuagucucgcacauugaaaggaucuuuuauccaugcaugauuuugaccugauugacccuguaaaaggguuuaagcaauucccuggggguucucgggaccacauuuugagaauuauugaaacagauccuuugcccucacagaguuuagguagaagaccaacaaauaaauuaauacaugguaggucauuuaagcaccccuaagcuccccguuuucuuagaaucacugagguaauacacaaaacuccucuaaauuuucgcaauauaucuuaccucuuccuugacagccuucccccaccauacccucuucuccaucccugccacauuguuugaggcuggagggauggaagaauggauugguguauaaggcagagcacagaggguguugggaaugguggcucaagagcuggaggaggagcauagaugguucgcuuacucguuaaacacugagugagaaggugcucgcguccuggaggcaccuccugagagcugcagguccauccacagcucagugugcucugcuccuugauuuuucucugaaaaguuuguucaaaaaugucuaugauaaaugaauacaauuuuaacucaaagaauauagaggaaaauuaagcuuuucucucccugucuugaagaguaaaauuaacauuuucuuuuugcuagcuagcuuguguuaggugaaagagguuagguuuugggguauuuaauauuuauaugucaguuaucuaccauuuguuucauugguuaaauuaaaauugauuuucaagaauauugaacaagacauuugagaauaaaguagcucauaaaauggaugaaauucaaauguaagaucuagauacuauuuuugcuucuggaguucaagaaaccauaucacuacucccuuagaaauuuauaagaucacuuuuuccauaugaaacacaauguuuaauuccaaguacauauuuucuuaaaacagggaaacuuaaauucuuguucacuaaaaaauuucucuuugcagucuuuucgucugcagaugacuauagagaacaugaaccauuugaaauucauuccccacaaagacuacacagccaaucgcuuggucagugggcuccuccagcugcccagcaauacuucccuuguaaucgaugagacucuccuggaacaggggcagcuggauaccccagguacguacauagauguuucucuuccauuucugacuuccuucgcacuaaagccagaucuaggaauaacuuuuagaagaguaucuauggacaaauucacauuuaacaacguaagauaaaggcuuggcauaugaauuugauuaaagcauauguuauaaacuaauuauauacaccaacuauguuuugccauaguauucugaaaguaguacaauggaacagauauauaucuuauauaauauaucuuauauaauauauaucauauauaauauauaaugucucauuuaauauauaucauauauuauauauuuuauauauuauauaauggagcaauaauauaaaggguaguauuaguauaauggagcaguaauauaaaggguaguauuagauguugagggucguaaggguucuuuggugaaaaguuuuauugugucagcgaaugguuggagcagucuuuaugggccuacaguguuggguucuuuugcguaguuguauauaaccuaaaauuuuuuuuucagugaguguaaggaaugguagagacagggucucgcuauguugcccagcugaucuugaauuccugggcucaagugauccuccugccuuggccucccacagugcugggauuacaggugugagccacugcaccugccccaaauagcuuuuuaaaaagcugaaaugggaggaagcuuugccuuuagucaucuaauaccucaaaagggaaguguagaaaagaucuaauauaauuuuuuuuuuguuuugagacggagucuugcucugucgcccaggcuggagugcaguggccaaucuuggcucacugcaaccuccaacucccggguucacaccauucuccugccucagccucccgaguagcugggacuacaggcacccgccaucacgccuggcuaauuauguuuuaaccucccguuguaaaguuuguaaaugguuuucagagaaugucugagaaauaauagaucaaaugguuugcacuaaccucaguugcggaauauauuauaaaaucacaagaaagcagauuguuuaccagugcucaaaugaagacaauuaagaauacacugcuggcgaucagcucaagagguaaagguagaagaaaaaaugagguagacugggcauguuuaaggcaaaggggaauauaaaaucuguaaaauucacuaggcugaucuauguaugacgguaguuuuaguguuuccuugguuuagcccuguaaauacaccacuuagaaauaaucauacuugggaacuauuuuaugucuaggugcauaccagaugcuagguauuagauuugcggggguaucgccugcccccagaaaguucuaccuugaccaagacuguuguaagccuacacacuuagugacguuuagcuuaguaaacuggacagcgccucauacccuuuauuaaaagugguagaaacuucauggcucaucaucggugucagcaaaacugauguguuuagaugauuaaagucaaaugacugaaaguguuuuccugccuuuguagguguucauaaugugacagcccugagcaaccucauaacguggcagaagguggauuaugacuucagcuaccaucagauggaauuccccugcaauauuaacguuuucauuacuucggaggggaggucacuccucccgguaugaugagucauuuuuaaauggagggagguugacauuggaaaaauaccuacauuuuugcuguuucuugguaccgcuuauuaauaaguuacauuuguuguaaaaaaaaaaaaaaaaaaaaaaaaaaaaaaaaaaaaacugugacugcugaucauuaagggaauugaguauuuugcacugccauggaugaaaaccuuacaucuaccaagcucagguaucagcaagucaugagaccagcaaggcuguuggcagcagaaacacccacaucugagcauagcgagauugccugauuuuaacauccagacuucuguucuugcuaccuuugacccauuguuuucugcuaaucuuaugugaaaaauauuucagaguucuuuuaaaauguccuuggucacuugguaguuauuuucaugcuuuguggugaaaugcucugguaugucuucagaguggcugguaaagagagcuuuuaauucuguggaugaugggaaaugcucccaguugucaaaugguguguagucucugaauaauaguauucaccugcgauugaugagaaaccgccuuugacuaagaaugaaauggcucaaggauauguuuucugugugcaaguauugauagaccuuuuuaauuagcugcuuuuuagagguuggcuacauuuuugugugcuuacugauaccauugaggaaacauaaguaaccaagaaaaagcuuucauaauuauuucugagguaguuauaaagcauguaaauuaauauuaaaaauagaugcucacuggcugcgguggcucacgccuguaauccuagcacuuugggaggccaaggcagguggauugcgugagcccagaacuuugaggccagccuggacaacaugacgaaacuugucucuacaaaaaauccaaaauuagucaggcaugguggcgugcaccuguggucccacuacugaggaggcugaggugggaggaucacuugagccugggaagcagguugcagugagcugcaaucacaccacugcacuccagccugggugacaggacaaaacccugucucacacacagaaaaaaaaacauuauucccucccccuaaauaauaagugguauuuucuaauucccauaggggcugacagagaugaugcaucuuucuuuaaaaauguagauuaauuuaggaacucagaaaauacaguguacuccuucucuuuucaggcagacugccagauucacuuacagccccagcuaauuccaccaaacauggaggaguacaugaacagccuucucucagcggugcugccuuccgugcugaacaaauuccgcauuuaucuaacucuuuugagauucuuggaauauagcauaucugaugaaauaaccaagguaugucuagguuaaaauaaaggauuucccuguguugaauugcaguaugcaaccaauuuacauuuaccauaauuacugauaagguaauuuuguuauuuguuuucugucaugucuuuuuuuauuccucuguuacuccauuauugucuuuuuguuugaaauagguauuuuccagugucccauuuuaaucccuugaaguuucuuaaaguuauuuucuuaguaguugucuuugggggauaaacuuaacauguuaguauaaucaucuauuagggauuaaugccaguuuguuuaguuauuuuuaauuuaaaaaaaauuuguguggcuaaugccauuuuaauuauauuauacaaagacuuugccccuuuauaauuccguuccuucuccucucccuugugcuccugucauacaauuaccucucaguacauuguauguccaucaacacauuuagaauuacugcuuuugcaguugucuuuuagagaaaaaaguuagaaauggaaaagacuucuguacuauuuuuucuauuugccuaugcaaucacuuuuaccagcacccuuuauuuccucauguggguucauguuacugucuaguaucuuuucauuucagccugaagaacugucuuuaguguuucuugcauggcaggucuacuugugcaaauucuuuuuuuuuuuuuuuuuuuuuuuugagacagggucucgcugugucauccaggcuagagugcaguguugugaucauggcucacugcagccucaacccccccagguucaagcgauccucccacuucagccuccugaguaguugggaccacaggcaugugccacugugcccagcuaauucuuuguuuuuuggguuuuuuuguuuuguuuggguguguguguguguuugugugugugcagauaggggaucucuuuauguugcccaggcuagucucgaacuccuggguucaagugauccucucuccuuagccucccgaaauucuggaauuagaggugugagcuaccucgcccagcccucuuuuaaguuuuuguuuaucugggaaugucuuaauuucuccuuaaggcuaguuuugcuggauguagaauucuugguuuauagucuuugucucaucauuucgaauauguccucccaccacuuucuggccucugguuucuacugagaagccaacuaguuucugauaaggauccuuuguacacacugagucauuuuucugucacugcuuucaagauuuuguggcuuuugacaguuucgauuaugaugugucuauguguggaucucugaguuuauccuacauggaguuuguugagcuucuuggaggugcagaauaauucauauuuuggggaaguuuucaacaaguuugggaagguuuuggccauguuucuuucugccucauuucucucugcucuccuucugacacuaccacuguguaucugauguugcauuuaaugguaucccacaggucuucaaggcucuguucauuuucccucauucuucuuuuuuuguucuguuucuuagacuaaucucagugaacuuaucuucaaauuuagugauuuucuucugccugaucaaaucugagcaccucuagagaauuuuuacuauauuuuucaacuccagaauuuuuauuuccuucuucuaaaaaauuauuucucucuuuuuauugauacucucuauuuggugauucucauauuuuccugaaguucuuuuuaugugguuuccuuuauuucuuugaauguuuaaaauagccaauuuagagucuuuuugucuaauguuugaguuuccucugggacaguuuucuacugacucccuuauccccaaagugugagccauaccuucugguuucuuuguacuuuuuuguugaaaaccagacauuuuauuuggucaguggggucucacuguaucacccaggcuggaauaguaaguagcacagccacagcucacugcagccuuaaacugcugggcucaagugauccucuugccucaguagcugggaccauaggugugcaccaccaugcccaacuaaaguuuuguuuuuuuguuuuuucuuuucuuuuuuuuucuuucuuuuuuuuuuuguagugaugaggucuugcuuuauugccuaggcuggucaacuccuggcuucaaguaguccucccaccuuggccucccaauguguugggauuacagguguaagccaccacaucuagccacaaccagacauuuuaaauuauauaauauggcaacucugcuuuggaaguuacucuggaaauuaaaccucccuaggguuuauuguuguugcuguuuguuacuguugguagguuguuuaguaacuuuuuugacuaauucuauaaagucuguaucuuugucacaugugggcacugaagucucugcucuguuaguuuugugguuaaugauuggaaagaaauuuccuuaaaugcuggguaguagucucccagucuacgggugaauaauaaucauaaauaaaaauaaaaguuggggcaagcccucaguucaacacuuagccaugcaauuuacaagccuuagccuucauuuccugcucgcacagagccuccaggucaugcagaggugggagcuauggucucugagcaugucugcagccuucugaguuccuaggaguuacauacuuaagguuuucagagcccucuacagacaugucauuucccagcuagcuuuuccauugaaggguuuggguuagucugucugccgcagcuguuacccagugucucagguagcuaaggugauugguaauuucuuccgauuguuuuugauaaaugcccuggggaaagaggugguucauaguagacaggcuuccagucagguuaaauaaagacaaccuugcaaauggguccuuccagggagccaccagacagguggucagaugacaguucuccgggaauggcacuuggaaggagcccuagcccuguucucucuccgguggcugccaggcuguugauuuuugaagcuacuaauuaucgccuggaggggaagggguuggaauuuaggaguaggacauguuaaaaugcugccaggcucaacauucuuaccaauaaucaccugguuuucuugcauaaaugcucucuggauugcugcaaguaugguuuuauuucuaguuuuuaaaaagcugauuuugaucaguguuaacaguagagacaguuuucugcggucccuucucugccauuuucacuaacaucacucuuccuuuguggaaaagcauuguuuccuaugccaguugcugauuuauauguuugcuugaccuuaaaugaaucugaguuucauuauuuuauuuucaucagcagcauuauguauguauaugcuuugguacuuucacccauauugccuccuuugucuaagaggcugacaugcaccuuacuacaucagucaaggaaccauguuaauuuucuuuuccuuacaaaaaugcacaucauuuacauuuacucuuuugauaaaggcaguugaagaugacuuuguggaaaugcggaagaacgacccucagagcaucacugcugaugaucuucaccagcugcucgugguggcucgguaaguggcgcacguccauuauugcuguuucgguaagcuuguguauaugucuucugaguuauucagcaguaacugaggcagaauucuaaaaacggaaaugaacuuuuccuuuuaaaaacgcuguaugaaagggcucauugagggggaaucgaguuuggcuggugaucucuucaguggaacaggcaugcugcuuguucucuaagcuucaaagagugagccacuuuccaauucugacucuucaacgauuucuuuuuagaagccuaacuuggcuguugacuuguguguaacuaccauacggucuugucuccuaacgugcucuguguuuucacaaaguauuccuaggucuuaaaaaaaauuuaaaacuuacuaucccagcucuagacuuaaauuuguuucuguguuucaaaccaggugucugucucucagugcuggucagacaacgcugucaagagaacgauggcugagagcaaagcagcuagagucuuuaagaagaacgaggcuucagcagcaaaaaugugugaauggaaaugaacuuuaaagauguaauaccuaugaagaguaaugggcaaacuguagccacauaauuguaaaauucagauauucauuuauaccacauuguuuuauagguaauuucuaucacaaaccagugacauuuccugaaaucaagccugguaacaccugauguuuauaugauauucaguaaggacuuuuaccuuacugauuucauggagcuuuugaaguuuguuuuauaauaauuauauaaauuaguaaugauguaaaaaaaguauuugauauuaaaaguuuaauauugauaauguugcugauuguaccauuuccuuagcuucagcugagucauaggccagacuguugaaaugcugaaaugaagaagguuguugcaguuucaaagucagaggaaucgugcuucggauuucuuauguuuucuaguucucuguuuuuccaguucacaguggguuggggugcauucaguaguccaucuuuggggaacggaggcguacuugccauugauucacaugacuacaugaaauucuguacugucauuucccagauguuuggccacagaaacuuuuucccacuuaacauuuguuaacagccugcaaaacuaaacuuguacauggcagugguucccagacuuuuguauuuuauggaccgguaguaauauuuccaaaaaucugggguacuauaagguugccaauuuaccuugccaaguaauccgaauaaaucacuguauuaucaccauuuuuuucauaaaaggaaaggacaaucuaucucugaauaagaggaguccuuuaaacggaaugaauguggcuuuugggggcaaaagaaaccaagacacuacauugucuuuauuuucuccuaucccagugcauuugagaaccaugcauaagggaaugcugugcuacaaagcugugcccaaauaugaaaacaaaauaggaaacuuaaaaagcaauacccccuuuagaaaguuuuuauuuucuuaaaugucauugaguugcuuugauucuauuggauuuuuggcauuuuuuaugggaucaucaguugguuccaaguauguuagaucagcuaacaucugcuacuccaguaacagccucguacaacugcagguagguuuucuccagaccaauuaguuuuaauagagcaaacuaacaacagacuguaguagcaugguuauggcaaccagaaucuucagaaagguuaggacauuacuuuuuaagcugucagugguaucaaauaacuuaccuaguuggaggcagauaaaggaucccuuacguuuuuuccuauaaggccuaaauugaaauuguuaaccaaggaaacagggucagccuugaaaaaucaaggaauucauuguaccuaauaacugaaguaaaaauaacuaguuguucaacuuuuccuaaacucaaaucuauuuuuauaaacaaauguaaauaauguuuauauuagaguugaacugguuuucauuuuuauaacugguagacuagaccuuccuuaaacuuuuagaaauaaaaugaaggcuucacuggauuugugaggauaaaauacauuuucuuuaauuguccuagagcaaaguacauuagucaccauguguuuuuugugccaauguaaauuguaauuuaccaaagaaaaauacauacauugcuuggucuugcagaaaaguucccuugaaagaaccuuuccaauaaauaaaacgucccaaauuagcaguaccuugggcuguuuuucaugaguaagaagauucaccaucccaugugaucuguguggaaaaagaccauguccucuugguggaagacaugagagagcugaacugaaguggaggagguggugcaagagggaccuuccugcucaaggcccgcccaggcagcggaauggagugcagugcuuggcugcagaaacccuuugucccucaccuauauauacacggacagucaaguuuguugcucuaacguaaggcacagcguuaauccuguauggccaggaaacugaguagacuccuguguaacccuguuuggaacuuugccuucuuaaaaugauuuuuc

SEQ ID NO: 191808 - RNA, 173207 nt, Homo sapiens
gaggagugagcgagcggcgacccucaccucgccucccgccuagcuccugcgcagccagcggguaccgggagcugcggccagcgccgcuucuuuccuuuccuuuucucuccguuuuccuucuccuuccccggaggagaaaacaaauaaagaagagcaaauagccgggaggcgcucggcauccaggacguucccucccccgauccaaguuggaauuagcauccucucgggggugagcgcggcgcggggcgggcccgggccggggacccccagcgcagcccccucucggcgggcgggagggcgcggggccgggacgcggggggaauugggaaccgggugggcggaggaagggggugggguggguggggaaguaggaagaggcucggcggcgaggggaggagguggaagggaagggagggguaggguggggaggggaggggagcggagggaggguggggagggcgggagggggaggggcggggagcuggagagauuaaguuuuugugugugugucccugugugcgugugucauuuuaagguggcucgggagcggcccggaggagccggcggcggcccgaggagcgagggaccgaaccgggagccaugccgcgcugagggggggccgcacagccgccgccaccgccaccgccgccggguggggugggaggggcgggagacgccgccgccgccgccuccagggugggcgccuuucgccguggacgccgaccguccgggacgagguaaggggggccccgggggagggcuggggccgccgccgcccccgccucaccugcggccgcgggcugggggcgccgcgcccgcgccucacugcgccacucagggaggaggaggaggaggaggaagagggcgaaggacgcggagccggcauccgaggacaucuuugguccgugcccccggccucguguccccccucggcgcccggggguggacgcuggcucggggguccccgcccgcccccgccaccgauugcgcccgcuggccgccguuugcgccaggauuuuuguuguugugaugagaguugaugaaugcgaaguaggcggucaccuuccuucccaucaggguugaaaaaaaaaaaaaaagaaaccccgagcgcggcggcguccggagggcagcggcggcggcggcggcggcgucucggcgacgguucccugggcgcccccggcuccugcucccugagcccggugggugcgcgcccgggggccgccggcgacccaggccgagcgcgcgacgcgccgcggggacaauacggccggaucuccggggaacaggaguccgagcgcgccggggugcggcgggccuugcgccuacgaggcgaggguggggggggcgcggagaagagggguuccguggggaagucggggcgugagcggcucucgguccccaggggcgcugccccugccggcgggggaucccgcgcggcuccccgggagcgcaagugaaagacgggaaaggaggcgaaguggaacccuuuuguuuugccggccccgcauuguuggcuccuccgggcagccgggccacaucugcugccgcugccgccgccgccacugccgcgcggggcucggcccgccaaagucgcggcggggcggggggccugggcgggccgggcggcgggcgcgggcgggggccgggcgggccgggcauuuccucugcccggccgcgcucccgcgggcaccacuuccuccucgcccgccgccgccgggagcccggcccgcccgccucccccaccuuccccgcccgggccgcacuuuucggguggggcgaaucaaaaagaaaaaguuuagcaggaggggcuggcuagggcgcgccccgggcggcagggacccggugcggcgcagggacagccgggccgccgcgguuccuccuccucccagcccuccgcggcgccggacggccccgcgcggccgaggggaagcgccuuucuuucucucccucgcgcugcccccagcgccccgggcgaguugggcagaggcgcgcgggagccggggcgugccugggccuuucucccgcgggaggcccagcggcguggcgggucgccugcagcccacgccgcgcccuggggcucggaggccgcgggcccaagagcucagcucggucaccgcgggccgcgccgagacacacacgcgcgcacacacucccucccguggcucgcuuuccgccggcgacgacggucgcggacacggagugagcgugugcgcgcgaguguuugugguuguccccccuccccccgcccgguacuuuuuccggaggcggcccaagcggcaguuggcugcagaggaccccacguuuaggauuuuauagggaagaggaggaauuuuucguagaaauccccgcucugcgugcucgugguggaggcugcuggcaauggccuacgucgucauaccgggcuuccuugcccuguccgggguaaacaauccuucuguguauuuacccccuuuuuucuuuaaagauuggagaucggguuaaguucuuagagagucugaugcgaguggcuggaaggauagacaagagaauucuauucuauaaauaugcauugggaauuuaaaaugcuaaacgccuuauuugcaauucuguuggauauucuagagacugguauauuuuuaucugacauggauaauuuugaggggacguuauauuuuggggaaguuuacaaagugauucuuucugccuuucuaacuugggcgaaauauaucgacucauaccacccuuucaaaaaagauagcuuucucuacuagguguuuggguucgaagacaguuuaaaaauuaccucguguucaguaccuaagauugcuguuuugccucgaggguuuuccaaguagaaguggguaguuuucauguacuuugagaauucugagguuuuuaaccccccccuuuuuuuuuaaauauaaaucuuuucuauuuugaaguaaugagacuuuaaaggaucuuguuuuuguaaucacuugauuucaaaggauacuucuuacagcaauuauaaaguaauagucaaaaugcuaauuagacauuuucagucauagcugcuuuaauguugaaacagaauuuuuuucuuuagcagagacuguaucguagaguugaaacgcuaaauauucuuuugucuggcaucagaucucugaacugcucugacauucuccugaaaaaccccuagugcccuuuuuauugcccccaaaagaaaaguuaaugagaugguagauuucaagcaaaaaaacaggcccucuuucuugcaaaauaugcuuacaguugccauugaaguuggauguuagccgugaaugcacuugccuuuaaugaaaccaguuuaaucguucacacuugaucaaguauaacaugagcaaacaaaggaaauaagccagcauauuucuguagaguguaaguguugauguugggucacccccucccccuacccugccccccuguaaaagggagagaggguugaaggcaaagggaauuuauggcgcugauugguuuuuugugccccagggguaggggaccccaguuacaucccuguggaaagcaguuauuagagggaauuaaaagaucuuggguuuggagcuuguuuugaaccugacuaggugguuuggguuuaauucuuuuuccuguucagaaagauaagguaaagaauaccgacucccccccgcucuuuuuuuuuuuuuaacccccaccugacaacccccucucuaauuguaccuuaauaagagucugcagguugaaugcagaacccugugaguuauuuacgguuucgccugggagcuuugaaacugacccuugaauggguguucuccugcggggaggggcagggugaauuaccuuuucuuaacugauuuuaaaaagccucauugucccuaaaaaucauuuccuugcacgaguugcaauuuauguguggaacugaaucaucaauuccgugaagagaaagauauucguaaaguacaucucucuaaaguuaagaaaguaagaacguuuggcuaguuaaaaacaaacacuacugccauuguaaaaaacacgccagugacauacuuggugagauauuuuggccuuuugagagucggggcacaccuguuccugucccugccaaguugugugugcuuucccugccauuguuaaucuggucguguacacaagaugaaacgguaaaacuugcuaucuguauaauuauuaacuaguuugucaguuacccuuucagagaauaaucaauaacuucagucuuaacuuuuaaaacuccagaaauuuuacuuuuuaagucuggaaaauguuucaaagagagauuaaaugaaacaaacaaacagcaacaacaaacaacaaaaccagaaaaucaaccuacaacuuuuuaguuucugaguagccagcuacaaggcaaagaaaugaugaauauauauaguauguacugaacaagcagugcacuggauuuuaaaaugauauuuuuauuguuaccauugcuguuaaaauacaaacagcucacacuauuugaaauccuugagauucacggauugaaaaaaaaccgaaaaggacaccucugagugagggaguagcccugcugagaucuagcaccagaaugccauuugccaacaguucacuaacaucaugaaucauuuuugaaagcaaaguuauacccuuugcacuuaacgcuuucccuaaauggaaaaaauuuaaagaguuuacagcaaugguagaauggcagccccaguugucauuuuuuuaccacugucauuuccauagagaggggcugucaucauaauguaugugcaugcagccugggucccucuguuaaucuaucagggaaaagcagcagcccuaguguccuguggcccugaaucaggccacaaauauauauucauacagcacaugguugggaagggaaauuuaucaguugggcagggcacagcucagguaauauuuccacuuugggaugguaggucuguuacacaggguggaacauauuuuuguaguaacuaaaaaaugggagggcagugugucugucccuggaaaaagaaguauuuguacuuaauggaagugacccauguggugaaaucucggggugucuuuuccccagcaaucuuucuaugaauugcuaggggaggaaugcuugugugaacuuacccugcugaaaacuuuuagugggcacaugaaaugcuggaauggauacacuuuuagagacugugcggccuggcagauaucaguuuucucccuuacagcugguaagcaugucuuaauuuacgcugcugcaaguuaaaguuacagcacuccuggaaagaagggaaaaugcaaggcuucuccuccccaccucaucuuuugaaguuaauuuucauucaagucuguguuugauggaauauguaucaaagacuuaugaaagaguuuuuuuuuuuuuaauccuaucuugggguuuggaaaauuauauuuaauaauugcuaaaaacuuaagaaccauuuuaaagguguucaguggcccuuuugaucaugauuuaauggagaguauccaaaagccaucagugugacucuaaugauauucacaaauuaauguuugggcauaaucuggaguuugcuuuuagcuaucauuauuaauguuuaaagccuaaauuauggcugcacuugggcauucagaacuucgccugugaaaagaagggcuuugcacauuguguaaaaaaaaaaaggggggauucacaaaugaauacagaauguacaauagggagagagccaggccauuguuuguguggaauguugaccaugggagccaagggcuaguuucgccuucauucuucugacugcuggagaacacagaaacuucaggagcuguggacgggaugggaaccaggggcacauucauccgucuuugccgggcauggagauuuggccugcccccuuuccagaguuuuucuuagaagguggucuuuucuggacugcuaaggaacgucgugugcuuucucuucucaguaaucugcuuuuuugaggaacgauuuuaacggcagauaguaagaguuccucaaggaaaguaaacagaccuuuucuacccccucgaaaugugauuuuaggaaaugauauucaacuucagaaaggaggcaucuuaagucacaggaggaaguuguguuuauuuuuacuccucuccugacuuuaaaguaguuuuuaaucuguugguagcauuagggagaaugcagcuaaaauaaguuuuugcuggauguucauguuuugcguagcugcugccauuucggaaaaagcuccucccccauucacaaagcccuucuccuuccacgugggagccgaggucccaaaguggaaccaacucuguagcuuaagggaggugcauuccuggccccucacuuucuaacccucaccuuaaguggaauauguagauaauauguagaucauuaaccauuguuggugucugaagccuguucaguuuuuuuagcaacgacacucggugagaaccaguuguaguuugcauguguauaugccuagucccucccucagugaauguuuuagaaagugaucugcuuuagcuguuuaccuaacuaaauuuaacagaugguugccuagaguuggcuuaauauucacaaaaauugugaugaaaugguugggaucuuaugaaugggacaagugaugauuuuguuucuauagagaauugugacuuuuguccuagguaauaauagagacuucguuuuucccaaagaucgguugguguuuaaaggaugggaacccugaauagcugcuguugucugccccugauccuggugguggccagccuugccuuugguuuuguugccuucugugaguccagaaaagcccuggaggcaggggugaggggggagagggagggcugggcuuuucauccgugggguucuaaaaauccuucucauuuauaaaauacaaaaauacuuaccuuccauuguauugcugauuugugcuuccuccaaagcucuccucugaucagcagaaaugugcuucuugcauuaaaacaaauccuuaauuaugacuaaaagaaacugucagcugccuuaaagauugucuggaaauaguggcaauauuucugugucucauuccagcccacguuguggcagaagccuggaagggccacguuaaaggaugugucacagagacaguguguguaggucuuccugcagcacaagcaagcucagggcuuguaaaguccagcuuaucguggcugugcuccagccaugccugaaaucuggccuccagcaaucugucccgucccaggacaaacaaaaacuuuauuauggagucauggaaccugaggaaguuucucuggaaggaaccgaagaccuagaccguggagggagaucaacuccucuggccuaauggggcuuuucuuuuuccaagauggaauuuaaaaaucucaucuauaaaaugaggcuagcaaagaaucauuuuaugguguaaguggccagaaucuaaccuggaagugauaguauuguaccugccgcagguguguguguggcagcgggaggguggagaggggaaaugagaggagaagaguuuggaggggaaaacagagcauucgagguuucucugcuggagggggugaaaggccaggaguuugugcaccuuuccuuuuaaaugagcucuagcugugaguuuauuauuuugcugauggauggucuuucgugcagucuagaagugcaaacacagucggcuuauccgcugcuuguucagguccagggagaccaagggaacgggugggggcagugcuugcaaauccaucuggauccuggacaccccacuugguguugcugcagccagcucccaggccugcccaccuggaguacagccagcgccagcagcgggcagggcccgagagagcucuuaaagccaugucccaggaacgguugagggaacugagaauguucagccuggaguggagacaccccugggaagcccaacauuguccucugugcggucauguggccuuacucugcucggaacagggaggccuugcuguuggagcugccgggccagaugggcugcgugggcuccuggcacaggcagaacuuggcugaccauuggcucccagugccagccaaggcucugcaaacacccgagacccugauggagacucaggcuuugggagcaccuccuaaugagcuggggaggauacuguguuuucuucccaguggggggugaccaauaaucuuaaaguuuuuucccuuucuccagacguucagcugugguccgcacucuggauugcucuaucugcccugcggacuggauagaggcucagcguagaugcccagcugaccugacauuuccuacccauauuuccuaguguuucaggagcaggcagagacagaccugauuccuuuaucucggggcuuucagauuacggaauagaagucacacuaggagggcaaucaauaaagaguauauuuugcuguacagauaccaauaugcacauauaagugccuacaaguaaaaucugggaauguuuuugaucuuaaaaacauuucacagucauuaaucuucacgacgcuccugcgggcuggguaaauagagcaauuccuauuuuaugccaggaagaaauauugaauugccucccccaagucauaaagaggcuguuuuuccuccuuguuccugugacucgcgguguggggggccuggggcgccuggaaccccugcgauccgcucagacugacuccaggacgacuuccgguguccugcgcgaccuucuguugcggggagcgccaguccgccacaccuggccgcgcucuaccuggagggggcggggucuccugcauuucccggaccgcgggggugccccacccugcugcaaggacgggccuccuggcguccgggcuucuggggucccggggucccgggguuccuggcucccgagccccaggugaagcccccuccaucccugggguucgccccucuccucccggcggguggaccuggaggccccgcccccgcgggccagaacaccuggcggcgcggccccgccccagcugugcccucuuccccccgcagggcacuuggcggccccacccuggccccuccgcgggccgcgguaucugacacccccgggcccccccaccucgcgccucgccuuuacacuuguaaauggagccgcuucccgccgcggggaagucguugagaggugugagaaugggcccugcccccuccccccgcuccgugcccacuuccuccuuccucccgcuggccuuugugcugggcggggccgcucggacccggggcggcggggguccagcuagacgccgccucaagccagcagggucgccggccccucuccgguccgcgaggccccggcaagguaggagccucgagaccacgcgggacaccagguuggcccccagcccgcacucgaggcucagagcaggggcggggaccugguugcaccaggccagagccgccuccaccccgcagcggucgcggacuccgggcacucauggggacuccuggggucguggugaguggugagguucguugauugacugcgcgaugguggcugaguugcaagcaaacgguaaacagcggcaucauuuccacuugaccggcuugggaucucgucuccugggcaguguuugggggugaccacgguucuuggauaaccuucgaaucuggguguuuuccuuguaguacaaauagcgcaguggcaguugcugugggaaacagcgagggccacugagaccuucagcagaacuccacgucgaggacgagugacauuugcgcgccucugcugcguucucugcuguucaccccggcggcucccaacaccugaagccuggcgaggcaugugacuagagguuguccgagcgcagagugguaggacggugcgaucuggcccguuucgucuugcccucgucuucuccauggaggaauuucuguguucgccucuauguuuugcagacuuaauuuggugcuccagaaacuuaugcagccauucaagugcgcucuaccuguuauucaaguaacuagagagcaaccauuucuugagcacuuacuuagugucuggcacuagcucgcugggccauuguguguuguugcguugcccugacucuucauugguaaaacagugacuaacuaucaccugugccucugcgaggacagcgcugugcuuggccagggcuggagagccgaucucaaggcaggugucuggccuuuuccuggacauagugagucugugauccagagucugacccacguauucaacggggccugccucaggcuuccaaacaggagccaggcuguugugaauauucacuccaaaagugcagugaauguaaaacauccuagagcaggaagugaggcaggccccguugaauacgugggucagacucuggaucacagacucacuauguccgggaaaaggccagacaccugccuugagaucggcucuccagcccuggccaagcacagcgcuguccucgcagaggcacaggugauaguuagucacuguuuuaccaaugaagagucagggccagggagcuuagguaauuaagucuggcuaguuacuaccaacuucgccuggcucuggcuucucuguggcugaccgaggcuucuuguggccuuugacugggacacgggaaugucuggggauggcuuugccacacuaaccaagacuagacuccuucuuuccucccaagcuguuucucccuugcccucaucugugugucucugaugcagcaccaccccacacuccaagaaugcaugggcacacucuccugggguuauguguguagcuuucacagugcuuaggguuucaugugguaaaauuggauuuaguggccagguaucauuucaucaauagguaagaccauguuuguggucugggauagugugaucucaguugcccuccaccccccaucucccucgagggagggcuuggguccaugggaugcaccccuccccaacucugguugccucuggcauucaacuggagccaugugcacaccugaaauaggaucugguuuguggguuccacguuggggaguugggggucaagagacagggaagaugcuuaggauuucuccuaacugugauagucuguuugcaccacuccugugaaaaccagggagaaacuagguuuugccgggugaacuuccuuugggucgcuccccugcauccguguggugugggccuuagaaaggaauuugaauuaauacuccugaacaaagggaacagccuucuuuucaaagaggcuaucagagaacugacagggaauggcacagaguugggugugucuucaaauccagagaccagccccgcuccaccggaagaguacccggagcaggugaugcgggagcucccagguugaccuuggcuuuccauagaggguaagguccccacaaggugaagguuuuccugaaaaacaggcuuuucuuuauaagauuaccuuccuauucuacaacccuucucuucuuuuugugaacacguguguacacuugugagcacauguguauucuggaaauccuugguuuccgcuggggcucugguggggccgggggugguguggauguugggugccccccgccuccaucuuggccuuuggauucugcucugucuuguggaugacucaaggaagugcugggaggagucucuugacaaaucagucaugugagucccgguguccuggcucaccuccagcuuggguaugaauagagucagcccauuuuaagugcccccugcaguuuuuaaacaggucuccuuccacuucacuccaccuggaagagggugguggggccaggaucaucccugggccagcccucuccuuucuguggugccucacugggacacugagaagggggaagcugcuuucucagaggcuguugcuuggaaaguggcaucuaagcaugagaaugacugcggcgugcagguucccaugaauggucauuuccugugagccgggccuugugaguggucuuccagagcccaugucgugucuaugguguguccccuguccuguuccagguuucagggauccuuugcgcugggcagaagauccacugagcuggcauccagguuccuccagcagaacacggcgcagugguggaccugccgcagcucugaggccagcgagccaguuuuccccagcacccuguuucccagcccuagcaucuucagaguguccauucuccucgcuccuccacggcgcaugcuuuucacucaggguugaggauucuuuuuccuccacuugcacacauccuucucauuucucagcuaagccugggauuaagaaugaggcuucaagugacaaaagccaggagauuucacaauuaaaguuggaauugugucugcagugaugucuuccucagcauuuaaggaaggccuugaauaguggguaauauuuuucuauccuaaauuggccacauggcuccaaauagugggcaaaggaagacacuccugugguaaauucgagaaugucuuaguugaggcucucauguccguagaggaugaagggagggggguuaugacucaacccaguugugcuuuugggucccugguugugucccagucaggcccgagagcuuagaagcaaaucccguauguuacuuggccccucagagcagucuuuuaaaauauuucucagcaaggaagcuuaaaaaggaguuuacuuuccuaauucucuuuuguuuucuagagcagcgggcaaggugggagggagagccuggguucgcugugguuagugggaagggggcugcagcagcacauggaccaccuuuuuggucacgccuguagcugggaguuuugcaaccuggugguuacuuggcaugucaggguccuggcucagauccaaaguuuugcucuaggggccccggcagcgcacuuugaaagcacugagcuaacugcugugcucacuuugguggcuggugaccagagaggucccacuggaaggucgugaaugucuuucuuccuuucaaacacugaggcucggcccaaggagagaugguccugcccuccuagagcuuaguagaggcaaaacaaggaaguguggcaaagaagggauggaaagaaaugcuggacuucucucccacacugggaggccuuugcaaagggcuucgguuucugaaucuguaaaaugaggguaaggagaggguguguuguaaggauucaaugaaguaguguuucuaaagccuuuagaacuggccugacguaccguauguguuuguuagaauuuuuuuuuuucccgagauggggguuucaccgugucgccgaggcuuggagugcaguggcgcaaucacggcugacugcggccucgaccucccggguucaagcaauuuucccaucucagccucccaaguaggugggacuacagguacagggcaccacaccuggcuaguuucuguauuuuuuguagagaugggguuugccauguugcccggacugcucaugaacuccugagcucaaguaauccucccuccuuggccucccaaaaguguuaggauuacaggugugagcugccaagccugucauggugcuauguuaaaaauaccuggaagaugucgugcccugugguagggaaggggaguggcugguggggcuggcuuaguuugggagcagccgucuucuuucucauugauuccuggggcccaaagcaaugaacugaaaacuguucacgagguuaauuuuagucugugggauguuacuacguauuaggucacuccaagaaacgcucaguaaaauauuuacuuucuauuuaagaccuacuuucucuuccuggagaaggaagaaaaaaacugccuugccugaugggcagccagggugggggcccagugcugccccagccacccugcccaggugaagccuguugagaagggucgcucagguuugaauucuccucuacugaggccucaguacauaaaccacagugaacgugggcaugacaggccacauuccgaggagcauauuuguugaggaaaaggaacugugucugcccuucccucugugcacacgucaucaucauagcucccuucacccucccaggucccugaggaaugggugcguuugccggucagugaccagggcugucgacuugcuugguggcauccuguuugguuucuugugggugcucagucagcagcagcugugguaacuggaccaggugcagcuggguggcagaucugcugugauguuugagcauguuccugaccccaggcccuggcaauggggugguaauuaaucauguccuccuaggauauucauucacagauacugacugagcacccacuaggggccaggcacaguacgcaugugcguacagcaucaccaaaugucuucugauugaaauguucaaauaucuuuucuccacccagccaguguuaacugcucugugcuuccuguggggcuccaggugugaauaguaggucaugugcgugaaauggcaaggugggguaaggaaggugccuguccggcaguuaguuugucaccuucagagugggcuggucauuucauggaccagcaguuucuuuggauucaacucaugcuauuaaaaaaucucacuuggaggccaggugggguggcucaugccuauaaccccagcacuuugggaggcugaggcagguggaucaccuaagaucaggaguuugagaccagccuggccaacauggcaaaaacccugucucuacuaaaaauacaaaaaauuagccaugcgugguggcgcgcaccuguaauccuagcuauuugggagucugaggcaggagaauugcuugaacucuggagacagagguugcaguaagccaagaucgugccauugcacuccagccugggcaacagagcaagacgcugucuccaaaaaaaaaaaaaaaucucacuuagggccgggcaugguggcucacaccuauaauccuagcacuuugagaggccgaggcaggccagucaccugaggucaggaguucaagaccagccuggccaacauggcaaaacccugucucuucuaauuaguuuuggagaaauugauuuuguagauuauauuuuagucucuucuagaaauacaaaaauuagccagguauggugguuggcaccuguaauuccagcuaaucgggaggcugaggcaggagaaucacuugaaccugggaggcagagguugcagugagucgagaucaucccauugcacuccagcgugggcaacaaaagcaaaacucugucucaaauuaaaaaaaaaaaaaaaucucacuuggaaaagcaaaaugguccuugaaaaugcccuugggaaaccacccaugcuggaaugcaagggcaucucagcuggccagggaccaggggucuggggccagaaugucauauucuucaauugcaaauccuggagagugugcacaaugaauaagaugugggaagugcucccacgcuagcuguuuguuaccauuauuauuauuagggacgguggugcuggugguggugguggugauaguaguaggauucauggcaaucccaguaguuaugguggcgugaaugucauugagaaagacaaauccucccgucaacugugccuucuucuuccuagcagggaguggcuguuugugcccuguuuuaucaggagggagcagauaagugcuagcaaccuucucuggcccccugccgugcccugcccuacccugccccaagggacagcagauaccuuuaauacuacgaagcuugggugggcuuggugguuuucacgagugacucagucaguccccagagaggcccugguaccugggguugggggugcucaaaagguuggcuucuggagcaggggcguccccaaggcaccccuggccaggagucuccugagggccccacccuucgucccgauggagaagcccuaacaucuguauuuuuagccaccuccuccagggggugccugaugcagccagcccgaaacugccaacagcagcacacagacuggcuuucuucaaaaacaaaccacucccccaacacacacccacacacucgagucuaguuauugaacauuuggcaugaaaaaugguugaaagaagauuuuauauaacucaaauaacccacuaaauuauuugaaacuuggaauauggauuucugcuguacucauccucauucuuugaagagggauucuccacccuccaacauuaccaggcauuucuaggaaggcagaggaaauuuccugggugucugauaaaauuggagcuaguuccguauucagaugcacuugacauuucacucuugaccgggcagcaguguguauugagaugaggcugggcagugucagagcauaccugcuagaaaagaaauugguuuugcagauuauauuuuaguaaaaucugaacugcucagugaagcacacuauuacuaucuauguacacaagucaaagauggaugccacagagucgauguuuuuaacauuggcccgugugagcaagaacauggaucagcaaaaggugcauuuacuucccacugcaggcaaauaugcuuaaccuucaggagcgcccccgaggcccucacuugugccucuagccuguuucaucaugaugcaagcggauuugggagugauaccugcuguuuuagaacugagagugaacucguuuuguggcaaauccuuuuuaucuugaucggggaauuuauuaauuaguaggcuucagcgaggcugguaaccuagcuuguuucuguuugcagaaguacuuuguuauacauuggcuuauuuuauuuuuaguaacaacccuguugugaggcagugcgauuauuucccacuugaggaauuggcaagccgcauaggcugggcucacaguuaauuaaugaucgagcgagauccgaacugguucuccuccaccaauaccaggccguccagagaaugguuguguauucacaugaccccauucuagggaugagcgggugggugcaaauucgaaggccagaagggaagcaggagaauccaguuucaagagucuggagccuuuggugggagucccccggguugaaaggugaacuugaaagagcauccacggguguccuuagaugaagaaggauuuaagggacucuguuugccccuugauaugagguuuguaacuggggucuugagcagaaaggaauugcucuucuugguuugagugacugcuuucuggggagcgucugggugcuuuuugaguugcaugcagagccauuuauggugagagaaauuaugaccugacuaauuggcccagggcuagguguuuuggggcucugcacugaggccucugugcaaggagcuugucugcuugaauauggaaagugauagucuuuggggcccuggcaguuucuuuuggggccgcuuuuggacuugaguuagcaaagaaaugacuuuaugauuuaugguguuuaugaagaauaccuaucuguuuucacauagacaucuuaauagagauuaaauacaaaauaaaguggaaugcaugaacggagauauucccauaagcaauauuguaguuuuaggcaguguaauuauguuuuguacacuucccgauuaagcaguuaugcauuacuggggaaacuaccuuuuagagauuuagaaaagcuuuagaauuuaguaaaucaaauaaaaauagguauacaauauuuuagacauaggguuucaacauguuacauggugugauaaugcagugccauugaggugaauuuuuucuuuuuuugaaauggaggcucacucuguagcccaggcuggagugcaguggcgaguucuccgcucacugcaaccucugccucccggguucaagcaguucuccuuucucagccuccugaguaggugggauuacagcacucccagcuaauuuuuguauuuuuuaguagagacagguuuucaccauguuggucaggcuggucuugaacuccugaccucagguggucggccugccucagccucccaaagugcugggauuacaggugugagccaacacacccggccggcugaggcgaauuugcuucuucugaacauugccuguggaaugaaggugcaccccuacugugugcgggaugucgugggggggcugccgggcuacagggaagaagagcaaggaggguuuaucuggaguucagcaaaacagugguggauuuccgcgagcuggggugggcagagguggccacauuagguuuggaguuaggcugaagggggugugcugaggguaaaugugggagagggaacccaagguaggagccuuucaagcucgcguguccuuucagcucccauguccuggccacuaaaccacgggagguaacgaaaugauuuucccugaguaaaccaucugaagcggagcugcaucucaggcagccucugcgagcaugugcuucacagaauccuuccuccuggugucuucuggguguugcugauuucaaggaagccugguggggugugugcuggcucagccaccccucaguugcaaagcucuugggggccgcagaggauuucacaguucacugcauaaagcaagucauuuaauuuuaucauuugcuuuuugagaaggaucaaguuuucaaaauccuauguagaaauaacuuauauacaguaaaacacccuuuagcaugcaguucugcaagucuugacgaucuaggcgucgccaccgggugguugcggaaccaucccaucaccgaggaaaguucucugugcuccuauggaguuccugccuccccgcccugacucccagccuccagccaccacuaaggaaaucacuccuuuuugauaguagaagggccagccuaggaagugcgaggaguuugguagaugcuggugugagaggccaguaauuuccaggacauuuguaauauccaaggauuaugcaugagccccaggggugcucuggucacagcagauggacuuggcuuggaugacaccccuccucuccccagugccauccuagggaugccugagacuccaggagcuuggcucgucuggacaggucggaccaaaagccagucacugcagucuugagucgugucugaaaccagcagauaaccaccuccuccgcaaaguaggcaaaccgcccccguccccugcaaacccaagagugggcaguucugggccacaccugcaggcccuggugcaucuaaggccaugcucccugggcuccccagggacacucacaacagcugccucuccacacugugucccaccagccccucuuggaaagugccugggaacaggugccucuucguccgccauagccgcuggcuccagguccagagggacugugagugacugccaggccagggccgcuuucuccuuucucugugggggaaguggcuuuggagggagccgggcagugugcuaaccgugugcaugucguguguuugccgcgugcucacuguguacuugcugugugcuugcuguguauuuacugugugcuugccaugugcuuacugugugcucgcuguguaccugcugugcauuugccauguacuugcugaguguuuaccgugugcuuacugugugcucgcuguguaccugcuguguauuugccauguacuugccguguguuuacugugugcuugccaugugcuuacugugugcugucucccugcuuccuguuccgugcuccugugacuucuggguggucuggggugguugagcgcccucagguccccauuuguuuuccugaagguagagaccagucaggauggccaccuuuuuguggucaagaagggugguuuguggaaagcccagaggaaugagagcuucugagguggggaaggucagcugccccgaggcuggugccggccccgaggguagauggccaugcuugcaguccugggcuccacuuucaacccugccagcuccuuaugcgucaaauaggacgcuagucacuaguuccucucacaggaggagguaaugagaaggcgcuggagacuugugcccaggugcccagcagaggagaugcuuggcaggaagucccuauugcacucugggauauaagcugcaacugacucauugccucaugguuuuuguuuuuauuuuuauuuauucuuuuuuuuuuuuugacagagucucacucuguuacccaggcuggagugcaguggugugaucucagcucacugcagccucuccucugccucccagguucaagcgauucuccugucucagccucccgaguagccgggauuacagccagucugucaggccuggcuaauuuuuguauuuuuaguagagaugggguuucaccauguuggccaggcuggucucaaacuccugaccucaagugaucugccugucucggccucccaaagugcuggguaugcaggugugagccaccaugcccagccacgucaugguuuuuaauauucuuuuuauuguuuuuuugacacagggucacacugucacccaugcugcagugcaguggugugaucuuggcucacugcaaccuccaccuucuggguucaagugauuuuccugccucagccuccugaguagcugagaugauaggcacccaccaccauguccagcuaauuuuuauauuuuuuguagaaaugggcuuuugccauguuagccaggcuggucucgaacuccugaccucaggugauccacccaccuuggccucccaaagugcugagauuacaggcgugagccacugcacccggcccuugauauuauuuucuuucaguugggagaaacuugaaaugagucuuggaauuuauaaaauuguuaaguggggaucacugcauuugcuaauuuucuggucguugcccgaaauguccuuucggagcucauucuuuguccccuucccucaucacaucagucaggcugagggcagguuuaagcggcagucaucgugauuggccagcccugacuggcauucccgugaucucggugcaucuuguaugcgugcauuugcaguaugagaaaacccuuugaugccuuugagcucagacuaaaugugaccuugauuccuggccugaaauuaaugucuaagcauucuuggcuucuucuggguggucgucugugaacaaacugccaugcagcgagugugauggaaacauacccuccaaagacauacauagcuuagcagauuucagcggggcuucccaguguagugugaggacacuuggguacaugggguuaguagcugaaagguggguggacaccccaucgugucuuuauuaaggguucagggacaguucagcaaggguuggggaaggggugugcuagacgcugaguggaaguugcgaauguguguggccaccggucugcuuucggauggugagagcaaaguucuuuacugucuggaaaggugaucuggggaccuuuucacaggucaccagccaccugugcucugugaugugcagcugugagcacaguagggucgcaguucuaggcagccacaaggccucaugguguccuggauacaggaugcuuucccagaacccuucuggggcuccacaucuaucuccacacuuuggguggggaaguugcuucccuuggguggauccaaaaauuccagcugacuuggagggaagugaguugagagccccuccagcggugcuugcucaggugaguagcuuuugcuauuacaugcccaggcccagcuggccuagacuggaagcucccagaguccaaaaaacaggggcuaaugaacagucgagaaaaaaacaaggcagacagucuuuuaggggugugcaguauuaaaucacuuugaaaggggaccacuuaagaaaauccucugcccucauucaagaauauuagaaauacauuaauuugguggaauaauuauaauaguagcuaccaucuuuuuuuuuuuuuuuuuuuuuugagacagucuagcucugucacccaggcuguacagugauuguacaguggugcaaucucggcucacuggaaccucugccuccugguuugaagcaauucaugccucaaccucccauguagcugggauuacgggugugcgccaccacacccggcuaaauuuuguauuuuaguagagacagggcuucaccauguuggccaggcugcucucgaacuccuggccucaaguaaucuccccaccucagcuucccaaagugcugggauuacaggcgugagccaccucgccuggcuaauaguaucuacugucuguugagugccaggaaugugccaagcagggaagauggagauguauuugguagaugcauaauaguaauggcuaaugcaccacucacaggcuagagacaaaguagacucagagaagcucagugacuuucccaggaacacacagcucuuuggcagcugcuguauggaaaccacagugggacucaucagaagccgguuccuuugcacaguuagccgagugaagagacggacgggcacagguauguuuggaguucuuaaguucgucaucuugcacccaagaaucaaggucgcagggugaaacucuguaguucuggagccugaaaggcauuugacauccuggcuggaaacauacauuuuuguuuuacauuuauucggguagugguuugcuggucuguuuuuuuuuuuuuuuuuaaccauuuggcuuggagaaauuuucccuuugguuaugguaauuacccuuuccugauauguaaauugauuacagcggcucuuuccaaucuuacacauuugauuauccacgagccuccuucucugccucuuaguuaaucuuauuuuuagcacaguccuugaaaccucagcgugagacuguccaucuuccgcuguuucugaacugccgaaggucauuuucaccagccccaccaaacgcggauguguuucaagucaaacacagccauuugaaccaguuucaaacaguugccuuucaagugucagcgugguggggacaggaccugccgcaugagguccguguugcuugggauagucucgaaucacccagcgugacuccguuggcucccuugguucagucggcuccaggaugagugcacuugaccagaagcuccggcgacacugagauuauaagggagccaggugagcggaggcugcguuguggacaccagccaagucugggugggaggaggcaccgggaccuaucagcaaccugcccuggacuuuguuuccucaugugugugucuagggcuuugcggaugauuugcuccagauggaauuaaugcugcaguuguuagaagagcaucucuggcuccgcuucugaagcuaaucaccaccucuguuuuuguaaguuagugagaggagcguggcuggcuaugagggugcagaggugccccucccgcgguccccuggggucuucucugcaucugagucuucucagaggccacgugagugaguagccccaguggacuccggauguuuugugagccuuaccucgauaagaauaaaaacguuuuggugugugauuugauuuguuugcuagaagauuaguacaaaagcaggaaggaaaaagaacgugguggaggugauugcuagaggcuggcagaagguuauuuacggauuuuugcugacaguccuuguugaaaggaauucccugugagauuuaugaagccuuuccaauuuauugucuuuccaaguaagguaagcaaauaaauaaguuauucuauuuuauuauaaacacagccaauguaaaauuaaaaauaagaggaaauggggcuccauuuuuucagccuaguguguuucaggaaagcaucuuggagaggcuuuuuguuuuguuuuuggcuccagcacauugugcauuuaaaagauaaagucggugccuugauguuguaugugcaggucaccauccuuggagggaacugguugcagccuuggugggguugacaagauggugaggacagaggagcugggauauucaggaccagcccaccagagucaccagggacucccaggccccuugggaaauaaggcugagggguucccgagacucugcucuggguuuggccacagccgcugcccccagaagggacucuugacuccugaggcccacguccuagcaaacuggugacaucuuccugcauccuucuuccuguugucuugauuucuuugucucuucuccuuaaacucagaaauuguuggugcuuucaguaucuuggcgaauugugauuuuguugauacagauguguaaggacccacaugggaaauuuagauuuuuagguaaagaacaagcaggaauaugagaccuugucguaaacaaacuucucguuuucggcggugaugucagugcugaagauuugggugggucagguuuggugaccugugucccaccaaaggcagcuccugcuccugacacgagcccggagcccauuugaaaucgcucccggcucuuucaaggcccugggcaacgccaucagggaaacauccuguuaccauuuugggagaauguuuuacgucucugccccuagaugucccugugcuagugaagcuguuuuggggggacuaauaggcagcguuuggacggugucuuguaacugucaacugaugacuucaaguucguuggccccugcuguguaguaggugcauguugaagauagagugagucacauucucugcaaggguuuguuuuaggagcaaaagaggccuaaguagggaggcuuggaaggugcugagggcauaauuccugcaagaaugggcuccaugggguucauuuucuuucuuucccacauccuccacaguaccuugucccacuccuauaggcacacaaaagaggagggccuuucuucaacucaaggcuaaugagcugggcaccagggguuagggugggggaacaguguggccgaugcuuuucuggagugguggccugaacaagccugaccugcuccugccugcaaggagcugaccacccaaccagagaacacugggcaggcgaucaagcugggugagccagacagggggaugugucuggggccuggggagccccacccaugcacccugaggucagggcuggccuuucacaggagguaggcugugagcugugagggugaggggccagccugggccucccucccagcucacccuccccuaggaggccgcccccugccugggucccuccagccccuucguucucauccuuaucuggaucugagaaucaccuggagagcuuugaaaaaagaucccagcuuaauccuacccccagguucugagugugugguccacaguggcaucugccuugguaauaaaaaguucccaggugacucuaaugaacaaccagguagggaaccacugcccagccagcacuccucagcugaggccacuuguccuguucugcucgugggccggaagggaugggcuggagaaucagguaaguccuaacuucgcugccccacagacugggagcagggucagagggcagaaggcugcccugggaggccgacuucuuaaaugcacaccugacugacagguacgcuccugcuguggggccaggcaggagagcagcacaggggcacccagggccacacaccgagaagugucccgaguggugagcccaguguggccuggcuucccaucggcaggugagggucaucuuucagggcuguuucacuuccucaaaagaaugcaguggaaugagcuccauagggugaggugccugugugcguggggauggagaggagggcuagcugcugggaugccagaaaugaagggaggcugggaucuuccugccuugguccauguguagcuggaaggagaaagcagccguugccuaggagacaaagcuggagggcuugacucagacuauggaccucuugaggcuuccugccugggugggggaucagcccaggaaccccacgaggcgaugggggaugggauggggacggucauauaugcauuucuauagaaaaagaaucuggcuuuccagugucucaagggauuccgggaccuuacauuuuuuucggagcccucagaugggaauccuuggccuacaaaggugggaggcugucuuguggacaguagggagagagggugguggagcgggugcugcagggaacaaaggacaccuggaggcauuccugggcauuggcuuccuuccuggugguugggcuuuuguagaaggcagagucagggagagacuggggacuugguuuccucccagggugcaggaggaaguaaaccuaacagugauaccuggaucaagaaggggcuccccucuagcccagcgcagcgagugggggcgcaccaaggcauccaugcacaauguagccuugccgcugccuaugacgggaagguuugagguugugaacgucggcuaagguccccggggguuggcuguugggaugaacguggguucuaguauuaacguggguuuuaguauuauugaggguugaguauaccgggggcagggggcagggggcaggaggcaggaggagcuaagcagcaggguagguggaguggggagggcuaugccugacucccucuccaggcugggagggaaaggcugggggaagaugggaggaggccuggccacacgcaucuguacuguuggcuccuuuccccaaggacccgcagagguggcccagggugcugggcgcuucacccucccucauuggucagguucucuucguccucccgcgccgcgugucuggggcugcuguggugcgggggcagaaaaggaggggccugccagccugguucuccagccuuugugggcuucgauugguccugccuggcagagugcucuuugcucagaggagucaccagcaguugcugggagcgguaggauuauggucccuaccugggguucagaacaagaacuuugcugugaacuccccugguugaagcagagggccaggaagcagagggaccugaauuccccaccaggcggucccuacagagucauggaccuuccuuucuccccgcuuccuccugcccuguugucucugcugagcaaggcacggggcgggggggcuuccgcuggguggacuugaguuggccuagauuugaaucugcucuuacugccguggacucuggcaugagacucuaagccucagucucuccaccucugaguugggaaugauaacagaauuacuugauguuggucauguuggcuguuggugaugggcuuguuaaaucuggucguuggggcugcucaauauuugcauuuucagaacagcaugcagcgaguaacuagcgcuccaggacaggacuucggaauguuuccauuuguuccuucugaucguguccuuuucaaaucugaucuguaguuuguuucuugccugauauccuaccugcuaaguuuuacaugccuuuaugugcguuucuuuuuggacacauuuuaucacccaugcagaaagaagcugcuccagucuuccagccgugguuaggaagugccugccauucagaagucaguuguaguuuuccacauggucggcugaauaggaaugaggcacuucccugucccuaaagagcucacaguguggaggagagaugguauacuucugcuuuaggcuuugagacucuuuguaaauacaacuuugauuaaauuuguucaugguggcuuauuauuuccaaggcaaaaacagucauuucaaaagacuagacuagccucuuuaaagugauuuagaguuuauaguuguguucaaaugcguucuaauuacacccuccaaacaacaagccucuguuuucagauggagaaaacaaaggauucagauugaaggacugcucagacacccuccgaagagguggcccugccugcgcuccuccuggcugcagaguaccccaccagcgcgugagccuguuucccuauccccugguuuugaguuucuggccugaucguugcaugcuuggcuucacugcuacuuugugaaacucuuugcugagauuuuaaccugggcucuacuuucagggcacgaugggauugagacacaucuugggggauggguaggcaggugagcaggucugaggaggaggcugggucugccuugaccuguccucucccaucucuacauacuuaccaguaaucagugcuugaugcugaaggucauacugagauggaggcuaugggcaagaguuugaaucuguguggucuucugugggugcucacugaccugcuguauguggauuuccaugcaccagacacaugcucuuagaaugugccuggcagcuugagcaggauugagggaucuagagcuuucuucuggcugcuucccccacaaucaaggagauuuagcaagcaggugcagggccaaguucagggaugugggccacaggcaggcccuuuaaauccagucauccauuuugauucuucucuccuugugguaucugucacuugucaaaaaagacuucaucuucuggggcugucauucuaagcgucauuuugccauacuguuaaaauuuucugaguguuugcuugauuuguguuuauugaaacuaaauucauuaggaugaugugaaaauagcacucugcuguuuaccaaaucggauucuuguuguugauauuucaguacaucaucuguucucacuugaaugucguggaauuuguugguaaagugcugugcagaugaaaacccauauuuuaguggaguuuuuuuuauucaaauaaguuuauaaguauuauauacccaaggugcuugauuugccauuugaugcagucuguacggaugugcgaauacuggugcuuggcuugggcuuugagaguuugggggugugcugggagacagcugcagggauuaggacucuaccaggugcugagucagaggcugguuggaaauccuccuccuccaacuccgccccucgccagcuguuugacugcugccaagucccccaacugugggaaccccaggccuucaucugugaaauggccauuccuguguuucugacaaggcuguuggaagacuucauugaagacacuguauugguuuuucagcacuuuaacaucucuggacucaaguugugucauaaaauugaucacaagccauaguuuaauugacggcauuuuuuuuuuucucccuuagugguuuauaaaaugaugcuggucuaagguuugaugaugucuuagacuugaagaacaugaaccuguuuuugcaaaaguuuuagaguuuggcauuuuccaacaaaaaggcaguugcuggacuuuugaauuggucaacgaaauuccacuuguuaccagaagauuuacuaguugcauuucuagaguuguuggccucucuuuucugauuugauucaguggucagaucauccaggguucuuguguucagagacccagagugcuauaaugcuuccgaaauaagccugaccuaagacugagacagaaggugaguauggcagagaccaccagcuguccaccaaagggcccugcuucccuuccaccaccucaaguaucugucggaggcuccaugauaguucccacauggaauguggguggcaaugugugucgcuucccggcagcacuaauuaagaaacaagugugccuugcucaguuuuucuccuguugacugucagcuggauguggaaaauccagcagagaaugccuaggugcuaggggaggauucugagugccugaaucacucuguggagcagaguugcccauuaggaacaugagccugauguucuugugauuuagaaaucaaauucuaauguguugagcugauacacaauuuuaggcuuguuuguuaaagcagacaaugugaacguaaguaguacagugaguuggguaguuccaacccgccgcugcccccucccuguccuacacuugcuuggguuagauagaaagcagcgccgucucccauucaccagccuaaaugaaccucauggcuucacuucacucauucuugcucauuuauucacugaguccuguagauucugccccucccuucugcccuuguuugggggccucacaccuacccaaauggcauccaccuaaacacuuuggguucggcuaggugcccuuaaagccugauuuucaaacguuggagaaguuuagaagcaagucgggcuguaaaauugcagcaaugaccuggcaugguguggcagccaugaagacgcuccugaucuucugcuucugggaaugugagugacugguggccccagcugcuacguucugaaucccgcaguggaaauccagcauggcguucccagacagccugcacucugcgggcugcucccagccggggacagcaggugaagacuccuccuccccagccuccugccuucccugccaucucaucugcaucugcugucagacuugcgucucccucugccuccccgccugucugccuccccaagaagucucuuccagagcugaucgugucuuggcuucgguuuuuggaagagccgagccaacacacaucguauuugagauacagugggucggaggcgauacccagggauuuucuccagcuuggacagcgagcccuuugcccucucuggguggcagggugccucccucuaaaaugagggggcgaugcuuggcaguuucuagaaccuguucagaucaaggcaaccugggaguuagaguuccgcuagucuugucuggcaguacagucggucucuaaauaugcuuuuauuguaccuuccccaccaucugggugaagcaucaguaaugaaaauggaguggaggcugcauugaccuuuuccaguguccacgcacuauauuuuaacugggaaguugcauguauuuucuauacuuaauacuuuaaaagcuucuugggccucuugagaggcuuguaagugcagcccacgugugacuugagcugggaacgcaacuucagauugagaagucccacuuuuauaggacacagcauuuaacagcagcugcguccaagucguguggcauuuggcagcguguuuccaaguggaccugugguaaucacuuugcucuuggggaaccguggccaagggcugcccugccuccaaagaggcucagcaagggaaggcuagaaguccugugggcuggccaggcaugguggcucacaccuguaaucccugcauuuuuggguggcagaggugcguggaucaccugaggucaggaguucgagaccagccugaccaauaugaugaaaccccaucuguacuaaaaauacaaaaauuagcugggcaugguggugugcgucuguaaucccaccuacuugggagacugaggcaggagaaucacuugaaccugggaggcagagguugcagugagccgagaucaugcuauuacacuccagccugggcaacaagagugaaacucugucucaaaagaagaaaaaaaaaaaaaaagagagaaauccugugggcuauaccuggggguucuuugcccugcuuccaagcccuguacagccagcauguugcacaugucauuguccugggguuuucuucccagagggcccuuuucggugcaggguccucuguuucaucagccugcguuagcacaaacaacccugaccguguccuggaccuccuugagcucacgggcagagguugcugcucugucgugugcuguuugcagacuuggacuuggaguaguuauucucccugugccuccagggccuugguccucacagguguuucugugcuccuccuuccagagacaggccuccugugaaucgcucugaauaaaauguucccagcugagguuuuggagucuccuuuggaagguugucuugguauuguuuucagucucuuguuaggaaaaccggacaggugggucugaucaucuacaaugaaugugcacaccacccccggguucggcaggacacacugugcccccagcccuggucaucuucuguuugaccacauuucuuggcugaauuucagaucuucaccuggagcacgggucucaugaccuaaggucaaccuguuugugguucuuucuguuuuuucuuugagguaaaacuuagaggaaguguugggagggaaguggggauugguggggaaggggcaugaggucaaaugaaaugcaugaccuuaagugugccauuugguuaguucuaacacacgcacauaccugcguaccccccaaagcccuaccaagagcuacagucacuccggaaaguccccuuggggcccugccaggcuguccccacccucaccucccugaucaucucaggccaccacuguuuugguuucuuuuccuucaacagagguaguuuugccuguucuagaauuucauguaauacuacauaauacauguauguacauuauacacagcauauacauguauacauacaauuuaauauguauguauauuaugacacauguaccuuuuugcaugaagcuuuuuucaugccacacacaugauguauuugagauuuuuaagacauuuugggccagauuauucucuuguuccuuuuuacuucugaguaguauuccacugaaugacucgaccgcaguuucuuuacccgcucacccauuaauggacacuugggcuguuuccagcuuuucgcuauucugagcaaguagcuaugaaccauucucaugcaugucuuuuuguggacauaugauuucauuucucuuggguaaguuccuagaaauggaauugcugggucauggaguagguguauguuuagucuuacaaagugguuauaacauuuuaugcuuccacugaucauguauggaagucagcuauuuuuuaaaccacccuacagaacguuggcuuucugcuugggugguggagugggaugggagggugaguggguagggcccccuccucucccuugacccccaccucccuacuagcaggaugggggcaggggucugcaccguuggcucugcugggcgugggcuguggaguucacaugcucuggaagauguagcuguguccucuauauuaggguggggccuguuucucuugcuuuuccuggcuauucugaacaauucuuguuccuucauuccuuccccccgccucccaaugucucucccuuccccugcuuccucuuguccccaaaauaccaugcucucugaugaagcuccaggcuaguaagucaagaaugaaggucguggccuuugguaccugguguguuccugguucuuucugacaucugugcccacuguuuugcauucaugacugacagaaguggacuuuuggagccuacugauggucacaugguagcacaugcuguccuaguuugcuuccgugugaggauggacacuuggcuaaguagguauucuagacagcugcucccagagcagccucaccaugagcugggccaccccagaacccggcaucugggugugcuagccucaugggccucaggaagcugcagccagcucuuccaagucucuggggucauuacuuuuagaagcauguuuuauaggguuacuagaauguucucuuaaguggauuccauuuuauguauuuauauccuaccucuuucaggaaaguucuuugaggacucaaaaaauaggaugccguaauagggguugagauugggggagggccaaaauugauuuuaaaaugcaaauacagcaaccaaaaauuucacgacaguugcuguaacagauaacuuaaguugggcagcucucucugaguuuagggagggaugacguguguccuucagggaaacagcuugccacagggaggugcguauagggcauagugauggcuguaaagugcucuaccaccaaccaugggcugccaacagaugccaggccuggguucccacaacugcuucuugugcuugagauugcuggaaagagucagaaguacaacauggagggauguuuagaggaggccauuccauguggguccuucuagggauacccuuugauuuaggaucaaauuuacaauaccucaccaaacaccgagccaauugguacaggucuguucucccaaaaaauuauugaucucagcugggcuuuugauaggcguuugagagaagaugauucacauucuacuuucuucccaggaacugacgugcacggcuagccccggugaccugccagccucucagaugugcagguggacagugguugaggcaggccuguugguuccagugacacagacaugagaucagggcaggauugggcuuguuuggguuguugaugagcacugcaaggggugaggcagugaugucagugguugcgggugagcagaguuggagggguugauggaacaugcaguuggacagaaguaucuagaaggcaggugguaaggagccucuggagugccuuugauuugagagcaugugcauggggcugaggcagaguugccaucccuccuucguccgugccuacuucguguaacacucggcuguuucuuguuugaacuccuugaggacaaaguuaugucucauuuaauuuccagccuuccuuacuuaauaguaccuggcuuguucacaguugaugcaguauugggauggacagaguagaguagagagagagagagagagagagagaauguguguguguaugcacguguguggugcagcaggcaagacagauggcagcugagaaugggcuauaggcuuugaccaucagaagugcacgcagcucuuuuggauguguguguauguggaagaugugaaugugguguggaaauguggaaauagcuauagauguguauaugugugucuguauagcgggggguggugaucagaauaaaagcuugauggcaaggaucaaauaaggaauguuggcgccuaggggagcagauaguagcuucucuggggccgaggccgggaggugcgagcacaucugcccuaacagggaaggaacaaguacguggcuuguccugauugacgggccuggcccugccauguauuucgguucaucuguggcuuucugccuuugccauccccauccucagcuguaccacacgucaguuuguggggccuggccuugcggauggcauuuucuggugcuuccuauccauacgcuaggaacggaguucagcacccaaggaagagaauucuagccugaacccaaagagagaagccccuuaacucuugaugucuuuuaagucccagugacuuuugaguuuggcuuuggucguuaaguuucaugacugccuauuuuuaaguggaauuagaacuuaaguuaccgagaaucacagcgucuugcuagguagcauuccucucgacccugccaggugagcuucugagaggcuaagugacuugccugaggucacauaguuggacaaggcaggaaagcaccagcagcugaacuggcccauugcgaaguguguccagcgggccucucccaggccaccgcugcacugcggucuagugguacaggccagagcccugggcuccuccuugccuucccgcaaccucaguccacuccugcuucuuagguggacggcacuggcuuuggcuugagacuggguuaggcaugucaucuauuugguuucucgaaugcucagcccugacacuucuuccgauguucuuagcaucacccuugaacaaacguugguuggggauccggggaccgacuuguuuacacuucuucugauuugagugaaauaccaagaggcuggcagagggacagccccugagcuauggcucccuuucuuagcccagaucucaagagcuuucugcuguuuuugcugucaucucugcuggaugucgucucugcuaccgagguacagcaguuaggaaacauucgcguccccaucacucuggucacucugcugacugguuuuuggacacugagugucccauucacucuaucacuguugacugguuuugggacagugaguaugugacaugcauaugacccaugcuuaacucacucggagccauuaucugagcacuauuugucaggugcuaagaaggcaagcuucaauugacuuaaguuccagcggggauguuugcuuuuuaugaaaaugaugcuuaguaccuccuuacuaagacaauggcagaauagaccagacuguugucuucagagauucccaaacaccggauauugacaagguuugcuuuccuaaaguugagaagagggcugaaauauaaggcuuauaucugucucucugagcauuuuagaagaaagauauaucuaagcucuguguuuaaauauagcaugguguuugcuacucggauggcaaauaagcaauugaauauguaggucauugacuuaugagaaugaguuuggagguuuuuuugcaugugauuaacgcugucuuacgauugggcuguugaugcuccgccaacauuggguuacacagaguucagcaagccaucugggaagaaaacuggaagaaucaugagaggauaccucuguccccuuaagguguuaggagugugacuugguguugagcccuguggcuacagccaguggcaguggcaccaaccgcucccaaguuacacuggggagaaacacaucugagugccgugcgucuguacauaucuaucaggagggagggggcagagggcgauacuucaucgagauaaaugccagcgguguauuuuaauacauucuugauucagaaggcacuguuuggaauugcauauuuaaaaggaaacugccauccccuuuugaagguaugugacauuuaaaagaucuguagcagaagauugguuugacagcuuugaauuauaauugaaagaguuuuuguuuuaaaaaagaaaaugauuacuucuauuuuaaaugucaucacaaagacauaaauauguuuaaucaaauuauauauuuaauguauguagaauauaauuuuuguuuguguggaagagucacugguuuguguguguuuuaagcagcuuuaaagcuaagcaauguugaugauuugaaagugauucagcuuuuuugguaaaugacuguuuaaggguuuauagaauuucaaaaaauaguauuauuaaaaucugcuuauuuuuuaucuauacacguguaccuaguggcacauuuugggagauggagguacuuuuauuguugcugacagauaguaaauugucgaaugaacugaaaaaacguggaaccuugaagauaauaaaggcggaaacagcaaagacgcuccugcaguuuucuuuuggauucuuugaaccagcggggaguuaccgggagugcuagcgucgaguaugccagcccuuccuaaaagggaggcagcaggggaggcccaggaaaagacacagagugccacaaagaccuuucgggugauacaaaaggcugguguggcauuugagggcaccagcaagguccccaggcucgagaagcaggggcguagcucugggucuccccugacccuggcuaucugcuagcacacuccagcucuagaacuuucuuugagcaagcuggguguuggaagccggccagcccagcguacaacuguguaugucagcuggggacagucuuggccuguuccagccugcucuguaguuucgauuuagccagacugggucagggaguccugaaguuguuacccaccagagaggcacuugcccagcacagagcugccccgggggcugguuuucucugcuggucuguccuccagggcugcucugucagggaacgugcccucuguuggguguggcccugggaggccugggcagcuggcagcaccugggagagaacaaugagucagucaugcccgcucccaggaaagaauugacguagcacgagcaucucugccagcuccagugagagaaggucaggguucaggaauugugagcucuggcuucucgagagacaggaugcaccccggggccccuggggagccggaggacacagaucccaguugagugcguaagcagugucaacagggccagcuccucauggccccuccuuguaagcgcugauccccuaaagaaaggaauugcccuacuuagugcccagcaugagcuaaaccacauaaaccaaaaaaugacaaaucuguuauuuuaaaaauuaaacuuauuuugaaguaauugcagauucacauacagaaugaauucacaggguaggagaagguaauacaggaggucccuuaaacccuuucccuggugcccuccaguuguaacauugugcagaguucugguaacagcaacacagcggagaaauugacguggauagaauccauggauacuauucagaaaucccuaguguaacaugcacucauuuggcuguguauuuagucugugcaauuuuagcacggguaggucucuauuuguaccagcccaagaauccccccguugcccuuuuauagucauauccacuugagguggccaggacgguccccagcugaagcacauggucgacacacauggguagacacagcugaccagcuucuaagacccaguuugcucaaagaaaguucuggaguuggcguguccuaccuacuuccuggucucuaagccuggcaaccacuaauccguucaccaucucuccagugucauuuaagaauguuauauaaauggaaccuuacagcauugccgccuuugaggauugggauuuuucacuuggcuuaauucccuuugagauucauucaaguuguuguauguauggcugguugguuucuguguauugacuggaagauuuuugacccagccuuagaccagaacacugcggaagaggaaauccaucauggaaacccgagagugacaggacccuugcuuggugacaaguagagcuggucaugucgacagcccccucuuaccucgucgcgucucagcagauguccauggggucguauugggagugacuuuuguaccaguuggcuuggcugauuuuggaaagaguggaagaacccccuucaccuugugaguuuuguucaucuguguugcauguguuugcacaguguacauugacugaaacaugaagaaacagcccuugggcuuuugagucucgguuuucuuucuuggcgcucaugcucucagaauaauaauacguguggugcaggcccggugcaccaggcaagugagggcugugcuggcaugguuucuuuaggaggaaggccuguugcaccuauguggcuuuggcaugcuucagugaaaacuguaaaauuacaagucccaagaaucuaaucucacagugaaaauguugaguuguucauucagaaagcacgcuugcccugcauuuugaacauacauacuuguguguauuuauauguucaucaugugagaacagcauuugugaauugcuacccucaugaacauccaugcugaaagguuguccauucuuuccaaacugcagaaaugcggcugagcaguuacauacguguguaaguuaguucaggauucccaguguuagugacuugaugcgcaugaaucaauagauaauauuucuauguccuuuaggggcucugcaguuauuuuuuuuccugaaucaagacuaaagccagcccugcugcugauuguaggcaagugcccuuugcuuuuuggggagccaggacuggaaggucucuugguucacaggccuggguuagggugggccgcagguuggucuggaguuuggcuuuucucucccaucccagauuccccugguaagaggcugcgucaccugcaucgaggaccaucagaguuggguggucggaacucacuuuggcugaaugugaaggggcugcuguuugggagguuucaccuccgugauguguuucuugagccugggugacagcgugguguggcgcaagguggaaaggaguuuguugcugauggucugggggacgcaggccuuuuuccccauuucuagauguuguuguauucguuuggcacugugauuaauucuuaaaaauagaaugaguugcuucuagagggaauauauuuuggacccgggaauucaguucugucuuugggugcuuccuucauggcuguguuugcagaguuucuucauaugcuauuuucugugauauacauagccuugaaauggauuuuuuaaaguacagagucugaaaagugaguaguuuguacaugguggguuuagcugcugcuccauuccacagcaaggauacucuucauuuucaauugaaaucucccccaaccuugagguuuggguucauaauucaguuuaaaauuaaauagaacccgguuuccuucaggccucuuuucuuuccaggacuguggauucucgaauucaccaagccgugugaguaaagcauuugguauaugauacagcuaacacuugggugccucuggcgugccaggcgccacgcugagcgcugugcauugguauugccugugcuucccgcuguggccccaugagggagguacaggugaccacaccugggcuccugggggaagaagagaaagcagagggagagaacacucuccuggggugacucacagccucacccaagggcuccuuaccauuugguuggucucugagcuuugcaggauaaaacuuggauucugucucugcucucauggaucugcccaucuaaaccaguuacagaacaggcagcccauuuauguaaugccuuuugcaauagauaaaggguugagggugaggucauugucaggggaaggcaaugugagagagucagggucaaggaaccgauaucuggccaccuuaauuuuacuaacuucacuuucccagucaguauugcacauguaguccauugaucaauaguguugacaugggcagggcaauuagcugggcuugggggcccgugccuguacaggaggcugagcccagaagaauacuugagcccgagagguagaggcuguagugaacuaugaucaugccacugcacuccagccugagagacagagugagacccuuucucuaaagaaauguuguuggcugguggcucacaacuguaaucccagaacauugggaggccaaggcgggcagaucaccugaguucaggaguuugagagcagccuggccaacguggcgaaacccugucucugcagaaaauagaaaaauuagcugggcgugguggugcaugccuauaaucccagcuacucaggaggcugaggcaagagaaucacuugaaccugggaggugcaaguugcaguaagccgagauugcaccacugcacuccaaccugggcaacagggugagacuccgucucaaaaaagaaaaaaagaaaugguguugauauguaaagcuggucacgcuuguaaguaauuuuucagggacuguggacuuugagccauuugguucucacuucauuuguuuuuaaaugccacuuccugcucaucuuccugcucauccugcuggagucuaaucuguggucaaggacuuggcuggagcccacugggaagucuccuuuggcugagcccugacaaggcuuuggcugugccucuuucccggcaucagucgggguccuagauccucgcuggggcaagggauucucgcugugucucuccagcccaccaauucucucccagguugauuggcuauuggaauugagacaucugcauugaaauccccaagagaacauccuuuucuguaucgaacuugcaugaggguggagggacacuuggcuuuuuucaaaacccaccuuuguaguacagcagccacgcagggacuuacauccuaaauggggccacuuuacaauguugguguggcccgaaaaccugcaaggcaaagcagcccaggcagcagcucacuuucugcaccccagcuucagagcccuccugacaggagcucacagcucacauuuuuccauauuauaggaaaucaugcucuuugcagaaaauagaaaaauacaggaaaguauaagaaauaaguaaaugauaguuauguuacacauuguaaaaauccuuuuuaaucuuagcauggagaauaacacuuuggaucuauucugucucuuaugcauauacguauauacuaaaaaugagauucacugaagaauguuuuaaaauaugugagauuugaauacauguuucauaguuuauuuuccauuugaccuauaaguauuuuuccuaugucuuugaaguauuuugaaauacuuuuaguaaauacauaauuguugagauggauagugucugacauaucccuguacagcucuaucaggagaaaauuuauccuacucugguuuccagcauggucugguacaucuugaccacuuuucuaaggauucccuagggggagaguggaguggggcauggaaucucaaguuuacagaaaagaugcccacuccuuccaccgcagugggagugggggucacacccucgcugacuccucagagcagccagcauccugcuuuuggucaggggaucuugcauuaaaaccugccagcuuuagagguuccaucucucgcugugguaugggugugugcucugaaugucugaagaccccucugcucaccuucuggcccuguguagggccuauaguaaauauauagucuggcccuuguuagaucagguguccuugggauacccuguggaaaggagcucagaaaaccccucuuggucacccuaucagggagaaagcaagaccggagccugacaccaggaugccccagcugguuaguaguggccaccaguuggagugagccaucuccuauguccgcuccuucuggcagguuccugaccaucucacaggggugugugcaccuccaccagcagccgccuuguccacuuacaguguggaaccauggaagacuagagacggauaccuucaagugcuucugaguugggauguguuuucuacuugucuuucggagcugcgcgccuuugcggggaccucagggccaggcuucccucugagccaggcugauuuuaagcguuccccaucccccccucccaccccccagcgccuccacugcacuggucucuuucaaguucaggugauuuccuggcuugucuguaaguaggacugucgugccccacucagguacaggugugugggggugcagccaggccccaugagccucagguccaguugcucacaccggcugccucugcuuccauggcccacgggcagcuuugggugugggaaugcagcuugaauucacaaaaugacgucguugugugggcugcuugcucguggauccacuuuucuuccccccuuucaaaacuuggcccauggcagccccgaucagcagcacccguuuaucaauuuguuccuuguuccuuucuccaguuguugccaggacucccaucuggcauucucccaucucacgcccuuguuuauuucuccguccuggagccacuucggauggggcacuucuagaagccuagcuaaugccgcaagggcuucaaguuccuccuugucacccagcucgucucaaguccguuggcccugucaucuagaaaagcugaaagcugaaagagcaggggaauggucacauuaauugacuacaucugagacaacacuggaaacauauccuauuuuauuuuucuuuaaaaaguggcaggauuccaagacuucccuuccaguuuuccacugguuggccuucuauuggaagacgaguucuaaaaucuuggcuguugggccuuuuuacauucuuaaaaccagcugaauauauuuaauauuguaaaauuuccauaaacacucucugacaaagacuguguauguaaaguuucugccuagagggcauuuuucuucucagaguugagacucuugggcaucagggggucauaaugaaguguugauuucaccugaagugccucugugccaacguggcuguauagggacauggaaagaauuagcuuucgggguuguuguuuuuuccuucccugaauaaaggauaauuguuuccaagcuaauuaauaugguuuauuuauuacuaggcaauaguugguggaauugaaucucgggaaggaauaauccagcaaugcuaaagugacaaccucucggguacacccuguucauuccuguccaguguguaucugacacucagcccuuugguagacguugucauuuuauuguauuucuuuuccccaugugccaaccaaacuuggacuccacacugcuucaugcccagugagcuuggccuuucucaggguggguuuguccuuaaaggcuggccaggcgcguaauuaauauggugggcuuggggggugccgucccaggcaacguugagcugugcugucaugguagcagccugaaguccuuguuagagggcaugggucacacguguaccccacuguguggugcucgguggcagaguugagaagugaggagagguggcaucucccacugccguuugcucagggaugccugucuuuacccccagcagcccccaggacugcacaugaccucuuccugcagagccagcuggcggccaucccagugccaccccccacugcccccguuacaaugcguuguacugcgcguccucacugcaacugaagagagucggggcagaggaggguugggaaggccagggagcgggaugucgccuugugggagagcacagguguggcccguguucacacacagguggccagagacugcacugaggguggcugggggugugugaaccaggagccacugugguacgcaggaaaggaggcgggcagcugagugccugucccugguccuucagggaacccauggguccucugggcugcuucucauggccucgagucaagggccaccauccugccucaugcugcuguaggcaggucaguuuuggggcagagcauuuggcuucuugacaagauuuugcccgaggcuuuuccuugaccgcugcccuugaacuugaaaucguugggaggaucugcuaugggauguguggggaaagccccuggcaccacuuuccaugccauccgcucagggacugggaaacagcuacaugucuuccuugugguccuaccauugagaguccuccccuucccacauacugacugauaccccgaggcagugccguggugcucuagggagugucaggcuaggagagggggcuugcccugggguaucugagcugugucuggaugccuccgaggggugggcgugauccccagggcuguggcuuuagcucggcuucugauacagcucggcuucugugggucccacuuuuagcacccccaugguaagucaccccuucugaagggggccagaguguugggaggaggggcagaguguggggagaagggugggacauuuccuggguacccaugugacgggcccauuuugagaaggccgucagcaugggugccgagggagugucugugaggcagagggcguucacucguccuaacagacaccaugcuuccagaaaccucaggccagcuguggggcacugugaccugcacacuacccgucucuacgugaggcguggguacaggccuuggccccagaguuugcuugggaccuuguggcacagucauucggugguuugggcaacaguggggcgggggcugagugcuggguucgggccuggagucgguggccccuccugagucccuggggcagggaccagguuucuguuuugcuccugugccucuggggcuuggcacaguccuggcacugaguaggugcucaggaaaucccuguugaaaggauccaggaguuugaggucauaguugauguugcaucuaguccagagaggucucugaggaagccuggauguuuguggugggcagggguguggaguauagggggcgaagacuguagacuacucugaccugcuaccaugcccugugcuuggggcagaagugcagaauucuggaugguucuuuacgcaaucccucuuuucugagcacagccauaccacaggauggcagugaggccaccuuucaagggaggggaacgcuugggaugccuaaccauuaaccaucaaugaccugauuaggacuauuggauucuugugcugaaugucaacuguuuaucucaugaguuaggcagagaugaguuucuuagaagagguggauaacggccucagccuggagacaugucuggagucugaugaugacacacaguuauugagugcuugcuguaugcaggccuugggacgaaccuuccauggguucucucuuucaaagggccugaccaccugugaagguagaugcuguuaccuccaaaucacaggcaggauacuacuucucagccaccgaugcuggccugcggaacuugggauuaauucuugcuaacuccuuguucuuucccuugucccuucccagaguccauuaccugugggaaacuuuugaucgccuaagggaugguuuuguggacacauuccaguuuucucuuuuuagcaguaaacgugaacggugcuuccuggagugugaggaacacagcgcacaguggugcuccguucagccagacccguggaaaccaugagucaguuucagauaaggcuuuccagggugcaagggccccuuuaggaucagucuuucuucuccccuaauauaugcccacgcugagcugaaguucugcucucuggcuggugugacccagccgcagggccagccucaagaggaggcagcaggaggugccccaccuugaagcaggggugaugaauccuucgccauccacggcgggacaguaguaggaggaggagccuagacagccaaaaugugaguucaagcagaaagccucaaguccuaacgagagcuggcacaugugagcuucagauggcagaaauaucacuagaaaucccuccugcagagaaagcguagguaagcgggcacuugguuagaugaaugcugcucacagcaggcggcaugggggggccaggccagguugagcugcucgccuggccucuguuaucucugcauuugggugggugggugggcaccccuuccaugccaugcagaguacagaagcuguucugaaagaacgcuaugaguucaagugaaggcaggcccaguccuccuggaaggagccacaccagaguuucucagacgcccccaucaagaccuuuuuagggcucauugaaggcuucuaaagguucuagucucauuuaguuucuaagaaaaggauuuauucacuacagaccuaaaacguaauuuuuguaugccugacuuaguauaagaacaaaacacccaagcaguggcggugggguaggggguccugucuagguacugcagccucaguugugaguuuccuauauguggaaggugcaggaacuagcugaccacagucugguugggacucccacccccaaauccaucucugggugcugcgguucucuucugggaugugugagaguacacaccccccugucaucagcuguaggcagaucacauuugccgcgggauguuuaauaaguucacgcagguugaugguacaggccagaaauaggaccccugucuggcccgaagcagccacgugaacuuggagggggugggcaugcugaccggcaguuacacgcugaggccacuucagcuccugcgguugcugguucagaaguaguggugauuuuaaucagcuaagucauuucugcgucucguuguauacuccuggaaguucuuagagaaauccugccaagaaaauauccccuggugaauccucggggcacuaguccacgccgcacugucagcaaguaucugcugaaacaaguauuuuugaaucuuuagcuuuucuguagcuccagucuuuuuaaaguacuucuuuugaccuucaaguaacaacgagcacuugcuuuaaaauucugacagucuuccaagccuuuuaacauucuuauuccacuaaauaagcugucgccguucacugggacaggcagcacaguugcuugaacgcccggcuugaaauuccacgaaaugucaccuccucugugaagccuucuacaaggcagacuugucuauuuccuacuuaauuuuacuaugaaauaucucaaauuagaaccuguacccaccaucaagauuagguagauguuaacauguugcuacguuugucuucagacauuguucaaaaacaaguaauguuauagucauugcuaaggugcaccuccccaguuccuuuuccaucccuccuuccuuuccaaaagggacuacuuccugaaaauagauacaaucccuuuauauuuuuggaaauucuguguaaaccauuggaaauggaaggagaaagccugugacauacgaagacaagcaacacuaaucaggaguauaaauucuguuuugcaguuaauuaaauauuugauucccuacuauguuucaaagauaaauaaaaugugauuaaguaaaaggcauuuaaccuuuagagacuuggagaugggcaggguauauaguagccugccagcuagaguagggaagauguuaaagaagauaaccugugagauggguuuugaaggguggauaggaguuugccaggcaagcucugccaccucaaaaaaauaguuccuuggcuguuagaugcuugugucacuauaggcuugggauuacugaaaagcuaugcuugucccucccuuccuaacacuucugaggcuggaaugucugucucccaucuacuuccuuaagagguguggguuacagugugguguacaguugggagugaauuacuacuugaccuuggguacaugauaaccuugacuguagaguccaugcuuuuccugaguaguucuucagaguccuuccugccagugacuugguucuagguguggagcaggagcuggcugucggaggacucauugaauucaguggaaacagcagggagcaugguuuucuuuugaauggaaaccaugaguguagcaguucuucuuuaugacuugcuacauaaucaugcaggaaaaugccugucacgggauuggauccuaggagauuagccccauugcuaauuaaaagccccauuaaaagaggggaaguucuuuuagguaucuacagcuuccuaagauuugaaugguuuacaaagcagaauguuggcugggcaugguggcucaugccuguaucccagcacuuugggaggccaaggcagacagaucagaaggucaggaguuugauaccagccugaccaacauggugaaaccucgucuauacuaaaaauacaaaaauuauccgggcaugguggcaugcgccuguaaucccagcuacuagggaggcuggggcaggagaaucccuuggaccugggaggcggagguugcagugagccgagacggcgccauugcacuccagccugggugacagagugagacuacgucucaaaaaaaaaaaaaaaacgaaaaagguagaaugauggcugggcgcgguggcucacgccuguaaucccagcacuuugggaggcccaggccaguggaucacuugaggucagaaguucaagaccagccugaccaacguggugaaaccccaucucuacuaaaaauacaaaaauuagccaggugugguggcaggcgccuguagucccagcuauucaggaggccgaggcaggagaauugccugaacucaggaggcggagcuugcagugagccgagaucgcgccauugcacuccagccugggugacagagugagacucuuucucccaaaaaaaaaaaaaaaaaaaaagucaaaugcagcugggaaugugguucgugccuuuuuguauauuaaccauuugaaacuugguuguaaggugggguuggcaaugucaggccuggcugcagcagcucaugucuuuagagugugccucuucccucucucguggggcucgagcaagacuaccuucauacaugggcucuccaguuacauagcaacuccaguguuaaauuccaucuuuucuuccuggaaaagccguagaaaggacaccuggacaugccugcugcacagguugucugccuuccccaucagccgcagaaggaggaacuuugcucucuucucucacagcugugugugcauaggaaguaguucggaugaugugggucccaccauguauuccuucucuguuccauguagaguaaaauaaaugggaguucuguuuaaugcaucaccucgguucauauugcauuugccaagaaagugcaauuuuauugaacauuaggauugaauucuuaacugaguaaucaauuucaguaguaaguuaaaaugccuucuauuaauggacaacugcaaccguuaaucagaguuacaguagauuaacaguugucagcauuuaugcuaauagcacuuauaaaccgugggcucaugauuugcacuuuauaauuccauauuucucaaaacaguugguaauacuuuuugcuugaagguauugauucuuuugucccuuugcuugcuacuuggagauguagagaaagcuaaaugacauuuucacggugaugacacaauaucaccuucugcuuuugcacacuuggcuuugugucaaaauagauggaaaggguucauuuguucuggugcucuacuguuuaauuugaucuggugugugacuaaagcaagacaaauaguauuuuuaaugaaaccauuuaauaaccucugguagcuuagagucgaaggcauuggaaaaaugcaauuaaaggaugccuagauguaaacaaaaaaaaaaaaucucuacuucaucuucacugacuccauucauuuugcuuucaggguuucaucaccuuaaaugguuuugaaccaaugaagguguauucccuuaaaaagacggacagcccaucgugugaacuauagaguuuguggacagauuuauauuggugaguuauugugaaauaucuccagguaaaaguucaguuuucuagaauccccuuugcaauguguguucaauuaguugaugaguauggauugccugcagccucuggcuguuucauugggaugucuaaucgugggaucauauugauugucuuucaauuaauugcaucuaguauuuucauuuaucaaaagcaaaauacauguaauuaacucugaagcaauauaguucaguguaaagugauuuuugcugcugcugcugcuauagagauaagucaacggaaauuaugcuacaaggaaacucaagucagaauggaaauaguguuaggauuucucgauguauuaauuaaaaagaauaaaaaugaauuagagaaaccaucucaugacaccccgagucagucauaagugauagauggaugucuuuaggaagaaggcggcuuguggauacuggcaccucuucagucagcuuaggcuuuuaguguuaccagccucuaggaugucuugaacauaccaugauuuuucuggcggaguagauugggaaugugggugcaggcugagaugagcauucaaucccuaccacacucauugauggauggaguucaauccugugcccguagcaggguuuugggauucuaaguuucauuucggcaugucuuuagccauuuuucacaaaaccuggaucuuucuuaaagucucaaaguggcaacuucucugauggaauugauuuuaaucuugcuuuuuaaaaaaaaauguuuuccccgugagguaacaacaucauucaaaagcaagggaaaccgcuagccaauuguguccugucucucucaccugucacacuccuagcagagccuugaggggacuagcuuugguucccagagagguuuaaguuugugaccaggcccucaggccuggcuuccugaguugcuggaggcaguuagagacuuggagcccaggggcacacaugggugaccaccugagggggccaagcugaaucucugccugaaccuaagcagcacaguggguuguaggaucaggaaaggaucucugugugucccuuccuuuucuccauaaaguagaucuagcuggggaaacugagguagcugacccagaccuagaccuccaaauauugcuuaccagcuuggugacugagcaaguggucucugcuggcacucggaagccuuaucugugaaucgaacagguggauugggcugguacccaggacccuccccacccuuuaagcuugaauuugauguagaaauucagaacccuuuccugggagugcucugacagggcuuugcugggccaaaggccauagcagagcgugaagcucgaguugaguuguguaugagaggggccccucagucaucuuugaacacuuaaggcucuuagcauugaggaggaugaggaacuggaagucugauggaauguucuuugguggaaaccugagggaggucaggaccgccacucgcaaccuuauucaguucagccuuucaggacaaacguugcuuacuuuucuggcucucacucucagaccugugugcuagaaucugcccggguuucucaggcagagacaaagucaccuugggccugggguuggcaaagauaguuccaguguugggugcuggguccaaagauguuuucaguggguugggucauggugauguuuccaguuggacaccauggaacuggccauguuggacauccacgcucuuucacccagacaaguaccaggcccugccugccugggagcaucuccgcuggauggaccaucauuacguuucauagaugcucauuucaguguuggaaaucauuuucucuaaacagaaggaugugggaacuugguguauaaggaugaaauggacuuuuuaaauaucaaaaaugguugaaugaggacacuuucauuugacucagucuaauaaccagagccacucugggauccuguuuagcagugaucucccucucagacagaugaguuaacauucuccaaaugcauccagaaccagaaugaaauugugacacgcuuccuguuaacaaauguuuccugagugcuaagcagacucaagacacuuacccuuaugugggguucccaccauuccuguauuuuuggcauccuuuuggguaagaguuuuuuauagcacuuuggaagagcuuaagagacuuggugugguacuggagcuggccaucacuggagcauggucacugugcugugacaacagcucaugguguccacggcccacgcacacacugaguguggccccacuggcccaccugcuccccgcccagcccaccccagaagcaggauaaaacuucuccccugaccacuugcagaugcucucaugguggaauucucacauggccccagaaggcguguguuugcucucagacccuuucugcucuguggaacgucaccaugcccagggaguuguauccagcucugccugcugucuacaugcagcaacacaaggaggucaugugggauuguaaccaaaguaaggaccacguauggauuucaaccagagcccaccuguugagaucucuggucuagacacaucuuuuaaaaugugggcacagaagaaggagguagaugaaaaucacgugacaccaucagagguaauggugaauccgugaggcccuagagccauuuauacaucguuuuugcccucuuaguauuuucuuuagcauguccuaauuuuaaaagcaucccauuccuguugugcuagacuuaauauuuugguuuauggccgucuuuuuuaguaacuugacgucaaacacuucagccuucuccugacaagaggcucguucucucaguaaugaauagugacgugcuaaauuuagaucggaugcauguucugcuuuuacuaucuguucuguauguugcuauuugucagaaugaaagcucaaugugccagauggcuuugcuggcuucuccuggaaaaagacuucguucuccaucacuucaguugggucaugguuuuuuaguacuauuuuguuguuaagcauuaauauuugcagcaguacccaauuaucuuuuuuuaacaaaagugucacagaaaaaguguuuuugguuaaaugcucauaaaugagggggaaugcaaaucaaaucccuuaacuuuuauuauauuacguaaaauggugguagaauaguugcagcugugguuuugcaaagauaggacuguuuccggcugccaugcaugcuguauuauguauuuugacagaucuccaggaugauguagaagcuuggccugccgaccagggccucugggaaagacagucugaggugacacagugcuggaaacucagugugcuuggugguggaagagggguuugccuugaucugcugugggaacuaggcuggauuuccaucugaguuguggcuguagcaggccaccuaguugaggucaucuuccugaucauugguccucuagccugcuucuggcaggacagauaucuuuuuuccaugaaaaacagaaggaaaguauugaauuacucuggaaacacauaccuaaaccuugggguccgauugucaaugguugugaagugguggagguguuggcgccauggccacugugccacucuggucccaguguguggcccccagaguccuucgggcccuuggccuccugagcuccuggccugcaugcauccguggggccuuugcuagggccgugugauccugcuccaguguuugggccagaagcaagacugccaacauccgaaaccacaaaccagaggaagauccacagggccuuucaucucugggguucucuaggugagaaacagucaggaggcugagauggggcaguggggaagaugccagcgaagcuuuagccagccuucggaguaggggaggaggggcccccgcugaagcucuugguucuugcuuggauuuuauuccugugccuucuggaugugaguuaugcuucggaaucccagccucccuccaccccccaaggauaaaugggaggcauugauucaguguuuguucuucucuccugagcaucucagcaaccuaguguggccucccaaguagggauggagagaucaccccguccauuccccuucuuuuugcuuuagcaucuacauggguccagggucacacaggggucacgcccuccauucuccuggugagucuggcuuucugcuguuacuguuguuuuccgcuuccugcgccacccuggcugcugguucucaucagaguggauuugcaaaguagggaggaagagaccaggcagaaggccugaauuuucccacugugacccaugugucaacacuguguggccggccuggguggguuccugcugaguugcuccuucgcuggagggguaccuccgagcagggcaucugcaggauggugggcacacuugccucucacucuuggcggggccaggagucucuguugccacugagugacguuaugcugggaaauggaggcgugguguccgcuucucuuuccgugauccucauacccuucccaagacccccauuuuguuagugaagaacuugacgcccagauccaccugccagcauguguggccuuagguauaucuggcauucaggagccgaugaagcaaccccaaacucaggucgccccgcgucccuugcugguggaagccuuuccggaaacacugugguagugagccuggcuucccauacacugcagggucccuuuacagugaagauggcuucccgggggcuuugauauuccuggaagcuuucucagguuugucaugguaccguccccacacccaggguugugggaggaagagcacuugguccaugugaaguggggccgcacauggggugcaucuuuccgcugagaguguggcagugugcagagaaugggccucugcuaccccucaucagccaacccugguggagacccccuugugcccuagacaggccuggccacugaacugagggauggcagcccuguugugugggacagccagagacacgggucagcggcugauuucucugaggcuuggagcguguguuuguuaaaggcaagaagagugggaaggaguggauggagugagcggcagggccagagccucacuuguugaagggagugguggugcauuguguuuacugucaaguuucaggcuggggcguagaugccgaugugcaaaugaguaggcagggaagugagcuuucucuuauuaaaauguuggcuuacuaaucaaguguugcugggugugauuaguggcagaggaaaagguuauuucuuucuguaaauauuuuugcuuaacauuuaugcguuaccauugcugauuguauuaauacucuuagaaugcauuagaccaauaacuuguuuuuuuuuaaaaaaaugucuugguuuuaagcaguuucaguuggucuuuauggaaggacacacagcauuucacugaagcuugagggaucugccagguucaaguguaaaggggcauuaguuucaacuuagagcagcucccccagcuacaaaugcugauaaaauagcucagaagugcaagagccugguuacuuucaguaauuuuaggauuuaguaucuggaucugaauuuugaccauuguugaaggagcagauaauuggaugcauuuucuaaaguaaugauuuaggccaaggagggcagauccuuugagcccaggaguuugagaccagccugggcaacauagcaagaccccaucucuauaaaaaaauuuuuuuaaaaaaucagccagguggugguguguaucugugguccucagguuccagaguagcugggugggaggauugugugagccugggaggucaaggcugcaguaagccaugauugcaccacugcacucagccuugggugacagagggagaccccaucuccagaaaauguuuuuaaaacucggccagguggcggcgccugccuaugccuggguggccagauugugugagccugggagcucacgucugcagugcacugugaucacaccccucuacuuagccugagugacagaggcagacccugucucaaauaaauuaauaaauaaauaaaaguaacgauuuaggaaauggcugagaauucccaugacccucguguccucgggccugguguuuucacaggggugggggcgggagaaggggagaaagaaggacgugcugucuguggcuuccuucuucccaggcauucauuuaacaccagcugaacacauuugcuuuauugauugguugauucauuuauuuuuggcaaacuuggcaacuuccaccuggccccaugcuguuaaaaauaaagucuucuuggucgacugaaugcuuuugcaauucauucuuuccauguagcaauuaagaugauuccccuagccuuguaccaguuaaggauaaauaggagguuuucaaagaaaaugcugcguaauucaucggcauuugugugugagcacacggguaauacaugcgaguagccuccgugaguggacuccuguguaaggagguaaaauggaacguuuuucugcacuuauccugagaagcagcccgaacagugacauuuauacauauuucauaaugugguuucuucaggcacgcggagcaaacaaaucaauuucucagcaguauacuguuuaaaagaaacagcaacaaccuguggggaaguugcagaagcuguuaaaauuaauuauauauggcaaaaagauagaacauuagggggaaauguuaaugugggaggaugaaaaaacacagccguggaugagcagcagugcagagcaucugaugacaguguuuaauuuccguuucuuuauaaauguauacugaugaacaacaauggcgcccgcacaggguccuccuguuccguccuuucuccaggccgcugggaucgaauguccccgugagcauccagucagcuccacguggugugagccuugauuucugggaacgguaccgugcugucuuuuaauagggauuuguggaaaacgagaauugguggugaagguaucgaauuccugagccuuguaaugcaacaccuuucccguggucaccuucccucuuccgguucagcuauacguuguuuaacucaaaggaaaccuuuguugucguggguaggguguaaccugcaacuccuugaaaaauucagcuugggugaucaguuuccucagggauguagggggagaggcucuucagcaggggugggagggugcuuacaggagggucccagagcugugggacaggcuugcccccuuuccugggggaagcucgccucuuucccggacacugcagguuuguaggauauaccccuugguucagcuggucauggcaagugaguccucccuaucacccacuuccgcgguggugggacgccuggggggcauggauggggccugcguccuaggagaccuuggcuccagcugcucgaggccacuuugucucuucugcaugucgcagaagcgucuguaccuccugggguuggcuuuccugugagcauuugggcucccucugccuggguggccuguugucuggagggagucuucagucccucuuagugcagcagccaagggugucucuucucacucccugagccuucugauuccuguaucaggggaaguuaaaaaguguuguaaauggacuuggaccaaggagcaggacucugacuacgaacuuagaaccuuccagagugauuuccgcagcucccugaagcagagcuagcuccuugagcucauuguccccuuaauucugugcauggccugcauauuguagaugccccagaaguaauuuuuugaaugaaugaauccaggcugcaguggggccagggggguguggagugggcugggcacauguaggagcgcaucgcagcagcugucuggaaggcuggguugguucuguguuagcugggaguguuuucugcagacagaaggcaacccagcauguuauacuaccuguucaggggaggugugcauguucugagauaaucacgccguguucuugagcuuuccaccgcagggaagugaagucaugcccccgccucuccuuugugcaaguagggcggggagucuaaacccaugcagguaggguguggggacccagcuguacucucccgccaccugugggugcugcucuugcggcagccucguaggugagggauaaugugguucagccaaccugacuacauccaagcugggaugaugaggacagcaagaaggcccacuggcucugcaaguccuguaggccugggucccucgagacaaagcucagauggcuucuguaucaaauucaaggacccagcaugguggcugcugcuuugcucaccuucagaggccuggaagcugguguuuccugcauguguaacugacggccccagucccacauuuguuaaaaaaaaccuucacuuugaugagaguacaguacuccuggcuuuuuguaauucaauugaaacucacugccacucccucauuacagcagaagaugaccucuaaaccaugacacagggcgacagcuuccucugggaaggaggacucaacauugauuugugcucugauccccaccccccugcaaacccugggcuuaaguggcagcacugcagaggccugcugaaggccggaaagcccucucugccuguguguuuaaacagagcagauugaugcagaguuugauguggccaggaagaauucuuuagcauggaauugcaucauaacagucacucccuccaggagccccagcggcucuggcacuuccuccugauguuugcaaggggaagguaaugauucuaauugcacaggacuugguccuggccuuggugauggcaggagggcagaguccucaugguauggccaaaaaauguuuacaacuugaccuuguccuccucugaugguguugaccuuggacaaacuaugccccucugagccuagugccucaguuucccccucuugcaaaugcagcagguaguagugcuuaaucucagaguuguggggauucaaugaaacaguacugaacggggcuuaacagauaccugguacauguuaagagcuuagucaagaaugacugcugagucuggaaugacauuauggggacugacgagggaggcugaugagagguggcuugguggguacaaugugcauuguuucagcgaucgaggcacugaaggcccugacuucaccacaaugcaauguauggauguagaaaauugcacuuguaccccaugaauauauguacacacacaaagaugauugcugcaguagcagcaguaaaugcacacagccaaaggcuuagcaugugggagaugcccugcucgccuggcugggcuggaggggaagguaguacagguugcaucucuccaagccgguaccuguggucuauguugcaaugaacauuucgaugcaagacgaacggaacucaaaccuuucuuggucgugaaggucugcuguguuccugaagguucugucuuccaccuggcacuugggauguggguugcucacuccuugcccaucgaccugguaauaauguuuuccuaucaagcagugaaagguuugggguuuccaugaagccuuucccaaaugucacgcauugggguuuuaguugugagggugugcugaucccagccgcagccaaggcgaggugcuggcaccaugcugcugcacccgcuccuaugcccaccuggacaucuguuucguaauggacauccuucccugggaacaugucucuacuccuuuaaauggcuugaggucucugcaauuugccugaacauuaagugugaccaaagagccugaggccagccauggagaggacgaagacaugaggcuuucucucgagagccacacugggagaggccgggaacacggccacuucacaugaaaggcgguuagauucaggucacugggucuggacuccugcauuuuauggcaaagucuaaaaaugccgauuuguaacaaccaauguuaaugaauucagacuguuugaauuucacacugaauaauggcuggaauuaucagagcccacagcuuauaagaucccuggaucguguaaucuuuucucaagauuuaauugauagaaugauguaauaucacauuacuuuuauuaaaaguucuggccauaaaagagaaacaccuauuaggauagaagaauuuaguaaaaauaguaguaauaacaagacaguuuggaauaugucauauauucaguaaauuucaaaagucuucaucucauuuaaaauacaguauugugcccauagauccugaaugcaauaccuuuguacccuagggcuuccucuuuccuacacuaaaaacauucuauuuaaaugcagauuuugauuugcaaucuaggaagaggauucuggaagaaugggaagaaggacaacucugcaucuauuaauuuuaguuuuauguuauucgcguuuuuccucucauccuuaucuccuccagcccuuccuuccuguaaaaggauccuuucuaaacauacaaauaaagacaugcuuagaauuucagcacauaagaauguuguuacgccuucuuuuauuuuuguuuaaaaauuaaauuaaaaaauuuuuuuuccaaaaauguuuguuccuuugauuuguguacgugugugcacguguauuugccccuggguuguagccuugucuugcuuuuccacacaugcucccaguaucuuaccuaggaaaugagcggaacaguggaauuaccaagugcagaugguagaacuucccuuaccagagcccaagugacuugugugauauugagcuuugguuacuaaauaaauggauuucuggcuuuugacauuguacucugagaauuggguggccaaucaucaaauaccauuuuuuucacuguugucugcauuuaauacagcaucuucugccauacgcacuugucaauucaaacaugagcguuacauuuuggucuuuaugaucugucaagggaaaauggaaguaaauucuuuauaauaugcuaauugauguauuugggaauuuuuagauguagacaacaucugugcaugccguuaacacaguuaauagcucccguucuucaauaugagaagguuuucagagucuaugugugaucuagaugagaccuucuguguccgcccccccaggacuuggcagugucaaauuuaaggcuguuuuuucuggugccuuaggacugaaucugagccugcgcaaaguccuguuuugaggaugcuucuggccacagugugcugggauuguguugguucugggaagagccuggcuggccagaccuggucuuaucuaucacccccaucccuacuccguccuagccuggaccagacuggcuggagugauggguccagagaaagagaccguggaccugaacaguccuugggacccuucugccacucuuggaggugccaccuccccugguagcuuggcaccauuuggguucuccuuuagccauggguuuuugacaacucaagagcuuauuuuccauacaaacuuguugaugguuuucuaaggcaggaagcauugcuuuauugagagugaggaauuguacccuuugaaagcugcccccugaaaagggaguggagagagauggcuccaguuggaguucaggauggggguaucuuucagugaacuuggggggagggcugagugguggagcuuggggcucaugucccaggccuucucuggucaggaaagcagaguugaaaagggcccuuuuaaucuggagggcccagaaugguccagccaguugccccggaaaggaagccucauguggcaugcgugccagacgcugcacagcuugaguugguccuauguguguggcacagccuuacaagguugagguauuuaccuuuauuccuauaaauugauggauaagggggguuaauugauuucucuuggcacuuggcaagaacagacgucagauuugaaccuaggucuagguuucaguugcacacccagcauguucugcuccacagccuuuuccuaaaauaguuuagauguugguauaaaccugugcguacugaacgugccugaccgugugcuaguaugauggcuuuucuacagugucucccuagacuccaugcuugcagaccgacagcgcguggaaaggaggcuuucuggcuugguaaaugcucagucaggugagcuugcugaguuuauuguaagcuuugcaguuccauuccccacacacccagugguggggauggagggggcgcagggaggagguggccccagagcagauugagccccuuggucuuugcuguagccaggacuccaggcuaaaguagcacagggugggcagcuccgaggccugggugucucucugucucucucucugucucucucucucucucucucucucucucugucucucucucucucucucucucucugucucucucucucucugucucucucucucucucucucucucucucucucucucucucucucucucucccccucccccauuucucucucuguucacccgcagcagccccaggcugcgucauuggcacugugaaggugcagggcacagguacaaauaggggggucuucuggccaucuuuggacauaaacccccauccucggaagcauggcccgcucauccccagguccuggccuuccuaagggcuguuaaacacacaucaaccaagugaugccuuacggaccacgcauauaccagacgcagcuggguaccguguauucucuugauauuacuauauucucagccaccagggcuaguguaugugggugucauugucauuagcagccuagggagggaauggaauuuggggaguagucugccuaaguuccauuccguucacuccaagagcugaacacgugcuggguccacacaccuguggacugauggcugggaccgucucagugcuuggcaaaaaagaaaacggggauagcaggcacuuuuugaacauugauuacugacugcugcugcuguuacugguauuguuggcauuuuuuguucguuugguuuuugagacagagucucgcucugucgcccagacuggagugcaguggugcgaucucgguucacugcgaucuccgccuccuggguucaagcaguucuccugccucagccucccuaguagcugggacuacaggcgcccgccgccacacccagcuacuuuuaguagagaugggguuucaccauguuggccaggcugaucucaaacuccugaccucaagugauccaccugcaugauccaccugccuuggccucccaaggugcugugcugggauuacaggcgugagccacugcucccagccucgucggccuuuuuugccuucugcuuguaccucaacccuuuggcaaaaaguaggaacuacagagggccugucauugagacuucaaguugccaaugccccucaccuauucaucugaacucaggcacauguacaugcucacacgugugcaugcucacacgugugcacacauacaucugacauggacacacugauaugcacacguguacaaauugugaaugguauggaccccacgugaggcaugcaccuaaggcgcgccuguagcagcgggacagagaacaggcuuccuuguacccuguacucaucacggggguugcgcuggcuuccuuggguuggcuuugaggagugcggcuugugacuucuccacgguagagaacugaggccuuagacaaauagucauccauuguaacuguucccugcaguguugauagaaaugguguugggauaauuagacugugcugcugcuuucuccuuuucucccagguugaugaguaggagcaguuuaauuugagacuaguaaauuuuguaauuggauuuaaaagacugaaaugagcggaccugguuuccauauuaccuuuauaccccagcgaggggaaaugcuugagucagguguggaucagauuauuuuauugugccaacauuaauauugggagcacacacauaaucuggagucagcagguucauccacuacuaucucauuaaauuuucaggcaaaagcugcaaaaauuaauuggaggcauguaauaguuuagaaugugugccagcuuaugguaauauaaauuaugugaagagaagacaguuuuauauacugagagagggaaaacugguuuacuuuaaugagaagagauagaaauguagagcuauuuuuucauuacagauacacucuaaaauguuuggacuuaguugaugaauagaguuaauucgcugcuacaguuccaauaauucauguugcacaguuuaaugacuucuagauaaaaacaggauugaaauguuaauuucucggaagaaauuggggcacucuuguauaucagacaucucccccccacccccccauuaaaccacuaguuaauuccaccaaacaagucucuuugagcuauuucaugccguguagacuuuuguauuucuuaccugggcuggcuggcuuuuuuuuaaaccuuaauguauaugauaaucuuaggugacagaauguguuagagcugugucuaggcaaccugacucagcagagaguuucauaccuuuuaguuuuguaaaugaccacgugcuauaaccugcauucuccuguccaguaacuguuucggcagggaggggguuuacuggguugugguuagccaucuguuuagucgaguagcgauguugucccacuucugagcugggaaauaggaaguauugaucagucagcuuuagauucaugaggcgauagucucaaaucaugcagagauuuuaucacuauguuauuuugcaucuuuguuuucuuuuucacuuuucauaacuuggagacauuuuuuccccaugggguagguucagcaaaguucacugucuucuuucucuuuaaccuacucucagaaaaaaagacgaaaaggaaauacgaaguauaguaaugaaguguuaacuaauaguggggcuacauaauugaguacucggauuuuguugccagaguucuuagaacaagaaugcaaacaugucuuauuucaaccaugugcgugcuguguuuugcuuuuuuuguguuugacaaaggggacaaaagaauaacccccuaaguauuaaggaguggagggaaaggagaugagcccccacucccugcgcucccuuccugguuugccuuuggguguacaguucauagggcuuccuagaaacggcugcguuagggccgagggggugaagacuuggcaggacuuccuggcagaggcaaggacuccccugccucccaccucaugaccauugggccuuagcaaggcuuagugaauccugaguggggucaucuuuagccuaaaccuggagucaccacagagcuuuuguaaacagugagaaaccuacuacuuccuacagaaacugugcugucugcaaagcucagcgucugcuccagccugaauccccaggcccugucccuguacacaccuaguuuugaggucaggacaucacaaaacaucugccaacaucgaaaagucaucaggagccacccagacgugggguguauuggugggaagaaggagcaucuuagucugcuuccuucugaggcccacaguuccagaaggacuagcguccucagagcaugugguaguggcuguucuugucuuuuccuggugguggggccuggugaccccuaacaccaacggagcuguucccagguucauuucgucccuuuuucuguggugagaugaggcuccuccugcccuccuugcuggguggucuuucuguuuugaccacaucccuuggaagcguggcugggcugcguaacuccagagcagccuggugguagcuggggcugccuucugaguuugggcugguggaugcugaguauuugcauucagagccuuaggcauugaccuuggcuuucugggacccuacgccccucuguuugccuuugucaguagagaccuucucacauuuagggauucauuuuuuccaagaucuguuugcuaggugugugucaaacuuccucccagagcagugacauggaugggaauugugaguguguugagagaccuacccuaaaagauggggcugcagucauccucaggggaccuccuguucucagcuccaccucagccacacuuggcugugggucagcuucuucugaaucagcauccgcaggacagcgccacccagcccugccacacuugcuuccuccgcgcuucuucagaggcuggagcccacccccaugcucgucgucuguucugcuuuuuugaugcacuuacuugucccuuucagcguauugcuuauguccuauguugguuaaaaaaaaaaaaaaaauugccgguaaucagccccagccauuucucagcauuucuaguuuggaacuucagagacuucaacuuacgauuccuuuaaggcaggaguuucuacuuuggcacuguugacauuuugggucuggugguucuucauuguggggggcuguccugugcaucauacaauguucaacagcaucccuggccucuccccacccgaugccaguguugccucccuccccaccccggcaugaccagagaugucgccagauagggcccaguguccccugcuugagagccccuggugaagggguagaaguugauuccauggcccuugucacacuguacuugagccauaccgugcuuggcacggaaaccacccuguagccguugucagagguggagcguccucccugaggugcguaacccccacaucaucguugcuuccuugggcuguguucuagcgauugcguccgucccuuuuucuccuugauugcagauggaagggcccugcucugagccgucgccacaugccuggugcuuggcuccaugaugcucacauggguguucaugacagugcauuugacagacagauuuauuugucaccuugucagggugacauguugggauggcuccaccacuugugugccauugacacuuggcugucugaaaucaggacaaagcaucccugagacugauccgaaugaggcuuaucagcaccaggcguaacuuaccgccugcuuuccucuguuucuuuaacuuuuaauugaaaccauuuaguuaccaccccugcugcuaggaaucuggggacaauuaggaaagucccaucuguccuuugaaccacauuauauugcguuucuccucgcaaucucaagaagacggcacauucuagcagcagugucuuugccuugccgucucgccucccacuggaugguuuuuaucucacuugaaugaguuauagcaacucuuuaauucaauuauuuucuccagugcaggcuuugagaugauuuaguugaaucaaacacccggguuuuccaaugcagagcagugacucccagcgaggccgugggaggguuuuuacauuuucacuuccagccacgguugcgcgcguucugugcugcccccugagcguccuggcacaagccccuacuuaccauuccgaggaguagauuggaaauggcagaugccgugggcuuugccagucuuuccccaaggcaaggaauuaucuguccagugauauuaggucacugcauucccacccagcugugucgaaagaagggaggggguggggcagccugggugaugggcaggaaggccauuuauaaauucaagugugguaaacagucgacucuccugcuuugguauuugaguuugaauuaaacaaagugucgugggugggagguguaucauacgaucauuuuaaccauugugccuuuuaauguggaaaaucugcccaaaauaggaccugcugcagugguuuucacauauacaaagaaguggcuagaauguucucucagaacagcacacaggauuagaaaggacauuuggccgcuggaauucuucagugagaauucagugauuaagccugccuucuguuuuccuugugggccgcaggguuccuguggauguccccacccucagauugcuggaguagaaaacuuaacuuuccaaaacacugaguuguuuucagcccagcauuagagguuaaagaugcucauguagaaagcacgcaggauggaucugacgaaggaaacagcuucugauacuugagcaggcuuuggacagugcagaugaagggggcugagauacugaggcaguaaagagaacggucagcuuggggucuggagucgcugggcacugagugcgcguucugagugccauucaagcaccacguaacgguuggggcugguguuggguccugagaugggccaugggccaccguuaaacucaggaagcacgugcugcccccccccacucuagaaggcgggcuguuuuccuggcgcugugugugccaugcuuugugugaacaucucacugggugucgcucucaugugguaacugggcauguuguagaagucguugcuccuaaacguaagccagugcccacauuggguacguucuggaagaaacaguguggcccaacaugggcuuauccagagacaggacaccugcugccuggugacgucaccaccucccgauggcaccacucuguucuacuccacugcccccggggccugacuugcuacuauggaacuaacccuguaggaugaggccgccaugcccgugugugugucuguccagaucuguccccacauacuugcugguggcgggugggaagaagguuagauaaguuacugucauagauugugacuaugaaguaauccauuagaaucuucagacaaggaaugcugggagugguggcucaugccuguaaucccagcacuuugggagguggaggcaggauggaucacuugaggucaggaguucgagaccaacguggugaaacccaucucuacuaaaaauacaaaaaugagcugggugugauggcacgugacugcagucccagcuacuagggaggcugaggcaggagaaucucuugaccccagaaggcagagguugcagugagcagagaucauagagaucaugccacuguacuccagccugggcaacaaagggaaacuucaucucaaaaaaaaaaaaaaaaaaaaaaagaaucuucagacaaggaaaccaugcucuuugaccuaguaaucucccuuccccacccaaugccaagaaagcucuaaugcaccaagauuuuaguuaugguguuacuugacagcaaaaagacagaugacucaagcauccaacagugggaaaacagcuaauucuuuuucaaaugaugccuucacaguuugaaauaaguagaaugcuugucuuaaaaugaaaagcuucaauaucaaauguugaacauuuaugaauagaaccauaaaaauaaucaugggggaaagcugaugaggagcaguucauagugauuaucuuuaguugguagaauuuugggugauuuuuuuuuccauacccacuccuccuccccaaauguucuguaaugaauauauguuuggguuuuuuuguuuuuuuccaagacagggucucacucugucacccaggcuguagugcaguggcacagucacagcucacagcagucuugaccuccgggcucaagcaguccugccucagcuccccacauagcugggaccacaggcaugcaucacgaugcccagcuaauuuuuuguuuguuuguagagauggggucucccuguguugcccagacuggucucaaacucccgggcucaugugauccuccugccuuggccucccaaagugcugggauuacaggugugagccacugcaccuggccuauguuacuuuuuaaauagggaauaaaauagcuggucacccugaugcuuccaaaggaaucaugcauuuguugaagaggggaacagugcaaugcaagauuuacgaagacagagcugauuaccuucccuccccaguccucagauacugucuuucuccuugccuuuaccaggacguacaagugcaucugagcauacggagggugucuguguuggcuuaccgaaaggaguccuguuacuccugcauucccauucgauauggcagauugugcauagauaccucugcagaccaguaggccucuccaauacuuuucuuucccucuuacugccuuugggcaugugugcacacccaggauuuuaccuaaguggaaucuguacuuacuaugguuuugguuuguguuaagucauauccuuuguuuuuucaauugucucuuuuggcagaaccauguaugcuagcauccagcugccugggcucaauuccugccucugccuuugguagcuguguggcauugggaaaauggcugaucuuuucuuugcgccaauuuccuccuuaaauauaaguaauaauaguaccuguuuuauaagcuuguaaaggauaaaugacuuaguaccugcaaauuacauggaccagugcuuggagacguaagcacuuugccaacuugcugucagugugguugguuauuuucccccaucuccccaguuuuguuuuguuuuguuuuguuauuuauuuauuuuuuuuuuugagacaagaucuugcucugucguccagggugagugccagcacagcuuacuacagccucgacguccugggcucaagcaguccucccaccucagccucccaaauagcugagacugcaggcauaugccaccaugcccagcuaaucuuuaaacuuuugguagaggucgggucucacuauguugcccaagcuggugucaaacuccuggccucaagugauccuuccaccuuggccucccaaagugcugggauuacaggugugagccaccacgcuggcccuccucagcuuuuuuuuuuuuuuuuaaauaaccauuauuauuccauauuuuuucuaugaaaucauuuauaaacauaaaauaucuuaagucuguaauucaguuuaugauacauauucaguuaugauacauucuuugcauuucacuguuucauguuucagccaaaucccauccccccaaccuuuuuuuuuuuuuuuuugagccagggacucucugucgcccagacuguaguacaguggcaugaucucggcucaccgcagccucuuccuauuaaaguacugggauuauaggugugagccaccgugucuggccccuaucccucuauuaagugccuuucagcaauucuguuuuuagaggaaaauuccuuuuugcuucugcuugcuccuuuuaccaccccugcccaugaaagggggaguuaccuguccagagcaaguauagcuuuggccgugaucuucaaggacuauugcauuggugcugacugcuggggccccuuggcccccagguucccaccaguggagcaaacacgaagggugcagccuagucggaaguguucccaaggacaacaucagugugcagacuuccaggggaggggcauaugaaacugagccaacagaggccaagaugagaacccuccugugacauggucccacccauuaggccauucccuuggucagcuggauggcaaauacuaguaguguaugcuauggagcagacauuuauuaagucccugcugugugucaaggauugagcuaggacucugcaggaaaugcauguguaguucaguccuggaagcugcccagcuuccgccuccuggaagcauccuuuucuccccagcugcucucgccugcacaucuuacauucucuggcugguccuucuggguguguucagccacuuugagcugugccugccugaucugcacacuuugcaaauguguagacucagaaagagaaacagcccaaacaguggccagaaacuguucuuggaggcucuagguugacaaaaggguccuuuaauagcuccagguugaccccuccccuagacaccugugcucccccugagccacaccgugacuucggaaguucaacugucauccaguuuggucggcucuuucacaaaauaauuucacugauucugucaggcauuuucauuacuuugauuuaaaguuuuugugucaaccucugguacuuuagaaucuccagauguugaaaaacaaaaucccauugguaauguuuguuuuccuuuacacuuaugaaaaaagcaacuuuuauucucgccuaaaauuuauugucgagagcacgucuuuuaaaguaaaaaaauguuugcagcaugucauacggcucugaaauacuauguaggucgcagcuuguuuugaggcauaagugacaaauauacuugugagagauguuauucuuacccuauuaaagaaauuagaacauggcuuuugugucucugauacugauuuuauaucuucgcaaccgaauuugugaaucccagcuagaguaaaagacacacgugaugcaugaagaaagugaaaugguucuguuugguauuuaucucaucuugaucuuuggcuuggaagaacugauaaugaaacucucuuugggaggacagagagcucuggggcauucaucucccaacuaggucuccgaauuuggugcaguucuugaaggcagguggguuuacacaguggugagaagugggaaguaugaagggugugaucuucgcccucuuuuuguaugcccguuaacaaaacucaauuguuaggcguugaguagggcuauugauuucuagccaacggaaacacuuacuguguaauuuccaggagagagacauuuucaggugauguggacucauucccugcaguucagaagguaaugagcaauagugaucaauccugagguuauccggggugauuucagcuuguccauugcauugauugauaaauggcaugcucugaggcugauugagugaugaccagcagcaucaaagaaaacccucaguuugcauggcggguauuagaaguggcugccuugaugccuccugucaucguuugagugguaaagagacauucuuuguauguuuauaacucuugauuuggggucaugguuaucaucuguacuaacugcacaggucaucccgcucccaucccuuuuucauucuuuagaaucccccacagcgguccacgccccuugccaacuuccuuccacuauccugguucuguuguuacuccugccgacugcagugcuguuccgugagcuucuugaaugacaucguacaguaucuccgacgcacaguacguaccaguuacaguugucuugacaggaucuccugugaucuuuugucccuuuucaguuuagcucuugguggcuccauaggcucucaagcauccuggacaguucucugugggcuggcguccugggucagauuccagggccggaugugagcugugccuugaccauuugaagagcucaccgaaggaggugggaauggacggugcaggaaaguaacucaggcacccgaggcugcugagcccagagaagaagcaccuguccuuggaguauuguuccaggaaauggggaggcaaccgguuccagagggcagaacuggguugggagacaaggaagcacaguucuuguaaaucaagaaaauuuguaaagccacauaagcuguccaccagugagagagagcauguacaugcugugagcugcagucaggccgccuggccacaaggcauguuguggcaugcugugggagucggcguugaagcaucccagagaccucuugugcuuaaacaaagcugaguuauucagcacacuccuagauguggggucugauuguuggucaaacugaaggacucgagaaaaugaggacuaaguggggggaugagagacaugugaguggguguugggccaguagaaugacaaaaggagcaggcccaggcucuuuggaagacagaccuuugcccuucagggggacugggggaguguuuccuggcagguguggacauucguccucauggaugucuucuuuauaauaaccuguggaggacggcccagcgcaucaugccacugaccuucacugaugcuucuguacuuaagaaguaaugucccuuggcugggcgcgguggcucaugcuuguaaucccagcacuuugggagcuggaggugggcgaaucaccugaggucaggaguucaagaccagccugggcaacauggcgaaaccccgucucuacuaaaaauacaaaaauuaaccgggcaugguggcaggcuauaaucccagguacucgggaggcugaggcgggagacucgcuugaacccaggaguuggaaguugcagggagcugagaucacaccacugcacucuagccugggugacagaacgagacucugucucaaaaaaaaaaaaaaaaagaaagaaauugcccaaauuuuccuuucaagguugaaguuagggcugaagaaucagggcuggcucaugaucucuucagacucagucauccauccauucagagaucgugugugugggcgcacgugugugucguggacuguuccucaggauccgcaggugcaguggccgcgcucccacugaacuuguguucuagaggcggagcccccucccugagggccuggcuuucucagugucaaguggagagcauguugucuuagucugcuuuggcuacuauaacaaaauuccauaagcagguggcucauagcaacagaaauuuaauucucacaauucuugggaaauccaagaccaagaugccagcagauucgaugucugaugagggcccaaguucugguucagagacgguacucucucgcuauguggaagggucaaaugagaucuuccuuuuuuuuuuuuuuuuuuuuuuuaaauaaaauuuugcucgauugcccaggcuggagugcaguggugugaucucggcucaccgcaaccuccaccucccagguucaagcgauucuccugccucauccucccaaguagcugggauuacagccgauuaccagcacacuuggcaaauuuuuguauuuucuccugccucagucucccggguagcugagauuacagggauugcuggaucaaaguuuaccacgcucgacaaauuuuuguauuuuuaguagagaugagguuucgcuguguuggccaggcuggucucgaacuccugaccucaggugauccacuuaccucggccucccaaagugcuaggauuacaggcauuagccaccgagccuuggccaaaagagcucuuucaucaggcacuaaucccguucaugagugcuccacccucaucaucuaauuaccacucaaaggccucacccucuaauaccaccaccuuggggaugaggcuuucagcauaggaauuugcagggggacacaaacauuaagaccagagagauacuuuggacugaggggacccuuuggugagaacacagggagugguucucuguggggaggcugagauuggcguggcaggaggaggccagccauggggcaucuggggaaaggucuggaggccgaggggcuguacccagggcaggagccagugcgguuguggcccugugagggcagacccggaucuugaccacgaaggcacugggcguugcuggagagcuuccagacacugggcuaggaucacauuucaguuuccagugagaauccuccugggugucucuggaaaauggcuuggaaggcauaagagcagaaacaaggggaucauuugagugaacucauauaguagcagagcugugcauugagauuacccacaccccagcugcgagagucccuguuaaugcaagguggccaguuuaaagcugacaggacuagauuuccccauggagugauuugcugaaggcuuugggcuggaaguuccagcgcccgcagaaaacuuacuguuggagguucuucgcccucguuucugaaggaaagcucccagcucugccuggagccugggauggaaauugucucugguuaauaggaucuuuaagacagcuaaauccugcacuaaagacuugaugcaacugcuguugcacacggagguggcuccccugccauaugcccgcagagcuuucuuucauugucauuacagagagucaggcguguguacaggaaggagacgggauccugccguaaugacuuugucuucaccaucuuuucucagcugcuuaaauugcugucagggcagcguaggaaucuuaaaggagggaguuuucucucauauaauuaugcuguugguaaaaauguuggcggcuuuucucuacuuuuccccuuagccaccaaaauaaaacucuuuaucuuggaacucggcagcuguuugcaauccgccucauuucuccugcugauguauuggugucgcagcuugggugauggguggugacgugaggguugaagguaauuucugucgcagucccauggucaugagccaagaccuggagugcuggaggugcgccaggucgggucaucuuuggguuuugcccagugagcuguugcuaaggagagggcuuuguuugccuagagcugggggaaauguucaagggcaggcacacauuggcagagaucugcugacguggcgacggcggaacucauggcugugugucaagccugggcaguaacagguggcgaaggccaaaccuuugggggcagacuuggggcagcaguggagacguguuuuggggaucucaaggcgucuuggugggaaagagugccggugggucaggaaggcgggggugcugggacacugcugcugcuuggguggggucaggaccugcuacacagauaccagacccacccucugccaggggacacagaacgggcaaggagaagggcugugcuucugagugcuucacuggucuggaaacccauguuuuaacuggggccacccccggaccccugagacugagguggugugaaccucagggcuggggagguggcuuccaggggaccaccuccucacgcccucccuucccagagaggauggggaagguuugggcgggagccuccggacugguagggacuccaccuagaggccagccccuccugggguaggcacagaggccuccagagcgccucccucugagucacauuccuucucauuuagucaccuuuccuuccacggggcugcuguuggcucgaaauagaaggaugacuggaccguucuccgugcagcuucuucccugagauguuccccaagccccucaaggcauccuuugugaugcacuucuaaacagcagccggcugggcucacaguggcucacaccuguaaucccacgacuuugggaggccaaggcaggaggauugcuugagcucagaaguucaagaccagcaugggcaacauacauaacaucucuacaaaaaauaaaauaacauagugggcucucuucucuacaaaaaaucaaaaaacguagcuggggccaggcgccguggcucacaccuguaauccuagcacuuugggaggccaaggcgggcagaucauuugagauuaggaguucuagaccagccuggccaacauagugaaaccccauaucuacuaaagaauacaaaaaucagcugggcgugguggcgcaugccucuaaucccagcuacucgggaagcugaggcaggaaaaaugcuuaaaccagggaacggagguugcagugagcccagaucgcaccacugcacuccagcuggaugacagagcaagacuccgucucaaaaaaacaaaacaaaaaaaacuuuagcugggugugauggugcgugccuacagucacagcuacuugagaagcugacguggcaggacggcuggaguccaggaggucaagacugcacuccagccugggaggcagagugagauccugccuuaaaacaaacaaacaaacaacagcgaguguauccugggugcuuguucggacuaaggugcaaacagagggcuuugcguuauggucuuugauccugguggcauuuucauuagacuagauggucacgguaaugugguaucuuuuccuuuuuuguagacaggcgacugagucucagagggcgguauccucgcccaggucgggggucugcacauggcugucaguguuguguccucggacagcccuguccugggaacucagaggcucagcaguggugccuguggaaugggccucuguuuucaccgaguaguugaccccaucuggcacgacagggagacucuuuuuuauccagaagccaaaucaagagaggcuuuucugagugacuuggcugugcuuuuuuccagcuuuggaaaguauguugagaaugcgugcuggcccugguggucuuacguuguuggugucagauguaaacuugcgacgugaaggcagaauuuaagucuagcuuuauuuaguccaacacguguucugcagcagccgcuggcugcagagccaaggggauaaccauccccucccaguacuugcagucugguggggaccaaccccccagagagauggacccugugcuggcucagagagagagggcacuuaaaucuugcuuggugugcucugggaaacccucuccuggagcauuggcuucugagcugaauuuucuggaguagaagguaaugccgaggccugcuggacauauguccugugaaaauucucagaaaggcugggugcaggggcucacgccuauaaucccagcacuucaggaggccgaggcgagcggaucauuugaggucuggcauucgagaccacccuggccaacauggugaaaccccgucucuaccaaaaauacaaaaaguuagccaggugugguggcgugcaccuguggucgcagcuacucaggaggcuaaggcacgaaaaucacuugaucccacgaggcggagguugcagugagcugagaucaugccacuucacucuagccugggcgacagagcaagacuguuucaaaaaaaaaaaaaaaaaagaggaaagcuggcagaaugaucauggauacagugugcaaacgugacuugugcagccaccauacucuccucaugggggaguaaaaauuagcuggaaaugauaccugaggcaagaggccuauuaaaucuuauuaauaauugauuuuagugggaaguacaaguucaguacauaaagcaggagcuuuuuggggaaguuacugaguuuuuugucuucuccagagagaggccagaagggcagcaucuccaaggugaaucugcccauuggcuguaaggagcauggacgaggacuuaagaggcagcccaucuggccacaucuccaaggcgaggcuguccacuggcuguaaggagcauggauggggauuuugaagacagugugucccggagccggccugcagagacaggcugccuggggggaggagggcagcccccagcuccggcguggccagcccugaccuugggccaucagggagggcacgccaagcuuugugacuuucaggucuguucccuugcccacgggcugguucuggcugguuucuggacuguacuguggccguguggaauucucuggcacacagcagcagguacagagccugccccugggcagcgcugaccaugcuggccugggguuuggauacuugagccuggguagagacaggguggguucucgguggccacuuccucugcagcagccaacagcagagacagaaggaggccugggaccuugcccugccugacccgccugucuuuccaucugaagcgccccugacaugcugugacucuuacuuuauuuuugguaguuuaccuuaaagaguaaugaaaucacauugcaaaaauuuggguucucugggaaaauaucagucaaucuugauucuaaaacuugaacacaaucacuguggccauucaugucuauuuuuuuuuucccuuuaacuuuuucuuuugacauaauuacagacuuacagaagaguuguaagaauggaacaaagaauuucuaauuacccuuuaccuagccucuccaaaugacauuuuaccacauuugcuuguguuucucucauauacagaaacacacgcacagaguauauaaucuucagaucccucugagauauuugcaaauauauaaggcuaaaguauuuagggauggaggaguuaauuuuuccuaaacacagugcccauucuuucacauaagacaaguaucaaggucaggaaauuaacauugauaaucauaucuaauauucagaucuuacugauuuugccaguagucccaauaagauccuuuauagcaaaagaaacuucggauucugcguugccucugguuuccuugucucuuuagucaucuuuaaucuggaaccguuucuuguccuccuuuguaccaugacauugauguuuuugaagagagcagaugagucauuuuguagaauggcccucaguucaguuuguccuguguuuuuuccugauuggaguugggcacuuugggcgggaaugcucaggacccacuguuguugucagcacagcggauuaggagggcacaucaugugaauuuaucuuauuauuggugggguuaacuuugaucacuuggcuaagaucgaguccgucuuucuccacuguaaagcuauuaucucaaucuccuuuuuuuuuuuuuuaaguccuguacaugauuuugugcaucguaacauaccaggucuggguaugggaugugggaggcagcgcugugcccuuaauuuguggaggugacgcaugugcaguugccuccacugaacguuaaaagugcacuccugugacccugaguugaguucagagacuccuaucaggucagaagagcuccugcuguugaccugcagggcacagcuugagaccuaagucuggcccuuccagaugggccauggcuaagguucccucauucaauaaauaauugaugacuucagcugcuguaugcauggauuucuugcgugacuauuuuucccccuuuuuaaauuucuuaugugcgucuggagacccuuuggcaguggggccuggagcuccuuuuagaaaagauccacaggagauuguguuuccaaugaugacagccaagauggcacagguggcagcccucccaugcuagggguguugucaggucgacagcgcucaauccccauuguuccagaacggccagaggacagugaccaggggcagaggagagugcacucucauggcccagccccucacuuagcccaccugcccugggcugggugcacugguggcuaccacugcuugguaagagguacgggugacagaugucuugguugacgguguggguguguguuuuuuuuuuaccccuaauccaaggaaacuggguguauuucucuuugugaguuuugacugcuguuccccuaagucaaguuauauggaagcaugauuuaucuucuccaaaaaauaugggccccucagugaaguuaaacagaguauaaaaugccuucaugguaguuaaauuuauacucuguuaaaaugauuugugcacuuugcaguaagcugugauauuaagugcauaaauauacagcggaguuaacuuggaggaacguuuuauuugacaggaucacuuaaaugcucagguacaguaucgaaaccauuuagcaugguuaccaggaauggagggugagccgacucuguuuaaaaucugcagaaaacauucagaauccaaaggaaagcuuguaaguaaguacuucuccauggagugcuuaaucguggaagugguuuucaucacaggagagaggauugcaauuucuaaaucagucucccugcaucaugugagaaaaugccuuguaaauaaacucuccauuggaauagucacuuguccuaagcguggaacugauucuauucaaauuagcaaccauuauagauauuuuggucuucuauugucaaugacaauacauuuuccugugggaauagguuauuuaguccauauugggacauuacaggagaauuaauaauuaaugacaugcuagugcucggcccacccuucuguuuuuguagccaaggcuugauuggauuuucuguauguauaaugggcuguuucaaaauggucuugccucauuguuucuucauaucuuauugaaaccaacccacuguugaucucaaucuguguaaggagaaugcggaguauggcauucgcaggacugaaucccuagauuuuaaguuuggaaggagauccaaccgggcagaugaauugaccgguggugaauauucuguagcauuuuccucccuggagaggaaugccgccaccgcugggaaccguggacuggcaugugagccaguggcugugaaaggcgcugugcccuguguccuccguguacuuuagagcaggagcgucacacaugguggagccgggugauaucccgggcaggcucccgaaagcuccugguggcccaucaggggcugguuuuuccaccuuuuuuuuuuuuuuuuuuuuuuccucgagacaaggucucacucugucacccaggcaggagugcaguggcaugaucuugacucacugcaaccuuugccuccuggguucaagcaauucucguuccuuagccucccgaguagcuggcauuacaggcacucgucaccaugcccggcucguuuuuuuuuuuuuguauuuuuaguagagacaggguuucaccauguuggccaggcuggucuugaacuccugaccccaaaaugaucugcccgccucagccucccagaaugcugggauuacaagcacgagccaccgugccaggccugguuauuccaaauuuuuugauuggucuaaaauuuguaaugaaugguaggaaaacacagcaggaaaaagaaagaacauuauuauugguaagggucagauuaagcccugggugagagucaugagucccuagagguaucugaagaaguccuccuggcuuuggccaucucuacaggauccggugauugcuccgccuccagagcuguccccaaccaucgcagcuuggcuugucugugaccucgugucaacucaaaacagcacuuuccccccgacacuuugaagucaacccugguagaauuugugaggaaauggccaguguguguuggguuuaaaaaaaaaaaaaggcuguggaaguagaacaaucuugggguugccacagaacaggcaguuugaggugacgaaguggcuuuguaaucaauaauaauugauaagaccuuguuucuagcaggcuguagacaaaaauaaucuucuuggaccuaucuucgccuaggaaauauguccuagaaccucccuccucuguugaucucaacgcccaagcccauccucccaugagaaagguuuuuuuuuuuuuuuuuuuuugagacggagucucgcucugucgcccaggcuggagugcagaggcgcgaucucggcucacuacaagcuccgccugccagguucaugccauucuccugccucagccuccagaguaacugggacuacaggcgccugccaccaugccuggcuaauuuuuuguauuuuuaguagagacgggguuucaccguguuagccaggauggugucgaucuccugaccucgugaucugcccgucuuggccucccaaagugcugggauuacaggcgugagccaccgcgcccggccugagaaagguucuuaugggaauugugaugaaggggucagagcagcccccaccuccccccaucagcaccacccagggcugaaucugaagucagacuuggcugcuuaagccacaaccuaagauaacuuugaauaccaggugcugaaaucacagaacagacuccaaaugguggccccguuuggacuaaaugagaggugagcugagguugaacacgggaggcagagggccaggggucccgugggcaucagcuggggugggcaucaccacggugcccccagcuuuuucaugggugauuucuucagcugaccuggguuuucaggguucuuuuaggcaggcucccaguuguuugugucagagagcccuuuuuguugguaaucccaagcccagaacuuuccagaaugugcuguuggauguggcuuuauucuuugaucccuucaaaaaaugaaccacaccgauuacuauuggcugccaggccuggugagggggugagugagcccuuucugcgagcccggggaguuuggagccagauggggguucuuccuuccccgucuccaguccuguugcucuaagaacacagauaagggagucacuccauccccaacaggugccgccuuaucccugcugaugucagaaaccaacucugcagaaaccaacucuuccccagcucacacaugcuggaaacgcugaaugugucuuauacccugcaucucauuacaugugucuugaaaauguggcuuuucuuuauguauauaaaccuacauucacagcucugcacaaucaguggcuuguuuuccgcuuacaauagcgacauuuuggugguagcggugccugacacgcauuucauuuuuauuuaacuuauaaaaccuuggggugagugcuucuggacacacaaaagcuuucauggagugcaagaguggugaauuuuuucucuuuucaaaauggaggcguggcgcaucuggacacacacaucaguuggccugaccugugcguucgcuacaggaaguaaaaguuuggaugacaucacugcaggguuauuucuuguuauuguaauuaauggaccagcaggaaguagcgagacagaugauucuuggcagaaaugaccauuuaaagggggaaggaugaagagggucugggaaggaagaaaccuuucuggacauuuaaacucuccagggaugaaauagggaaauacguagacagugcacaaggaacgagccaucucuugccagaguggauauaaaauuguuaaccccugcuacaacucaguuucuguuuuucucucugccuucucagaacaacgccgaccugacuggcacuggguuuugucugguccuuuugugccaagugugucuuccacgucaggucgguggcaggagaacucggaaagugaagucugugcugcguggagaggcgcgcugccucucaagucccaggugcucuuuugugugaguggaaggagcuggaaggaguguggggcugugaugaaagaagggagguggccgaguuccuggggaaagagcugaguggugacaguguuccuggacagaacugaaccuagaggagaucuucuggacccagaggagaucuugacccuccuugaaguugagccucccaugguguguaggggccagagcugacugggcgauggccgugcucccaaagugguugagcuggggcuagaacccagcugcugccuggaccagccuuccagggccagugucacaccccagcccaccugaguggaguugacaggguuggagccuuaagccacguuugcucagggucgucuucuguggcccagagguggaugcugccugugguguuaagggaugauagugggguaaugggggucuggagcuugggaaaagaaaggaauagaggaggcuccucaugggagggagggagggaguaguucauuucuguguacgguuccauugugugaugauagcacagauuauacacccauucugugcguggucauuugggauuuguagcuuugagcuguuagggaugcugcugccaugaucaugucauuuggugcacaugugcuacacgcaugucuguugagcacauaccuagaagaagauugcuggcccauugggauacacaugcucagcuuugguagaaaccgccuggugguuuucuagaagaguuguaccgauuuccacuccugccagcugcgcaugggaguuguguuccacagcuuuggcaauucuuagcauuauccucugcauuuggcaauucuggugcauuuguaguagaaccucagcacguuuuaaucuauauuuuccuggugcauauuagauaccuuuucauuggcuauuuggguauucucuuaaguuccugucaagucuuuugccuguucuaaaaauugcuuugucuggauuuuuuucuuaccgugucuuaguccauuuugugcugcuguaacagaauaccacagaaugaguaauuuauaaugaauagaaauuggcuugcaguuuuugagguugggaaguccaagaucacaagguuggcaucuggcgagggucuucuuggugugucauucccugaccaaggggcaaagagagaggagaaagagaaaagggaauaaaauucaccuuuuuauaaggaacccacucgcacgauaacagcauugauucauuaauggggguagagccucauggccuaaucaccucauuaacgccccaccucccagaaugaugggggauuaaguuuccagcauacucuucuugggggccauaugcgaacugugguauacuggaacuguagaaauucuugauauauucuagauggaagaccauuguugcauauuuuuacugaaauauguucuuacuuuguauugucacucuauaaucuuuuugaugagcagaagcuuuuuaugauggcuagucuuagauuuuaugguugaugcauuugugucuuagaucaccguugucuacccaagauccuuaggacauucuccuuuguuuucuuuuaaaaguuugguuuacuuuauugagucugccuggcgucaguuaggaguccagguucccaccuauuauuguuuucucggcuccgccuguggaagucguagucaagguaggacucaugguuccacagguggcuccagugucacugugccauugagcugccaucucagcucauuguacuucucugccagguuaaaccuguagcugaugaggaacagcccugagugaugugugggguccaaguuguugagaagggccaaggaaacggaaguacuacacagagugcuucaagguaagaaagaaguuacuggagaacaacacugaauacaugcugugcacucugaaacguacacccagucacacuuacuucaaugugaaaaggacaguguucgccaggcacuguggcucaugccuguaacccagcacuuugggaggccgaggcgggcggaucaccugaagucaggaguuugagaccagccacggugaaaccccgucucuaccaaaaauacaaaaauugcugggugugauggcgggcgccugugaucccagcuacucaggaggcugaggcaggagaaucgcuugaacccgcgaggcagagguugcagugagcagagaaugcaccacugcacuccagccugggugaaaagugcaaaacucugucucaaagaaaaagaaagaaaaaaagacaguguucacugcagagggugcaucccagcuaggucuucauggugcaccagacaggucauugccuacagccaauugucugcaggggauccuuguugcccugagcuauuuuguuacauucuuccuuauguucacuauauucucugagaccuucauguagcugcugcuuucaggagacuuugccuugagggacugauuaucauauucagagagggggaaugcugcugguaucuagaggguagaggccaggcuuaugaacauaccacaaugcacaggaaggccccccaccacaaauaauuguuaagccuaaaauaccaacagugcugagggggagagauacagcugaacagguacugagaacauccccagcauucuguggugcugggugggauugaagaucaggguucacgguuuccacgccugggccgugggaguaagaacagaccguccugggaaagaugacaucagacagacuccaaccagcaccagacccugauugggaggaguuuucccucucauaugucgccauguccggacccuuuccggggggcagcacgcagagaugcuggccauuuuauguguccaguccuggugaacuucacuauguucuaagagaaauuuacuuguaucuuucuuuuuggugaaacuuagcugcuauagccauaacaauuuguauaaaugccuauaugaaucaaggcaguugacuuuccaccuaaaaauuguuugccacguacaaaucgguuuccaauuuuauuaacauguuuaucuuacuuuaaaaaauaaaucccauuugaaagaggugcagaaaccagccaugcaugauggcucacgccuguaaucccagcacuuuggggggccaaggcgggcggaucacuugaggucaagaguugaccagccuggccaacauggugaagcccugucucuacuaaaaauacaaaauauagcugggugugguggugcacgcuuguaauuccaguuacucaggagccugaggcaggagaaucgcuugaaccuggucaauugaacucgggaggcugcggugagccaagauggcgucacugcacuccagccuggcgacagagggagacuccaucucaaaaaaaagagagaugcagaagccauugaagaaaucucaucguguuuuugagcuucuaaguggacaucaucaacauugagauuaagaaagaaagaugauguaaaauguaagagaguggcccuugccauugcagacacugauuuauugggcagggccacaucugaagacuugggcgagccggcguggaacugcuguggcuguuagcuuucucugacacuguguucuugggcucuggaggugggaucucagcuguuugccauucugucaucucuauuuauugcauccaaccguuaguaaugacuuaaaugaugauugccaaaacuguagucaacaguuuuguuagugauuuggggccuuguaaaauaauuaguccugagacauguaucaaggggaacauacugaauaucugagacuagcuuuuacuugauuugagccugcagguccugcuacaagauccugugugugcuccagggaccugcaggcaguuacuuggggaaucagccaugccagugguaggugguaguuccuccccagcuaccaugagggccccaagcaauuggcaucuguuucuuuguuuuggccuucuugucaguuuccuuuuuuuuuuuuuuuuuuuuuuucuuuucuuuuuugagacagagucucacucugcacucuguuguccaggcuggagugcaguggugcaauccuggcucacugcagccuccgcuucccagguuagagcaauucucuugccucagucucccgaggaccugggauuacaggcgccugccaucacaccugacuaauuguuuuuguuuuuaguagagaugagguuucaccauguuggcaaggcuggugucaaacuccugaccucagguaauucacccaccuuggccucucaaaaugcuggaauuacagacgugagucacugcacccagcuucgucaauuuccuuuucuugcaggacagauaggagcuguacguggauuccuuuuucuuuuuugagacggagucucuccaggcuggagugcaguggcgccaucuuggcucacugcaaccacagccucccgaguagcuggaacuacaggcgcacgccaccaugccuggcuaauuuuuguauuuuuaguagagaugggguuucaccauauuggccaggcuggucucgaacuccugaccucgugagccaccgugcccggccauguauguggauuauguucuggccagaaaagcccauguccaggucucaggguuuguccaugguguggaugucuagggcccagacuggccacccucagcccagaggaagugccugucuugaccucuugucuuccaccaaguacccugcgggcagcugacuguuccggcccauuccccucaacaacaguugccagauuccguuuccugcuugcauccucuguuucuuaaucugcagcauuugcaaaggugcagggucugcuuugggaauguuuggggguggugguacgcauuucacgguaucugggaauuugguuuugugauggaaggaagaaccauuggaccauuaacuaugguuuuagagaguuacugucuuucuucuaagcguuuuauucuucacuggcucuagucagccuugcuuucuaaaaaagcucuucaaaaccuggcggacugguccauucuccuguuccuuggccagcugucaucaccauuagcucuguuuuaauuugcaucuuguaaguuuuuacugccaucuuucaggucuuacuucacuuuuggggugggaccccuucgccuuguuccagcaguuggaacucaggucuucagcauguuggauuaauuuccugucccacuugggcucaggcucacuguaccaaugaccaauuuguuagccggcuuugcugcuuccuccaucaggagcacacagcaaguguucugcauuuuauuaauauuuccugguuuuuccaucaucccugaaucccuggcuggcccccuaguccagugccaagggccguccaguggccuucaaccaggcucucauguucuugggccuucccgcaaaugcuccuucccuucccagagcagggagccugccccucgcugccucuguuuccccucucagcaggcggugguugcaugggugaguggggcacagauacgaggucguggcagcccuggcacacggcucgggagcaucuggaugugccuggaauaugcuuccaugcaacagagagcagcaucugcucagaauuggggagggaagcaaucaccgcauacggggcauuuugucuuugcaggaaugcagugugagggaagugggugauuuucuuuuuuucuuugguuaaaaaguuuuuauuuuagaaaaauuuuaggccaagcaugguggcucgcacccguaauccuggcacuuugggagacugagagcagccuggccaacgugaaauccugccucuacuaaaaauacaaaauuagccgggcguggcggcagaugccuguaaucccagcaacuugggaggcugaggcaggagaaucacuugaacuccagaagcggaggcugcagugagcugagaucacaccacugcacuccagccugggcaacagaacgagacucccucucaaaaaauagaaaaaauuuuagauuuacauaaaaauugugaugauaauacagauuucauauaccucacacccaguuuuccguauuaaaauugguaaucauuauuauuauuauuaucauuaucauuuuuuagaaauugagucucacugucacccaggcuggaauguaguggccccaucauagcucgcugaagucuguaguuucuggacucaagcuauccugccggcucagccucccaaagcucugggauuacaggcaugagccaccccaccuggccuuucccuauaauuaacaucuuacauuaguacgauacauuuguuuuuuguuuguuuguuugagacagagucucucucugucacucaggcuggagugcaguggcacgaucucggcucacugcaacaucugccuccccaguucaagggauucuccugccucagccucccaaguaucugggccugcaggcacgugccaccacaccuggcuaauuuuuuguauuuuuaguagagaccggguuucaccuuguuagccagggugguguagaucuccugacuuugugauccgccugccucggccucccaaagugcugggacuacaggccugagccacccgugcccagccgguaugaugcauuuguuacaauuaaugacccauauauauauauaaaacugcugagcucaagugauuggcccagcuaggccucccaaaguaauugauccauuguuauccaaagucuguaguuacuuaggguaacuuuuuaucuuucuauauucacuucuuuugggguuugugugggggggggaggggggcaggguauggaaaaggaaguaauuuuacaucuuuacuuucugucaacuuccugauggugguggaguuggggaguagggaaacaacaaaauacucugugagaaccuccauuaaaggggagacucucagcagaaaucuccauguccugauuagauggcacaacaaacagaaaugaccguguccuggcuuggggauuuaauauuggaaaacaagcuugucuuaauggaaacuuucagccaguaauuuuguuuucuuguuuguuugagaugaagucucacucugucgcccaggcuggugugcaauggcacgaucucaggcucacuacaaccucugccuccuggguucguggcaguucuccugccucagccuccugaguagcugggauuacaggugugcaccacaacgcccagcuaauuuuuguauuuucaguagagaugggguuucaccauguuggccaggcuggucuugaacucccaaccucaguugauccacgcaccucggccucccaaagugcugggauaacgggugugagccaccgcacuuggccauaggcaguauuuuuguguguuugaaacucaucauugugggcguuuacaaguuggacuaauuccaauacugauuuuggaauuuaaagcuuuauaaaaucauaacgcaauuuguaguguugucaauagaagguccugauuuguaggagcuggcuggcaggcagcuauuaggggagguggucacucagccaagacaggcagggaacaggaaacccuugguccugagaaaggccccuggaagaggccagccccgagacuguuuggcuaguggugggggugggcaccagcucuaccccagcccugugagugcaucguucccuucuguuccuguagcugaucucccugccccagccugcgaugggaggaucagcaguaaaauaaguugucuaaggucgcgugucaggauccaaaggagaacccggugcuccagcuggcugaggggagaguggggccucggagacagcaggggcagauucccccagcagggcaaagcaacccugaccuccaaguugcaagggaauaggugacucagggaguaccuccugcagcccugcuggucucaagacucccaccuuccagggccugguccugugcucagaaaccccucugcauagggugcugaugaguccucugcagcucccucacccaagggaccacacugggaaacccaguaguugucucggccauggcacuaagaccuuugcacccuggccaucuuguuccgggacagccagcaucuguggugugguauagagacaaagcugccaccuccaggacacuugcuccuuccuggccuuccugcugcccugaaaccuguggccuguguguuaguggaaacauucucaguuucauugcucaguaaaccuuagguuauccaaacugcaaauaaaauguucucuacuuucuagauuuuuauaacuugcuauuuugagagaaaggggaugggguuaugugugcaaauuaacauuuucuuuugguuuauauaacucccugucuacguaguuugaauucuuuaauguagaugaaguuucacacuccugaauuugggaauggucauuguaugguguucacccugugccuagcagaggcucagugaacaucuguggucagaauggacguguccuucgcagaucaggauggucguggggcagaacucuggugcagcugugaagcuucccaaaauccucuggagucugugggccugggccgcauggugaaauuggcugucaucuuccucgcuuugcuuucuggcugcuuguuggggcugaguugaggcccaucugacugucuggagguaguggguauucauccguuguugcuuggcaccagagggcagguagauccuguggcaaguggacaggugagaggcccaccaaggagaggugaaauugggggugccuccuaggguauacaucggacccgcccugggucugcagcccgguggcuucuugggcagacacugcacuuggcggcuucagaggugagggcacagaaugacgcgggucagggagucccaccaugggcccugcccaugggacuugaugcuugggucaguguacaggucagggccuuccuugaacuaaaggcuacgugcacagacugacagcugacacuugcuauaacuuacugcuuugagagaaagagaaugaggguuaugcgugccauuaauauuuuccuuugauuucucucauauuuugguuuacauuauauccuuugccuggguuuugagaugguaagauaagaaguuugauaaauggcauauauaaaagcaguuuuuucccuucuaaauggauauuuuuaagaacaguuugauuuacagaaacgucuagaagguuacauggagaguuccguaucuccucaccuaguuuccuuauuaucauuugacauuacauuaguaugagacauuuauuaaaauuaaugaaccaauuaucaauacauuaauauuaacugaagucuacauuguauucugaugaucugauauccuuuuuccaucccagaauccuguccaguuuuucaccuuguaugucacugucuuucuccuuaggccccacauggcgguggcaguuucacagucuuuccuuauuuuugaugaccuugacaguuuugauuaugauaguauauuuuguggauugucccucuacugcaguuugugugauguuuuucucauuccugggcuggguuauggguuucacagaagacuuuuuuuguguaaucucuaaauaaaaaaauucuugaaagaaaaaaguguaagccuuugccggccaauaaugaaucgccccacauagcagguggacguggggggugucugguuguccaucaguaggagucgcccuucccuuauaccugggccugguggucaggcggggacuucaggaauucagcagccuugccugcguucagcugaccaaagacuuuuccauggagcugggaagacugcccaggggagauaggaagaggcacgucgcacacacugggcuucccuggagacuucuggauucucgaguucacccugaggcauuuacugaucgacacaugggcuaguuccuuuuuuguuacauuuuaaaauucuggugaggucguuccauuuauggauaagaaacccccaggugugaagggcucaggugauguacccagagucacacagcucacgagucaguggcaggacuggagauuacacugaagguuggugcacugugcucccuggcuucugugcaggugucacccuccuccaccaggcagacuuugagucgugcaaacagaaaagaugcugcccacacuucagggccaugcuuccaguccccgugagcuacccccagcaggcuccuguacgaaacaugacagcacuuucuagggugcuuggccgugccugcuucccccguuacaucugcgcacccugcuugccuuccguuccugcccugcacucaccuagcauggugcaugcaccugacugcuuagaaggcacgggacguucugacuugauguuuucccgauuucucgcugguccugauguugguagcuccaugugacacaaagcauugagucucuggcucugcugggguuaggauuugggauguggcuugguagagggguggcugccugugccuagccaucgccauguuaacagaagcugugauguaggggcucauagcucacaucccucagccaagagccacuggucacucagacguuguccuggguguuaggacaucagccugagcauuagagggaguucaccaucaagaagaugacggcuuuuuuuuuuuggcuagagugccauggcacaaucagggcucacuguaaccucugccuucugggcucaagcgauccucccaccucagccaccuggguagcugggauuacaggcgcaugccaccaagccaggcuaauuuuuguauuuuucuuaggacaggguuucgccauguugcccaggcuggucucaagcuauccuaggcucaagcuauccgcccaccucagccucccaaaguguugggauuauaggugagagucaccacacccagccgaugauggcauuuuucugauagacuggaaagccagcugaaugaaauagcuagaagaggacagugacccucagcuucuucauauggagcacgaauggauguaaauuuagugggauuucuuuuccacuggggcuggccacaagagcuggcagugugcuccuacagugagucccuccucuaacuuuaccucccacuuucucccuccggcccccuuagcucucagcucagagacccacaaaaacaaauccuggggagcugacugcgcaggauguggacuugguauuucccugauacuggcauuuguuagccggauccugccucuucccuucgccaccucgccuuccccaaagccccugcgggcuuugcucuuccuucccuuuauuuugcugaaguugacagucagguaugagcugcauuaaaauguugacucauccuuggguuguuuucaauuuuuuaaaaagugcacauugagaaaagcacagauucaugugugcagcacaggaaaucaucacaaagagaacaaggcucuuguugggggcauuugaguucaagcagagugccccaguugcaagacuuccauuuggaucugaugauggcuggaccucccuggaaagacuggaaccugaagagcccagucaaagaacagucugucaagcagccccuccgcaaccacaguuuuugugcagagugguuuggggagcccauggaauggggacaguacgauguauuuucuaguggcaaacauuucaucaucaagugagaguuucuuugcugggcauuuccuguucugugugaaacaguugugguuaccuguggguguguuucagauaaucauuagagcauauucucugcucguuaagcaguaaaaccagugagguggggaagcuugugaaacugaaaucccaaauaugcaaaacuuggcaagaaaguagagaagagccagaccagcucugagcuaagucaccaaaccagaaagguuucauucuuugucuuuucuuccucugucuuuaaccacaagccuugggcugaauccccacaucucacuacacagucagggaagcagggucaaggcugacuggggacacuggcguggcgggaaugggugaagucuccuggguggauagucaccucucugccuuuuuugaaacuaaacuucucugauuuuuauuucaaguuguccugaagaacaugauucuaaaacagauucagagcacgcacucugacuauaaauagaacauaaggcaaacuuggacaauggauuguggcacuuuuuuuucauguaccugaaauucuuagaguuggggcucucuucccuugagaaguagaacugcuauucuucggagaccgaugggugaccucagcauuguccucaccaagaacgcuguuuccccagggauugcaccccucccaccacaguuauuuuucucugaaggccugaguuuggaagaaguacuugccuguucccguaauuauggaaaccggaagguaacuuaccuguuugugccuggccuaauucagauuagaaaaagaucaauccauuguugucuaauggacaggggacaaaugaugaagaaaacagaaauagcccauaaaaugauagggaugucccggcucccaggcaaacucuggugaaaaccgaggagacuaugguguucccugagguauucaccaucuaacugucuuccacaccauauauauaagcuguuuauaaauucuuuguccuggccaaaaauacaaaaccuacuggcagugauuuauuuuuuuaaugcauuuuaaauaacuggauuccuauguggaauuggaguuggauaauuaaauuacgauggccucuaaaguuggggugcgggggguugagggcuucagcagagagcaccccuggaagguggcacugcagccugggggugggggaaaaccgugccugauggaguugcugcaggggucccuacacgggguguccacccuucuugcccagacacccuguggcuuugagaaucgcugugacauagccacgggagagcugugucugcuuaaugcuuuuguuuacuuuggaaguuuguccuacaugaaugaauucgcaaaacuuacauuccccguaaagcugucacugagagaaaacacagcaauaacucaggugauguaguuaaaccaccauugaguuugcgccauccaugagcugauaaaucguacagcuucauuugguaggaaucagcaauuuuauguggcaauuaauuuuuacuacuguaggggagccagaggaugagcauuuuacuucgguuuuguguguguugagagaaacuuaacgguuuugccacagcaagaaaggaucgugcaugaggccuuucgcacgagucgacguguuuggguguuauccugggguguccuugccagcuuuuguugguuccucacgugggcagaagagugaaugcucaguccccaucggggugccacaggccucaugacgugugggguaaaacacguauguggcuugcggagaaauaaauucuccguauuucuuaaguaugauguuuuuccccaccagaccgauucgcccaugcuguuuccacaucagagaugaagaugugcgcagaguaacacguaauuagcuuuccagauugcuucguagaaggauaaugugauaauuuucccauuguucguuuuugguuccaccaaugauggccauuuagcacagcacacaguugcggcugagguccagcucgaggcuggccgaggcugugcacagcugcccagggcccugccucgcugcuggggagcuguccuuucuuuggcugagcucucuuccuguggaggcccagccugcucacuggaacgccagaaagaucaucugagcauaguugucuguucagccagccucucuuggggccauuaggaaaacgggugcacagcagauguuguuccuugggugcccucagugguuuauuuuuuauuuuauuuuauuuuuuugagauagagucucgcuuuguugcccaggcgcccaguggcgcaaucucagcucagugcaaccuccaucucccagguucaagagauuauccugccucaacccuccugaguagcugggauuacaggcgugugccaccgcacccggcuaauuuuuuguauuuuuaguagagaggagguuucaucauguugaccaggcuggucuuaaacugaccucaggugauccagcugccuuggcuucccaaagugcugggauuauaggugugagcuaccgcacccggucccuccguauuuuuuauuacugauggcagcgacccuaacccuaacucuaaccccucgcgcugaguucugcugcgugcugccagcgggugucugcugucccagaaccuccccgcagccuucagaguuguccccacguuacaguguuagagcuuuaaacaggacagacuuaaaaaagcagauguccucaucacccucauuucacgugcguucucuuacagacacacccuacuaggccauuauacaguaaacccuagcuucuauuacaucaacaaauaguucaguguauuuuccuaaaauaaaaggacuaacauuugcugaguuuugagagcaccccuguguccccccauucaggggcaccucuuucuaguaguccagaaccgaggcuggacucagucguccccugcucaccccguuuuccccuguaggcaccguuuugaguccgcuggguucugcuucuccagcccuggugggagcagucgcuaagggcccucucgguuuagcaauugaaacaggaagugaaacacacaggaguuuagguccaucacaaacucagggcguggacgaucccugggcuacccggcuucggucccaccuccaccccagcugugucuuuggcccguuguuuucuacccugggccucuguuuagucauuuuagaugaggaaagcauaccugguuccuaagacuguugggaggaaugagugaauucaugcaaagugacgggaacaguguccaggaugccgugagccggggagccugcuuauugcuacagcugcuccucucaguaagggugugacaguugcagugaccgugaggagguggcaccucaccgaggugcaucugagaacccaggaaugcaggccagcucacagguccaggaugcugcacgggggcuccgucuggccugugguaccagcucucaguugccucuggcuuggugugggggccucaggcuuugcugccguagacgcuguuauauccucccauacccagaucaccuggugucugagucccaggccacuccuggaacugggaugugugggauuuggugucaaacuggcuguuccuuggagcaaggaggaggagaggugagggagguccuguuccuggcgcugcagggccuguaccccuuccuguccacaggccuucucuggccuuccccuggggcagcuagggguguggagcagggcggcugccaguggagccaccgucaagggaagugugggugucgccccggaugcccagcgagagcuuuccccugaaccagagugucuggugccaacagcgccaccagagggggccguuccacuggaaguccuaucgggaaguauuuuuacagcgcuuggcuguccuugcagacgaaaauaagauguuugcuuuagcaauuugcuuagcccugaaaacauuccuagacaaugccagggccuuaguugaaaauaguaugcucagcuugcugggauggucccaggaaggauguuuugagugaaaauaaaaugguacauaccagggcuguuugccaccgcaggaauccugggagaguucagcauugaggguugccgggagccgggaucuagcaggggcuggcuaugggcugcccuagcgugcaccccuggggccgaccggaagauuccagaacagggagaacugucugcaggugucacccugcauguugcucuuuccucccuuugcaccuuagcacaccagcccccgcgggucaagaggggucuccagcugcgguccacaguccuggccucggcuucguguccucuagguuggggcaccggccucucuggggaagccugcccgugugcuucuuauuccucgacugugagaaacuucuuuauccaucugcaaucucuccucuuggcuuccccucucuccuggucaugguucugcccacgcagaauacacccaaucccucuuccgcaugacugcccugcacauaaucacaggcagagauggaaacucgggaacguucccugcuggggaugagcauugccauucucuuccacaacacauuugcaaguuuuucacuugcucagaaccaguguugcagguaagccgcaacagacacacacauguacacacacacacacacacacacacacacacacacacacguggggggaauggaauaucaugaccaguaguuaaggaaaaaugcauuucuguuuaaaagccauguuuuaagaaaaaguacuugaacucaaauaaugacgagugacuuauuucaugacauuugucucugagacaagguggcaaauaguaugcuaugaucauuugucgugugaagagugaagucagaguaacccgcucagcuccagagcuuuguuuuccucugcggauucccuuggcagcauuucuguggaggauaaaaauagcacacggugccuuaaaauaaauggcuguggggaaugcuuguguacaucagcugcguggccacauauguucacauucuccauauuguucacucuucaaaagagugacugggauagacgguucgaaucugcccgccauaugauaacuaaagugacauggaagagccuuuggcccccgggaaggaugacuccagggaugggcaguggggcaggcucaggugugucagacucguggcuaacccgcgagguccugcaggugagccuuuucuguccuuuaccccauuucauccuaagugucuccccacaaaagaucagcaaagccagacccaacacaagcucccaaacaggccccuuccugacucccagugaauccagacaaacgcugacaagcugacagauuccgccuccuggagcuggugggggugggcgggcaggaaauuggcggggcgagaggggcagcacacugagcugcccacugaugcagugucaguggccuuggagcauggcuucuggggucgacgucaaaaaacagugugaaaaucuuagcguggacauuaggcuaauggguccaggucagguguggaucaggauggguugguggugacaagccuugggucuggaguaaauuccaucuaaaucaugucacuuuuggcuggagugcagugaugcaaucucugcucacugcaaccuccaccucccagguucaagccauucuaaugcuucagccucccgaguagcugggauuacaggcgugcaccaccacacccggcuaauuuuuuguauuuuaaguagagacgggguuuugcuauguuggccagguugguguugaacuccugaccucaagugaccugcccgccucagccucccaaagugcugggauuccaagcgugaaacaccaugcccggccucaauucacauuucugaagugaaauugcguaugucuuaccccucacguaccuucauaucgcugauuuucuccucuauaagccaacaaaacccagcaggauccugaaacaacuagcauugcuugugucuccuuuuuacuuaaacacgccucccacccccaccgcccacacuuuguuuagcaccagcaaaggagacaaaagugacagugccgucuccagaagguucacgcagugagccuccgguauccaugcagaagccucccccugcccauccuagugguaaggaaaucuccugaagguccucgucaccugccugaccguggggaugugcuuuugguggugguggaaucuccgugugaagaauuugguagacuugauucucugaucucucugugccuuuuuauuuugagacagagucucacccugucgcccaggcuggagugcaguggcauaaucuugguucacugcagccaccgccucccggguucaaaugauucuucugccucagcguccugaguuguggagauuacaggugugugccaccacaccuggcuaauuuuuguauuuuuaguagagacggguuucgucauguuggccgggcuagucucgaacucccggccucaggugaucugcccaccgcgccaccacaccugacuaaucuuuguauuuuuaguagaguugggguuuugccauguuggccaggcuggucucaaacuccugaccucaggugaucugcccgccucagccucccaaagugcugggauuacagguguaagccaccgcgcccggccguggcuucacauuucaacaggggaauaguugcgacacacgcccaugccucgcugugugaacaccguccuccagauccuuggcgguuagcuuggaaaaggcaaaacucagggggagaggaauggaugguuagaucaggugagagcaccuuuaugggacggugcccaggaggcaucuugugaggacgcagcacugugugugcaaucguaucacgugaagaacuuuuaacaucuuucuggaguuuucuggugccuguauucuuuauagugggugacuuuggggagggcgcagcugcauauuccaggcuggcugggugcaacugggaccuccacuuugccuacugcacaguggucaaguucaggugacaguccaagaguuucuccccgucagggcuccuguaaaacucuguaacaguucauaaagaacaagcagaauacuaacuccgagaggccuccaaguuagaaaugcuuuagaggagaaggcugaaaaagcaccucccgccacccagcucguugauggcaugaaagcaccaggccucauuccugccacggcccugagccuggcuucccgugagacccucuugggggccuguggacaggaagugggacggccaggacccagaccugugaccugcgucagaguguaacgaaguccaggccagucuguugcccgaagcacugggaugcuuuuuacugaaggaguguuuaaaagguaagcuggaucucagacaaagcuccuccaagaggcuuccagaggcuggaguuuugucaacaaaugaaacaggcccuauuuuaagccacgcuguguaccaggacuuccuguuuuuccagagaaacuucuuguuuugguuuuugugaugauggauuuauugaaacauuugcuauucaagugacccucuuuguguuccaaggaaaaagucaagcuggagauucuguggccuggaaaagggauacgcacucacagcaaaaacgucauccccaaaagacucagucggggggagucugggccucaguggccgaucagugaauggacaaagagcuaauugccagucaggggcccagacggauuucauagcucgggguuuggccuguuguuuagagggaggcgggggcuggucacaggacaauugaaagggguuuuuguuguuccucucaggcuaaguuaagccaugugugugucucucuuucgaggagugcuggucuggccaaucccagccacguaaaucccacucacuuccugcugaccuuuugacaccaacagauguuuuuucuuacaagugucauuagggccucucuacucgcugaccucaucagauuguguugaagucguuuucaucgguuuugucucuaacaauccguuuaacccuuccugggugccucucugggaauaagauugcacugccuucuggccuugcugucucccuccugcccccaggaccuggcauggggaacggagcccaacccagagggcagagaggcaugcuuccccggcugggggcugcccuguguaccccggggacagagggacccuugugucuuccucgggaaggugugauggagaaagcaaugaggggcucaacaggucccucggagagaaccuuccagagcucugccuguggauacaugcucugaucacacagcucaucaagcacuggggccacagacacggacugggagguggguccccauggcacuugugugaccuguccgcauugcugcccgugaugggguugggagcgauggaguuggagguccuaaggccacggaaguuucuguagccaacaucccucgacuaagagugcagacugucaucugaccugacucuguggccguucuagaggcaggaggauggcguuggucauuuaaccuuuccaugaagcugaggcacaaagagcagcuguggggcuggcgggugacuagagggagugaguuuucagcagaugacccugacuccugggccgcuguguugugauguuaucuuacaggcucugggccuccugggcuccuuagagccaauggcacacucuucugaaggcaucugggguggagggggaguguguguauccugccugcaccugagguuucggggacucaccugaagccucauccagagcugacagacaucugugcugggcguguccuccuccauggcgugcacgccuucacugugcaaaccagcccagcagaauggaauugcuggcugcuuaugcauugugucaguuacuacucacagccgcuuagaauaguucucaucgcacauggagcauucuagaagugguagcugcuuuuguuuauuaguuauuauuauuauuauuacuauuauuauuauuauuauuauuuuuauuuuugagacacaaucucgcuguauugcccaggcuggagugcaguggcgugaucucggcacacuguaaccucugccugucaggcugaagcaauucuccugccuuagccuccugaguagcugggacuacaggcacgugccaccacaccuggcuaguuuuuguauuuuuaguacacacgggguuucaccauguuggccaggcuggucucgaacuccuggacucaugaucugcccaccucggccucccaaagugcugggauugcaggugugagcugccacgccuggccaguuagcugcuuuuaaagucaugcaugcagcuaaaaagcguuccagccucuuggagccuccuccuucccacagucccacuccucagagggacuccccugccaacaguuggguaugugucuaccugccucuuugauuuuuuucuuuucaugauuuuacaugcuagucuggcuuuuugcuucugcagauguucugugucugcucuggagagcucucccuuggagugugguucggggauugugggguguggcuuugugagacguagccguguuuugcaucuggcugguguggcucagucugacuccacaagccucugcagugcugcuucugggggagcgggagauguacaucgggguccuaaggacauaggacuaggagugaccuggccauguugagucucagguucucugaaguuuggauuuggugaccucuacaaucucagaaggcuccagaaaugccgugauccuaggaaaucauccagggccacccaagcaucugggcacaugagggcauggcaccugcgugguuuuugcagccuucccauuucugccccuuguguugcaguugaggccagcuccugccucggcucaugguguucccugucucagaagcggcuguguuugugcccugaaccucugugcagacugccuucaauauuuaccuacaugcucuuuuucucugagagcucagacuuaaucguagcugcaguucaaggaccacuuuuaagaaaaagcaagaaggucuguuuacccagugaauuaccauucagaggggggucuaggaggcugcauucuuaauguggggcccaggcucugauagaucuuuuuaauguuccccagauuuaugggugugcgugagucagaguggagaccccagggugccugaguuaacucugugcauguugagcguagcccuggaauuuauuuuaagcaucugggguaagugaacauaacagcagacuuuccguuccuucagcuuguacgcauugcuguugugaggagaauagcguuuaccccaagaguuuacagaaguggauauaucacagaccucaugucagucugggcagcggaggauuuagaggguuucgcuuguuuuuuguuaguguucucuguccuguagguaguauaaacuagacgccaugcauuacaaauguauuacuguuuuuaucuuuucuguugaacuguacugugucagugaccauagucagugugauaguuuguguaaaggguuguauuaguuaucuauugcugugugacaaauuaccucaaaauguaaaggcuuaaaacaacaaaacuuuauugucuugcacugucuaugggacaggaaccugcacagcuuagcuuggugccuccugcuagggcccugacaauguugcauucaggaugucagugggguuguggucucaucugaaggcccggcucggggaggguucagcuucucauggacuguugggacugagggccuugguuuccuguuccgugggucucuccuuagggcagcuggcauggcagcuggccucugggagggagggaaguuggcagggaagaugggaggaugcccacacugguagccacagucucuuuuaaccuaaucucagaagugacauccccucaccuguguauacuguuuacuguuuguuuagaagcagagcuuguacaaggacaugaauuccaaaagguuggggguccccgggggccaugggauugauucuuuuucuggcauccacaguguagaugggaucugccuuauucagggagagggucauguucagcuuggaaagcucucagugggccucuggggaggggcagugauucagaaaagccuccauggcccucaauucauggcccucuacuguuuugugggcacgccugugucaccgguggguggcugugcagagcuauccggcuucggauuccccagaaguccuguaggggcuggaaaggucacugagauaaugugugugcaaccucagugagggucccuguguggaaucugauccucugccgggucccugguuucuuguggagcugggcaugaagggcagucuguggccagugcccugcccuucggaacuauguggcaucucuccuuuuccaagugaaguucccauuucccuuccugucuucccacucaucagacccgucuacaccuucggcucugggcugagaucuccccucccaucuucaggagcgugucugagauguucaccccggcaucaucugaagugcugucucugaagcccagagggucuaaccucagaccuuccaaaaaccaaaaccuauuagccucaccccuucucugccucucuugagcugagccuguugauuucccaagggccuugggaguggagcaggcugagcccaggagccacucaucccuggguguccucccugggagaaccucugggaggggccuggagaggacagagggccuuccuugcacugcuguguugggggaugccaggaggggcugcaagaaucuggacugcaaaagaccuuucacuguguccucuugcucucuguucggcgggcagugagguugccauucaaaagauagaguggcgggucauuuucagugggcuccuccugcucccauguccuuuguguugacaaugcacuggauccuuccuggaggugagggagccccggcccuccagagaugaacccccagucguacuccagaaaccugggagaaugcugcaccugcccugaggggcagccuuggcuucgguggccccguggauucaugcuugaauuauccuggaaguugugugggguuuuguuuucuuuuuuuuucucucucuucgaauaagccuuuuguacuccuaaaguucuguguuuugaagaaauaaguacacuuggggucagcggcugcaugcugcgugaugcguauucauaaacuucauucugggggaagaauuugagaauggaccggagagaaugcuuugacagucagaaaaguuuuucucaaaauuucccaugaacuugggaaguguggagaugcacguggcugucccaaagccauaugaauggaguugauccaagcgcccaauuccagccugagauccagugggcgcuccgucugggcucccaugggaauguguuggggcugccgccaagcaggaaccgauggugccugugauuguggaccccagauuccugcuggagcccacacuaugauacacaaagcccggacugaggcauucaaaggcacaaucaccauccguuugcugcuggaccccaagggcguucuugauagguucuucccuccucugugggccguguggggaucaccuuucuuugaucucccaacccuggcaugaggcugauggaaucuucuggguguuguuaacacagacaacacaaaggcaggacgguccaaacaaugaaaucccagacauggagcacagaaaacagcuuaagggaaauaagguuagaacauucccuccugggucucuccccuggcgaacacaggucugagccucucaggaggcugcucccugcguguugugggggucagcucugggaccugcagccccucugaccacugcugggaaauggccacgggcacaccucaggccgugcguguugagcugucuggggcgagauuggagggugaagguugccucuccccauaaagcaggcuuggguugacuuggagcuuuuuaauaaagccaggauucugcacagauugcugccccugcaucacaaccaggcuuccugccgggggguccugagcuugcaggucucagcagcgcagacccccaccgauaggugcgagccucccgucuguuggcauguguuggcgugcucggguugcugaaagaagguuccacagacaggccaggacagagauguguuuucucagaguucuagaggcuggaagucugagauaaggcauccgcaggggugcuuccuuccaaggauuugagagaagcccugucuccguagcuuuuagaugccaucuucacgucgucuucccccugucugugucuaaguguccaacuguccuccuuuuuaugagaauauucgucuuggauuagaguccacucuaaugaccuguuuaauuugauugccgcuguaacgaccuuaucuucaaauaagguuccauucugagguccuggggcuuagaacuuuaacauaauuagggggguccauaauucaaccuguaacagucagugugugaccugugggcauuuaauugaaaagguuucuuuuuuuuuuuuuugguugguugguuucuauuuugagacagagucucacucuguugcccaggcuagugugcaguggcgugaucucaguucacugcaagcucuguccccuggguucaagcaauucuccugccucagccuccugaguagcugggauuacaggugcccaccaccacaccuggcuaauuuuuguauuuuuaguagagaugggguuuugccauguuggccaggcuugucucaaacuccugaccucaagugauccacccaccuuggccucccaaagugcugggauuacaggcgugagccaccaugccuggccugaaaagguauuuuaauugcuuuggggacuuaauugacaucaagaccauaaauguucaggcuuggaugacuauggcaggaaguacaugaggagugggccuccagggaccugccuuucccuaagggucuccauguaccguuuucgaauggugucugggguggggacauaaacuugggauccagguauccugaguccucggaccuuuuuucccauuuauuugucuggcuugggcucuaacaugcacaauauccccauaaaaugucucagagcagauuuuuaaauggccauuaccuugucaagaauucuccagugggauuucauguaaaauuaggaucccugaugguagcucacgaugagcuguaauucuccacauaggugacuguauucaugggcaccauccacccuccucauccagaugucucccucuccagaggacuuuggugcaggaggccugugaggaccccaguucauuaugacaagguugcaguucucuagaagauucucaucaggagccuugucuacuccuccccagcaaccucuuuccacuaacuuauauuuuagcuauagccuggaacauucugagcuaugaugaguguuaaaauggggugguguacucgucagagaccuggagaccgggacuggaagccacugugaaacaggugaaaugauucaagaagacagcugaaccccagcgacaccccauaacagaaacaaaagaacucuugugagccgcacccccacccuuccuuuucccggcauuugauaggcaaagaugaauuugugugacacgggagugucccacccuccuccuccccaucagacucugcgagacgcccgcucucccuuugggugcagucauggauaccaaacaaagccuucaucccucuggguuuccguuacguagccgucuuccacgugaaaaccguguuaagcaaaaugaauagcugcaagcuauuuuauuucauguuaaauaacuguggauaagacuaagauuuuucucuuuaugacucagguugaaaagauaaggucugggaagcggugucuuugaaucuagagauuuucuggaguuagggaugucugauuucuacauaucauuuccacgaccugucgcaggagacaggguaccggugccccaugaugcugcagagcggcuuuuggugauagagacgcauuauggaauguguauacuuguaaggacccaggcauagaguaucugcccucauaaagcaaacauaauccuccacuccugaggucugaguuggcucuccuggaugccagccuuugcaugaugagugaugccuuaguugaaaugaaggaugggccaccccaggugccuggagcacuuuuaucccagugcaugcccaaacuacugguguccuaaacaguuggccccacagacgugggguuuggggagcugagcugugcacuggggcgguggcuacacuggccuggucacgucaggcugggcagaagaguuggagcgggguggcucaagagucuugauuugguuugacucuauaacuuggcuggcauggaacuuggaaggcuggguccccacuccuucagcaggugggccccuuuggagggagccguuccugcuuguuuuugagauaaucucuccggacacuuggcagcccagccagcguuugcuuugauagcuuaucucugcccguccagcuugaacuccccuuucccaccaucuucgaccaugccugcgggucuccaccucucccuggccaccauguagcccucauuccuugcugaagguuccacacugaaguggguuguacagaggaaccucguccuggaaagugaaagcaagucccacugaaugugacuuggagcaagcuugugagguauucguggcaucagagccaugaagagaagguggagaggcgcugccugggggagguggcaccggagcucaggugggggcuccccaggauccgcacguguguggggucuauccaaaggcauccucugccaaaucaggccaagcaugugcuguaucacucagugguauccugcugcugugacaacuguggcgacuuugaaaugaugguaagaaagaguguccugugacgguggggacugaauuaggcacaucugucucccguaguggggcauuagugggcuacaccagccccucccauucuucuccaaccagaaacugucagguacccugccaguguggagaagagguggccagcaucuuagaacuuggugaaagggguguuguguguguauguguguggucagguggacgugugugugugugugugugugugugugugugugugugugugugugucuguggucaggcgggcaaauugaggccagagagcacauuaaugugcauucuggccagaaucaauuccuggggaaaguuggaaaaaucuccuuuccuuucuaaauuagugucuaccaggaaaaaaaguuguauaucuuaagaucauacuugucucacagcaaacugauccugguguugagucaaauugagccuguugaucaggugugcauagugcuccagaggcugucauuuguaauggaaagccuaaggggcauuugcggagcagcccagccggccccuccccagcaccguccucucuguguguguuccgucucugccaaguuguuuccaauuuucaacacuaacugguugcugucagcagacguaauggaaaaaucauuugucaggguggccccuggcucccuggggucggggacuccacacccugggcagggagccucccuccuucuuggccuguaccuccagucacuccgcugugaaagugggacccccagcuagcgucucgggagauaaacaaguaggcgcuggcgcugcauccccuuuccccuggcauaucaugcuccuagaaacgaagcaucugcugcuggaacggugagaccuucugccucuuucacaucuggaacuuucggggaaaugcagcaucucauccaugggcccaggccuucccuucuaggaguagcugaucuuauuuucuccaggugcuuguagagcuuaaguugggauagaaaugaggaugguggcucauggcugucucugcagccucuggaaggccaugcagggugugcagugcccucugcuggccaaagggccccaucgcuggacaccaggccucccuugggcugggccagcucccaggaagggcugcaacaggaaaaggucagcccacguggggguuuccauugguuuugagagcaagcagagacugcagagagcauguccuuauacaagcauucuggacccuacggugucaagagaugagugggcugggaucucagaaggccaguuggguuccccuaaggacaguagaggccccauaaaaucagucgaggauuccaggccucucugaggcaaaauucaaaggcaaacaucuuaaaaaucuaaccugaagauuuuuuuuacaaauucauaucucaucauugcaauuuguuugauaaguagcuaauuccuauaauugccuuuauuugauauuuaaauacaagggcaauucauguguuaaguguaagcuaaauaauuaaaaguuaggaggauuaaaucuucccccauuucauauauuaagacagcaauguuuaacauuaucucauuaauaauuuauuauauacuauaugauacauauaacacaguguucuauaauaugguuacaauugacaguugaauacauagucuaauaaauuguauuaaguuuugcauagguuuagcauauaaccuccagauauuucucuccaagaaguguagcuugguggcucuugccuuugcaaguccucaaguucaaaacccuuaguggccaucaguccccugugcuuuuacaccaugcuggacacagcagauguauugugugugcccaauuguauugugugugcccaguuucucugcaugacguucagauauaaacauucuggaaucauuucuugcacacuguauguaacaaaagaugaguuuucugguggaaccacuucugucugccuaaaauuugagaucacuaauuuuuuuuaucuguucaaccagucuucucggcuacagaucaaaauuuucaugccagaguaggaaagagaaaacuagaaaaggaaaaauugaucugcauuccugauuccucaagucuaaacagacaggaauaagaggugucauuuaguuuguuugcuuauuugcuuuuaucccuuuuuuuuugcuuaaccuuuauuauuaaauaacacuauuaaaacuaauauacaguuuauuuuuaaggcauauuuggaagacaaguucuuuuaaacugugugaaaauccuaaacacaagaauggcucauuuucuuuagcaacaaagaccaacacuuaauuuccauuaugacacaaaucaaacaaccaauuaggaaaaucacaaauucuuucugcucaagucuucuguucuugauuauagcuuuuagcaagugaaaauauuuagaauuuuggagucuugcauuuaacacgaggaaauguauuuucgugugcuaacaacccuuaaccaaaacgggaggauuuacucagcuuuguuggccaagggaaagccugguuuuuagauuugcucaccuccuucuguguggcagcccagagccucauagugugcccucuccuagcacugacuccaugugcucagagacuugcuguguacauuucuuugauguuucuuacucuguguaacuuacaggggcuucacuuuuaauuuuuuggucauuucaaagccccuaagaauguuuuggugggaguuagauggacagaacagaaucacagauccacauuccuuagccucauauccaaauucuuuuuuuuuuuuuuuuuugagauagagucucacucugucacucaggcuggagugcaguggcgggaucucagcugacuacaaccuacacuuccuggguucaagcgauucucaugccucagccuccccaguagcugggauuacaggcgugcaccaccaugccuggcuaauuuuuuguauuuuuaguagagaugggguuucaccauguuggccaggcuggucucgaacuucugaccucaugugauccacccuccuuggccucccagugugcuaggauuacagguaugagccacuacgccuggcccucauauccaaauucuaaaauacucugauagcggcagaauuugaccugcccuaaauuguugagucuauuuuuuauauucuuucuuaaugcaguugggucaguaugauuaucuguucuggcacaggcauuuagaugauuugggggguacaccguaauagauuguggaagccauguauuuuuuuuuuaaacccaagcacuugugaauucuguagcauaccuagccuuggggugugggaaguggauuguagcccuguguuggcuacagcuggguuuccugcauugcaucagcccuagggaauuagaggguggggcccuuggaacugaucgagggcaugugaccagggugugaccaugucacucugggguugggcugcugggugcucccuggggaaauaugagcucccuagccuuucuuugaugguggaaccagagugaaacuucaauguguauauuagaaagggucacgacugggcuugguggcucacgccuguaaucccagcacuuugggaggccgaggggucaggacaccugaagucaggaguuugagaccagccuggccaacguggugaaacccugugucuacuaaaaauacaaaaauuugcugggcuugguggcuugugcccagcuacuugggaggcuacagcaggagaaucacuugaacucgagaaguggagguugcagucagcugagauucccugggcaacaaagugagaaucugucuccaaaaaagaaagaaaggguccugcuaguuaccuuuagggcaugguaugggggcccuuggagagggagauuuuccuguacgccucuuuauugguaguguauaggaagucagacacccucuuaauucccaaaaacauaaaacuaaauuugcaaaaauuaauaaauaaucaggaagcaauauucacuuuuggccauugucuuaguucgggcugcuguaagaaaaauaccaucgacugaguggcuuuauuucucacagcucuggagccuaggaaauguaaaacuaaugaucuggcagauccaggaucugggagggccugcuugcuggcuguagaccuccuggcuguauccucgcguggggcagcaagaucaucuauuggguacuacggacuggguaauaauccuguuccugagggcagagccucaugaaucaccuccagaggcccagcacccagauacaaucacugugggcauuaggguuugcacauucacgaauccagcauucagcauggaagaauuuuaggguacacaagcauucgguccauagcugccguucugaaaauuggcuccauuaagcucauuuccuauccugauuuucucaaaaagcuucauuuccuuccuuuaaaguacaguuuuaguaauuuuguuauuaauugugguguugcgguugccauuuaaucaaaggcugggccagugcuuuuugacccacugaucccugacuccuuuaggacguuuauuuuguuauaucuggcuuugcuguugcuuuaaguuugagacaggcucucacuggguggcccaggcuggagugcaguggcuuuauucacaggugcgaucguggcacaucacagccucaagagagcugcccgucucagccuucugaggagggagacuagaggcacacgccacugugcccugcuuauaucugguuuuuaguaguuuuuuccaaguguaguuuacaaaauaaaaugcucaucacccguucagaagauucuacccagcucucuuccuaagaaagacaucuguugcacaaguuuggcuucugaagccuauggaaugugcucuuuugagguggccugagcacauguggcuguuaacuccggaugaaaagucagaguguuuucugggcagaagucauuggugggcuggcguucucaaggcccuguuaacuggcaccguaucugcagaugugccgccagcaccacaccagcaggauccucggcuaugugugcaagagcugggugucaccaccgccuggacuguugcugucuccucaucuuggcacaguggucgcacaggcuccuggaugagccugugggugcacugagaggcccuguaggcugcggugaaggaagcuuuccaggagugaguccugucguuugggaucccaggcucagaagggugguggaccuugugcauugaugcggccaucuggguugcagggaaucuuuucuuccugcauuggaucgccucaaccucucaaacagaaagucugcgccccacucaugcuuaacagugagaucugaguucuccggggacacacucagagaacuuuggcaggacuugcuuaacuacgaugauauuaauuugugagcauauugugaaacucggucugccuuuauuaacagaauguuuaaauagauuuccuugaaagaauugaaagccaucaucauguuuaacuggauuugagagaaauuucauuuugaagaaaggcacugucaaaggcaugcacuuacucuauaaaucccuucagcugccuauucuugaugaaggcuaggaaguggagucaagaaaucgagagggucggccgggcacgguugcuuacaccuauaaucccagcacuuugggaggcugaggcagacagaucacgaggucaggagaucgagaccauccuggcuaacacggugaaacccagucucuacuaaaaguacaaaaaguagccgggcgugguggcggcacuuguagucccagcuacucgggaggcugugagggaggagaauggcgugaaccugggaggcggagcuugcagugagcccagauugcgccccugcacuccagccugggcgacagagcaagacuccuucucaaaaaagaaaaagaaauagaaaaagaaaagaaaucgagagggucuauaaaacugaguugaucccagguuuuugugcuguguaaccuuaagggcgcuugguagagaaccucaugaugguggcgaggagcuggugauggucauugaguaaaauuaaccugcccagauuuuagacugugcuugaugaggggaacccuccccuuuccccugcccuugauucuggauauguuggaguuugauagccaagcaaggguuuguaaaaugugccguuuuuccuuuuuguucucucacgucuucaaaaaugucacauucucugugauaccuccacggaacaaaucuuccauacccguccccucuggaaacaaccaaguaucuacaaguggcuuucuuuuccaagccuuguucaucuucagaaaugaguugaauuucuuggcaccaaauauuucagcccuagaucacagcccucacuuaaagcaaauaaaauuuaagguccacguuucugaucuuugguuggaguuuggccugugauacccguaacuuuccuuuugggaggagguaguguuucuugugcgguuuggcuucagggcacucuucuuccuuuugaaaagauacagcuuuccuguugaccuugaccuucacugagguuuaccucccagccucagccagaagggaaugauuauucgcugcggggaugagugugcaagggggugucaaaggaaaggcaggagcagcucacagagaccugcaggcucccaccgaguguuuuugugcauauccucacuggcugguccucacugccacucugggacaucacagugacaucccauucuacagacaaggagccugagucuccagaacagcucauccaagcucauuccacgaguggggucuagaacucccuccacccacgauuccgccccuggcaugauuugaggaacaauuucagcagaaguggaauagugaaacacguucccucugcuuuuguuccuuccuuauuugugcccguauuguuugguguuuaggggggaaaaauugauuuaugaguggagccugguuuucauagcaggcaucaccaagagagcugugaugucagggagcccagagccagcguggaucgggggugcuggcuugcucagcauggagaccagcuggaggccgcugugugcagcucagcucuaaggagggccuguggcugucauuggaagaugguuauguuaauuaaguccucguaaauagcuugcuccuugggagggcuaaggaggaaaaugucacauuucauacauucuuuuugcacaagagauaucgggggagaggauugaggcuacacaagucaauggucacugcccagaccagacccagaggcugguggccuugggagccaagauggccagcccuaaacaugggucggugccacuggccuggggugugcagaaaggaacccacagaagguccagaacagagugaccccccucccccacccccacccccaaaaaagccagacaugggagucagccucuuuuuuuuuuuuuaauaguggaauauuggcguuuguggaagcugauggcugaucuuuccuuugauugcaugauugagauucuacuuaucaauuuuucaggaagccaucuaauuauacaaauuaaaauucaaaggaaagcaaaaggaaugauuacgccucacucggggguugggggaggagggugugaaaccccccuugccucagauuauaaugcugucauuuuucaucuccgaggucuucacaaaaauuaacugauuaauucucuuccccccuuggaugacgcagcugauguggaaaucuguuuuuacaacagagucaaggaggggccagacugcaguuugaccaucagagcuugcgccugagcaaaugacaauugcuggcccgagccucccuggucagccucaccuagagucacuugugggugggggggggggggguggggauggacaaaagcucagaucaauagguuuggccccccgcccccacuccaauaacucuuaaguuggcuauaguuagggacucuuuuuuugugugguuaccuuucagaaagcccagcacuggcuaggcgcaguggcucacaccuguaaucccagcacuuugggaggcugagguggguggaucacuugaguucaggaguucgagaccagucugggcaacauggugugaaaccccaucucuucaaaaaauacaaaaauuagccaggcauguuggcacaugccuguaguaccaccuauuaaggaggugaggugggaggauugcuugagccugggagguugaggcugcagugagccaugagcuugccccugcauuccagccugagugaagaacagacccugucucaccaaaaauaaaaaagccaacacuagcaaaaccaauuuuuaaaauacguccacauggaucugcucaaggguaaccccacacauucuaugacaaccuccaucuccugacugauccgauauggucaguccccguuuugggggaacuucccaaucguugaaaggguuugguaucucagggauguuacauuaauuauuuaugugauuggaaauugugcuuuuucguagcucuuuuauggagaaucacguaauuaucgccauaaaucuuucggaugccuuuucagcuucguugcugggaaauuagccguuaacuuacagaaaccugguagaccugcagucugaccuuuugauaaaguaacucuuaauguuuugcauaacugaugaccguacaucauuauccucauuucuaccccuugggccucauuuuuaucuuuaucucuccucuuucuuucugcuagaucacugagaaccacuuuuucuguguguguguguguguguguguguguaugugguuguggugguggucuuaaaauaagacugauuuaauuguauuccuugggaaaaaaaaaauacagaagacaauagagugggccuuaaauguuguuucccaguugagauucaagccaccuuuuuuuuuuuuuuuuuuuuuuuaaagacagagucuugcucugucaccagguuggagugcagugguacaaccucagcucacugcaaccuccaccucccagauucacgugauucuuuugccucagccucccaaguagcugggauuacaggugccugccagcauacccggcuaauuuuuguauuuuuaguagagacgggauuuuaccauguuggccaggcuggucucgaacuccugaccucaggugaucugcccgccucggccucccaaacuucugggcuuacaggcaugagccaccgugccuggccaagauucauuaagccuccuuuaaucaauguaaagaaugcaguuccagagcagugacuuaaaagcugggauauuggggacagcuguuaaugaucuggaccucaccgggcacauuggugacagucagaggcuuccaaagugcucagauccuccugagaaggaggaugggcagcagcuccucuuccccaggccgcagucaggucucccucuagagaaucccacauaccccaaaccacaugggagaccuuucuugccuccuccaucagccucaccucuaccugaaacgucauggggaugguuacacucucacacuaagaaauacuucagcccauauagcuggaaccaagugucaaggccagcagccugggacccugcccuugcuggugcugacugcgguccccuccagcugcaaggaagguucaggaaggcggcaucggaggaacguugguuaggagcugcuggggcuucccacccgcguucucacgugguagagucaggguuuuguguugugcugagcuguggcuuugaccccugaccccugcgcggcuguuuuggaaagcauuguuguaacucaccuggcagcaggccuucgcagagccccucgagucgccacggugugcgucugcaucucagugugagugcguuuggggcagguccaacuggcugucacuuggucucugccacuggaauauaauuuauuacacuucaaauuggucaguaaauuggaauuuauagcccuaaaguuaaaagcaagagaucuguuggaauuugcugcuuccagaaauaacugacgauugucuugugugcauucacuugcuuucuauuaugagauaagaagcaggaggcggcugagaugcacuuggugcagccuccauucccagugcuuugggaaaagagcaagucccauguguccgcauggcagguucccuuauagaaaguagcaguuaaguccccagugagcuguuguccugugcccagagggucuccagagaguaaggauucuuuucuccuuguuucaggguucauaguggcgucaugcacgcagacuccugcaaguuccccuaaguucuuagaggacugcuuugccuuuugaucugagaguugcaaaguuccauaaagaauggcccuuguggauaagcacaaagucaagagacagcgauuggacagaauuugugaagguaagagcguguuuggcgguuuuuaccaaacauacguagucccucacucaaaucuucgcuggcugcucccuugaguuggcugugccacuccccaagccagagucccuccuccgauuccaacacugcauaccauuggcacccucugcuggguguccuuggccgugggccuggccuuggcuuaggacaaggccuggcuucuggggcgggguuggggacuaggaggacaguuucagggcuggugggcccugaggucuaugucuuccauguaccuaagguuauuuugcauauaaaagaugguguugauuaggaccaucuuuuuucacuuccugaaaucucaggacuuuaccuguuuuggauuaagauauuuacaaugcugaauucccugauacuaugagauuccugaagagcccagcauugccccucgugguguguucaugucccugguaucuuuggaaaugucuggaaguguucuguucaugaaaggaaaaauaaacauaauuaaaaucuaauggaaaccuggggacaaaacucugaaguguugauuaagcacugcgcucuuccagcuagcgggugguaagaaaccagcguguggguucggguuuaggggugagugcaccugccagauggggucagugcuacagggcugcucuuugcucagggugauugcugguacugcccuacaggguggcucucggagggaagcgaagauggcuccgcagcccccucugcacccuucacgcacacgcugaaguuuaguagcugacccaccaguuuguggacaggaauaugcaacccacagggcuuccccugcagcugcccauauggaauugucuguccuauaaguagauguggcucaugccacacgggguggggacaucauagacauucugcugagugacuccauggccucacagaacucugcgcugcaagaacacaaaagcacugacauuccugggguucaguauaaggaguuuggcguuaaaggguuuuuuuaaaguaaacauucacaaauuauaaaaaccuacagagagguugguaggaugguacagugaacaccaauauuccauucaguuuuccagauucuuuugaggggagauaaagauagagauauacauauaaauagacacugugugaguagaugauggauuuucuuccagaaccaucugaaaaaauucaggggcagcacuuuacucuggacuaccuauggcauggcaccuuuuauccaauuucguacugcucccaguaccggaaugaaccccaggaaucuaaccucagggacaguauugucuaguauaggcugcauauucgcauuuccuccacgucucuuugccugugcaauagauaagggucacgcauuguguuuaguuguuacaucucucuagucuccuuagucuaaaauuauccccugggcuuuuuugacuuucagagacauuggacuuacugaagagcccaggccccauugauuuguagacuauuccacaguauagguucaccagauuguauggggaguuguaaaauuuacucuugacuuccacuguaaaggugcuugauugagguuacugaguacuugcuucuggaacacgcucgugacucagcuuuccaagguuacuagcaggaaugccucuggggcugacuccacccccugcacccaggauucuccagggauguugcaucagaaacuagaaugggauugaagagcuagcagcguuuccucuguguguuuccauggcuguauaaaccugacuugggcaaaaccauugucugcuugcagacccucugucccauccagacaggugcugaaggaugguucaccaaccuucccacccccuucauguguaauaggaaauuuucagccaauuuuuuauaacagaaguuugcauuaccuugucuaugcaugguguuccagauacauuugcaguuauauauuuuaaauuucucaauaacuaucaacgcagacaggccaaaaugcaguuacuccagugugggucaccaucuauaugucagcucccuaggcaucucauuaaguacucacaguuggucccaagugcuuuguuggugcuccuccuauguauaagcugacuuaguccuuguggcaccuguuaugggucaggacagguggcacccaucucacaggugcugccagagaggcguugagcaguaggcaguuugcacccaggaacccgggcagucuguuuuuuucuguuuggccuucucucauaccagcuuguuggauucagcucuuucuuccaccugaaggccuugaacaucuaacacacacaaacacacacacacacacacacacacacacacacacacacacacacacacccccucuagcuuugaauucucaccauguuucuauucuaucaacuacuuguagaauguucuguauugauaugcagagagccugucaaacuguuuuuuucucccuccccacugccuacaccugacacagggacuucugcgucccuuagguuuguuuuuuuuuucuuucuaaaugauuaaaagcaugaagcugccauguucugcugugcuuacccggucugcucccaggcuuguaggaacuuugucuuccugcucuuggugucuggauacaccagcuccuuaaaauucguccccucccgccugcuacacaaugccaacaucaagcccuggucgugggucccuaggcuggaaucaggcaggccucuccagggucccacuccagguacuccgcuggaaucugagcaucaccccugcacagauacuuguacaaccuuucccuguuuucuaaggccuguccagccccuuccucuuugaaacuuuucaaagcaagaaaaaguggcauggagcuugauccuucugugugcccagaaucugccguggggauucacuccgccaggcugugucucuacucggagagcaggacacagacagucuuugggacuccagccaaaugagcuggaauaauggucuuucuagccaauguaaaagccacauuuuaauuuuuuuaauguaacucuuugaguuugcuauuuauaauuguuccuuuuuuuucugaugccugcuaucaagcaauccuauaauaccauguaagaauuauuacgaaggagcccucucguaacacaggcugaucagaacaagauuguggucuccucauucucaaguauaauggagaucuuccuaucuguuuagucugcugacauaauugacauugugaacugcaccagcuggaggguuuuaguaccuacuuuaucgcauuaugccagagcuccuuugguuugccccaaacaucuauugguuggaaaugagggcuagcuaacaaucacucagcauugcaaagggaacccagaagagcaucuugcagagcccuggguuuguagaacuuaauaaaccacaauggcuguuguuggugguaacuuuuuguuagagcugcuucuuguggauuaugauagaaucagucuguaaacacugcuccccuuuccugcggcuguugcgauugcaacuugaaaaaaguauguguuucguuuuacugcguuuuguucgaauguguuagagacguggaaaauggucccccgaggaugguaucagcugaguugugaguaguccccuuguaacaugacucagggagggugcuucuccauuuccucugcaaaaauaaaagggaccuccucuuaaauaaacaagcucaugaaacauuccgcaccucuggaauguucucacgaccacagaggauaaaaggaaugagaacguugagcugguuggguggauaugaggaaaaaggagacaagcugguuucugugaaacacauagauaguuagaaagucugggaaucucauucugcaucaccuuugucgcaggaggaugagaagucugagaagaugcugccggggaugagguggaagggaguuuccccagugggucucuucugugucgcgggcucuucugcucuucucaguggguugaacuugccaugguggaagcacaugucagugggauguacccccaagaaaggucauccauacguauaaggaacaaagacaggcgccuccagggucagcaagguuacccaaguggucuagaagucccucuggcucuuuccuucuuccagcagccuccuugccuggcaaacacccaucagagccuccaggaugagagagugacuuucucuuuccccgaggaaagaacauaauccacagaguguugacaaaugguuuuguuugguauuuaagauuuauuuguuuuuguucugaguagcuguuuucuuuucaccuaucuuuguacagaugcauuauaaaaucaggacuuguuuuguuuuuguuuguuuuuuuaaagcacuuugagcgcuucguaaagaaacagaguugaagccugccuauagguaguccacaaacaguucuaauaaauaacuuuaaauagccccaaaauguggauuuuaaaaaugggauucauaauguugcuauacauuauaauuauauguugggaucaggcaauuaugcacauuuccagcaauuaugugauuagcuguaauuacauuagcuauguaaauauacaauagucaacuagacaugccuuaaaaccccaaagcacaaaugaacauacccaaacaaucuuaugcaaagguaaagguucaggaaacagccaaggcaaagcuucacagacaaaagugcgguucuuugcaagggguaaaguuucauguuuugccuuaucuguccccggcuuuaagagaaacucagagugggggaccccuccccagggaaccccucaccccaccuguuccuccaccgacucuggggaugggguucauagacugcccucccguucugcagcugugaaucagguucgguguuuuauuucucuguuguuacucauuucucaagcacaaacauaagcgucucuuugcaccggucaguuuggugaugggcggaugucuucauacucaccacuuuuuucuaauagcaacauguuaaggccacuuugcuuuuauuuggggggccagggauguguagugcaacuggagucuguggcugggguuuggggguucaucaccgucuucuaguuugguucugcagcugcgguuuucagcuccugccccuaccacagugaaucgcgcuguuucccaccgccugguugguggugcccugucuccaucgaugauugaguugaaaccucccacaguguggcccggagccccugggcccagcugcccagggcuuuacucucagugccuguccucuuggucccggcaccuuugggaaaagagcaucucuaguuucaggccaagucagugccuugaggggagcagugcuuggggugggcagggggaaggagugccgcggggggaacagugcauccguagucuccguguuuggaggaggccccaggguagccagacagcagcagacagcagcccgcacgaaugcggagaaccuucugcgcgcuucacacagcucaaccuaauugacagguauuuggggugacugugaaccagaaccccaagauacauuuugcugccggcuucuugcccucucuccuuuuccagaacguacaguguuaaagcugugaaaugagacuccucucugauugguuucuaccacuuggcucgcuugcuacuaaagcucaggcaccuuggcgugcgcgcucgagggcguuccucugucucugucucaucuccaucuacagagugaccucacgugccuuucucagcccuuccacauccagcaggagccuggcugagcaccccagcugggcugugaagaugccgagaggggagagcauucuggguguccagcgcuggggcacagugggaucccacacucccugucccuccagccuguuucucaucaccugaggguuuuguuuuccguguuccgguugaagagaugucugugccaggaggguuccucccuucccauuugcaaccugggaugggugacgcagauuuauccgagacuugggagugaggcugagagucaguucuuucguauccuaagaaaggcugaccgucccaucaaggcccgugugcugaaacuguccgugugcaggcucagguggagcaggucucugucaggcagccauuuguauuugggcggugggugcuuugccuagcuuagugccuaccaugcccaggcuugcaaauggggcuguuugggcuuugaugugggcucaggcucagagggcugaagugguuguggggaggggcuucuggggacuguguccaugucucugucguuuuuccccaucacaccguacacucccuugaggccagccguccaucaccauugagucauagucgacaguuugauuuacagcccgggugucaaacaaaaugaaaagcacgugaugaauggagggagcacgugcuguggagggaggggugcgcuccgcuccgcaggucaggggcuaagcggccaugccuuggccugucucuacaggcacaugcaugcccuggacuauuuuuggggugccuuucucaucuugaggaguggcagguuuuuuggacuaaggacaaagugacagaauuggacugagaaagguucaugggggagggcucgcugagccagcccugauuaggagcauugcucacaaaaccagaggaaggacggcauccugggaccuucugaucgcaggacagccgaggagaccucaaacaguggagugugauggggcgggucaccauggaggugagguggagacuuugggaaucugcaggaaaagcugcuaaagagcagaaggggugguguucauugagcaccuacugugcggagcgucuugugccgggugcuguccagagcugagcacagccucuugagguugaguguguuccauugcuagaaaugggaauccugacaugguccaaggugaggccuguccugcaucccagcuggggucccguugcacacuuuggcuccaccaacacuuucaaaaugggcagugcaagagaaugggcuuguuuuuuuuuuucuuuugaaaccccauaaugaguggucuaauuuucauaaugcaguucccaggaagcuuuacaauauaguuaagaaauugagucagaagcaaugugcaggccuuuguuuucacuuaccauggcuaaauacugagagacaugaggacuggggcuucuuaggaugcagcuaaucugaaaaaggcuggguugguucagacacucgacgucacucuccugacuuccuuuggcgcguugcgugggugcccaagccuccgcgcuccaggcccagaaauuggugagagcacucagugugcaagcaagggugcacggugcacucagccccuuugauaccugaaacgaugucugggcaguuuugcuaauuguugcugugugcuugcgugauuuagacgaaggcugcuuuaaaacccagccagacuuuguguuugcuauguaaccagugcauuugguguggccucccacccuuugcguuagauuagccaacuuggcuacuuuggguugaggacguucgggggcaggggguaggggguugaugagaggaaagacuuuuuuuuuuuuuuuuuuuuuuuuugaaauggagucuugcucuguugcccaggcuggaaugcaaugguucugucucggcucacugcaaccugcaccucccggguucacgccauucuccugccucagccucccgaguagcugggauuacaggcacccgccaccacgcccggcuaauuuuuguauuuuuaguagagacaggguuucgccauguuggccaggauggucuccaucuccugacaucaggugauccgccccacucagucucccaaagugcugggauuacaggcaugagccacggcacccggcccaagaaaacuuuuuuaauggcacaaauuccacaacacuuaacuugacagaagcagacaaaaauccagcacaggcuguccacauuuaaaagcaggaaauggguaugccauaggccgauuuuucugcccugugucugccagaaaaccguguuacccgcuaacuucugcagccucccuagggaagcgcucgcugugggagacguagagggcacugugguggcuccguccugggaugcagcaggcgcugaagagccuccugagauguuauuuccgcuaucaccuucagagcugcccuggcccuuuguguugguggaggcaggaucagggaauggaagcccaggcaggugcaggaccccccuggggaagcuguuccuuaaguuccuucaguugggaacuuaaguugccuccugagaaugagcuauucccugagaaggccuugagacaaaccuggcagcccaccaagugggcgggugacaacacaguuaagagggacacaccauugagccaaauggcccucauguuacugcaaccuucagacucacugaucccaccuguucuucuuuuucuauaaaagugagaauuagaccccagagucauguuuucucucucauuucaagcaguuuccugcaugauuauuccaaugggaacaugaaaugcuuguuggcaguuuguccaaagacugcuccgucggaggguacccacugaucauccccauccuggccucucuucccagcucuucuggaacugucuggauccaucucuggaauugucuggaucucuguaggucucuguuguuaauugacaccuugugucgcacagggacuucagaauuggcuuuggguggacaucgccucucuccccgacacagcuauguuacacaaucaucuuauuuuuacuugacauaauuucuauagugaggguuuuggcagaauuaaaaaauuaagcccgugagauguauuacucuaaugggucccaucucacuuuuagucaacaugagaauuuuuaagaaaagcaguccuuucuaaaagacuggaguguggugugugugugugugugugugugguguuuguguaaccagaguguuuggaaaagugaguccaguuacagguguuuuuaccuagcgcaggaaaacaucugucauaauauuugucaaaucucagagccaaggcugugcgaguuugggugguuuccaagcagaacagguugaaaguugauagaaauggaagcugggccuccugguucaaugggaggcugaugcugccccaaagcgcaucugcccacaucugcccugcuccugcgaucaccccuuggacaccagcucaguaaccucucugaagaaucauuacugguuucuuaggcgcuaccggguaaacauucuucuauagagcccuguuuacauuugagaacuugcugagcugaaaaccagauagcaaagaagcuggugagucaacagagcuaccucacccugcuacaaaaaagacuuggcaugggggauuuucccggaaugcuccaaguuuauccacccaucuuugaggggugugcaugcaccaugagugggguagcauaguacuaacaccacauaaggucauguuguucauuacaacaaggggaggaaagaaauuggcaagguggcuuaauccugaggcgcuggccaggcgcaguggcucaugccuguaaucccagcaccuugggaggcugagguggguggaucaccugaggucaggaguuugagaccagucuggccaacauggugaaguagauagaguagagacaugguaggcucuacuaaaaauauaaaaauuagcugggugugguggugcacaccuguaaucccagcuacuugugaggcugaggcaggagaauugcuugaacccaggaggcggagacugcagugagccgagaucgcgccauugcacuccagccugagaaacgagcaaaacucggucucaaaaaaaaaaaaaaacugugucucaaaaaaaaaaaauuuaaagacugguauuucucuuuagaagauucuaguagagugcuagauugagagagaugugagugaggaacagcacucggguuuaaugcuugcagguaugcauguugucucauuuuaaagugcuuucaauguauacagccuuuguagcuuccuaaucaccggcuuuuauuuuugcuaugaauucuuugucaugggaauccugcaguugcagggcaggaaccuaccguguuagucugggauguugcuucucugguacuguuccauauguuuaaggaaaugucuuaauacuucggggcacuccuuuaucuaaauaacugcuguucuuugcauuauugcgccugaaguccuuuguggacucugaaagcuuaauccaugugaauauggaaaagcaucugcaggaucuaagccugcuggaauuaggcuuuucauccugacauaccuaaaggaagaugagauauucagaugcagccgcuucccaguucugcuuugcaguguaagguuuagucacccauccuccuguuccugugaccucuguugcagucacuuuaaaucccagauuacacacgcccuucccuggcacuccccggccccccggcagcaugagcccaucuguguuucacaguaauaagguaaagaaugcauuugggcuugagcucggaaaccuguuugauucacaaccaaagagucgucucaaagccagaucucaguauuaucaaagcaucagguuucagagcuggcccuuuuuugggcuaggcauccauggccuaggaucacguguggaccuuuuucuguuuauccauguuuaauuuguguuuagcugugccauggauuaacguuucaucacgguggauuaagaguggacugacauugaagcagccuuauuuugcuucuguuaccucucaggaaucaguggcaggggugggaacagccccuuccagagggggaggcaggguucauccuaaaaguacccuggugcuuggaagagggaguauaaaccugagcgucaguguggaaguaaaucccaguugcagcuugggagggcuggauagagcaagccaccggcuucaucagucuaacgagaugucacauggaacaaagcuuuaggguuuuauuuagcuccuaauccgcaugcugagagagcccugguccaugugagcacaccagccaggaagggggaccuggcaggcuggggacagccuccucuccgggacugagcuguaaggaacagaccucucuggcuaucguuggggagugaggcaaaguuaccgugagucuuauguuuugucugcuaagguuucggaggauuaauaauucaggccaugcuuugaaacagaaaacccccaguugguugucccugccgucucggaaggguuagcacacagccaggucuguuuuugauguauguaauugaagauuuauaaagaaaagcuucuccucugccucauccgcagucauuuuuuuuccaaugccaguucccagcaggcauauaaauauuggucguucucagagcugggaugcugcugggugguacgagggccccugggagaacgccgagucccugcggccucuggggaggagaagcucccugacguauggcacagcagaggggacuugguuugagccaaaccaccgaccacaggacgcugcccugcccguggccgccgagcccuaccuguaccgggaggccguuuauaacucaguggcugcaagaaaggggucuacuccugacuucaccuucuacgacagcagacaggcagugaugucuggucgcagcccccugcugccacgggaguacuacagugauccgucuggagcugcuaggguacccaaagagccuccccucuaucgggacccaggagucagccggccgguccccagcuacggagugcuuggcagcagaacgucaugggauccaaugcaaggccggucaccugcccugcaggacgccggucaccuguaccgggauccuggagguaaaaugaucccucaggggcggcagacacagagcagggcugcaucucccgggcgguauggacgggagcagcccgacaccagguauggggcggaggugccugccuacccccucagccaggucuucagcgacaucagcgaaagacccauugacccugccccugccagacagguggccccgacgugccugguuguggaccccaguucagcugcugcccccgaaggcagcacagggguggccccaggggcccugaaucguggcuacgggccugcccgggaaagcaucccauccaagauggcuuacgagacuuacgaagcugaccuguccaccuuccaggguccugguggcaagaggaccgugcucccugaguuccuggccuuucugcgggcggaggggcuggcagaggccacgcugggagcccuacugcagcagggcuuugacuccccggccguccuggcuacccuggaggacgcggauaucaagucugucgcacccaaccugggccaggcccguguucugagccgccuggccaauagcugcaggaccgaaaugcagcugcggaggcaggaccgggggggcccgcugccccgggcgcgguccagcagcuucagccaccgaagcgaacugcuccauggugacuuggcuucucugggcgcugcggcuccucugcagacagcauccccccgagcuggagacccggcucgccgucccuccagcgcaccaucucagcaccuccuggagacggcagccaccuauucugccccuggcgugggcacccaugccccacacuuccccuccaacuccggguacagcucucccaccccuugcgcccugacagcgcgucugagccccacguacccccugcaggcagggguggccuugacuaacccgggccccucaaacccccuucacccaggccccagaacagccuacuccacggcauacacggugcccauggagcugcuaaagagggagcgcaacguggccgccucuccgcugcccagcccucacggcagcccccaggucuugcggaagccaggugcaccccuggggccauccacccugccgccggccagccagagccuccacacgccucacucaccguaccagaagguggcccggcgcacaggggcacccaucaucguguccaccaugcuugcaccagaaccaaguaauacauccuccccgccugcccugccuggggaccuggggggagcaggggggugcgggguuguagaaguuugaacauaggauggcaaguccucacucaccaggccacacacacacacaccaccaaacaagaaggacgcagcacuguggccaguugacacggcuucucuuaaguuaaucagauuugugugucaggccagaucugcuggggcagcagugcccuccuguucuuuaguugaggucggguugauguguagauuucccauuacggugguaaaacucaacuguguuucuuggagaaagucgcaagucacucagaacagacugcagccuugagcucacgagggguggcccuuucuguaguucacacuagggaacuuuggagaaggcaggaacguuucaucaaaugcuggcuguaaagugugcauccuccauuuagaagggcgugaucguguggaaacguaccucucacggguccgcacgccguaucagaggcagugauuacccaccguggagaugaaaauguguguguuugcauacuuguggguuaaacaaagcaagauguugaaaucccucagaacucaguuucaaaaacagauuuagucucucauaucagaaaauacaguugggaauuccgcgugcuugaagggaaggauauauuuccaaguccaggaaagggagagugaugguaggugguuuucuucacaacaugugccaggugugauuuauggcguguguuuccuuggacauuguggaugaaguccuaggugggcguccucagagcaccauuuacaauuuuuauuuuaacucuagagucuugaccacaaauuuaaaauguaaaucaguuuucuuccuuucaaacauaauucuuuccuccccgccagccuccccuacgucauucagaaaacagaauccuuuucaaaugauuuuuuuuuuuccugaauagcuugugaaaaucaggaugaaacaauaagaucuaccuuuuugaaaauagcccugaagcagcuguaggcggggaccgaggcgcuggaccucacaacccugcagagaccaccuuaaguuucucugccaucgcuguguggcccgugugugcuauuaauauuaccuccuagagaugaccuccaggcauuuugcauuuuguuuccaaguggagacugagcaacuggccugauuuucugcuuugucguauagauucugauuuugucucauggauuuuuuugaagucugaucacaucauuauuugacuuucucaaauacaugugcggcaggagggacgucagauaauuuuuccgagggccugugccugcucucucagucaaacauucuuucuuugcaaccaacugauuugcauggcgaugacauuuguugcuccaguaauuucaucugauaauggccgggcuugcaaagcggaucugaaaacauauuccuuaauuauguguugcuaagugacaggaggguuuggucauaaucacagaaagauuaucuccucacccaagucguggaaagguuuugccgaaggaggaaccuguaagauugccuuuucuuuucuuuucuuuuuccuguuuauuuuagacuugccuuuuaacaaaaacauucgccauuauuuggguauggagugagggguauuauauaaguuguuugcagugugauugcuaacacgauguuuuacagaccggaggauauugauuuuuacuuaauuugcguggcagcgagccagugccagggaagucugcaggcagaagccagccagcaaaucaaaugucucuguuaaaugauccaccccauagcugcaguuucccuccucauuccuuaucguaugcugauuguggcauuaucccccacacccugucgggaagggggcaggggcuggcgucccugguagcgcuucagcuguguacauggcuguacguuuuguacaguagguuccacagaauccgcagucacauuuggaucugucggagccagcagggaaaguagacgguguguguguggaggauaauguugacauuucaggaaagcacaggcugggcagucccgccggccucugguccaggacgcggccaucuggaaauccaguguugcuuguuugggacgccgccagccugaacgcaucuucguucuggugccgccuaacucaagugcuucccucccaucggagggacaaggaacgcccuucuggaaguugacucucuucuccccuucgggaugggcgguguugcacugcuuauaguggggugguuugggguuuggggauuguuuucaguaucuauuuuauuuucggaugcuuuggcuauuuuuaauguauguuugcuuuuucucaguccacgaacuaccugccuuaucuugguggguuuugugcauacacacaauaggcuccuauuucuaguccaguuugcuggccaagcaguccagagugacaacgugaggaaggcguaugcugcggggaccccagugcggcccaccagccccggugacacagacaaaugggggcuccaggcccgcgugaguggcagcaccuggcaggugguggggucggcugucgcucucaggcugaccuggccggcuauggcacaagucgcggagcccuccggcgguggcugcgagccagcaaucuccccgugucacgugcugucacccgagcccugccugcaccagaugcagcagggaucaucagaaacaacgaacgaauggggcugcggccauuuucauaucuuugucuucacaaaauacagccaagccugcagccugcacagggcucagcucaggacacacccugggggcaaaguuucagaugugagaaacgcagucccagcccaaagagccacaaaaagaucuuucugagcuuuuuccauuuucuuccagccguuuuucuugaugcaacuggauuaaugggggcacaugugaccccugucuaguugcuuagggucacugccugaggacuccaggauggagggaggagcgcguggucuguguggaggggcuguugaggaggcugaugguugugacaguuaccugucaccagagcuggucacucucauggcuucuuuucguguggccucgguuuccagcaacuggaggugugaacgcugaucuccuagguagaaagcaccuccaucaauaauuuuagcccuaucagaaucuguauagagggucgccgccaucggcccacaccccugcugcugaguccucaagcagccuugccucuuguuugagacuccucugcaccuugaggucuguccuggggcagaggacgcacugcucuugagggucuugacccuuaaaccuucggcaggcuucccccaucucagagcacaaggacauuugggggugagguccaggggcugugaccccaggcuggcccugcagaccagcagagggaugaguccagcccuuccugugugcuggccaugcaguccagccagagagaguuguaagggagcaaggaaaccucuuccgggcugcccccaggaccccugaguccuggacacagaccacugcccugggcagagcccagcgugagcuuagaggcuuguucacuucuuccuuccuuccucauugaccuguccccugcuguuccuuccuuccuuccucauugaccuguaccccugcuguucuuccuucuuuccauccuuccucauugaccuguccccugcuaugugccaggccuguggccagauguuuggggcucccaggugggcaagacccaaggcuuguguuuaggugcucucuggucugggggccaggaaaggcaauucauaaaaggacaguuaacugugacuauguauagcaggcaccaagauggggccuguggagcaccuggagcuccagggcuucuuggccacuccuaugcuuggaagagcgucccuacagcgcaugugugugcaccggcagggaagcaggagaagggcagagcucagcaccgcagccagacuggggccaggggagaggccaccgcccaggccggcguggggcagauggaagugugugcgugagcugucgugugcaagggcagcuaagggccugacugguguuuugagacucccuguggcgucucuuuucuugcagaguaaucuaugccugcguaguaaaaacauuccagcauuguggagccacauagccaggacucugccccuaccccagccugguagagcaagaaccucggcauggccucccuuccaaauccaagagcagcugaacgguucccaggugcugacagcucagccuuuucuagcaaaacauugaacacacccgacaucagugagcucugcgggccuuccguuuggcuuuuguacuugaucagucauuggguuucauggcccgguguucccugcauucagugugccccugggcaagucaccugcuacuggccucugugccucugaggcccugguugugacugaugccugaccuccugagacucccagcccuucuugugaccucgccagaucacccuccgccuucauggcagaacagcagugaucaucccuccugcccguugcugcccugaaguauucgcaucuugguugugcccccuuaccagacugaacucagcgagugccugaaccuggccucacccuuuguucauggagcucauucugcuaggcuagacuggguuucuugguccccuuucaggcuccuggacgugccguagaccccaggaauaugauuucagcccaggagcauaaaguaguugaaugcauggcccgaaggagugccaccugcuuuguguuugggcaaguauguugaguucucugugcuucuauuuccaugucugucaaaggggguaggucuugaaccuguuuccucugcuucugggagagcagugagcagagaaggaagagagggcuuguguguugagguuggagcugccuggccucagcggggaauggcgcuuuucuugucgugguugacccuuggccucuucucacacuggacuacugaggcccucggggucucaggggccaaacuugucccccagcucugccgccuucacagcacuuccucugaccccguggguguggauuucauucuguccauggaggacguggggugagccaugccgggacaacuagacagcggccaagcugcugaagaaggcccugcugugguccucaguuuugugcaaagacugcucuccuaggccucugucuuguuaaagcuuagugggccuuuuuucaaaagugaguaucugggaauuucuguaagcccaccuugcauagagugugucccccucgacagcgcagacccccuccacacuggugggugggugaucugaccaggagucuggccagagaguaacguggaugcuuggugucagcuggcuggggucgugagucucaggccuugugcguaacaggcugggcuccucgccgcaucuggagagcuccaagggggaagaggucgacaaaugauuucugccgggcguggugcaggacucagagcagguggugaaugaggucggcgcuugcuguugguuuaaagggauugacccguguuuucaugggaggccaugucagccaagacugcugcugggaccuuggccagcucugcccgcguuccagucaccagacccucuucugucugucuccacaaggcccgcguugacugaccuccucaugucuacaggggcguucugucuuccugguuuagaaagcaguuccacauggaguagggaggucuuggccagcggacccucugcuuuccaggaagcaggucauggggccauagcuucaguuucuagauaauaguuuuguguggcugugcuguccccaucccauccccccaacccccacccagugcugugagaaccacaucacaccuggaacucugugcauggccaagcucagggccuccuaaaccccuccagggauuguugcuccucugaaaucuuuaaaagcuguugaucuuggccaagguaugguuccuauuuuccuggaagguuugcggagccaagggcauaaguaccugagcagauuccacagaccaggugaguggccccauguucaccuggccauaaaaacaaccaaugggccccuacgcuauuuugcuuuaacucuacuuucaaauguggccuuugcucuugaguguccaguguccauccuggggcuccacaagucacauuucagcucugucaaccucagugcuugaguugagggucuuccugggucauggggcccaggcuuuuuggugucaggcacacaguuuggaaauaguucucccccauucugugguuguuuuuucaauuucuugauaguguccuugaagcaugaaaguuuuaauuuggagucuuacguauuugcuuaugccguuggugugacaucuaagaaaccauugcuuaaucgagggucaugaagauauauucuuauguuguccuccaggaauguuaguuuuagcucugacauugaggucuugaucugcuuugaguaaaguucugcauauggugugagguaggggucccauucagccaguugucccaguguuugcuuugugcuuugcagaagcugagcuguggagagcugggcuggguagagcaaaauuagagcuucacgccagacuucuugcauuuggaaacuaacauucuaaggaagaaagacgugguuuuuuuuuuuaagugagaaagccaacauauauuaacaggaaagcuuuucagguguuuggcacaaauuuauuuacccccaagaacauacgaagccagaauucuaaagcuuuuucacagauuccuugcucauacgugggagagguuuuuuugguaaguuuaugaaagagaaauaguacuuguaauccauaacuaauuagcccacguuagcgauguagaaacgagugugauuaaacgugcaguugucagguguguguuucccacucugaggcuggcuucaacaaagggcuuucuaguuguuuuuuacauaaaggauaaaaaaacuagccuucguucacuuuucuugcccccuccagugggagggaggaacugcugaaggaacaggaagguacacuguaguuaaauuuagcccaacagcagcuuucagcaugugaauaaaacaacuuuugccaaauuguuaggagagcaaaaaauccaaccuagaaacacccguccccacugacagagugggcggcccccugggacauguucuccugagagccauggagaaauucaucccaggaggguuugcaaaugucaaugggacauggggcagccuguggcugaguuagcacccugggugugcuucaccagaaggggcaagaguaggaacccugauuccuggucccccaaugcaguugugugggaugccaguggcguuggcggggagcgcguccugcaauaccagcuagauaugaacacggugccuccgcagggcugguggggugcaccuaccccagguggcccauggaaugugccucuugccccuuugccagggccgagguaggggaaaccagccuugagagaaucuagggcccugacugaguucaguaaauauuaguaauugucacuauuguggaguuuguuuguuuguuuguuuguuuguuuguuuguugguugguuugguuuggucuggugcuuuuuuugguuuuugguuuuugguuuguuuuuguuuuuuugagacagagucuugcucugucacccaggcuggagugcaguggaacaaucucggcucacugcaaccucugcuucccaagaagcugagaccacaggugcccacuaccauaccugguuaauuuuuguauuaguagagaugggauuucuccauguuggccaggcuggucucaaacuccugaccucaggugauccccccgccucagccucccaaaguguugggauuacaggcgugagccacugcaccuggccuauuguggagcauuugacaaggaugaucccccaucugaaaucccaggaagacucuggacauuuuuccucugacagacucagagagguucacccccuacccugagucccacagcaggggguggcccaugccaugaugauccucaggcacggugcauuagcacagcaagggaaaaucaacaaugguauacacuuggggaggagacaccaguccgagcuggaagccaaggucugugucagcaagaggaaacaggacaaaguggcugggcucuggagcaagagucaugacgggcucuggagcagcagucaucaugaugggcucugaggcucgcuucccauggguaacacuggggugauggugcccacccuaccugccccccacggcucugagaaccgcaucacaccggagcugugugcauggcaagcucaggguccccagcuggcuccacgagcaccugcugguguuugccuggcuccagcugcugcccucaagaccaugcugcaucugagcugcuccgacugcggggccaaacuccuugcccuggaucaugcugcugccugggagaguucagggaauuaauucucccagugaagagcaaaugccauucuuuugugugauuaaauggaauguaaaauguucuuuggucauaagaggauuuaagcuggcuguugggaacagcuguaacacacacaaggguaaaguuuuaauaaauggaaaaguaaauguaggaaaaggugagggagggugguagggccggaacacagcaucccgugcaauccuguacacaaggauaggugggaauucugcucugagcuuccuagcaaccaaagaaagagggaaacugaucacauagaagaaucacacugcauguaagaugggaccgaugaacccguugcucagaagcagaggugaguuucuccugccuuuaucgccucuccaaagaagcggcaucagcgcugguuugcaguuugcuuucuggcauuaccucccugcuccucagccugcaccuuccuccgcuacccgucgacagccuccugcgugucaccuucugauuucaccagggccucauccugguugaaguuguuaagcucuucuugcacuuuggcuggauacagucagcuguucuuuggcgcugacuucccccgggguuccuaccuccucuucuggcccugccucauuaagggauugcauuaagggauuuuucgugguggaaggaagcucugccugcggaacugaauguuggcaccaacugcccagcgcaggccaguccauuccccuuccauccacagugcuuagagcugaccucuggccucucaacccaacacguuuccccacuggggauuugccuauuagaugcuuuuuauaugaaggaauaaauaugccuuugugauggguucuaguguuuuccuguaaacugggcucugagccugggaugcuguagaaguuacuagauuuuaagaaaaaguuagagaagaaagaagaguggaggcggcauccagccagcuguugugcugagaauguucacuuccuggcugugagcugggccugggcgcagcgcucuuggcccuuggccugccggacagcaguccucgcggaucacuuuccucuuggguuuuaggaccacucgaaaaacgagagugugcugcaagcaugaggcuucucccucucccaucucagccuuggcugccauagcuaaggaggaggguguuauuuugcuuuuguggacauucacccugggaaauaaggugagaaaauuaagacugggucugccaggcuacaggcuacucaggguccuuuugcgggaggacguguuguucauuucucuggaacacugguggaauugguccaucugauuccaagggacaagccagcagccagggcggccauccagagggcuccuggucccggcacucaugggcagccauccccucgggcagugacucagugguggccccuggaacuuggcaguggcacucggcucgcugcagguucauggaacauccagggcguuugcccuccugguugcugcuacuuccuguaccuuggaggaaaagucccuuggggcacugggaagggugggcggggccucauggccuuccucagccugaucgggacccaccaaagggucccagaccccagucucacugcacccugaccauccccuuccccgucaccccggguggugccagagccuuuuugugaggugcagggauccggguacccagcgcacaguaggcguucucaaacuuucacacagugagaagucagacugagccauccaucucuggguugccuguggccuuuuuagauuccugcagaaucucacccagccccguguguguccacacuggacacgcugccagcccagcacccagccucuugugcggccggcgagugagugugcagcagcuggccgcucugccagauuccucuggcaacaauucguacuuuucucuucucuauuuucccuuauuuuucucaaacauccccuucuguuguugucaggggcacauuuuuagaacuugagagcuguucacccaacaccuccaccagcgguauccacacagcgggcgggcgaggcgccuucuuggaagugcuucggggagcacugaggccagcccaucccuccucagccucgagccagagggaguccucuaggguuugggcugcaugggcuuccgggacgcccucccaacugcaagaccgggaguggacggagggagcccugggagcccggcuguggccccagcgaggcaggggaggauggccaggccacaccagggaccgcacagcaaaggcucuguuucaaaaacagacgucacguuuccugcuuguggccugugggguugucacugauuuuuugcauugauaugaaaaccagcagugcuucuuuuccaucugggccauggcucuucuggggacagugcaggacucgaagagaagcuaauggccuugcuuggguggggaugacuaguuuuuucuuuuguguuggucacuugcuggcaagcggguuuucccaccucacuggcugguuguccagcagcgugaauccgcugccugagaagugagucuccaaacaaucacagcgggacugaccacgcagguuuccccauuacugcgcuaugaagcucccucgggcuccggucacucagaccuaaugucgaggaacguggagcacauuuuuuuccucuacccaaggaagcagaugugugguagcugguaaacauccuccacaccgcagaguaucuucuaggaaaacugccugguacggggagcuuggguugacgaacgcucacuuuucuugguuuuuauucgcuuggaggugagaucugaugauuggcccuucucucugguuauugcugaaaaggacagaagggcgucccugccggccaaggcggcugcugguggcucaaccuggagagccuggauucugagcagccguggucacuggucuuguccaccacggcucagaacugggugaaacucagcuccccaaacucauucuucccgagacuuuaggggaagugcuuccuuccaagucagugcuuucuggagggcugguguucccgucucggcaaguucugccuggccagaggccuacgggcucaggcaucugaggcacagggcauuugggccauuugccaggaggccgccaagagguugcuccccguaaggaaggucaaccucgugugcauugaaucuugcauuaacccucuuagaggccaguguuaagggccaaguugacauagauccauuucuuggaucagguguuuguuuuuucaguuaauuuuuuagagccaagucucacucugucacccaggcugaagugcaguggcacacucauagcucacugcagccuugaacuccugggcucaagggauccaccugccucagccuccuaaguagcugggacuacaggcacguggcaccacgcccaguaaauuuuguagagaugggauuucacugugucguccagguuaggacaagguuucuuaucaccggggccaugaaugccugcugggccaauaggacaccgugaggaggaccgugugucccugcauccagcuuggggaguggggccagcacacacguguuacuauccuguggcgucucggucuugcuuggaugugcccuucuguucuccgccguucugauaacaguuaccaugaugacgucucuuuuaggcugcaagaucuagagagacacccgggugggaagagcgcaugccucacgugagaagccucaggcccuugguucuugauuuugugugccugguugauagaucgaacaaucacauuccugcaguaaaagagagagaacuuuaagaccuaccucagccugccgaggcaagaucaccugucuguuuccuagggccaggccugaugaugucugucuuuccaguguccagagcuuguugaguugaaccaauccagcaggugguuugcacugcgguggacccugggguugcaugcuuggucucuggugucagagagaccugaguuugaguccugacuccaucacuuacuugcugugugaccccgggcaaguuccccccgccuccguuaccugcuggggaaacagcagcgccuacggcacaggguuguguggagggugcaagagaaguggccgugaccauccuucuaaaugggacaggcuguauuccauggucaugaugcucagcauaugguauaaggagcuaacuguuuaccaucccuuuguuaccagaaacuugacucccuguguguuuggguucuuggugcauaggugauuuuauugcugcaauaaaguauugaaaaccaauuaaguaaaagaggcugacggcagcggugcccgcacgagacuauuuuacaacuucgggcguuuccagucucagguauuuccccagcuuccaggcacauccugggaaagucuagucugugucuaauuacuguggcacagaaugcacccugcccacaugggauauguaaaguagggguaucccaggcggccccuuggcuacaggcagcugguuuucauuacaggugaggcugagcagauggugggcauucuugguggucuuuccaacaggcuccagaccaccucacaacucggagcuugggccuuugaacugagaaucucauaguuuaggagcugugggcuggaaccacaugcuggcagcugccacccucgagacagaaggcccaucgccauagucauagcauucuuugcugcuggcuggcagcuuggagaggcgaggugggcaccucccaaggaggaaugaguuagguggaccagccaguccugguuuugacgacugaguucaccagggugaacagauagucauaugggagccccuuuuuguccuuggcagguuugugcuucuuuuggccgggcgcgguggcucaugccuguaaucccagcacuuugggaggccgaggcgggcggaucaccugaguucagaaguuugagaccugcuuggccaacuuggugaaaccccaucuggaaggcugaggcaggagaaucacgugagcccaggaggcggagguugcagugagccgagaucgcgccacugcacuccagccuggacaacagcgugagacuccaucucaaaacaacaacaacaacaauuuuuagucuuuggcgaugcccugaggcucaucucuuccacagaggcuuggaggaucggccacacgagugggguaugcagaggcacaggcaggugggggagugagaaccccagggcgcaucugaccuuggcgugccggcaggaagagaacaagcaguccuccuggaagauuccaccagaacuguuuauuggacaggggacucagacgauguguguccccagccacagugguggcugagagugucccuauccugugcaugagauccugaccacccgucccugcagggaccguccccguguugggaagcaggaggguaugucgcagagccucacccagugggagccacaauccuuauuccuugcuccucaggcuuggauguugcuccggcuucuaucccccacauccuguccucccucccggagcccagggaccacccaugugaggcugggccacuggggaaaucucgcacacguagcgcgucucaccagaaauagaagcagagccucacguccuuggcugcuucgcugugggaaugccuucuaaggcgccguuuuuggugaugucccuucacggaucuuucaggcccagugagucagcagugucugcauucacacaggcugggugggguuguuggaucugccccggguggauggcaccugcucccucagggcaaaaauucaccccagaacaugagcugcacccgggguuaggugaaggugacggagccugaacacucaacaccagaggcagccaacaggacggugucugggcuuccaaaaagccaccagugccuaaaaacacuuucaagcaccuaacaucacucuugguuuuguuuuuauuuuaaacuccauuacaaaccgggaaauagcugucacuuuccuguguucugggcccgcugugcuccuccguuccgcauagcgcggacacugcagggugcgggcugcagcuuccccaggggcucugaggaacccguugaagugacugcacgugcuugucuuucuaggguugcagaugagcuucguuuucagggggguuuguauuuuguguuuuuucugaacuugauggugugggucuggacaucucuuuccaacccuggaagauaccacacaugcucuucguuauuaacaugaucacccagaaagcuuuugggggccugagaacauggcccaggcucuggggagcaucagacugcaccugacuggcuggauaaagacagggguaccuggagccuccugccucgccagcucuguguccagcugucaccugagcuacaagggagauuaccugggagccucucaugugucacaucgugacucauucagauacauguuuuauuuaagaagcaaaucuauuuaucaggguguuccuguggccauuucuucaccaaaccuccagcugacuuugcagagaaugccaaacucagaagccgaggaguagcuuaaaacuagguuccccauggggcacauccagccuucuggggagcccacuugguguggggcaccccaaacagcacagccccugggugcucagaggccuuggugaagcuagauuucccaacacucgauuuuuucccuccuuacagaaaagcagggggaacuugagggauaauucacaugaaaccuuugccauaaacccuuuuaaauuguucacaaguaagagcccaacuuuggaagauuaagauccuggcguuuuuagugugaggagugggcuggcugaauaugcugcagauugugagcuuuuuccuaccugguuguaccucacuggaggaaaaauaaggauaaucccuauagcugcuaaggauguacacggugauggcacagccaucaccgcuuucuaaguuuagaaggugugcuucaugcuuuaaauuccccggcacucauuuuguaccacgcugcucucucauucucuccucaugcugucuuccagugccugguucaggccaguccuuguccaagguugaguuaaaucauuuucagcugggccaggucuucaacagcuuggugugugugaugccacuccagggcugagguccuggcuucaggaagaauguggggaucgauuagugaugucugccaugaaugcagaaagagagauaaggguugcgcauuugcauugcauggugggaggaggagugugcacaugagccagggaaucuguugggcgugucaggugauacuuaaaacucaaggauuggguucuccauucugggggagcacauacuaccuauacauuacugagacuguaaaaugaaaucgcagccucugggaagcugggcaaagaaguggacgcagcauugggagagcuucccagaagcaacacagagagaaagcccauuugccaaaugaaaaagcagauaacaacguagaaacaaagcugagauuuccaauagcaguugcuuuuuuuuuuuuuuuuuuuuuuuaaccuuaaaauagugccacucuuagcaacacagauuuucuuccaaauuaugccuugaagcugcucccggagccacccgcucaucagcacccugcuccugugguccuucucgugaaaggcagaggggagaugccuguugcccgcagucuucucugcagcugccgugggaacaggcaccuucccggcugcuggggacacaaggagggggagucaccguggcuugcucacuuuccagaucagccaacugcagaacauuuguuguuguuuagaucccacgucugacgguuuagaacagcuuuuauaacaugguuaaacauguuuacaaagcaagggagacaucucuuaccuugacaacacgaggcucccacagaccgccuucccccacucagagcuccacagcccugugugcugggcuggccuguagacccacugaggcagcuguguuuacaagucuaacgccaagugucugagaggcacuugcguacgucccagcaucagaaucuggcccccagcuuggcccugucacgauuuucaguuuuauguuguagaaacccaagccucugaaauaacacuguuagcaggccuuaguucugauucugugucuggcuuucuagaaaucaggucugcugagcucagccaguggggaucgggucaugcuggauugcagaaagcggccacuuaauuggggagcaggccgcauuuaagaggaagcuuuucugaggguggugggaucggugggauauuaaguggggcuuccuuggaggcaggcggggccucagguucggcuguguugggucacucccugucccgccccggccucuggaguuugugugguuuugucuccucuuucuuccuggaucauugugcaugaggcugggagccacaccggcugcuuaggcuccuccugccucccaggccaccugcaggucacaggggcugaugaagccgugaaucgcuuggcucuguuuggaaugcucguuccccggugccauaaagaaauagcacuugaacauaaauuuaauuuacuuaguaaggccauuuuuacuuucugcagaaaggguacacucuccagcaguuuucccacgagaguucacccaacaaaggacacagggucauuuauaaccugacacguccacccuaccgcuguguccaguuuccguuggcuggaaagggaccucacauucucuauuugucccgauuggcuagcaacuuagaacuuuuuuaaagaggcaaagguagaggggaacaaaggaaggaggaaguaacuuguggaauguugagaaagguaaaaacaccuucaaauaaggaagaggaacaggcuaugaccuaaugcuugcuuggaccaguauaagcaugcuaaggcaaauauuuaggcuaaauugcgggagcuaagaacauaacguacauugauuuccuuauuacggcuagcaaauauuuaagaauguuagcacagaucuuugaauaaauuuugccucuaagagaaguuaguauuuauuccuaauuagacggggaggaaagucuuugaagaggaaccucugcuuuacucuguacagcucggagcugcuugcagcacucugacaccuucugucgggaucuuuggaagaccugccuggaucucccgucuguggaaggauccagguacuucuuacaacaucuguguuagggcagcuggugacggcacccggcaaauuccagcaacugcccucauuccacagaggcucccuccugcaaggccacuacugugacucugagcagcgguucuucucaugaaugugauagcucggucagcucuaagacugcaaccugcagggacuucauggggcaacccugggguauguggccagugucuguccuugggcagccguagccccugucaggaacagggagugacucaggcacuggugucuugagacugcuacggugucaggaaacuuccauaaaaucuagugcguuuuaaaaaaagaggccagagccggccaggcacgguggcuuauugccuguaaucccagcauuuugggagaccgaggcagguggaucaccugaggucagggguucgaagccagccuggccaacaucgcgaaacccugucucugcuaaaaauacaaaauuagccaggcaugguggcacaugccuguagucucagcuauuugggaggcuaaggcaggagaaucacuugaaccugggagguggagguugcagugagcggagaucgugccacugcauuccagccugggcaacaaaagugaaacucugucuccaaaaaaaaaaaagccagagccagccuuugccuccuaugucagaaaugaucauuugcagcugcuuugcuuugggguagaagccucaaauccugaaacccuuuacccuggggcagguugucuugugcuguaagcaacagaaacccauuuagaucauuuuuaaauaaugagaauuucuguuggaaggaugucggcuuagcucacacagugucuaggaagacuggaaaaugggucucagaaacacugcaggcagcuuuguguggcaggaucaauccaguuccuucuuggugacugcucaggggaacaucccauuugccuugcaugguacugagccagaaggucaacuccaggccugucugccuguauccgagaaagcagcagcuccccacaaugaaauguagcguuuuccagcuccggauccuuccgccauccucccugagaucuaccugccuuaggaucugugagauccacgcacuuugcuuuuccugggugucugguuacuguucacaaaaguccagcaguuuggccugguguugucuuuguuuuugacugagcaucucucauuucacaaguauuuauugcagcugcagcucuaagcaauaccaggcccagggaugggcgucagcacugccuugagcuggugcacagcacaucccggacggaggggcagggccguccuggugcacacgcaagccugaaaccagauaguaauugauaccaggggagccggcagggcuuucugcucuacacaguuaaugugggcaagcugucaacaguaaggcacugaugucauuuccgugauguguccaguugcagcuggaauuguccugaaauggacaaggcagguuuacuggcgggagacgguagaaaggaaaaauagcgcauagagggcaccagggcccugugacccucguccgcaagugucuccucauaccucgugguugcgcaccgugguacggggccacccugagcgcugacucccgggcugugaagugggaagaacagcagcacugcaggacucuugucagccuuguggucuguacgcauggaaaaggccgucagcugugcauagcaacuggaagccauggcuuuuuagcauaaagcccaguucuucggaagcccucauuacguacugcgccuugggcuuucuccucgcaaauucccaauccugccccacugggccuggggaccccacgucccugaaagggucguguuccaucuuaauguauaugaaucuuacucugugugucaguuacauccuaauagguuaaaaacuugcucaaauggucagaagccugaaagaggcgucaggaauccugugugagguaagaugggggaucuguuugcaccuucaucucuccauaugagaucuuccauaugagcucuuccagaaaccucugccccaggcuccagcaagccuguagggcagcggcugcuaggcaagggcuugaauuucaguccagauucucugguguguggguggacaguuuccuucugggacugaaggagcacuuggaagauggugcuuucccuucuagagcaaaccuuggcauugucccagcuaagcucucaugcccagggcuugggggucuccuguggccuccauaucccugcaccucaugcagggcacgcaagcaucccacccacucccaaccccccaccuccagccgucgugcccggcaucuuuucccagcaugagaacccguuggcuuuucucuuuucccgccuugccaugaaggaccugcugccaggauucgagccucagaccuuggacaggucucgggccagccucagccacguucugcgugcccggccaucagggaggguagaggguggguuucaccaaggagaaaggcaacccgugucggggagggagccgaucgcuaggcaaccuggaguuuguuacccugguaacggauccaugcacugaugaugcugcggauggacaucuugugacaauggccucucaggcuccccagacgcaucagcggcucuggauucccaccuugcgcccagcgugguuuuccuguguggcuaccauuuaacgaacagcuuggauuucuuauaaucaggcacucucuccgauaaccauccugccagcaccccugaaagugaaguugggguguuccucacugugugugggcgaccgccuggggcaugagaccaggacuuccaggccccacaggguugugcgcucagaccucaaguaggggccagaagaguguacugaaacagaaggaaucuuguggaauuuggcaguuguaccauuuucuuagcagaaaacaggagcccaggugggagccaugugugucggguuccucgucaggugacggugcuguugcggaucucgcggaugagcugaggggguauccagcuuugugcugcacgcuuccuguccacucauacaggucgugggcuggugaggacacggggguguuggcccucgucccugccuuauuuucccccuccccugcccuguuuuccuggugcagaaggauguuggagugcggauccaugcggacacccuguuuggggaccugggugucggggcagcagcaggagugacugggugcacgugugccuuuggugucugagcgucaggugcagcugccgcucagggcugagaggggccaugauuucucccagccggggguggcaggagaacugcacuuagcuugggggccaugcggggcuggcuguggaccuggcuaccccagcccauucuucugaggcugggacaaaagccuuuuuuguacuuugugcucaaagagacaauuaucccaagucccacuggccgagcacggccuuccaugcagggcuggugcaggugcucugggccgucccuccccagcaccguguauagucuuaacaggaugcagucacggccccaguggagggggauuuccuuccucgucuccgagcguguggcuaacggaauaugagccuuggugguccagcaggagcccccccguggcuggggucccagucaucguccccaccaaguggccagcuuggggacuacuaagagcccuugaggagguuagggauggaaggcgaggccacacagaugaaguuggccuuuguggaaggcuccugcuuuugccugugggacccugagccugcugccuugugcucaaaggccagugaucccgggaaugucacaccuuccugguuggguuacccauggugggucaccaggcugggcucagccuggagcaauggccuggaccguccagccucagagggagggaggggauggggauguaaggccgccgucaggguugaucuggauaucugaaaaguugaugagccccaaaguuuuaaucugaggcuaaagaguucuaauuugacaagagacauugccccuuccuggcaucucggcggauugcaccucuggaacucagguaguuguucucuuguguccagggugugggucuugaagaugugagguuugggcagauggucaggaggaccuacgaaauccaaggauggauuugaagggggcaguuuuuguuggagaaaaugcugcuucucugucucugaggucuucggagccugcuggguuugcugcacagaauaaagagagaaaagaggcccugaggcucucgcugcauccugggcgggccccgcagggugucugcccuguaugugcacggggcgcaagcaugcgcgucuguaguguggcagguaaggccuuccaccacccugcugaacgucuagaugcagccgcgcugguccagaugaaguugcuagagaauuuguacuuggacuugugggaaggaccacuggggcccuuccuggggucaccccugccccucuguccucacagcugucccuucaccuuguuggcagcaccaggaaaucugucaggauuaauaugauggcucuggccugucuagagagcugcuugcugugugguccuuugagaaguuugcucuccugagccccuagaggccuccugcccucaggcauaccuucccugccccagacccgccauuucuccucacccagcgcaggugagaggggcuggaggagccugcccaggccgccuguuugugcagggccuguccaggaaguuccuuuggacgcacacgccuuauccccugucauagugugugaggggcagcuggugccggugcaggcagggaggcacgcggugcagggacccguccugugcuggacuagccugugcuggccucggggccccaugguccugaggcucucgggacuauggucugcuggcagggaagcagccgugugcgucuccagccagagccgcaaguggaugggaaguggcuccucuucgugucaguggcucccuggaaggugaugcagguggaggcggugcccucgcugcuccgccacccucgcuugcccaagcccugcccugagugaugaguggggagcugccccuccacgcacccuguggccccagccacccacccacugugcucaccccuucccuccuggcagguauccgcccccagaucaugaacggcccccugcacccccgcccccugguggcgcugcuggacggccgcgacugcacuguggagaugcccauccugaaggaccuggccacuguggccuucugugacgcgcagucgacgcaggaaauccacgagaaggugggcccacccugcccggccggggccugcacugaccuugggcaguuuccuccccagcauccccccauuagaucgccccaagucaccggcaggccccagaaccccuguucccugcuuuccugcugaacuccucugccucagguucaagggugauagggccagggggccaggccaaguggugccggugggcugcacgggguggggcuccgacccugugcucuguucccacgcagguucuaaacgaagccgugggcgccaugauguaccacaccaucacccucaccagggaggaccuggagaaguucaaggcccugagagugaucgugcggauaggcaguggcuaugacaacguggacaucaaggcugccggcgagcucggugagugcgaggcagcgcuggcugccuggaguuguccggagcucugugggcccugcucgggugggcuuggagaagcagcuggaacugggaccacggagcagccgcuucuggcuguagcaagguggcugccuccaggccgggcuguggagcaccuugcggcccugccuucacaugacacagguaggauagucccugcuggcccuuguguggggucugcggggcugugaggcaucucugcccucagagcaacacccagcuggcacaggcucaauuuggagacacccagugccgccuccagaggggagaaugcgacuggccacauguccucuaaaccaccccugcugggugcguccccuaaaugaccccugccguguguguccccuaaacugccccugccgugugcacagcucuaggccccuguccacaugggaaccugggccucccguucugggagggcagccuuagcagcaugugguccaggucagcaccaaagcaggugggccccugcccaacacaguugaugacagaggcuuccgaagaaaagcagaggcagcaggcgggaacccagaguugggggcuucaaagcugcuuaucggccccaugcacuugcggcugggggugcauguugaggggggccucugcccagcaccccgugugagcucgugagugcugagugcagaggcacaagaagcagaccgcuggcaucgagcguccucgggagagggccaggugggcacugugcuugcucuguguuuggaacacgccaccccugcauuuugggggugggggcuguacucugccuuacgagugcugaggugccccaaauucaugaggcaccaugaauuccaaggcagcagccuggccuuggaacagcucuuccugugcuccaggaauagcccaggcgcuauuuccccaccucucucccaucggcuaaggccccagugggccccggugcuuccgggacgggcugggugucagaugggcucugugugugagcggaguguuacauacaucugagaauccugcucucgggcaccaccggccacguuuucagggaggccacccccaugggcuccagcugucucuccacagccuuagccuggggcauggaguguaugggucagaaucuuaguugaauccuucacggccagucggggcagcacccagguaccggaagcacugggugggucuuggugucaggagcagggcuggggagccgggcgagcagggagcugcccguacacucacaggggucaggacgcagugggguggggcugccccacgggcaaaucccaaagcaaaaggccagggaaggagagagagucacucagauuccacaccccuuaggguccuggaagcagcagcuucacacauccaccccucacccuccccacaccccucacuugcuaccagccacggcguccuuccgagccccucuguuggaacaaagacacuccagaagaugugagucuucaaaggcguguuuaauauaaacuaaaauuuuccaucuuucccuggcacaaacaaggauauuuuuguuugaaaacaaauguccuuugugcucuggguagagcugaaaucccaaguuucaacagcagaggagaauacagcuucaugugccaggggcucucaaauccuugucccccgcaccucuugcuucuccagcacgucggccccucaccacacagcucccaggcccauacgggugcugacccugcccuuccucggcuggaccagacgcugcuuuccagggagagaggggagguccuugccuguggaacuuccuauuucuccauuucuagaagugccccgcacaggcaguggggccagaaaggcaccaaggccucaaugacagggggccugggagggccgagaugggagguuguguucccugaguucugagacccacagaagacgaccaggaccagggacugcgguuuuggaaaauguagaagggcugugagugguggauuuucauugauccuggucccaucugauaagggcgcuuggaagacaucugcggggcccuuuuaaagggcacuuuucgaauguagacucuggaggcggaaaaugagccucuguccagacguccuuugucuccgaaugcauauuccccacaucaugcggucaacgggccuuuugugcugagggcugggagcggcagguggcugcaggcaggcccucuccugaugaaagagggucccucgcaggcccagaaaacaaggcccuccauguugcacgaggcagcacacuaggccucuggugacaccuucugggaucgcaaggcucugagcugucagcccuggaaugacaggcgagagucagcgcuucacggcaagagcagggcaaggcuugaggaagcugcucaccugcacuucuccccacgagccgggaagaccucgagagggcccuacaccccuccccacccccgccgccucuagcaagcugguuuaugugguuuccuugccagcggcagucaugaagggauuaaagcacgauggcacugaccgugagagaaaagcagcuugccucuuuggggccguuuuccaggcuccguggaugcugggaggcccagccugcgaguaucagagccacccaucguguggcacuugaaggaucagcuugacucauccagaagggaggcugcauccacagagcgauagaggacagcuaagaagaugcucccuccgagagagcggugaggguuauggagguuccuggcaguggcgccgccgcggucugggugggaagguucugccaucccaggcaguggcugcagcucuuccuccugcaccaucuccccguccugggacucugcacuccggugagcaguggaaccacggagcugaauguccaaguucggugagaagacugaccagauguccugccucaaccugccuuuuugugccacccacccacccgggugccuuuacacacguggccuuguggggucucccagccagcaucagcucaucuccuaggaggaggugcugcuguugacgccaggcagcacugccgagccagccccggcagcagcacggagccagcguccuugagggugauucugcugcggggccucccugcugggcuuuagccugcccgaggaaugaaaauugucccagccgccaaagauuuucuugaaccucuggcaucagccucagucugucugacuuaauaauaacauggcaugugaucaagccccagcuucucugcugagcuauuucaaaugaaugaggccaguuuccugcaagauuccuggcauccagcucgugggaaaguuggucggccucagucaccgucaaccacacuggucccuuggcaggggucgguggcccagaggagcccucaguggccacguugggugggugggugaccugcucacaguggcuucaccuucucugagcugugugucuugcuaagcgggucacucucaaggcccuagaccuagggguggcccuuguggggagacagccacgcagccaucuagaaaguggguuuguggcacccacuggucuuguuuccuguccaguagagccgaagaagcugccuuggugauugccguccccaccccaaucuguccccaccccaaucuucaggacuuaagauagaggaauccugggcugccuuaaagguggcccugucccagugccuugggcaccccuugcugggagagacacucuccuaagggucccaaagcugggauuaggagggaaccauuucacuugggcugacgugaugcccagauagccacaccccuccucagagagcucaacugggagccacaggcuggcugcugagcccacccucuggggccccgccccuggcucggccccucuggucucugcugcaagcaggccucuggaucuccaccugucggguguagggaggggccguucccagccuggcccucugccuacuugcaccccuguuguaucuggcagucauucauucuuccccagacacccucuggcugaggaggguaaauggcagggcccuuucugccuaugacuuggguuaacucuccaugccacagcugcuuugugcugggagauacuugacccuggucucugcagcucguguggggccagagggcucaccccaagccacccucggcccugaccugaaggcugcuccacggggcagggagggcauccugucugcucugaguucuucccagcagagcagggugcugagcacaugaccacagggcgauugugcacacgcuucggccaucgguuccguucccggggccagcccuugcauccguguggggguggagguguuuuuuuaaaaccaguauguuuaaaacguauguuuuuugcaucaaacuguuagcauagcuuaaaaccaaaagccauucuuugucacccugccagcuccaugagggagacccugagggguuugaggcugagugggguccacuuggaggagucuggucugaggcccacuggcuuccugccacuccggguccuuucuugggacucagugcaagcccaggaggaagccagucaggcccaaaaucagccauaggaguuggguuggucaugagccacguccuggagcaaaaguccuccuugggagggagggguagauguuggggcuagagcuucccaugcaucagagccagagggccuaccgcccacgugcccagccccgcgucugcuagacgauaaggugggccucccccggugccaacaaccgagucucaggagggcgggcugggagcccuggggcuuccccacugaucuugagguuuucucaucuccggccuuggccucaucccuuucaggaauugccgugugcaacaucccgucugcagccguggaagagacagcggacucuaccaucugccacauccucaaccuguaccggaggaacacguggcuguaccaggcacugcgggaaggcacgcggguucagagcguggagcagauccgcgagguggccucgggagcggcccgcauccguggggagacgcugggccucauuggcuuugguacgugccacccucugcgcugacccccaaccccuccgacacuggggcugguguaguggggaccccucgggaaaggcaaccccagccugcucuugaggagccagggcaggcagggccagcacccuccccguguugcacgggguaggagaucggagucaagacccaucaggcaacucacccuagaggcaggaucugggcugguucuggaagaaugcguguccacugcugucuguagugucuggcaggacagcauucuuugcuguggggcagcgggcaaggcgcugugcccaguaaauuucccugggcaggggugaagggcaggggcuguauggaggugugucguaaagcagcagccaggcuuggggcucguguaggggcuggcguaggguucaguggagacgcggguuauggacauggccucacuccugaaggccuucaaaugccagguugggguggcacagucaggccaucagcuuggaaagcucuccugagagaggggcaggaaaaggagacgugaggagaggcccaggagggucuucagcagggugguaggggccggugccacggagaaggugaugguaagcagccugauuccaugggggcucgaggagguccccacccugcucaccaucaggguccacaccacacccaggagaccucggcccauugccacugaaucucaaccccaccgcuuaccagcucuguggccuugugggaauuaccugagcuuuuugccucaauuucccaaucuguaaguagauauuuggugggauacgugguaucugccuuuugggacuccaagaaggcgcaugugcacacggggccaguaauguucuggccuccgggagacucccagcugcugcucagcccuugcuuggagcuccgcgccuccgaggacgaagcccccgugcuccucuccccacaagccccgcucuggaccuggggugccacuugaacaagagagaaguugcuggacgcuuccaggagugcacaccuuucuguccccgcuacaggcugugaucuccugggucuggccucgcccgacgccuggagucugaguugaagugucgggugcuggggaucuucugaaaggacccaccguguuuugacuuuguuggaaaacagauguggugugugaacaccaggcucccucuguccgggccccacugggccucauggcucggagaugcagcuucaucuccaucucugaagccccuccuggggccucgguggucucuggccaggcugcagagccuggggguggucaugagcacccuggguacacgguggggccucacuggggaggugcuuguuucaggggcuucugacuccagccgucacgggacuucuuccuggggucguuccuguagcugugcccuugucauucaacuuuaaaaacccucucgguguauagaggucagugcagcccccugccgccgcccuguuuucucgagacuguacacuaaccccugccgccaccacccuggauccucagcacagggacugucgugcucuccuuguucccuuuccaggugucucuguagccuucaggacugucgcugcugcagccauccugggcuaagagcuuuugcuggccucggguucuacugagcaagagucccccaggcccagcgggcucagugcagcaggcggggugggacggugccgccaagagagggcagccuggggcugggggcauggacagaaacugaaggaaaggcagccugugggagcugcgcuuuuaaaauaagcggcauggggggccggggggggcgcugugacgggggagcaggucucuucuguagggacuggguuuugauuaagucaguagcaggauuaagucauugggucaucagaaaaucucauggauaaaguucaagggguuugugaacuuuaaaaaaaaaaaaaaaaaaaacaaagaaauagccgucggcacgguucaaaucugggcuuggugcucugggcugcuuuuccacaggcccuccaggcccuggaucugcagagugugagccccacugauugaagcauguucgugcacagacgccaugagggggauggaggcugcaggaacgggggaaggcaggcggggguccugugaagugugagcucccagcaguugcaugcugggguccucaguuucauguugccagugcgucagagagccaucucucacuccgucccugccaccguccaguccugccugcuguaaagggugacacugaggaggagaggcgugaugguucgugccuugcuauacuaguuguccugcagcugucccugaucagacuggccuuauucaaccuuuguucuaaacuacggcaguuguccuagccaggccaucgguuagauggagcugcugcaggaggagccauccagcauugagguaccccuggaacacaggcugccugcucggaaaugcgcaucuuuguccuucuccugccugcaccuuggagccauggcuuuaaagauuccuucugugaucuccaagagaaccagucgagcaucaacacuaaccauuuuguuuucaaaaugcugaaaacugcucugggaagcuggaggugcuaucgagggggaccccauggguuuaugaaaugacagccguuggggagugggagacaccuccucauccugugacauagcuggcgggaggcccaggcugcauaaugcagaugggcgcgaggccccaccagugggacagguccaggucugauggucaugugcccugccucccgcccagaacacaguagcauguggccagucugcacucgggccagccugcagggagccauugugcucaugucacccuuugcaggagcgagcccagcaaugaggaggcaggacauuacucccugugacauugagagcaaguuuuucaaacacaaagcucauguuaagaagccugcagugcacacaagaaguggggagaggggugggaacggaggacacggguggugaugggaggggcaugugggcuugucagaacacucuguguuugaaaaugucaauaacaaggaaggguuuuguuuuguuuuuaacaaaaauccugcuguacccaauauaagcagcaagcacugcgguccucaccuguccuacaccggccaugguggccccucgcgggcagugcucgccucaggccucacuaagcuuugggcacacgguuucucuggcagcagcuaccagcggggaugccaagcccggacucagcucagaagcaauggagguggcagcgcuggggcgcgggcuguggacucacucaccuggacgcucuguuucuguacaggucgcacggggcaggcgguugcaguucgagccaaggccuuuggauucagcgucauauuuuaugaccccuacuugcaggaugggaucgagcggucccugggcgugcagagggucuacacccugcaggauuugcuguaucagagcgacugcgucuccuugcacugcaaucucaacgaacauaaccaccaccucaucaaugacuuuaccauaaagcagguaauuugaaaauagaugccauggaagcuucugucgaaaggugguagcacuugcuugugggcacaagagggacacggagggcaacggaggugguuucuggauacacuguugagcagggaagaggcccugcaacaaaccagugacaagccacgugaagccccuuccucgggcugagccaggcuaagcagagaaggacaggcgcuagccaggacccagcuucagaagcuucccagaaccuuuaaagaggccagcagcucggcacaguccagccuuuccaccguguugcuuccucucaggaucagcagcaacggcccuggcuuccagccgucaccaacacuucccacucccuucccucaaacugcagcacacacauuaaaccaccagaccaacaaaacuagcuugcagcuuucuucuuuaaaccuugguacaagagucuuccaccaugccagugugccuguaaccggcuuuucuuuccuuccacagaugaggcagggagcauuccuugugaacgcagcccguggcggccugguggacgagaaagccuuagcacaagcccucaaggagggcaggauacgaggggcagcccucgacgugcaugagucagagcccuucaggugcguguugccccagccgccuaccaggagcccacagggcccagcuccacaccugacccccacacuuugaacucgaggcccuuuucccaaacaggucccugggcaggaaacuccagagaugacauuuacagucucuguucuucuaaggauugugcuguauucuaauuguaaaagggcuggaaguuucccagaggucaucagggaaaggagaggcagaaaauugguggggguguggcagugguucuggucuucagacagacaggcaucaucucugcccuggauuacagcaggacaagccuucaauagaauugggcuuuuugaucuaccaauuauacgguucuuacacaacuuugauaauuacauucaaaaauucccagccuucauaaaauaucaucacagauguuccuguauccaugcuaucuauguagcuacuuuucuacauggccaagagcucccuugugcugaggagggcagggagcguaugcgacauuucccgcuuacucuguuuuuucuacauuuuucuagcuuugcucaggguccguugaaagaugccccgaaucucaucugcacuccucacacugccugguacagugagcaggcgucacuggagaugagggaggcagcugccaccgagauccgccgagccaucacaggugagccccuccgugccucuggccugccaagggcagccucagcuccacagugcagccggcuccuguccugcuggcuacaggcagcucucgacagguagaauucacuuuuagcaucaaauuuauaugaguugggcccuguuuauuuacguaagcccugaacuaaacuucacagagggaaccauucccuuuagucccagacauuauaaacucgggggucggggggcacacagaggcugaaggucaguguugaagagcucaagcacuugggccuuuggauguucuacauuuuuacaaaugcuuauuuccccacauaagcagcuacagguguaauguugaacuuacugugauuuguaaaaauaauaugauuaauuuuaaucaucuuacccuaggucgcaucccagaaagcuuaagaaauugugugaacaaggaauucuuugucacaucagcgccuuggucaguaauagaccagcaagcaauucauccugagcucaauggugccacauacaggugagaaaaggaacugacuuugucucagcuugugagcaccacggccccggggccagggagagaagcccaaacuuggcggaagcuuaaccucccgcagaugcuaagucagggucagaacaaucagccuucucagcaggaacuguguacaccgcccccauuucuuccaaugccuaauuucauggaacaaacagaagcuccuauuuuaaaaggggguguguucggucagaugugauugaccacaggugcuaggaacugccuuucauucuaaagccaucuuaaaaccagaaggcuucccagucacgugugguggcgcacaccugcagucucagcugcuagggaggcugaggugggagaggugcuugaagcugggagguggagauugcagugagccgagaucacccacugcacuccagccuaggccacagagugagacaaugcugcuaccccccgaccccaccccaccaccaaaaaaaaaaaaaaaaaaagggcuucucaaagagaaagguauacguagauaagauguucaagugcaaaggccugugagcaaguucauuuuccaauuugaaucuuauguccacagaaggcauucugguacagucaacucaggauaguacaaucaacucaggaugaugaccuuguccacacacuaaaaaugauaccuguaguuugggucagcugagaaacuggagccauguuugggaacgcagagugggggaaagacaggagcccucacagggagaagggguuccuuuugugguauuuuccaugcacgaaucgguuuucucccacacccccccccccauuauugcuggcuucccaggaaaaucaguagcccccucaugcauaaaugaaugaaguugcagccuugaaucuuaagaaaaauuuuugcauauucuaaaccaggguuucuagcucuuggcaauaaguauauuuggggccagaucauucucuucauucucucguaggaggccuggccuguccugugcauuguaggacguucagcggcaucccuggccucuacccacgggaugccaguagcaccucccacucccacucaugaugauugagaaugucuccagccacauguccccugcuguagccacagugacgaccagggugcauucaguuuguguaaugaaggcucugacacucuugaagaagcuaugccggugcuugcaggucacauggcugucuucacauuucauccagccccguccuuuuggcccucaaaaguauuuugagccuaucacagcaccagauuccccuguuggguggagcugggggcccaccucuuccaugucuccauuguuauuuauccuucacguaagcuggggcucuuaggcccccuagaacaguaugugugcacugaggaagggacccuaaugaccagaguccuucugaaggucuuggugacaggauggcaggccaggagcugggggugggguggcuaccauagugagaugccuccuccucuaccuggauggaugauaagucugugugaauacacugagucccacuuugcccgaggacccuguguucugugguuggcgaaugcaguguguccucacacagcacuucgugcuugcaauauaaaaccagcccgagccugggcguuccgaggaaggcgggcccccagccaacagccagcaagcauaccacuucccaucucaggccaugggaguauauagccaaccagccuagaaagcuuagugaguucuggcugccauaauugaguagcauagacuggguggcuuguaaagaaaugccuugcucgcaguucuggaggcuggaagucugagaugaggcugccagcauggucagguucuggugacggccaggcagcagaccgucagcuucuucccacauccucauauggcagagagagggccagagcacugacuagacucccuuguguaaaggcacugaucccauucaugacccagucauuuccucacccagucacuucccaagggcucuaccucuuaaggucaucaccuuuaaggugugggauuugaacuggaauuagggggauggagggagacaaacauugagucccuaaggguccauuguacucuguugggaaaucauuuuaucagucagaaguaacuggugaacaguugggaguccauuuuguacaaaguggguuuuuuuaaauaguauaauguauccacauucauaaauaguaugggcuaauaucuucuuaucuaaaagcuacaaaauuaguggccccguguuuggauuggacuaguuuuguuuuuaugaauuaguugccaguguuuuauauaaaaauugagacuucuccuugcuuuggggauagggaagauaaacuaucccauaaaaaucguuagccagggccgggcaugguggcucacgccuguaaucccagcacuuugggaggcugaggcgggcggaucacgaggucgggagauugagaccauccuggccaacguggugaaaccccgucucuacuaaaaauauaaaaauuagccgggugugguagcgcacaccuguagucccagcuacuugggaggcugaggcaggagaaucacuuuaacccaggaggcagagguugcagugggcugagauugcucacgccacugcacuccagacuggcgacagagugagacuccaucucaaaaaaaaaaaaaaaaacuauuagccaggccuggugucucucgccuguacucccaggacucugggaggccuaugauggggcaucacuugagcucaagaguuugagaccagccugggcagucuggcaaaaccgcaucucuacaaaaaaauacaaaaacuagcuaggcgugguggcucaugccuguggucgccacuacuugggugucugaggugggaucacuugagcccagaaggucggucaaggugagccauguucaugucacugggcuccugucucuuaugaaaaggccagaaguagaagagccaagagcuuggcaacucugcccugaacuuacaaggcccuauuucuguguguuccuuagauauccgccaggcaucguggguguggcuccaggaggacuuccugcagccauggaagggaucaucccuggaggcaucccagugacucacaaccucccgacaguggcacauccuucccaagcgcccucucccaaccagcccacaaaacacggggacaaucgagagcaccccaacgagcaauagcagagaaugccagaagguaaucacucagauacacuugggaccaagagacagugaaaaauagaugaacuaagagaaaaagaaucggauggucuuuguaacugauucuggacauaugcaucauugauguugcaguguugaaacuacaagagcuagaaaacugaagaugucgucugcuuacggaagcgcugaaagacuaggaugugauuuauuaacgaccaacuucuguuauuguguguuaaguuuuucaucugugcaucaaaucacaaaaagaauaaauagagcuuuuuccuuuaucagucccuugggcacagcagguccugaacacccugcucuacaauguugcaucaagaguucaaacaacaaaauaaaaaauauuaagaggaaauccccauccugugacuugagucccuuaagucuacaggggcuggugaccucuuuuugcuaauaggaaaaucacauuacuacaaaauggggagaaaacuguuugccugugguagacaccugcacgcauaggauugaagacaguacaggcugcuguacagagaagcgccucucacaucugaacugcauacugagcgggcaagucgguuguaaguucaguaaaacccucugaugaugcaaaaaaaaaaaaaaaaguauuaaguuucacaagcuguuuguacucaaauauauuuucucaguuucagauccucugcuauuuuauugaguggaaagucuugagcuaaaaggguucaagaagaauaauguugcauuuccuuaugucucaggaaacacuuuuuaugguaacuugucagauugucuaugaacaaacccacuuuuuuagacauugauaaagucuucuuuucuucacgugauauuuuauacaagaacacuucagauguauuagaugugacugauuuuaacaaauccuauuagauuuguaucaacuaguuacauguucuauucauagucuuuugugaaucauugccuuuuuguuuaaaaagauggccuauuuugagccuuuguauagguacauuccuguuuuugugacaaaagaaaaacuuuaaaauugucccaaacagaaaaauaauggcuaucagaaguauguuuuguuuuagugugaguuaccguuacuguauuuguuuauuguaaagguggacauuuagcguucagugcaguuuucaauaaaaaguaauuaaaauuuguuaaguucugaaauucaaguacaucucacuaauguaaauguucucuacuugagauguuuaaggcaauugcauugucaauuagccaauuuccagcucuuguuacuacaggguuccauaaccagacucaagaccgcugacaauuaauuaccugugauaacaaaaaguuuaauugaaaaaucaaaaccucacacaaguccaucauuaucacgucaugccauccuuaagaugcaaugguggguuagugcuaaaucaauucaaaaaaaaacaaaguugcucaacuuuuagaguucugacuuuaaucuaccccaaagcaaaaugaccuggaccugguucaagggagggaagugaaccuugaaacuguuuugccaauaaccuaacaaacaaaaugauauuuacaaagaaguguugcaaauagucccaugaguuaagagcuugauuuaauggaucuucuuuuuaaauagaauuaaaccuuuauacuaaaagua

SEQ ID NO: 191809 - RNA, 30161 nt, Homo sapiens
uaaaggugauagucaucuuuaauaguauuuuuucuuuagcuaagguacuagcaaagcaaauuguuugacucuuaaacugaucucuucuuaugaacaauuuacuggauuuuuuugauagccccuuuaucagaguaauuaguaucuuaccccagagaacuuacuagaaacuuguuucaaguauacugacuuuaauuuuagcaaauuuuggcuuauaauugacgauaaaauuuucauccuaaucauuacaaaauauucuuuauuacuuuuaaauuaaaaauuagaaaaaaugaaaacaagguaucucaaacucugaaagacacugagacuucagaaaauccuaacauuugagaucucaaacgaaacuaacaaauauugacuaauuuaccauuacuaggugccgagauguuuuaucccuccaggagacuaugagccuccuaaauaucccugacuuauuaugacagagcaauuccaacagucaugaagguucccuggaaaucacuuagaguugaucuugauugaauuaguccagccuucagagaaaccagggcugucacuugcccccgugaaccaccuguaaggaaaaucauuguuagugccauacgcaguuucuguauuagcuguuaugauuggaacucucaguauguguuguaaaggugagaccaccaagauccugguugauuugaacaaaacuauaaagaaacauggcacuaucaggugagaacccuuucucugugugacauaugagcauauguuaucauucaccaguacagugcuuugagaagugacagugcuaguauuucagcagaugacacaaaggucucauaguuauugaagccacaaugaaagcagacaaccuuuaaauccauuuaucaaagcacuugcaguuuccaucucaaggcaagugaaacaauaauaaauaucgugcaaagaaaaugagucuguggcagugcauuucauggaguaaaguacugcgcagcauauucucuucaggaucagugagccuacugaaucaugacuuaucugacgcuaaugaugcugucuuuccauuuaaagguguacaacccgagaauaagagcaaacucgcucgucaugcagcccaucagccagagccaggcagagauacgcaagcagauucuuggcucaucuucuucagguagugcuguggacacaaauacuaaauguugucaauucuuguaugcaggcaacccagaaauauuaaagccauuuuucuuggugucuuuuaggaaaauuuuucugccuguacacugaagaauuugccuccaaagacaugacgccacugaagccagcagaaaugcaggaagccaaccuaacaagcauggugcuuuuuaugaagaggauagacauugcgggccuaggccacugugacuucaugaacagaccagguagccuuaugcucccaugucagccaggcauuaggcugagauucaccuucuccugcccauucucuguccugaguucacaugaugcgcagcaaugcacacaagcauggagggggcguugguuuggacugaagcauuuuccugcuagagguaaacauucucugaagguaauuuuuaaaaccccacaaaccucuaggaaauaacuguucugacacgagaaaugugucugcuguuggacacugcagcacaggggaacugggcuuaaggagcuggguaauguggaguauggaagcguaagggugaaucagcagaaagaagaauucucagcagcuugaauuguccuuuuuucuuuucuuuuuuuuuuuuuuuuuuuuugagacagggucuugcucuguugcucaaacuggaguacaguggcgugaucauagcucacugcaaccuccaccucacaggcucaagugauccucccaccacagcuucccaaauagcugggaccacaggugcaagccaccacacuuauuaauguagauuuccuuuguagauguagauuucuuuuacaaagugacagcuuuucagagcuaguccuaugucugcaguuucucagaauaaccagcucaaaauaugccagagaaguauauuuugggguggcauauucuagucuccuccagucauauuuuggggugguguguccugagccccaacaagauagguuucauuuuugaaaauugcucuuccagucccacuguucaucucauaagcccaggaaucaccaccuguugauuuccuaggcaucuucuugcucaggguaguagauguuugguggacuagaaaugcagggagaagaaaaggaaggcuuggugaugucaaggauuuuuaaaagcaaacuaucucacuguguucucucaauagucacccucugugcugcucauuccaugaggcuuaaagcugauaacugggggacaaaaggguuaggguaacaauuuauuuuugucuccugacaauacacacauaacuuuucugcugugcuuggggaaaauauaacuguggauuaauucugacucauuguuuuggaagcaaaaaaagaaaaagaugcucgcagcugcugcauuuaauucaacuuauaauugaaauaugcaaauccagcaaacuaguuacccuuuucaggaugcaugaaccaugugaaaaugaauuuggcauaacuaggcuacaggcuguuaauugaauuccccugaucuggaccucuuuuuaaaaaaucaguuguauuuuucuuccuuggcugccugacaauugaccuccauccugaaugacacagucacuguccauugggguaggaggccucaggaccagcugaccacuucaguggaaacagauggccugagacugccgcuacccugggaaggcagugguaccuagauagaaauuuggagaaaaacuagccaaaagguaccagacuacaccagaggucaucuuuguauucagaggcagaacucauuuugguaguagccagaugacuggcuuugguaugaucuaugauucuuuggauuaugaaaagaaaagugaacccaaacacaaacaggcauggcacguuagauaaggcaacgccucaugaaaacaggggaaaaugcaggaagaaaauaaaguugcugggcacaguggcucacgccucuaaucccagcauuuugggaggccgagguggguggaucaccucaggucaggaguucaagaccagccugaccaacguggugaaaucucgucucuacuaaaaacaaaauuagccgggcaugguagugcaugccuguaaucccagcuacuugggaggcugaggcaggagaaucacuugaacucaggagguggagguugcggugaaccaagauugcgccauugcacugcagccugggcaacaagagcaaaacucugucucaaaaaaaaaaaaaaaaaaaagaaagaaagaaaagaaagucaaaggcugcagaggccagggauggcucuggugaaaagaggaauuaaagauucugcagggcugggcaugguggcucacaccuguaauccuggcaccuugggaggcugaggugggagaacugcuugagggccaggaauucaagaccagccugggcaauauaacaagaccccaucucuacaaauuuuuuuuuuuuuuuuuuuuaaugagccaggugugguggcauacgccuguaguacuagcuguuugggaagcugagucaggaggaucacuugaguccaggguucaagguugcagugagcuaugaucgugcuacuguacuucagacagggugacagagcaagacccugguucaaaagagaaacaaaagauucuacaguggugucaucuguugugauggugcagaucuuucaccagaggauuccuaaaccaauucaucaagaccuucuggaauaguauuuaccacacuaaaagcccaguuuguaagaauacuagagaaguauaugcgcuuguuuguaaaucacuuggaaacucaagauuuggcuuuggaauuuacaaaaugaucuuuaaauguuaacguaacauuuacuauacuauauauaacauuuacauguacuaagaggagaaugggaggaagcaggcugccaacggcccucacauguggcccuccccauagcucugccgcagugccugacaccuaccggcaggacuggcacugcccaaacagcccagagagucgagcaaauauucuagcaugacugucaggaggccacagccuagguuuuuaaguuaaugaagguuacacuauuaucuguuuaaaggcuacacaaaaguuacuacuauacucagaugagggggugugaaaaagagacgcaaacaugccaaaacaacuuuccagggccagugugugaggaucuuggaaacaauaaaguaaauaauguuacagaaagugaaaacaaaauccaggagagguuuuaaagggcccagaauggaaguacuuuuggcuccugaagcccuuuaggcucuugugggccugggaacuauauggcuuaucauuuaaguugauauguuuuugcgugcaacagugcaggcggaaagauggcuguggcucagcaggagugaccccucccugcuaacaaaacaaaacaaaacagcaauuuaacuuaauggaaccuguuuauuuugcgaugaauucagacaaacugaccaugucccugugaacuucaugggacaggggcaugaaugcuauuaaugauuaagcugggaugaaagguggaaacagauacugcccuggguaaacugggguagaugguccccauauugaggggacuaugccaaaaggcacaggcucuugggccaggcugccagggcuccaagccuggccccaucauuugcuagugggguauuauucaguaaauuaggacucucauugcuucacuucauuuaucugaauaugaggauaaucaaagcaauugguucauagaguuauuaagauaaauuaguuaacauaugcaugccccuuagaaaagugacugguguauaguaaaugcuauagcacagucaucgucugagugacuccuaccugagcucugcaccacaggggcccugagcugcagaggguccuagaaagagcaguuuuaaugggugugagaagcagauaaugacccucaguuauuaggagacaucaccagauugccucugagaugggccggagccaggaagagccauggcagauaacagcaacagcacuggacuugggaguccagcaucagcugugcuggcagagcaugccaggugccagguucaacacugccgguggaaggcccaaguucaaaaccucacuuuacauaugacaaaacagcuggguggccauguggcuuuggcaagccacuugucuuuuucucaucuguaaaauuaggguagagugucugcccucuuguauccugggguuauuuagagguacaaaugagauguuuaugcaaaauugccauguacaguguaaaggaguaggaguuaggcaaaugccagguuuugggaacaugucccugugaaauuaagugaagcagaagccuuuccucccuguccucuucagagccaacucuuaaugcuauuccccagaggcccuagacauuguagagucuuagggucuacaccaucucuucauucuucaguuucucccccuguggacucuuuuacacaaugcccaagucccaacccuaaaauaaaucagaaacagaagcuucauuugcuccuucagcccuccuaagugauaacugcauuuuucucuguccauuuauguaaauguguauauacauuaaugcagggguccccaaccccuaggcagugauggguaccaguucguggccuguuaggaacugggccggacagcaggaggugaguggggggcaagcgagcauuacugccugagcuccaccuccugucagaucaguggcagcacuggauucucguaggagcucgaacccuauuaugaacugcacaugccagggaucuaggcugcccgcuccuuaugagaaucuaaugccugaugaucugucacugucucccaucacccccagaugggaccgucuaguuacaggaaaacaagcucagggcucccacugauucuacacuaugaugaguuguauaauuauuucauuauauauuacaauguaauaauaauaaaaauaaagugcacauguaacgagcuugaaucaucucacaaccauccucuccacccucuggucuguggaaaaauugucuuccaugaagucggucccuggugccaaaaaguuuggggaccucugcauuaaugcauguaccuggcacacaguagguacuaugugaguauagcucuuuuuguucuucccuaugcuacgucccuaccauuuggaaguuccaguggcacucuggaagcacucuguuauagaaugcauuauguugcaguggauauauuaaauucuucugaaugcaagcacuaguaauccagcucaaacuagcauaaggaaaaagugaauuaugauaagggaacugagguaucuuaagaaauccaaaacaaguuuuuuaguuucucaucccuguaucucuagguuccccucccucccucccuuccaugguauggaacuggcagucccagaacaaccuagaaaaaucaggaagaaaaaugcauggguuuuaaaaugaccauacaauggguguuuucuauaugaguaguuagcuggcauuaugcaaauguguagagucucccccuguggacucuuuuacacaaugcccaagucccaacccuaaaauaaaucagaaacagaaacuucauuugcuccuucagcccuccuaagugauaacugcauuucucucuguccauugauauaaauguguauauacauuaaugcaggggucuccaacccccaggccgcgauggguacuaguuaaugacccguuaggaacugggcagagucuuagcugcucucugcccuaagcuuuaugauuuacuaugucagcuccuggaaacucccuuggucuaaagucgaaaacgcccaagaaagggagccauugauucuauuugagaagcugcccacccugaaccaguccccugugacugggguuaguagugauaaugugguguugucacguggcacaaaauccuguccuauaaguauggaagugaagguacaguuccuauaaaaggggacaauuuggagguaaaagugcauuuccaguagagcaggauucuugauuuacgugugcaucuccauauauaaaugagaccauccaugcuagaagggccaagagugaggcugucccagaugugugccugccccagagccuugccagugccaauagcacaagauacucaaaacagacugagagcaaauaauaauuugagccucacccuuaugaggaaaucaugaaccaacaccaaacauaaaguccuuuaacuacucauauagaaaacacccacuguauggucauuuuaaaacccaugcauuuuuuuuccugauuuuucuagguuguucuggggcugccaguuccauacuaucuaacuacagugccaacucuuguuuaaagauaguucucuauaaugguaugaggguggggagagucuucagcuagucaccacuacaaaaaccuggggccagcuuccuggcuguaagaacaguuacugggaguggagaccguugguaauuugugaaguggcagaacuuucccaaugcccuuacgcuugaggaauacugacuagacaggugcccucuagaaggccgauagucuuccccagaacaugagcaaaggcagucacgugugggagacaaauucagcuuccuuccccacuuaguccuuucugaggccugggcggugggagugaugugacaugcagggagagucgagaggaucaggaggugccuguggcugucaaaggucugcguguguuuccuuccaugucacgggcaggagcagagcuggcgugugagaggucuucaggcacagcuaagcucggaggagcuggccuccgccugccucacggugcggguggcacugggagggcaguggggauacugccauuacccgagagcccugcccagggcaaggcuggacagaaggaucuuggcucccgccagugggcagggaguugaaaaugcuuuucuucaguuuaccauggaggccacucuaucucuaacauccuuuccaacucuaaugacucaaauccagccuuacuucucugcucuuauugggaagaaaggggguuaaggagugugguggaaggagagggaauggcccuggcuuuggggacugguuaccaggagacccccugcccuauccucgugaaaauacauguccacuuuagacaagagaaggcaugauguucucucuccuaugcauauucccaggaauaauugcagacuaaaacuuuuaccuguaggaaaguacauauaaauauguuggcauacauuugcauaaugucagcuaccuugagaggaaauucaguguuucugagccauuuuugccagauuaggcagaaaguaggccaaagauuguuauaacaaaagagaccuggcuggaggaagccuccugagcaccugaguagacagacuuccugugaggguuugggagccaaccgaggcuuccuaccaucugacaucuauaagaacacuauaagaacaugggaaacaugccgcguggggcugucagcucuggaacugccguggccuuggacuccacuuggccugugcucagcuuggaguuagcgcugcaucggcuccuccucugcugguugcaguuuaaugaccucuuuguaacuagguuuucuacugaugccaaggaaggaaaaugcaggcacauauuggagcuuggcauuugggguuccacagaaaacaggcacacagaacagugaagaaauacuguaaugauagcccuucacauuacuuugagugaugguaguggaggaggagugugaccuugcagugagcuauuccacagggaguacagcugccgcuggcaagcgagcuuaauaaagaugauguuugguucaucucaaaauugccuucagaauaaagcagucugauuuugcacugccagaacaaagaggccugacacuaaaacacuuccauuccauuuguuagcguuacuuacuauggauuauacuuaagcagcacugcccuaaagaacccccauauaaacucuucugcuuuuuagcuaagcaaguuuaugggccacacuggggagauaaaaugcagaauauaauauuagcaaauccuauuuaguuauuuauuaauguucuucaccuguguaaucugcauucauuaacucauucuuucuaauauaauaaaaccccaagaacauccucuccuuuucuguuguaggaccaggagcagaaucaugaagucauuuauguuacuaacccugugugcggccaacucaacuccaggguguaaaaaugaauaguaggugcccuuuggggacagagccuggcugucaagccagaugcuuaaagggaccauugccaaagauccuguaacuuauaaugcagcagcuuugcugauuuauagaaacugguuucugaaaagcuuucaguaguuaaguuuguacuccagccccuuccugcucuguuuaagaugcuuauuucugaugcugcuucuuguaccuucuccagcagaucggcuguuacuuuucaugucaugccucacugauagaacucuugaacuuuuuuucugaauagcccaucuguuuauuucccaugauugugauuucucaaggucaugguuaguccaaagguccccaagaaugaacaaguaagacgguaaugcuguaugucaggacccaggcaggacaggaauaucucugagaagccauaagcuucugcucaguuuuaaaucuugaugggaaaacauucagaauagggaaauucaacauauuugccccaagguaaggaugaaagccuugcuucaguacuccagcggaugucuggguucccugcagauuucccuugggugguuuggcacugcccccucacuccuaguagcagaucuuuugccuguggugggcgcgucaggcugaaguuauaucuggugcuggcuccgcuguccuccagcaggacuggaggugugguaggcugcaucgcagcuucccugagucauuucccagccuacaguaguggcuucuaaugccuuccaguuguccugacaggaauggaggaauuuuaucaaaucgaaguuugugaguagguuuuuuuuuuuuugagacggagucucgcucugucgcccaggcuggagugcaguggugccaucucggcucacuacaagcuccacuuccuggguucacgccauucuccugccucaaccucccgaguagcugggaccacaggcgccugccaccacgcccggcuaauuuuuuguauuuuuuuaguugagacgggguuucaccguguuagccaggauggucucaaucuccugaccuggugauccucccgccucggccucccaaagugagguuuuugagcuacucaguuugccugaaauuuagacauagagcuuaaugaucaaaguuuagacagcacauaagaaaauuuuuaccauauguuacuuugaacucccaggagcagacagguucaagcgcuucuuagggccccagagucuucagccccugcccaccuugcacuuacuggaacuaaaacaaaaccaaccuaguggcucauaaauccugcaguuuugggguauaacaauacagcagcuuucuauuaugggauuugcuucauugugugaccuguauugcuauaccaggaaccagaaggguggacaaaacacauguauuuauuuaauaaauauuagguuggugcaaaaauaauugugguuuuugccauugaaaguaauggcaaaaaccgcaauuacuuuugcaccaaucuauauauagccuuauuccacaaagagaauauauuucuuuaaauaaauggauuuuuaaaaacuuugguaaagacugagcauauauaauaccacaucauuaucgauguuacauaaacuuaaaagaaauaaagagauggagagaaucagcuugcuaucuuuauuucuuuauuugcacugggaaauaacaucuuugucuacuauuucuagcaucugagauccaggucaguugugauuaauuuuucucuguauuaugcaauguauuuuccugcuuuucaugccucucuacuggaugcuagacauuguacauuuuaccuucuugggcacugaauauuuuuguagucccagagguacuuuugagcuuuguccuaggaugcagugugauccuuucagguccugcuguauagcugugucagguggcagugcccaucuaggguuucucacuuguguuuucuacccagugccccauaaaucaugagguuuuccagcuaggguggugggaacaggcccuacccuagguccugugucagcaccacuguuccuucuaaucuucucacauggcucuuucucuggccugaggugguuccuuacacacaugcgcugaucaguagggcugugcugccuaguugagggagcucccucuggcccccgacuuagaucugugugucucucuccaguacugugaccgcgaguuccggccaccuuagucucccuggaucccuggcauuguuuuccuacugcagggaggcuggcaggcuccaccuggguuccccccgcaugcacacugcagcugggacccuccucggagcaugagcuggacaaucacagggcuccccuccugaguuugcccucucaagaaucacuauccuucacucccugguauuugguggcuugcaaaccguuguuucacauauuuuguccauuguuugcuuguuucaugcaggagggaaaaguccaguaccuguuucuccaucuuagccauaugagacucuuaaauuauuauuuuuuuccuuuccuagcaccagaaaguuugaugcaggcauuggaagacuuagauuaucuggcagcacuggauaaugauggaaaucuuucugaauuuggaaucaucaugucagaguuuccucuugauccacaacucucgaagucuaucuuagcguccugugaauuugacuguguagaugaagugcuaacaaucgcagccaugguaacagguauccuuaaugacuauuccuuuucuuuuuuugcaaaucugcacuagguauagauuuagaucggauccauuugaaauuauauuuugaggagcacagagcagagauagugaucaacucauuuaaccuuuugaaaugauagugagguauuuuaauagguuagaaaaggaaaauuuucuuaauaugaaaaauuaucuuaagaaaacuaacucaaaguucagcaaauuuauacaucagauguaugaaaacauacuagauuucuuuugcugaaauaaucagugcagaugaagaaaaugugucacuagagguguuuuuccccaaauaauguugugugccuguuuuuuauuuccuauuggcuucauucauccuggcuuguauguuuuaauuuauucuaauacugggggaacagaccaaccauugugcuguaucggaacugguuccaauccucuucuugugucuggaccuccaagcaccucagguuuucccugcuccugccggaauagaagcaggauauuaaccauauucaguugaccuuagaaaagcaaacacacacacacaaaaggagagggagaauuaggaugacucacucuaaauuucugggauuucuaaguaaacaagaauaacauauuuauucagaguaccaagacaggagccaugccacuaacagucgugaccccuccccucugcauguuaggcuaagauaaaaugucuucauuauugcuaaccaugugaccuuuuucauuuugaagcuccaaauugcuuuucacaugugccacauggagcugaagaggcugccuugacuuguuggaagacauuuuuacaucccgaaggagaucacuuuacccucaucagcauuuacaaggcuuaccaagacacaacucugaauucuagcagugaguguaagugaaugcucagaaacuaccuauuaauuccaccuuccuuucccuagauaagucugaguccuuauuaguuauucaucaaacauucuucgccagcccuacuggccacuugaaugcaauggcacuugaggcccuaaacgcacccacaggcaucugcagagugggagaugcucagucccccugcucccacggagcucuggugugccaccauggcgggccuguacuuccagagcuccaggacuccacucagccagccuucagagcaagcuugcuuggggcauggugacgggggacacagacucguacaugggucuuuggaggaagacaagaacagccaccucuacgugcccacugucagaguugugcugugcaccuuccguauccuggcacauucaccacgugcaugcagagaggcugcagagcuccagauacuagugcagaauagguaggcuggggugcugaggggaggcugcagaguugcugacggagcuugauagaggagagcagaggguguccagagaagagaauggcgcaugucaaagcaaagccacaaaguccuuuguaugccugaagggcaguggguagcuuaccugucacaggaagguacucagaagucaacuggaagcugcuaugcagacagaaacaagaggagggggcaaacagggcaaagcagcauagcagaggcuagagccacccauaaagggcagccaguaaggucccucccugacauuuuccaugaagcaucuuuuaccuccuuuguucugaaagauggugugaaaauaugugaaguagugugaaaaauaugacagcaauuugaaagacagaauuguauaaagaacagggaguuaguguuucaaagcugagaagaaaaaguugucaguggagccagcagguacacaggaaucugguggcaccuuuugagggcaugcugaaugggugacacuaaguacaugcugugguugcuccgagcagcaugaguggacaggacaggguaaaugagggucuucuguccauggugccauggccauguacauucccagguccaucuuaaguaauuacagguggccagaaagacuaacuucaaacucacccacaugccugaauuuuaagauaaaaguuacagcuaggguagauagaugagcuuaacuauaacauaauuaauucccaaaucaaccugguaguaauccuguucuuaucauuaaauaaaauaugagauauuuucauagaucagaggaauuuauacugugggcuuuuuccugccuaguuugauuaaaugggaccacauacauacaugcuguaugcauagagacacaacauagaucuuacaaaauccucucuggccuuuaugagccacggguuagugaaauacaucuucagucaccacuaggaacaguuuccacaguuggcugggaucacagaaccccagcagguggcaugggugcugucgguggcaccgucucccuuccugguagugcccugacagcugaccuugcagccaccagaaauccuuguccuugcugccuuccugccacucaccuacguggccuccuuuguaggagaggagagcacagggcuuaaagauggcaacugccuggccugggcucuucagagcuucugacaaaucauuucuaaauagccuuguguucuuucccuccuagacuguguggaaaaguggugucgugauuacuuccucaacuguucagcacucagaauggcagauguuauucgagcugaacucuuagaaauuaucaagcgaaucgagcuucccuaugcagaaccugcuuuuggcuccaaggaaaacacucuaaacauaaagaaagcucuucuguccgguuacuuuaugcaggugagaagggguggggucaccucagcauaggcucugcugaauugcacauacucaggauaugcugccaacaauggcuuaggaugaugauuuugacauuaaguaaaacuaaaaauccauguuauuauuaaagauuugguacuuaaguauccuuccccucaagggaauaaagggccaaggcagaauauguagucuuaauggagaaaaaugacauaucauuauggauuuccucaucuguaaaguaagguuccuacaucacagggucauugcgugcuacacaccaaguguaaagcacuuggcauuggaguguaugucgcccauaguaugguggguagcgugcuaaguuucaucucauggccaaaacauuaaccucacagcugcacuguuuuagcagugcccugcuguugcugaaguuaguuaacaucacugucucaaaguuuuaggcaaaacaugcuuauggcuuauuuucuacaugugaaaguaggaaacaugaguggcaaacguuaguuuuaacuaucccguauaaaauacuuugguauuuuuuucaacaaacaucuuuguauaaugaucuccauauuaauacaaaaucuuuuuucuuuaaaauucugccuuucagauugcucgggauguugauggaucagguaacuacuuaaugcugacacauaagcagguugcucagcugcauccccugucugguuacucaaucaccaagaagaugccagaguggguccucuuccauaaauucagcauuucugagaacaacuacaucaggauuaccucagaaaucucuccugaacuguaaguuuaauggagaagaaaggguuguauuuuuuuuuuaauucauaccuguaggaguaaaugacaaauuuggcuuuuauucuuaguucuaaaguuuauacugaugcaaucuuaauuuacguugacaguaccuacuaagggcaggccucuguggaugauaccuaagaaaugucccugccuguuagauuacagcauagaaaagacaguguagaaauaaaaacaaagaccaugugucuuuaagaaggacagaaugcuagagaaaugcacuguauacaggugcauugaccuugagaggaaugagcuuagccaucuuucaagagccacugcaguuggagcugucggggaagaggaaggagggaaggcugaagagagaggcaggcaccagaagguguaaggcuuuaugggccacauaguuuauauuuuaucuaagugcaguacacagcaauuggagcauuuuaagcaagaguagcaucuucucgauauaguuuuaaggaucacuguagcuggccaggcaccuugggaggccaaggcaggaggaagauggcuugagcccaagaguucaagaccagcccuggcaacauagcaagaccccgucucuacaaaauaaaaaaauuagccgggugugguggcaugcgccuauagucccagcuacuugagauucugcgacagaggaucgcuugagcccaggaggucaaggcugcagugagguacugucacaccaccgcacaccagccugggagacagaccaagacgcugucuaaaaagaaaaaaggaaaaauaacuguggcugcuacaugaauggaaaggaggggcaauggcaagagugagacuacuccacuagucuuugagaggccaguacagagucuggauccauuuugaagguuccacuacuauuccagcaaguaguguucaaggcagcaaccaagagugacucauagaugucuggcuuacgcagcuggauguggagugguacuaguuaaaauaagaagcaaagauacccccucucuccccuacccaaagcucucuuaagcauacgauuggugccucuuauauggugaugggccuuaggggaaauacuaguuuccacuaaagguuagugguagacagcacuuccacuguguggcauaacacuagagaggccaacuuauucuagaaaugcaacaggauuggcugcauaaaaaacagaaaguauuuauuuuacaaagucggacugagauacuaucugaguucaaauuaaauaccgguucuacagguagauucuccagggaugggaagugcccagacauaauguuuggugucucucaccaccuuccccacucauaaucucaucuuuuugucuuaaauaaacagauuuaugcagcugguaccacaauacuauuucaguaaucugccuccuagugaaaguaaggacauucuacagcaaguaguggaucaccuauccccugugucaacaaugaauaaggaacagcaaaugugugagacgugcccugaaacugaacagagaugcacucuccagugacuccccagcaaacacaaggugcagcagggucccaaagguagcuggauggcugaacugcuggauaugggagauacaugacgcgaagacggauuucacauccacaggacggucuugaagaaaauaacacuguguauauuauuuuaaaauaaaaaauagaaguuuuuauugaguucuuuaaauuacuacuccaugcuuuucuucuucuuggaaaaguuuuuaaaucaaccacucauaauuugaccaaaauuuuaaaaaacugguauuuuguaaaugugucagagacacaugggacagaacccuacuuuuuguagaggaacuuaaucugaauaaagucugaguuuuucaguaaaucuccacugaguuuucugguaauuuuacaaaaacaagcccaucacuguccauuggaaauggguuagacagauagauauucuuucaguuuauccaugauuucguucaucuugucgccuggaauuaacaucacaguucgcaagggcgucauugguacgucaucaaaagaccauuugccucccagacaagugucgcucuccuccugcacugaguaguugaacuugagaauugccuucuaaaccaaauaaguaaccaugaauuaaaaaucgggacaacccaaagacaaaacccauuugaucuacggcaaagaauauuacguuuggcauaugcuuaaauaagaaugagagcuaaaaaaaagcaaaacucagaauugaaaaaguucaaaugggacauucaggcagaaguuauaaaacacaaaccaaguagauuuuaaacccacaugaggaacagggauagaggugugcaauuucuaagaggugaacaagcagcuaagugguauuuucauuuaauugucaaaauaaucuugugaaacauaaugaaauuaagacuuguaaaauuugauauuuaacaagaacuugucuucaaacacucuuuucucacuuucucagcugcuuccuuagcaucaggcuuuugugugaagacagaguaaaucugcauaccccgccaucuuaaaacacccauacacacuccccccaaauggucaaccugagguguugaagcauaugguuuuguuuuuuuuguuuguuuguuuuuuuuuuuugagacagagucucacucugucacccaggcuggagugcaguggcgugaucucggcucaccgcaagcucugccucccggguucacaccauucuccugccucagccucccaaguagcugggacuaccggugcccaccauugugccuggcuaauuuuuuguauuuuuaguaaagacagcguuucaucguguuagccaggauggucugaucuccugaccucgugauccgcccgccuuggccucccaaagugcugggauuacaggcaugagccaccgcacccggccuauguuuuuuaaaaauuauguuuacuauuuacuuccuggaaaagaagggcacagcuaaauuuguagcgcuuuagucuucugcagaagucuucaaagugaugugauaucauccaauucaggaaaauauguuccccucagagauacacuucaagauuuuuuuuuuucugagacagagucucgcucugucgcccaggcuggagugcaguggcgcaaucucggcucacugcaagcuccgccucccggguuuaugccauucuccugccucagccucccgaguagcugggacuacaggcacgugccaccacgcccggcuaauuuuuuguauuuuuuaguagagacgggguuucaccauguuagccaggauggucucgaucuccugaccucgugauccacccgccuugaccucccaaagugcugggauuacaggcgugagccaccgugccuggcucaagauguuuuuguguuuuuuguuuguuuguuuguuuuugagacggaguuucuuccuuguugcucaggcuggagugcaguggcgcgaucucggcucacugcagccucugccucccagguucaagcaauuuuccugccuuagccuuccgaguagcugggauuacaggcaucugccaccaugcccggcuaauuuuuuuuuuuuuguauuuuuaguagagaugggguuucucccuguuggccaggcuggucuugaauuucuggccucaggugaucugcccgccucagcuucccaaggugcugggauuacaggugugcaccaccgcaccuggcccacuucaagauuuuucagaggaagagaggguaagaauauucucugguauauggcuguccaucacaguacaagcuaccuuuauaggaaaaaaaugcuggagauaucccaccagcaggaugacauccacgacuaaggacacagagcagcaggggugccccagcuuccacacugaccagcugugugaucgcagguaauuucccucauuucccuaugccuuaaaguccacaucuguaaaccccaggcuaaugucuaccucuccgcaugguuuuagaaugaaagauuucacaggaagcauauuauaaaugccuaaucauucuuaacagguuaaucacuuuucuccuccuccuccucaugcucauaaccacagugcaggcaaggaggcuggugccuagccuccugaguaccuacuaugcaccuggcacuauguuagcugcuagguccuguggggaaacagaaaaacagaguagccacacuugaaagacuuggaccuaaagugggagaacaauaaaucuugauaaaucauuuucaagaaaauccuuauuuacaucuaaacaaauaagcaggauagucuuaccucauagaaaaauucuuccucugcauuugcaaacauuaacgcagcuuucuuuuuguugcuagguuucuuuuuggaauuguuuuuuccugcuuccacaaaugucuuacuaaucagaagguaaaaguagcacuucccacauggcuuauugguucugugugcccccgccaguucuuuccugcaaggcacacacacaacauuuguuuaccugcugggucaagugaaauccaucaacaaaccagagcacagaaaacccggugaggcaucuucaguggguucugcugugacgcaggcauucaaucugaacacuuagucuacaggaaugauuuuuauuuacauaaucaguugcauuuuagauuauguauuacuuuuuauaauacuaugauauaucucucagauuaugcugauuuguggauauauagcaacuaacagaucagaugagucucaaauucacucaauguaucacugcucugccugugcauaaguuaaaaauauauacgaaucugaauuuuugaauuuuuuaaagcaaugaacauuuaacugaaacacacaaagguauacagccacaaccaaugucacuacagccugugacuacuaccacagucucuaauugcuagagucuggaacuaauuucugacauacugcagaaacugcauaaacacacaaccuaaauucuagcaauggaaucgcaacaaagccuuaauguuucuucuuucugaaaauuaaacauagccuugugcaucuggaugcccuugaacaaaagaagaaacucagaacaaccguccucuucagcuuuccuuuuuuuuuuuuuucuuuuuuucguuuggagacaaaaucucacucuguugcccaggcuguagaguacaauggcacaaucucggcucacugcaaccucugccugccagguucacacgauuuucgugccuaagccuccugaguagcugggauuacaggucugcaccaccauacccggcuaauuuuuuguggguguauuuuuaguagaauugggguuucgccauguuggccaggcuggucucaaacuccuagccucaagugaucugccagcuucggccucccaaaguguuggaauuacaagugucagccaccacaccuggccuuuucaaaaaaaaaaaaagaaaaaaaaaaagauagggucuuguaauuuugcccaggcuggcgugcaguggcuauucacaggcacaaucauaguauauugcagccuggaacuccuggccucaagcauucccccugccucagccuccugaguagcugcgacuacaggcgugcaccacugcgcuuggcucacuucagcuuuaacaggacuaggagaaagcaaaucacccuccuauaaaaccaaauaaaugugagcuccagcugaucagaaaaaaagaaaaccaaaaaaaaacaaaaaccacuuaaggcaccagaagcacaaucugagcuacagcugagagagcagggagcaggagauaagaagcaucgaaucccuaggaaaaaacagcaaacguaaagguuuccagaguagaguugcauuccuacagcuauuuaaaggaaaaccacaacgcaagggcuaugaccucugagaaagaauauucuauaaagaaccugucuaggucaagugcugugacugacaccuguaaucccaacacugggaggccgaggcaggaagaucacuuuagccuaggaguucaagaccagccugggcaauguagcaagacccugucucuaccaaaaaaaaaaaaaaauuuaaauuagauagaaauaaauaagagaaucugccuauauuuuguccucuguugcaaagcacagacaauacaauucuuaguacacucaguuugcuagauuucacagcuacauuugaaauauuuuuguaaacuuaaaacuucuggauuaaaaaauagaauaacaaaaacccugaaaagcuagccacaguaucaggacuaugguuucauuuguuaugaaacauaccaauagaauuugggaacuuuaccaguuuuguuauuguuguaauuguucauuauuuuauucauguugcagaaagcuaucugugaaggugaaaaacuucaaucaaauggggaugcaaagucuauaugaaauuaucuacuuauauaucacuuaaaucuuaaguuaaaauuucaugauuauugucacaaacucuucaaaaagccaguuguuaauaauguauguacuucacaggauguuucuuccacuccccucacacuaaacccacuuaaaccaaggacagaacucuuucuauaucuacauauucuacuuaaaugacauuuaggaaucuauuugaaaaaaaaauuacuguucaaagauauuuucccagaaucucuuacugaagcugcugguacaugggcagagcgaucuguggagggacauuaaugaaucuuucacuuaggagaaggcccacaggcuugguggugucauuuaaaaacuuguccagcuguucaaccaugcucuuuucacaguucuucucacagaagcguagaaccaacucuugaauuuguucaacacacuggguacccuagaaagcaaagagaaagcuuguuuccuauuacaagccaucacauagaggacaaaaccugagaguaaaagcuaucacuuuucaucuuacagcuaagggcaguuuccugccauagccuuaacgucuuguaugucuucaguguugacugcuuaagcauuucucaaaaguaaauacacugguuauuuaccaucccaugaugagugguaagagagucauaauuaacauucagacacacuggaauggcaacucuaguccaucucauaaagauagauggaaguaacuggacaguuuauuucaaaauuaaagacuaaguguagccugcaucuuauucugagguggguaagcagcugguuuacuuuuuauuacaacucaucagagaaucaauaaaaagagaugaaucgaaacaaaauaaaaugucaguaaaugcccucaacauugaggcagcaaagccugagaauauccccacuacacaaguagcaaagauaacagcugcagagagacagcacaaacagcuccugcaucaguaccaacaucaggacugcaaagccagaugauucccuaaaccacagggaguaaacaacuuuaacuggguacagacccaacaccaccaccuucauauugaaaaaggauuacaauaagauuucacaagagcacuuaucccuauaguuaauaucacuguuuaacauaaaagacauuuucaccaugcauuaaauaaaagugguuuuggccuaagaaauaaccauucagaugccauccagugaaaccaaccuuucuuucaguuaaauuuaaaaggcuuaugaaaccaaaaaccucaucuucauccauaucaucauugcugucuucugaaacauccguuugcuauuuuaaaagaaaaaauauuuaaauguuauauuuaguauaauaccaagaguauaaaaccaagucuugggauguaggccucauuuaucuuuucacuuuucaaaagcaaaacuuuguuuuaccaccgccaucuuagaaagcauuguauuuuaaauacugucacaguuuuaccaccaucaucuuggaaagcauuguaucuuaaauacugugugaccuuguucauuucgcuuuaccucgacucuguuccucuuuucagauucugaacagauugaaauuucuuuguaccagauuaagucauuuucuuuuaucagauucucaauauaauacaaauccagaagagauaaaccucaugaaauaaagcauuuucauuuguuuucuacacaauuaggcuggagccaagccuugcuucucugcuggcccacagcauuguuucaucuaaaacucaugaguuuccagaacacuugucagucuugaccauuagugaagcuaggcaaugcuugagggccacuuacaccuaucacauuagcaagagagaaggggaaaaaagagaacccccugcccuuuguucuaugauccuagggacuggcuccaccgaacacuauggguagucccuuuacuaagaacaagaagucucuauccucaggacaccucaagugucucuggagaaucccaagaagccacaguuacaacugcagagcuauugaugugauuauccauuuaaagagugaauccugccauuagauaauaaccucuuucaaggauaaaaauaacugcuucuccuccauauccauuaggucuucuaagacacgaaucagcuagagaucacauuuauuugaugaaagggcagguggucugcuuuuucccauugcccuaauaaaaggaaugccccauagguuuaauuucucauuuucuuuacauugagugccauaaaguuacuaauauugucagaagccuugaaaaguguacacuguauuuaguaacaaguauguuggugacccuaucacucaguguccgaauuuuagugguguaaaagucagauaagagugucugaagaaugaauaggaggacaggaaguagaaaccaugacuuaagauuacuuuucaagaauuuuggcucugaaggugauguacuuaagaguggaacauuagacugaauggagcuuuuguuuguuguguuuuucacaacaggcuagggaacaggugcuaggaacaggaaaaagacaucaacagugacagcuacacauauguagcacaugucagcugccagacacuguuuuaagcagucagcaauucauuuuguuuacccaugcacucuacaagaucggugcuaguaccauccucauuuucagagacagaaauggaaacagauuaagguacuguggcagacuguaucuuucacagauggccccaauggaucucuccuuggacaugcucuucugacaaagugaccuagguacuuuucucauggaguggugggaucaaugugcccucccccuagauagaaauuucuaucuguaaagacuaagcaaaugguggaaauggcacuauaucacuucugccugcuucuuuugggcagcuugcucuuggaagcaaaccaaugugugacgaggcccacauggagaagaacuaaggccccugguccagagucccagcuaagcucccgacagacagcuagggcuaacuugccagucaugugagugagccaucuugaaagggaauccuccagccccuagucaagccaccccagcuaacaugauggagcaggagcacagaugaguugugcccacugagcucuguccaaacuguagauccauuagccaaauaaaugacuacugcuauuuuacgacacuaagcuauggggugguuuguuauacaaacaacagauaacccaaagaaccaccagaugauaagcagcagacccagggucuaaaccaguccuuauuuuguugagcucucuacaacaucuaucugauaaagaugaccauccccuccuccuucaaauguuaucuuucuugcuguguaugacaucacugcacuauuguuucuucuacuucuccugucaucccuuuuaaucuccuuugcuggcucugccacuuauauuacucaucgaaguauucuugguauuacuaaggugucugucccuucccucccugcgcaaucucaaucacuucuacgaccucaguaacauuuacgaccaacucccaagucuccagggcuccaccugcuacccgguaucucacagguaacucaaacucaaaauguacaaauccaaauucacauucccccuccuaauuugaccuuccuccauguuuguuauccuguuugcucaagcuagaaaccuggaagucauccuugacuccuuuuccucucacuuucagacccaaucagggacuaaaccucaucauauuucaucucccaaauauuuucuaaaugagcccacuucucucccucuccauugcccccaccuggacuacugcauuuaauaagcuuggauuucugcaaugacuucugaucagucuccauuccuccaguaauacugcuuccaauuugagcuaaacagaauaaagaacuuuuuuuuuuuuuuuuuuuuuuuuucagauauagggucuugcuguguugcccggcuagagugcagcggcacaaagcucaccauggccuucaacuucuuggcucaagagauccuccuaccucagccaccuggguaaaaagacuacaggcaugugcuacuaugcccggcuaauuuuuuguuauuuuuuguagagacagaguauugcuauauugcccaggauggucuugaacuccuggccucaagcaauccucccaccuuugcuucccaaagugcugggauuacaagcauggugaggcccagcaugaacagaauaaagaacucauuuaaucagaauaaacacaauuauccuacuuaccuuaaucacacucccaauaugguucuguugaauuaagagaucuguuaguucugcaguguucacaggagccuuuagaaaaagcuaaaaggaggaaaaaauuauuuuaaauuaagaucaaagcaugauuucuaauaacuucaaauccuauauucaaauacaaacaaugaaauuucugugacuuaagaugaugaucuagaaaagcaaccccaagagggaaagaaaagcccaggagagucaaagaagcuaaagauuaggaaauuucagaaaagaagaagucaguaguaauauagaaguaaugggggagggggagaaaaaagggagaaacgagagaggauaaacuuaaggccaaagaauuuggugaaaaagacgguagagcuauaaaggcuaaagaaccaaagucauauuauaugaguaaaagaauaaggagaagcagcaagcaucaauuuuauagcaccaaacagcacaguuauaugacuguuacauaagaauugugaauuaaaaaaaaaaacaaaauaacucuaauuagcagaugaaaggaaauaauucuuccuuccaggcaagguggagaggauagaaauggaaauucuaaaaagaugaacuugggagagccuguauugaaugaccugaauuuucuuuuuuuuuagagacagaggcucacucuguugcccagacuggagcucaauggcacauucauagcugcagccuugagcucuuagacucaaguaauccuccagccucagccuccugaggaguuaggacuaacggugugugcuaccacaguuggcuaauuuuuaauuuuuuuguagagacagguucucauuauguugcccaggcuggucucaaacuccugggcucaagcaauccucucaccucggccuuccaaaaugcugagauuauaggcaugaaccacugcacccggccccugauuuuucuuagaagaggaaauuuaugcauaauaaauaaaagacaauaccugcugcaguaauuucuuaauuccgucauaaucauuaucugauagggaauaagcuucaaauucaauauucacuuccuguaaauaacacacaaaauaguuguuaccagaaaaacuacaaacaucuagacuuuaaaacaggcaaacauugccaagauugccaucugugaagaauacaaagcaccuucacacuauuucuucaggugacacaaaagccugagaaaacaaaacacucagaguaaccuaguuuaaauguugagaaaguccaguucaaauaaaccagacacggcagccacaaaggauaaauuauuuuccugauuacaagggugggcaaaaaucaaaaucacuucaaaagucccuggaauugccuagagcuugacuuagcccauggauuugagguuacacuacauuugcuuagcaaauauuuauuaaguaucaauccagguaccaagcacugugccaggcacucaagaugaaaagguuaguaaggcagacacaaaugauccugcucucgugcagcuuacgauuuaggaaggaauauaggcauuaaggaaauauucauagaaauaaauguaagugcuauaaaacaaagguacacaauguuguaacaacuuaaaaaauaagaagucagucaggaaagccuuccuugaagugacauuugagcaagaaaccgagaaacagcaaagagaguuccugguacagggaacagcacaaacuaaggcccuaaggcagaaggaaauacaaugaguacaagggacuagaagaaugaauguguagcugggcucccugaucucuaucugcaagacaacagaaucuagaagauggaacuaaaaugccaaaaacaaaaccuaguugcuuuuaaacacuaacaagauuaguccuugaggacccuaaaucagaccuugauaagugacacaaugaaccuggggcucugaugaaauaauauauuuaaaggcacuucagguuuuaacgguuucagaauuuaggucuuagcugaagaacaucgcagaggaaaucagaccuccuuuuaccuugccacccugacuauguauauauuuaagucuuccuuaauuguaaaauugcaaggcccuggaauugcuuagagcaauuccagcuccaauuugaacucuuuaaguccagcuuugcagacuucaaaugcuaacuuagccagauuaugugagcagcaaaacacaaggggucgggugggaguguuccaaacaggaucaaacuaaaccaaauaacaaacugucauuauucaggacuuaaacuuauuccuuagauauaaauacauucuguaaauaaugcucaucuaguguuuuuuucuuugucuagacagacaucucggaccucugucccagacuauuauggcaccaccagggaaaugggcggcaaauggauuaucuguccagcacccuuuuccuggguaugggcucaucuccacauggcuucagcaggaacagucacguuuguagaaaagagcccugucccucauucccaggugauuuagaauuaagacugugguggugugauagauuucccauguuaacacaagcagcauugauuucuauaacccaaaaguaauaaaagagccagucaaaguucuaagugaaaaauggugagauggcauucaaggcauagagccaaaguaaaauuuguaagggaaggaagauugaucacauacccacaccauggugucaccucuaauccugcauccaugcuucucuccaugcuccccuccaugcucaucaugacucaugauuaccucucugauuuuauuuccuaucacucucucuuccuuauucugauccagccaucuaggcugccuuuccgucccucaauugugaagacucuugauuuucuuguaaaugaacuagaaagccaaugcagcaaucuaagcagaggccugagaucagaccuauaagaucucucugacuguaaguggaguauagacugauuguaggggaacaaaaauggagaaaagaacgccgguuaaaagcuguuacauuaaauaguaguccaggcaagagaugauagagguguggacuacgauggucucagaauuagugcugagaaaugucuggauaacaggauuuacugaugggcuggauauaggaugaggaaagggaggaauuaaaguuaagccccagguuuuggguuagagcagcuggugacuuuaggggccauuuauagaaauggugacgauuaagagaggggcaugaauuauuauacaaauucugcuuuggacaaguuaaggcugagguaucuauuuaaacauucaguaggcugaaggaucauucaguccuaauuguuuacuaaacaaauaauaaguaccuauauugccaggcacuacgguaggaccuagucugaagaaaggaacacaguucuaugagacuaugaaaccaaagauuuacccacgacuuggucagcugccccaggagccagaaaauacagccuagcugagaucugaagaaggaagggaaaacugcaggauaaagaagagcauuugaaaaggcuucuacgguagaacgcggcaagagccuucaagaaacugagggcccaagugagugccgcccgcagagugaagaggaggacagcugcugccccgaggggagagggcccccucugcgagcccgggguggccgauucaggaucugaggcuucagccugagaacuaaagaggacgagaagaacacaccuguuguggcgggcuuuuucggggaggacgcggguugggagauuaacuggaccggacuagaccuuuaaaaaauaacuacuauggcugcaguguguuaaagaccgaggagaaaccugagaaagaacuuaucuccaguuucuccucacagacccucagggucagggaagacccuacacuauuuuuacacagccugggcuugccaaaaaguuuuucucagguauaaaccaacuaggggagcguguccuucucaccucgucaaugaccucguccucuucauccuuuuccuugucacugucaucaucgucuucauccucauuuucgacuucuuuuuccucuuccucgucgcgcuggacugggggauccggcggcugcggaaccccacuuuccacggcacgccgcuuagaccuggacgccauguugccgcucacacugcgccugc

SEQ ID NO: 191810 - RNA, 22094 nt, Homo sapiens
uuggauuuaaaaacacuuuauaguguguuguuuuuauugagcgcucacacccgaagggguggcggcggaugcugugggugaguggggccgccugagccugcucgggccacauccacacauccacagaguccaccuggacucggaggaaggccgagaggacacggacgguggccacaccacgcugcagugaaggcccaagugugauggcagagaaagagggaaaguuggagaaagagcgguaucugacaauaacuuuucucuuggauguuaauuuuuuggucuauaaauuggaaaggaaggcucggacugaaauaaauacauuuauucugaguaaugaccuuuugggagcaguguccgucaacucugcuucgagagcgucuccacgugagcagcagcgccugucucgcgccucgccgaggcggaaccacaccgggccuccagcggaggcggcuuucuccugugucugugaagggaaguagcaggugcgucacuguucuuaauggagcggacaaugaugccuuuucucugacagaaaaauguccggcuuaacuaugcaagacaagacuugguccucacguucgcgucucuaguugauuuuguccuggaauauguacaaguuauugguggcagccacggcaaugacauuguccacggggugccaggcugugugcaggaucuucuuguugaaguccagacuguccacacugaucucgucuuuccuccgcuuaccccccguacacaccuuccgggguuugaggcuggcgcgcgguuugcugcucucucucgaggccuccagggucacaucccuccgcgugucucuaucaaacauccugaagaaguuguuauaggacccggucaugauggcgcuguucaaaacaagagcagacagcagcacuccucaguggggggagcggcagcaaggacucagaccccaccccuggggugcacagcgcacgccacccucccccacaacccaguuacuuucagaaaucaggaaugaucaaucacaaugggcagaagagaaaugcagugaaaauguguaccgagcuuuaucuauaaucaugucaguaagaauccaugucacaggagaaacaaaauaauggagucacacuuuuaacauuaguguauuuuuugaaacaaccccaccuauuuaucucacucaugaauaacagcacaguuuauuuuuaagccuuauguucugcaauuugucaaugauccauaaugaccugaacauaauccuuaucauguucaacaguuacuagucauaucugucaauguuucuuuggaguuaaacugcuuuucuauuaauuucaaaaaguuucuuucaaaugaggcaacggauagaaauaguaaaaauccacugggcaaaguguggcagaauuuuagaacaacugcauuucacacacauuccagacaauacaauaccguccaugcuuuuguuucuucaagaucaacuguaauggcuuucaaaugucucugcugucgaaaaauucuacuaccgcacacauccucaugauauaacuucauaauacugguaaaaaccucugcaaucuuacauuuucuacaaaaaugacagaaaaauagcugaaugaugcaaacgcugccaugauuugacccauggcuucaugaguccaguuucugaugaaagauguguucaaacaaugcccuucugguuucuccagccguccuugaagcucgccuccucuuccuauuuugacacuaacccgcgcccucacguccugcccccauggucaugcgcggugagaggccuuucacgcuggcgcgucuucaaggugccaugagaaagaagcgggccgcuucccuuccauggcccagcacugacccuggcugcuggcaaauaccuagugucugacugaccuugucuaaaacuucaaagcaggggaaaaaaaaaaaaaaaagacgaacucagagaagagaaacugcauucagcgauccauguuuauuucccaucuccugcuuccauccaggagcccacagcgccacagaggcgggagacacaaggugugcccagcgcccuccagcaaugccaagcugugcacguggucuuggaacagggguaugcagccaaguuggcacgugagggccauugacuggggguuccccaaauuaguuuccacauaaaacacaauguuuacgaaaggguaaguaauaagaaugugugaaucugaagcuuacauuuauguuauuaaaacucaacaguaaccauuauucagaacacagacgacagaugauguauggccgacacugacuggaauugcuggugcaugguaauaacgaaaagcacaucagcuuucauacagauuuaugaucacuuuuaaauucucgacagauagugccagccccagaguggguguuuccacacugcaaacaagggcgcugcccagcagccuggugcuggcccaggaagggaacagcacagacagagacacaggcguaagcacauaacugguucuguggggcgaccuagaacacaagaaggcgcugccacacggagaaucaggauugggcugaggcagcacugaaacgccucacuccccuucaucgcaucccucaacagaaguuuccagguaggaagacuggcguguuuuugagagugaauggacuaagcaaauguuacugggaacgcuuuuagauguucuuggggauauguaaucuaaggguauuuugcaauauuugaaauauaucaagaggaauaaaaaauacagugacuauccauguacccgcaagucacugcuaagacagugaaccccccgcacacucgcaagucacuaagacagugaacccccgcacaccagcaagucacuaagacagugacccccccacacacccgcaagucacugcuaagacagugaaccccccgcacacuuggaagucacuaagacagugaaccccugcacacccgcaagucacuaagacaaugaacccccgcauacccgcaagucacugcuaagacagugacccccacacacacaaccacaagucacugcuaagacagugaaacccccugcacaccugcaagucacuaagugaaccccccgcacacccacaagucacuaagacagugaacccccgcacaccugcaagucacugcuaagacagggaccccccgcaagucacugcuaagacagugaaccccccacacaccugcaagucacugcuaagugaaccccccgcacaacuggaagucacuaagacagugaacccccgcacaccugcaagucacuaagacagugaacccccgcauaccugcaagucacugcuaagacagggacccccccgcaagucacugcuaagacagugaacccccccacacacaaccgcaagucacugcuaagacagugaaaccccccgcacacccgcaagucacuaagacagugaacccccgcaaaccugcaagucacugcuaagacagggaacccccgcaagucacugcuaagacagugaaccucccacacacacccgcaagucacugcuaagacagugaaacccccugcacacccgcaagucacuaagacagugaacccccugcacacccgcaagucacuaagacagugaacccccgcacacucgcaagucacugauaagacagggaccccccccgcaagucacugcuaagacagugaaccccccacacacacccgcaagucacugauaagacagggaccccccccgcaagucacugcuaagacagugaaccccacacacacacccgcaagucacugcuaagugaacccccugcacacccgcaagucacuaagacagugaaccccccgcacacccgcaagucacuaagacagugaaccccgcacacccgcaagucacuaagacagugaacccccacacacccgaaagucacuaagugaacccccccgcacacccgcaagucacuaagacagugaaccccccgcacacccgcaagucacuaagacagugaaccccccgcacacccgcaagucacuagugaaccccccgcacacccgcaagucacuaagacagugaaccacccgcacacccacaagucacuaagacagugaacccccccgcacaccaagucacuaagacagugaacccccgcacacccacaagucacugcuaagacagugaacccccgcacacccgcaagucacuaagacagugaacccccgcacacccgcaagucacuaagacagugaaccccccccacacaugcaaaucacuaagacagugaaccccccgcacacccgcaagucacuaagacagugaacccccgcacacccgcaagucacugcuaagacagggaccccccaagucacugcuaagacagugaacccccccgcacacccgcaagucacugcuaagacagugaaacccccugcacacccgcaagucacugcuaagacagugaacccccccgcacacccgcaagucacugcuaagacagcgaaccccccugcacacccgcaagucacuguuaagacagggacccccugcaagucacugguaagguggugaacccccugcacacccgcaagucacugcuaagagagugaccccucugcacaccagcaagucacugcuaagacagggaccccccugcacuguguugccacucuggaaagaaagauggucuccuaucccauccccaguugggguccucacuugcuagaguacauaugugucauccccacacacauuuauauuuuguauacagauuuuuuuuguuuuuuuuugagacagagucucacucuaucgcccaggcuggagugcaguggcacaaucucagcuuacugcaaccuccaccuccaagguucaagcgauucuccugccucagccuccugaguggugggauuaaaggcaugcaccaccauguccggcuaauuuuuguauuucuaguagagaugggguuucacuauguuggucaggcugcucucgaacuccugaccucgugauccgcccuccucagccucccaaagugcugggauuacaggugugagccacugcgccuggccaauaguuacagauucuuaaaacaaaaccgucuuguaugucuuaaacauguuguaugucauugcaccguacgcauuccuccugaauuuucuuuguggauuaucuuugugagauccaccuaggugauccauguaguucuaauaauugauucucacugcuuuucaguauauguuaugauagagaacaacuuaccuguccauuccucuaaugaugcaccugugggcugucuccaguuguuugcuauuucagguaucugagcacguuuucuugucugaacaugcaagaagcucccaacccgacugaaugucaccaaggaggucacaagaaggguacuggguaagaccacuggucuccacccucucccccaaaccaucaucauucugaugggcaugaaaggacgucccucuggcuuuacuugcugaucacuaagaaggaugagcauuucuauuuauuuuuccauuucugcgaaaccccauucaugguuuuugcucuuuucugaguuguuugccaccuucuuguugacaacuaauucugcaccuauucuggauacuuaaucucuguucguuauccuuuuguggauuuuguuuucacuuuuaauuucaauauaaagaaguuuaaaauuuaauguaguugaauuucuuaauguuuuccuugggcuuuuggggccuucuuaaagaagcccuuguuuccagagcucacaaagaugucuuaggcuuagaaacacucagagcuuauuuauuuauuguguggggcuggugagggcucuaauuuuucucccccaaacacagauaacuaaggccguccagguggcagagcuucagaguuugcacugcucuucccugcaggcugcguuccucugccuaucugucucagccccuuucugcagggccaggcucccuuuacagcucgcucuacugaguuuccuguugugauacauuguuucccauuugaaaaugccuuuaucacaagcagauucuugaacgagcaucuacuucaaggcuugauucuaagcuggcgguggagaguaaggagucacacuugcuggaucugucacacggcuucuggcucccacuguggccguggcaaagccgagucucagucucgguguccgcucucagagguaauuugcguuuuuuccuugggugcauuuaagauauucucuuugcguuugguguccugcaauuucauuaugagauggauggaugcugugcucccgauccuguguauucaggcuuucauaauuuagagaaaauugcuggccacugucacuuuaagccucacacccccaaacuuuguuuaaacgugugcugugccucacccuggccuccacgguuccuagugucucuuguuuucuguuuggcucuuuagcccgcauuucuucugguuuuccuuuccauccacuaauacaagaucuguuuagccaaaauggaccugcugcuaaacccacacaguuucaucugucauacuugucauuucuagauguucucugacuccuuuccagucuccacgucauguuuggcggucauguaucauacuugucauuucuagauguucucugacuccuuuccagucuccacgucauguuuggcggucauguaucauacuugucauuucuagauguucucugacuccuuuccagucuccacgucauguuuggcggucauguaucauacuugucauuucuagauguucucugacuccuuuccagucuccacgucauguuuggcggucauguaucauacuugucauuucuagauguucucugacuccuuuccagucuccacgucauguuuggcggucauguaucauacuugucauuucuagauguucccucugauuccuuuccagucuccaggucacguuuagcggucauguggcuccugguucaggcuguuuccuuccucuagucugugaauaucucaagcauucuuaguuuaucuucuuuaacuuaggaucucaacagcugccuucucggagguucaguucugcugugguucugcugacuugcucacgguggcuuuuccuguaugugcuugguaauuuucaccugugagcucauguuuagaugauuuuaaugugacgaaauccagagagaccugggugugcuggcagcagcuacccagcaugcguguucucacggaguuugccaaugccauucucuccaccugggccacuucucagggcugugcuuccagcaagcggccuugaggaaugaggucaugucucuucuagucaaagugcagguguguuuacugcccgcugugaaagcagugggguucuccaagcucagugugcaucagccacggccucaaguguccacccguggggaacccaggccaacgagaggcucaugcugccagcugugccaugagaacccgggaaccucaugucuucagucaacauccgugagaugcuacaggcuggcaggucagucugcaaacagaguagaagccagaucuggaaacacgccggucccucccgaugcccgcacacagcccucguggaggcaggagcuccacagugugagauuuuacagaucaugauguagcuggcacaaacccaaacugcaaacccuugugaggggagguuuugcuuccacuucucagggcagugcuggccacccccaugcaaggccucagacagacaaacugcccuuuggacccuaucugccaguggagggagacaccaucuucaggggucccuguuccaacucuacaccucgugugggccaaggcuucagcucuugaaaauuaccaagcacauacaggaaaagccaccaugagcaagucaccucgugugggacaaggcuucagcuuugcaccauaaccugcuguucacaggggcagugguuccugcuaugggcugaugcuccugaggccagccggggcugcaaggcugcucucggaauagacgccuucagaggcugccauucugguuucagcucccucuuaguuucuggccguugugagauuucccuugcuuaucugugagcucaacuaugcaccugaagagacaccugcuguaucauauccagcauuucuagguguuuaugccagaggguuuugcagaauauccagucaaucacuuauugccaauagacuccucuguucucuugaauucugaacaaaaauucuauauaaaaauggugcaagacaaucuuccaucaucugaaacguaacuuuuugcauaauaaaaaaaacguaacucucaaccacacuaaucauagcuaucuuuaaagaauguauacaaaauaaauuaucaagguacuagaaccaucacauuacaaauuacauugguguuucagaccagccaugaccacgcugugucugggcaugacaggcaguggcucugggguguuuucaucuacuucucuccagaaggaaaggcagacugcaacgcggucauuccagugaggugaaucacuuccccacuuccuuccuuuucacucauuaucagcauaauaaaaaguaauacacuaucauucacuaagcauuuaacacauagccggccuguaccuagugcuauacuucuugucuaaauauaaauggaaugacaagcuaggugagaaacuugcucagagauccuauuuucucuaccuugauacuaucauccaucaaucaaaaggucuggaaaacaacacccuaugagcguccuccucugacgcuggaggacagcucgccucccucacugaccuugcacucucggaaaccagcaagcuuggggcgacagcucaucuccacgcaggccuuaccuauccgaaccguuccagcaacacucaaacuugucaaagaugcagucguucucauagagagagcagagcuugcugcgcagguacucguggaccuggugggucuccaccggccugcucuccauguugaggucccacaccuucaccgacagguagucucuggucaucauguaccgcccacuaugacugaauuuuacaucggauauggaugaaauuauuucugagaagaaggaccuacugcugggaucuucaggcucuucaaaaacugaaaaacaaaauaaaauguuuucagcuucuguuuaaaaaucagagaacaaaucauuuucaaguucaaguaggaaguggccccuucagagagacucuggaagggcuuggccucaacacuaggucuucugaucuuucugauucucuagguuuucugaucuucugugacuuccgugggcaagagcuucggauaagacauucuagcaccagcuauggacaagggaugggcaugagaagcguagacgcccaagucucacccggacccugaaugagaaucucuaggcaagguccugggcacugccaucugugggagcuccucggggcauccugaugugugcccagguucagcaccaccgcauuccuguaggagugucuccgcguccucauggcaccaggcccgagcacgugaaauucuaucgcauacacaucacaggaagacacaaacagcauuauauggucaugcagacacagcggucugugccucuaagaaacugccugcuuuuuggagggucgacaguuugugggucugcaggagugaccaccuugacuggcaacgcugugguccugauuuuaaccaccaagacggucccgccggucaaagccagccagccaagguuugucuccaauacugaauauacacaagcucuacugugacaaaacuggauuccuauuuucagaaagauccucccgccucaaccuccaggguagcugggaccacaggugagcaccacugcaccuggcuugugcuuccuugaccugaagcugcuuuagguuuuuucucuuuuuucuugaugcaggagccuguguuugucggcuuagcaucugaaauuaacuugaagccagcugugccgacgccaagcauuuacucaaauaaaucacucugaugacaaauagaacuggaaucugaaauuauuuacucaagaauuuuaugcuuaagauacaggccaaaugcuacgaaacacucauccucaucgcaggaauucuaguagaaauacgaauucuuaaaaacacacucaaccucaggaaagagaacaggcgaaaaggcugcugcacacgguccaugggcacauuccaccgaggcacugggggcgccgcugcacaugagcagcggcucagucuggugggauugacuggcggcuuccccaucagaggaagucacuggacgugugucuaccugcuggcacuggaggaagggucagcaauguuucaggacacugggacacgcugacuacagugcucuauaaagucaagcccauucuuuauggcuaaaaauaaaaacaaaaccagaaccucccucaccuaaaaggagcuugaaagcucacuggauuaaaaugcuagacuuucagcuaagggaaguggcuuccaauccagccaagcucaacaugaacaggagcucauuccaacagcugggaauggccuccugugugcuggcggccucagcccaggucucacgcacagaggcagaggcaacggguggcucuuggcgggacucagugcuggcagccucugaggagacacccaggcucugggcagaagugaccccgcuucucgguggugccaaaagcacacucacccuacagccauaagccugugggaagcaugaccucgaguuccacuuauuagcagcagccucugacacagccacacucggacggccccagcaaaggagggcuccccaguugugcaaaggcacuuggggaacaggaagaacucucuaagucuuuggagugucugaagaacaaguggcucuaaaugagaugcuuuaaaagacgccaggcgugaccaggugcggugacucacaccuguaaucccagcacuuugggaggccgagguagggggaucaccugaggucagaccagucuggucaacauggugaaacccugucuguacuaaaaauacaaaaacuagcugggcaugguggcaccugccuguggucccagcuacucgggaggccgaggcagaagacuugcuggaacccgggaggcggagcuugccgugagccgagacugugucacugcaccgcagccugggugacagagccagacuccaucucaacaacagacgcacuuacacuuggagugucugucgcacagggccgaggagcgcaugucacacaggcggauggucccuuugcuacugcuguagacgaacacguugcacuggugcggguggaacucggcugcagugaugacuucggucagcuccuccauguuagcaggcuugauguccacgaugucugggagugcaugguuaaggcacagugcucagcucagcugguuguuaauuagucuacauucagucacgcgaaauaggacgccaaauaauccacgcagugagguuuaagggauuagcuauuaagaaggcugguuacacaucccgaauuccaaaggagcgccugguaaggggauugggaugagcacacucagacuacagcaacgccccggcccagggggagacacagacaagcgaacaccgcuuucaucuugcugcuauuauuaauguuauacagaaagcccuuaauagcaagauaguacauacuuaaucauauaaauaggaaaaccaagcuaguaccaucugugcaaaaucccacacucccacacaaaacuacaacacaagaaugccgccaaauuccaaaagaugcugcucuuccugacaugaagagcuuauucuguguagcuagaacagauccaacagaaauccuauacagaaauccuucaacugaaaaaaauaagaaagggcagaauucagcugugggccaauucagacuagcagucccaguuucacccuucaagcugaaacaacuaagaaaaccaacauacgacauggaaccccagcucaagccacuggacagcagagggaggacggcagggacccuggagaggcugcagacgaagcaagccccaugcucccggcugcuggcuggaaaggggcccaugugaggagggcuggggccacccagacugugcacagccacagaagaacacagguucuaacuggaagcugcugcucagaugggugauuaaacacugcucuaaccuaagccaguauuuucuauuauucauuagcaaauuuagaaaaaaaaaaagaacacauaauguugguuuuucaaauguagccuauuuaaaacugccucugauuaaaccaggcaggcaguggacuucagguaauucccauuauacagauaacuuuuucccaaagguagaaagaaauuuguauuuuuagggacaaacauuucaaaucacagagaacuuacaucacaggcugcugugcagugaugguauuuacaagacuagacuccgagauacagguguauaaagggacgagagaaauuacuaucuaaagagcacccucgggaagacgccagugucccucugaggaaggauacuaaagcuucuaucugugauuucuaagugccauaaauuaauucucaggucaucugcagaaagauauguuucaugaucacuauuuacugaaauggaauuuauaugauaugugugagcauuugcaaaaauucgccguggacucgcuucuaccauaagauccaugggcuucaauauugggaccuaaaaauggaaggaaauaggaauucaaaacaaagaucacagcagcacauaauuagaacacuuauaguagauaacgaaagaggacaaguuuauauucauggcuaaguaauaauucuguacaggcaauacccccaaauaaccaauuagcagaguuaugaaaauaugcuacaaaauggaauacugucuauuccaagucuuccccuugcuuccauuaccgaggucgacauguuccugcugaagagaagaucagcuggcaggguaacaaacugcccaggcaccgaggccugcggcucccucuccuguguguccuccaguggccacacugaggcgcuggacagcaaaguccuccuggguggcucagcugcaccccucccuuuguccucuccuugcagcuagaugcacacaccucuucucacugcacuaggacuaugcuucucggugcaaaccccacaaaccuccacuggcuccagguacuggcagggugcacagcagggugcuggggagcugaggauauuccauuucuuggucuggggcuggcuacaugggcaugugcacccuacaaacauucauggagcuggucacuuauagggcagaugucuuaucuggagguauguauuauauauuacacuucacuugagguuaaaacaaaaaguagaagguaccucccgcccccaucucuguguugagugcuguggucagggaggcuuccuagggaagcccaauucgcacagaaauagaaaggacagagaggagugggcgcuggcugcaggccgccuauggucagaggugagagcucaggcgugaggaauagcaucacacaugaaaaaaggaaaaaggccugugucucacuaacauccagcuggaagaaaaacauaagcuuuaaaaucaaaacaaaaaauuaaugauaguauuuuuuguuauucuuguaauuagaaaccaaaagggagagccuugaaagcuuaggggaaaaagaaaagcucucaacugagucuugucuggcugaauucuguaaaaaaccaacuuggaaaaguguguguagggaggcuucccucauuuuaacccagguagugcugaccacacccuuggauucucuagagcaagaagagucaguucuaccaaguucaggcuuaaaaacacacaccuaccccaauccucuaacaaauuucccauuaaucaaaacauaugauagcugcaauacuuacaaagauuccuucuuuuauugaaaacauuuuaauuugcauauaaaauaauuugcuuucauuuuuagagauggggucuggcuauguugcccaggcuggucuuugaacuccugggcucaagugauccucccaucucggucucccaaagugcugggauuacagguaugagccaccauaccuggccaagauuucuucuuuuaauuauaucccuuuucuggcacuaaaauaauuuaagagcaaaaauuuaaaaacagcaacaugucugacucuuacccaguuaggcucagauacauaaauagcccacucugaacuguuagagagguaagaucucaaauaccgaccuaagucaauguacagaauuaccugucuguggucucuuccccaugcaccaacuaaugaaauaacuagacuucucacacaccuucaguagggccaccaauuauacccguuuuauuuaggcuaaaccuacaaaagcagccuugaauaaaaccaagacugggccuaguaaaggccuacuguucucccaaaaugagcacgugagcugauggguuguggcagggucugaucaggaggaacagggguuucugaggguggggugugcacagguaacugggugggaggugguguuggcugcagaagagauggacaaggcuggagggggucaagugcccacccucgggggucccaucacacuucuacuuuaggaucagcaguuucaugaugauggaacugcacaacucguguuacugucacuaaaagugauuuacacuaauucaggggugcaaaggcggcagcacuguguaucagacaucaccaacauuuuggaucaaaacaucuugguucaaauuaggacccuauaaacuagauuuucagcaaaugccacagccuuucucgcuuugaugaacucauaggaaauacggugacaacaucgaugugagaagucugaggacacuccuccugaggaaugcacaaccccagguguagccaccccacacggcaaagcuggagaaauggcaucagaacagacccaacaucacucccagaggcacauguguuagggaaaggcuucugcgguacagcguccucuguagcacucuccaagacuaauguggaaugggcucacucacucagucuucacuugauaaacaauaguguaaaaggggcugaaaucucauuaaaaaccaaccaaaccacccaacucaaccacccaccccccgcaaccaaaccacccaaccacccaaacaaccaacgguuuuccaaucuaguaacggcacccccuugggaccaggcagaguuuccuuccaggggacacaccucugcacaggugcugguuucucaccaagacacaccugggcucgagcccaguuugccggacacccuucaccauguuccaucuaauuuaagacaacaucaguggugcguagcaccaggccaauuauaagacauugagguuuugaguuuuagccgguuucauaaauguuaaaauaugaaaaaauuuaggcaucagaauugaugaaauaugaucauuucauacuaccaacaauggagcaaauaauuuaacaauuaaaaaaguaaugaugcucauggauggacagguggagaguucugaaccaucagcaucugccuaaaccaaccccaaagaaauuccccgagaagcguccugaauguaccuguggcccacagcucaucuuucgaccugcaaccugugcuacugcaccugugagguguucugaauuucaucugaacuccaaccucccaggugcuguucugaaccuucugagagaagggugguugcuauguccacaaagauuucugcuguagaauuaaauaugaguuuuccccuuaguauugcuguguuuccuaaggaccacaugugacuuucugccuuugugaaaacaggagaaagaccuugcuuuuaaacacacacaugagugcaaacgacuuucaggaaucacgaggcagaccucacagcagaccucacaguacuccaccgcgcagcacucuccagacagcagacugaaacguuuauucuuaacuucucaacagcauuggauaaagcaaaggcaacguguacccguagcgccgugauccuaaaugggucucgaagucuuccaucuucgucuuucagguuauaaccuucugcucuuuuaucccguucacuuauuuuccauaauuuuauaguuuuaucugaaaauaaaaaccucauucuccauaugaaaagaaaaacuauaacaugcaucacuacuguuugaguacugguauuagaaagcggugugguccuauauuggguuauaagcuauggggucucugaacaugaauauuuccaauuggagguguuuuguacaauaaagaaagaugugcagacgugcagaguaacagcauaauaaagugcacgugugguuuuuguugcauacuuugaauuuucaaccuaucacuugcuacccuagauaacuuacccuccccccaaaauuuaaagcaggaauaacuucuaaaauaaaaaggaaucuacacacacacagaaaauuaaaaauaaaaaacuaaaucaaacagccacuuagaacacaauucuuaccauuuguagacaguagaaaaugagcagcauucuguugugguaaccaccuaauuuuauuaauuuuuuccucaauuucuagacuuuucaaauagucaaacuccgguucaugacuuugaaaggugcuguaaacauuauauucuccccuagaaugagggcggcuuuuauucugcaaggaaacaugagagcuguuuuaaugaacaaagcacaguguagagaaaauuucaguacuauaaauuugaauaucaaaugaccauacauauuuuuuaaagcuaaaaaauccuggcucaaaaaaaucucagaugaaacucagggaaaaaaaaaaaaaaaagaacgaacuugauuuccgacucuucgacuccacuucuagguaugcaucuggagcaggucugccgaaugcagccuugcuguauuuucuggagcaggucugucaaaugcagccugccguauuuucugaagcaggccugccgaaugcagccugccguauuuucuggagcaggucugccgaauucagccugucgaauguagccugcuguguuuucuggagcaggucugcugaaugcagccugccguauuuucugaagcaggucugccaaacgcagccugccguguucucuggagcaggucugccaaauacagccugccguauuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugccgaaugcagccugccguguuuucuggagcaggucugcugaaugcagccugccguauuuaaggcaaguguuaguggaacacagucaggcccaugugugcacauacugucucuggcugcuucugcaccaucuggguagaggugagugguugugaaaaggccgcaugagcuauagaggcaaaaauguuugcaaucuggcccuggagagaaagugucugcugagucugcucuagaggagagccagcacgggccugaggagcgugacacagcgauguggcagcuccaacacagugguagugaaccagacgccacacauaugccaaccagaggcgaagggcaacaguaagccacagggccaugcagggaccaccacgaagccgcugagauaaaugagccagcacagacaaccgcacagugcugcacaagugaagcaggcugcacaggugcccagagugaggugcugcuuacguacguacagaacaagucuguuacagaaguggagaaacaugcuugggaagacauaugccaucuucaaaaucaugagcaacucugggaagcuagagggagagugaaaaagaccaggaggaaaguagcaggcugaaauggggaggggacaacaggagcuucaucuguaucccgagcauucuccuuccuuugaugaagggauaaccucugggugguggguuugcagguacaucuauauuaaccucugaaucuucuguaugcccuaagugaaauuuucuauuaaguauuaaauauuucauaauucaaaaucaaggacgccaguacuuucauucuugcucuauaaccaauaucuaauaucuuagguguuuaacacuuuaguacauaugcuaaaggaauggaacuaaacgaacuuucaagucuaaacagauguuccuugauauuuccaaucugaucaaguaucaggagaagacaucccaagaagcuacccacacccgcacugcugcagaguccaaugugcagggcauuccuuccaccgaagccuccacgggcagaagcugagcgccucgccugccccgcgucgcugcacugagucugacgugcagggcauuccuuccaccgaagccuccacgggcaggagcugagugccucgccugccccuguccgccgcacugagucugacaggcagggcauuccugcauuccuucaaccgaagccuccacgggcaggagcugagcgccuugcugcugacugccccgcgugugcugcacggggcagauguugaaacuguucuccuuugacccucuccuaccacucuacaaaaaagcacagccccucaacagacaguucuauuucaagggagaaaaguggaaccaaauuauuuaaaaagaaaaaucuguauaacuaaauuaguccuaugcccaagacauucaucuaccaagaaaaaacagcggaauagaagcaaaaaaauaaaauguccaagucaaagugcugccugcacugcccuggccuuucuccuaagagccagaacaagaauggucccuaggcugcaggcuugucucucugccaugaacggguuccaacucccaucccagucaccccaaacccaagcaaccccucagccuucuccaacacucccagaucucauggagugccgcucugcuaggagagaauucuaaaggaagccucauggggacacgggcaggagagcagggaaguaacacacaggaagaggaggaagcgagcaccuucucuuuuuggacgugcugauuucugauuucaccugauuccuggcggcuagagcugagccuggagggcagugggccgcacagccacacccauacguucugugggccuuaguuuuauuggcugggcuuuccuguaagacuuaaucugcacagaaaaguaagaaaagcuugaaacucaaggugcugacuaugcuucccaccucgucuucugcacagccagagcuucccaacgggccucuauggaccugacuccugaaucucaggcccugcaccuuccacaaucuggugcucacucacuagccuuccgaauccuccacgcuccuucgauucuaagacgcacacguggacgccugugaaccuugcugcagcuucuaacugggagcuggggucgcuugaugggcagcagcuucacccucuuggcggcugcaacaccauccgcggccuccggccauggaugaacacgugcacugccgcccuuacccacagacacacucaaguccacagggaagggcacauggggcaaccagccgaaugcucuaaaauggauggaccgugaaagccuuucagacgugaaccgaaauacgaagaaaaagaaaaaaggcugccugggguuugucaaguugcagcuggcugaacaacuucaguagggacuugcuccuguauaaaucugucacucacauaacaacuucaucuuaaaaaagcacuuaacacucuauaauacccaauaucuuuuagaacgagaugcuugacuuuuaucaggguuuguuuuauauuugagacuauuauuauuuagguuaagcaacgauucacaaaaacaagagaaauuccauuuucuaaccuaaaaucuguuaggcagggaugaggcaucuucccuaaggcuaucgcuacaaugacagacuuuuuaaauaagcuaaaagugaagucuugcauuaagauagccaugacucaacaauuuguuaaaaaauccuccugcuggccaggcgugguggcccaugccuguaaucccagcacuuugggaggccgaggugggcggaucaccugaggucaggaguucaagaccaaccuggccaacggugaaaccccaucgcuacuaaaauacaaaaauuagcuggucgugguggugcaugccuguaaucccagcgacuugggaggcugagucagggcgaaccacuuaaacccgggagacagagguugcagugagccaagaucacgccauugcacuccagcccaggugacagagcaagacuccaucucaaaaaaacaaaaacuccuccugcuuuaaaaguaacauuuaaacaccacaacccacuuuuacuucuguugagaaagguaagguguaugguucuuuuuuuuuuugagaugaagucucacucuuguugcccaggcuggagugcaauggcacgaucuuggcucaccgcaaccucugccuccuggguucaagcgauucuccugccucagccucccaaguagcugggauuacaggcaugugccaccacacccggcuaauuuuguauuuuucguagagacaggguuucuccauguuggucaggcuagucuugaacuuccgaccucaggugaucagcccaccucggccucccaaauugcugggauuacaggcgugagccacugcgccuggccaagguauaugguucuuaaguagcauugugugauauucuacuucugagauaaaaaugcaaaauuauaaauguaucaaacugugaagaaauauuaacgauauacuuauuauucacaaaaggauuucuuaccaucccaaaucagagaaaacaggauuuaaaaaaaucuuuaacuaccuggacauaaucaaaauaaagcugcaacagguauguuuugauaaugaaauugguuagcaccugucaauuuuccucauguggcccagggacaguccuccuccaggcuccccuuccuggggggcagggccagcacuuccuguguacagaucugcagagaggggaaccagggcccaccaaccucuaaaccaaaguucgucacacaaauuuagagaccagacuuuggagaugauaaacugucccuuucaucuguuaggaaacucagagacaggaagggcaagggacuguauuuauaaggaaaaggcaggacaaauauuucagaccccaggcuuagcugcacagagccaggguucuugccaggaauccuugacuaccaaaucaugaucuugcuuccuuuaucacugcucauuaggaccucugaggaggcucaacagaaagaagagggagggggcuggcaaggcaucagugaaaaggcagugccgugaccgggaagccagugcuugcuuaugagcugugggcuccuccaaggcccacacucugaagguucccuucccuccagacaggugaagccuucaagggggcauggaggagugagugcugcucaccucucccugaagggaagagagaauucacaccccugccagacuucucugcaggaagugcugagaaagcugcucacacuucauggcagggcaggacggcggggcugggccaguaccugcauaggcguauaaagggauuuucagagagagccgcgugaguucuuauggaaugaaagcacauaaaugcaccucaccaccacccugcauccuucaugggguccccagcggaaucuccucccuacucugaagacaaaggccuuggagacuucaccggggcucagcagcugaggccagaacuuagauaauuucugaaaggagauucuguauggcuaaugugauggaacugaaucuuaaugaaaugagacaaugagaaaauaauuuugcuuccucccuucuaaguuauaugcgaaagguugaauaauugcauuugauuuguggacugaaaauuacugaccucuuguucacgcugaaaaauaacaacucugccgcccuugucuccuguugcaagaagaucuccagaguaauuaaacucaacgguggaaaugauguccgcu

SEQ ID NO: 191811 - RNA, 2735 nt, Homo sapiens
cgccccgucugccgggccaugguggcgcugaaggguguccccgcacugcugucccccgagcugcucuacgcgcuggcgcggauggggcacggggacgagaucggugagcgcagcgggccggggccucggggagcaccccgggacaggcaggagggcgaggcuugcacggggacccccgggccgggaagggccgcguccuggggugugggcguugcucgggccucccuggcuuccgggcaggaagcccccucccccgcauucuuuagggaacugagaccucguggggcucugggcggagccggcccgagcuucucccggagucccuccccagacggcccgagagcccucgcgucugggcugcccccgaggguucggcgcuuuuucuucuccuggggccuggggucccggggcagggguuggguggccgggggccugguccgggcaucgcgggcagccgcgcguccucuggccccuggggaggcggccggguccgggucggcccccuggccuggucagcacccgacagccucgcgggcagcuguugacgccucucugccucccaggcagggaccuugcccuccccaccuccccgcguggcuuccagcccugcggaucugacugcggccggucggcggugggggcgcccaacuggcugaccugagaccucuugugacccacgaucugccgccaugacugggugggaggacgggcggcgccgaccccgagggcagggauaggugccgacacgggcuguccucccggcuguuuaguucuugcggacuugaacuucccggccuccuccaucugccagugugggcccauggagauccgugcagacggugagcgagccccaggucccccagggcagggcgggcgggugagcggugcuccuggcucugaggcuccucuguggccugccguggccccaaguccaugcuugcagugugaagggugcagacaggcaggcgggcgggcgggcuggagacugagugcugccuccucugcccuccaggccugggcaucccgcagcuccuggaggccgugcugaagcugcugccccuggacaccuauguggagaguccggugagggcugagucgccccugcacccugcugcuccgugccucaguuuccccuuuugcgggcuucauagggcccaccugccuuggaguggggggaagccauguguccccaaaggggcccugacccucaccaggggagucccgaauggucaccugaccaggaaggcuggcagugcccagggccccagagcugaccccucccucuaggcugcagucauggagcuggugcccagcgacaaggagaggggccugcagaccccaguguggacggaguacgaguccauccuacgcagggccggcugugugguaagccugcagccccaguuguggggaaaaggccagggacccucugucuccuggaggcucaggaggagccaaagacagagggucccaagcucuguccucaaguggucucccacccaucacccugagaaccccggaccacuggcacuccuucaccagccagguggaagaggugcaccugggcaguguggccccucuuccucugcccccgagcuuuccaccugcccugccccgcccaggauccugaccugccagguggguugucacccaccacagccugugaguggagccugggggacucaggaugccuggccuccaccuccucaaucuccccuggaggggugcccccuggucccaggucucucgccccauccuggcuaugguuggucagaggcuuagcugggugcugugucucacucagcccucuccacaccuugcccugcaaggggacaggcccauuuuccugggcaacccacuggcaggucuugagcagggccuccauaaggggggccaggggcucuuguccugggcaggggacuccccccaggacagcuggcaggggcucgacagucuacugagcugucuggguggccccaggucaggcagagacccaagcauggcagguuccucguccaccauguccugggacccccuguccuaggccuugggagccagaggcugagugaccguggggcccuugccgggggagagcccaagaaauggaaccccacuuccuggugcccucccugcuuugggcccuggggaguccagggcuggcccaugaggguuucuuggcaggguucccuccaacccugccauuuugucuuccagagagcccuggcaaagauagagagguuugaguuuuaugaacgggcuaagaaggcuuuugcuguuguggcaacggggugaguuccagcuggcucagaccugccccauccccacuggggccucaggagcugcccccauccccaccggggggccucaggagcugccccuacccucuucucagcuucugccuggcugaggcuagacgucccacagaguggagagaccagggaggaauuucgggggggcagggcccccauuugccugagcaucaagugggugaagguggacagggucugcucugucccccagaugcugaagcagggucucggcacccuggcccugcagcccagcucagugcugggcuuggcuccucugcagggagacggcccucuacggaaaccucauccucaggaagggggugcuugcccucaacccccugcuguaggccuggugaagaccaccugggccggaagaggaacugggggcacccugagcuccaguaccaccacucacaacaggccucc

SEQ ID NO: 191812 - RNA, 10922 nt, Homo sapiens
uguaaucugaaucgcuaucacuuuaaucagcaucuguaugaaggcagcagacagcguuucccucagagcagccccauucuucagcggcagggacacaaggacccgcaggccccgcuuuccguccgagcacagcaugcccagagggaccagcgggggcuccucagcagaaucuuagauuuagaaggugcuccagucaggacccucacaggcugggugacgaaggcugucaugccgugagaggucgggccacgaccacgcagcaauuggagaggaacugcacaccacggacacugcucuugaaaagaggaugauuuacuugcuucuaaaacugacaggcugcacuuguccucuccaagcagaggugugaagcaggggcagcugguucucacuggucuuugaaguuggccuuucucuuuuccacaaacgcggucaucccuucuuuccggucauccuggcaggaaaaggaacagaaacagagcuggacgcgcaguauccucacagagccugaugccaauguccgcccgucucucccuggcucugccucacucaugcucacaggggcccagggggccggggaggggacucagcggcaggaacaccugcccaaucagagcugggccugggcgcggggauuuucacggccucucucuaccagucuaggugacggucauucaggagccacuguguauguccaacaagcucacaucuaaagagccucagaugcacccaucuuggucacucaccaugucaucaacuggaugauggguggccuguaucaggggcuacucuguguuggaguaggacgugagaacucaacucugcaucugcuuuucuuacacugugugcacguguguccccaggugugcgcgcgcgcacacacacacacacacacacacacacacgcaucuguaccccuuccucaggugcccaaaccacuuuuaauuuuuauuuuauagaacaauuaaaacaccgaaguaugacuuucucccagugaaagacaugaauuaaaaugguaaucuggccgggugcaguggcucacgccuauaaucccagcacugugggaggccgaggcaggcagaucacuugaggucaggaguucaagaccagccuggccaacauggugaaacucugucucuacuaaaaauacaaaaauuagccaggugugguggugggcaccuguaaucccagcuacucgggaggcugaagcaggagaaucacuugaacccaggagguggagguugcagugagcugagaucucaccacugcauuccagccuggacgaccgagcaagacucugccucaaagggaagaaaauuaaaauuaugaugguaauuagaggaauuacuuuaaguuacuggcagaaaucuuauaaaauauugcucuaaagcuucagcuuaucuuauuagaauacauuugagccuauuccaaauaauuggaaugaucuaaaaaaacauggguaaaaugaguuacauuuuuuuuuucagacagagucucacucugucucccaggcuggagugcaguggcgugaucucggcucacuguaaucuccgccucuggguucaagcgauucuccugccucaacuuccagaguagcugggauuacaggcaccugccaccacgcccggcuaauuuuuuggauuuuuaguagagacggguuucgucauguugcccaggcugguuucaaacuccugagcucaggcaauccacccgccucagccucccaaagugcugggauuacagggugagccaccgcgcccggccucauuuuuuaaaaaagucuuuuuuuugagacggggucuugcuuugcugcccaguuggacucgaacgacccgccucagccucccaggaagcuggggcuacggaugcucgacacccacccggcugaaacugcauuuucaauaaaggagcugcuugagggugcaauucacagaccucacauaacaggaaaaacaagaaaagccccuguaagguuucuguacuuuugaacuuguacaugcucuacuuuuuuccuaacaucaagacccacugauggaaccaaucugaucccguuaaaggugaggcuggcaguucugaccagaaagaaacgauacuuaaugauaaaauuuaaaaggaaauucccagcaacuugugugacuggaauuugcuugauucuccgguugaacacuguuuacucacaguggcaaagguugaauaaaagaguuucuucuccaacuuacuuccuucuguuaaugucauuucaaaagcugaaaaacaaagucccagaguuaugaacggagauauuacaugcagaacuuuuccugcacggugacaggaagcccuccucacugacccaugcacaacugugcuuucgacguggcccagcccugcacaggcuuccauggugccgcccuucucaaaggcacugccccagcggagaccuggcagaaccaacagcucugcuauggcccccaaacgucacacuccgguagcccacggccccaagaagggagaggaacuggaugaaaggugagauggcaaacugugcccuugaggagaggcugugaggcggcaacggggcugcaaacagagaaaaauaaccaaggaugaaaaccaggaaggacagcacgagagccagagcugggcgcggccggcaccaagaacgccuuuggcucugcucauuccaggcccguucuuugcacgaggccaagcagagcagauccaggugcgcagauggaggcaggcgcuguggcuccagggcuggugccagcauccucucccaggggagcacgaccuugccaaacaccucgggcgacagcagccuccguucuuucaaaaugcucuccucacuguauccugccucaagccaacggcaagcccgggggacggccacacccucgagauaaaugcacucagagagguuaggggaccugccuggggccacccacaccuguccggacucaaccagcuaauaaccaucucauuccacaugcugagaauaaauugugacauuaaaacuugagcauuucugaggagggggagguucagauccacuucccuggcagagggagaacuaaaagggauccaggccaagaacgaacagcguggugcugggcugcaagccugcguagccaccugccaggcgcacacgcagccgccaaccccaggucucgggaggugaaccgagccuccccauggcagagaccauuuuacauuugggaccucugcucccuucucagccuuucccugccacugccagcucuguacugcccucaccucccaggccuggcucaguucuugggcccugguacaaaggggagcugggaacaucucagcggaguuccugagugcgugaccagaaaccacgacucuacagacagcagaacugagacacugagaagcauuucugcccaggagggcuuaaggcauauucauuuggagccagaaagccugcugcugaggaaugcuccugacagccacggagaccucuccagugucuuccuggcagauccccuaccugcauucacugauucuuuggccaucgcuacuacaauuuuagaauugcuggcaauuuuuucugcacacuggauggcuucuuccaccagugucucaacaggacaaaucuugcugacaagaccugaaacacaagaaagucagugagugaugugcagaaacagcacuugucuaucccuucucgagugaguggccgcuggggagcagcguggcuggagcaccccagccucuggacgcuaagcaagggcggcuuccacacgggaagugccgcacgugccccuuccugagugcugagugaucucggcacugcggucacugugcucucagacaugugggccaggcuggccacagcuccgacggcagaggcggccagacacggggacugugaucaccaacagggcagugggaggaccggccacugaggccuggagaugcccauugcuuacacugcauuuuggggacgcaauugcugggcuguuauucuguaccagauacuuacgugugguucacuuccguacauacaguacuucaaaauguagaaacaaaaggcagucagucuucucccagguccucaggacccaaaagcucaugcaaccaccgugggggcacuuggaugcugcccgggguuucuguggggcucccacgagggggacaccuggaugccgcccuggguuucuguggggcucccccaugggggacaccuggaugcagcucuggguuucuguggggcucccacgagggagacaacuggaugcagcucaggguuucuguggggcacccaugagggggacaccuggaugcugccccggguuucuguggggcucccccgagggggacaccuggaugccgcccuggguuucuguggggcucccaccccggguuuccagguggcucuugcgggcagccccaacccauaccugcuugcuuggcguccugggcugagauccggucaccagugaggaccaucuccaucgccagcgacuucccaacagcacgggugagucucugggugccgcccgcaccugcagggaggggcuggucauggcuggcacugugaugagugaacccaagaagacaucacagcugugcagccagcaaauuccaaggggcuuaagauaggcccugagacuagguccaggggucagaggccaggcagcacaagagcccgggaacaucaggggcagcagccccuuuucaagcucaggccccacaucuggugcuccccugugggcaaaggauuaccuaggugccgaggcaagagacugaaggcacaaacuguuucgguauaauaaagaaaauaguuagaauaacaauaguuauaauacaaauuagauauagagaugaucauggacauuaucaaucauuaguauaaacauuauuaaucauuagcucuuaauauuacucuuuguuguauuacuaauauaaccaagaaauaacuggcggguauagggucaggugcugaaggcacauugugagaagagaccuagaaggcaagaggugagccuucugucacaccugcauaagggccgcuugagggcuccuuggucaagcaguaacgccagugucugggaaggcaaccauuacuuagcagaccaugaaagggagucuccuuuccuuggaggagucagggaacacugcuccaccagcuucuugugagaggcuggauauucuccaggccugcccgcagucauccggaggccuaacccccucccuguggugcuucaacgaucacacuccuuguccacuuucaugcuccucccguacuccugguuccucuuugaaguucguagcagauaguggaagaagaaagagugaaagucuuaaagucuuugaucuuucuuguaagugcauagaagaaaaugcugacauaugcugccuucccucucugcuucggcuaccuaagagggaagggcccccugucccaugaucacgugacuugcuucaccuugucaaucacuuagaggauucaccguccucacccugcccccucguccuguaugcaauaaauaucagugcgcccagccauucggggccacuaccggucuccgccucuugaugguauuggucccccaggcccagcuguuuucucuuuaucucuuugucuugugucuuuauuucuuacaaucucucgucuccgcacauggggagaacaccugcuaagccccguagggcuggacacuacacucccccaacacccugacauuagaucaaggugaugacucuguagggcccuccccagccucuguggucaacauauuagaagcuuauaggccucccugaccccaggcacuggucccuuauaguagcagcuguucuagggaucagacccgaaacaaaugcaccgagcucacagcuccaggccucagaaucggccucguccaacucagagggcagcgaagggcacccugagugcagcugcuccccucagggucucagcucccuccuggcugcucggccugggcccacccuuccuaccaggagaacccugggguuagaggguguugcuuuuugccaagagcccaggcccuucucacgggccuggguggggggucugacuccccacccugaacccaggccaugugaccuccauggccagugagauggcagugugcagagcucccagugccacccagggucaccauguucccucucugccauggacacgaaucacaagcaagaacugucaugguuagaagccagcguuacccaggaccagccucucccaacaccaucagaugugggcacagucacagucccgggacucuaaggccccccccaagcucugucacaaccacucuagccuccguggcuguccacagagggaccacugaccagccauggggcuguccauccagggccucuggucagauaugagcugugggcccugagacacaggcagauuuugaguaauuaccuaaggcaucuaugccagagacagugucacucuuuaccugggaugguuccuauuaagaucuccggcugugcaaacugggccuucucaccggcauagaugauaucacacaucauggcaagcucacagcccccgccaaacuguaaaacauucggcaucaggagagucuuaccaggggaacccagucagaaaucacucugcuugcuuauucaaauuuuccauuuaaaagaaacaguguuggggguaugacaaagacuaacaugguggcaccaaacuagauaauuguuaugauaaguuaacuacagaugguugaugcuguuuaccaggggcuggcaaacauccuguaaaggaccaugagggucuuacaggcucugcugccacgacucaacucugcugcuguggccgaaaugcagccacagagacuaggugcacagguggguguggcugugccgggaaaacuccauccgcagaccccuggcuuacacggcagggagugucaugaaaugaucacaauccgcagaccccugguuuacacggcagggagcgucaugaaaugaucacaauccgcagaccccuggcuuacacggcagggagcgucaugaaaugaucacaauccgcagaccccuggcuuacacggcagggagcgucaugaaaugaucacauugccuucccuauaggccaagaucagucucagcacuucaaauagucccaggacacagagcuuucaaggggagcaaaagaagcuaguuuauagauguagccaaagccaacaccucucuucccccacccuggaagagaggcuugcuggggagaagcugucaggugaacagccacgaaaaaagcagaugccaggagguguccucuccacacaguuccuggcucuuuagcaccaugaggcaggaaaggaggcugcuggccugggaacuaaaggccucuucaaaauaaaaaucuguuaugcuguguaugcacagcacgguuccuucaaccacgagaggaggagacucuuggcagcaacacucacggcauagccauugacagcagcgaugacuggcuucuugaccugggugagguggucccagugcuucaagaacuugcuggaguaacaguccuggaaacucagguucugcauuuccuugauaucagcuccagcuagcaggaguggaaaggagguuccaguuaccagagagcagagagcccacccauccuauaucucucagaccaacaaggaacuucagagcacaccagacacaggcagugggguugcugggcacggcugacaccaggccacguggacagcuguagggacgcuguaaugccagcuagaacagaagucacgcagaggggcccugaggcaggcagcaggugcaagggaggcgcccacagaggcuaggcauauuugucagggcauaagcccuugacacacacaaagccugacugccaaggaccuaaaccccuuugaagaagcuguuuugcugguggagcacaugcagcucucuggcauacacaaagcugcucaugcaagccguucccaugaccgucuucacucgauauuugaggaaguccccagucgcaugccucugccaucacagaggcgcaaaucugucuggaggcuucucccaaggccauacgugccucccacaucugcccagacacaaaggccucugcugccgcgcguaccugcaaaggccuuauccccgccggugaggacaauggcccccacggccggguccuccucgaaggucuucagggccugguugagcucgucaaucaggccaucgcaaagugcauugagggccuuggggcgguucaguuggaucaaccccacgguguuauucuucccucuuuuuucugcgaugauguacucaaaguuagcaccuggagcaagaaggcaaaaagggguaucuauucacacagguaucaaacuggggagagugggggaagggauguggccccaucgguggauacagugugaccccaagaggcccucugagggcucccugccgaguccucaguggcuccagguguagcucucagccacaaggauagaugguagccuugguaccauucucucugcuuucacauguguuugaacauguccuaaagaaaauccccgggccgggcgcgguggcucacgccuguaaucccagcaauuugggaggccgaagcggucgaaucacaaggucaggagaucgagaccauccuggcuaacacggugaaacgccgucucuaccuaaaauacaaaaaauuagucggguguuguggcgggcgccuguagucccagcuacuggggaggcugaggcaggagaguggcaugaacccaggagguggagcuugcagugagcugagaucaugccacugcacuccagccugggugacagagugagacuccgucucaaaaaaaaagaaaagaaaaaaagaaaaauccccagcacagaacacagcccacagccgcuuuccuucuccuaauaugccuuggucagcucuucccaggacaccacucuggagacagcccuggacucugcugagacaaggcaccaggaaacaccuucuuucaacaaaugccaacaggugaggggguguaaggcagcuccuugcacuugguaccgccccagugccaagaccucuggccaacuggacgcagggugggggaugugaaaauccuggguguuccugcagcauuaagaucaggcacagguccggagcagcaggccagcccgaaaaugggagacgcaggcgcuucucgguuggccugcugcacaggaccugcgccugcuggguggacagcaaggugggaaggagacaaaggacaauggcguuccaggggugagaaggugaaccugaaaagacaaagguagccuguguguuggaugcuugccuccguuaguggcagagcagggaucauagucccugugcuauggguuucuuuuuuuuggagaccgagucucacucuauugcccaggcuggagugcaguggcgcaaucuuggcucacugcgaccucugccuacaggguucaggugauucuccugccucagccucccgaguagcugggacuacggucacacaccaccacaccuggcuaauuuuuguauuuuuaguagacaugggguuucaccauguuggccaagguggucuugaugaccucaggugauccaccugccucagccucccaaagugcugggauuauaggcauuagccacugugccccgccguauccuguggguuucuagggguaacuggaagaucacaggugaagugucuggcagcagugcccgccaugcaagauccaggaaagggcugcugucaggguggagaagccgaaggccaaggagagcauggagaugaaaccaacacaacucagugguccacugcuacacagggugagggaggaagaggaagcaagaguucuuccccagcccaaggcauggcccaagauuccucagauacuagagccggugauggccgcucaugaguggggccccgggugagccacgagggaggaagagggcagcccccuguggcuggggaggaggugucagcuuuucccuuaggacccucugagggguggcccuggucaggaggcacccaggacaaaaugcaccugcaucuccuguucucgggcuggccggcugcacaggagcuacgccugcucuuagagccgagggaacaccccggauuuuuacaacccccacccugcgcccaguuggccagaggucuuggcacuggggcaguaccagccagccgccgggccucccgcaggacguggccuggugagaguggccuccugcagagccaggcagggggugggggugcgggccagggucagguggguggugucggugcgggguggcgggugguggggggguguuaagccugggucaggcugugggugcgggucagguggggggugcagcacuaggcgagggggguguugcaggccugagccaggcaggggcugcgggucggggucaggugguaggugcggggucaggcaggagagugcggagucaggcccuggggaugcgggaucggacggaagaggggugcggggucaggccggggggugcggggucaggugggggggugcggggucaggcggaguggggugcggguaggggucaggccggagggugcggggucaggugggggggugcggggucaggcgggggggugcggggucaggcggaguggggugcggguaggggucaggugagggugcggggucaggcggaagagggguguggguuggggucaggugggggaugcggggucaggugggaggggggugcggucugggaucuggucugggcgugcaggucggagucaggaggagauucgggccgccagcucucaccgcgcacucacccgaggcgaagggacgccaggcgggacagcgaaccgggggccucagcgggccgcggacgcaggacagcaggacacgcagggcggccauggcucucuggacuccucgcccggccccgcggagccgcccccucgccuauagccuuucagggcucgcuccgc

SEQ ID NO: 191813 - RNA, 26554 nt, Homo sapiens
ggaagcccgcagugccggaggcccgcagcgccggaaccucagaggcgggucgcagcggcgcagaggaggucagcugcgggagcguuuccggggacggugccgccaugagauugaccccgcgcgcgcugugcagcgccgcccaggccgccuggcgggagaacuucccccugugcggucgcgacguggcgcgcugguucccgggccacauggccaagggugaggcacggcggggaggggcaaggucaugccuacggccgcggcgccucugcuucccucccaccccgguuucggccgucgccugcuucucccggucguucugggcuggccccgccccuccucccuugucuccccuccuuccccgcucucacccgcucccggagccgccgggaccccuuccccugcgcagcugcgggagaggcccguucccgcgagugcccccgcggcgcagccucggacccagggccugcuugaccuccuaccucuggcccgccgccccuguccucuguucccagcaaguuccuucugcccuuuuaaucccccgaagccuccguuuccacauguucuugacaagauagacuuuucugagucuuuuggggacuaaaugaaacaguggguaugaaggcaccuguucaguuuuaacugguaucuugagucguucuccugcuuaacgucuuugguaauucuuacuguuugucacaauucggccccaagaagaccucuggggccagcccagcccgucuagguguugugauggccacuccugcgucggcuccgcguguacugggggccgagggggaagaagggcccgugugggugacugaggcuguguccucggucuucggauaacacuggaggggaagaaagcuggaagcuuuguuaucuugguugugugugguauuccugguuaggggacuaucgucaucauccccgcgagguagcaggggccuaaugagccaguguuacucuguguuauagcccagauuaagacccguggaagggcccggcccgguggcucacgcuuguaaucccaguacuuugggaggccgaggugggcagaucacgaggucaggacaucgagacuauccuggccagcauggugaaaccgugucucuacuaaaaauacaaaaaauuagcccggcaugguggcgcgucccuguagucccagcuacucgggaggcugaggcaggagaauugcuugaaccuggcaggcggagguugcagugagccgagaucgugccacugcacuccagccugggugacagagcaagacuccgucucagaaaacaaaaaagcgacccaugcacguuaaauauuccacccagagucagccaugagucagguggugaagaccgcaucuggcuuuugacacauggcccacccuguggcagggugccucccagucucccacuccgagggugcggaccuuggaggaggcgcucagcggauguuaucuguuaccauuacuuaguacgcuucccucagauauagucuuuuuagguuauuuaugguggcgugucauucuggacgguucagcuugaaucgaucacucuagaaagguugugagccccuucgcugaggcguccuucuguuuuccagggcugaagaagaugcagagcagccugaagcugguggacuguaucaucgagguccacgaugcccggauauccuuucacagagcaggggaggccccucugccugaagucauauuacacauuagaauuaccuggggaggcuuuuaaaaauaugaauugcgaggccccuuucuagaccaguuaaucagaaucugugaugugggguccagacugcgugucuuugaaacuucauuguuaauacauauaucugcgucacucaagccugacgguacggugcagcaguggaauccucuagaugggcuaugaaacuguuuaaauguuccugccaacuggggcuuuucuccuguacuugaggaaugaauuggcaggaugugaugauucguucacugauggcaagaaaaaaaguugguuggcugguaaagcuuuggaggaauuuuuaccuuaauuuugccacaucccacuuucaggccgcaacccucuguuucaggaaacccuugggcuuaagccucacuugcugguccucaacaagauggacuuggcggaucuuacagagcagcagguaaaggccuuucucucagacgccuucagcaguguggcuguguuuucccgaggucgcuuguucuaacggaagaguugccggacgcacacuugucaguuugcccaggcaggcucugcuuuagaaacagcccuuugcuuugcagaagcgugccagcaucguuucucauauggcgugcccccaucuaaugugugguucgugaccuggacacccagggagugcacgucuccugugggaaguggccagguugugcugccagagcccgaguggucagugagugcgcauugugggcagcaagccacccaggugccgaggcaagagaccgaggacacgagcuuuuccaguguaauaaaacauaugaaauaagaauaguuauacuagauauaggucauagauaugauuguauaugaauauuacuaaucauuaguuuguagcaauuacucuucauuccaauauuauuauaauucuugcucuauaaucauaaccuaggaaaaaccaggccauacagagauaggagcugaggggacauagugagacgugacaagugugugagccuucuguuaugcccagacagggccaccagaggacuccuuggucuagcgguaacgccagugucugggaagacgcccguugccaagccgacuguggucuagcgguagcgucagugucaaggaaaagcacccgcuacuuagcagaccgggaaagggagucucccuuuccccaggggaguuuagagaagacucuacuccuccaccucuuguggaggaccugacaucagucaggccugcccgcaguuauccggaggcuuaacugucucccugugaugcugugcuucaguggucacgcuccuaguccgccuugauguuccaucuuguacaccuggcucugucuuuuagauagcaguagcaaaauuagugaaaguaccgaaagucucugauaagcagaaauaauggcguaagcugucucucuuucucccucucucucugccuuggcugccaggcagggaagggccccuuguccaguggacacaugacccacgugaccuuaccugucauuggagauggcucacacuccuuacccugccccuuuugcuuuguauccaauaaauauuagugcagccagacauuuggggccacuaccggucucugcaucuuggugguaguggucccccaggcacagcugucuuuucuuuuaucucuuugucuugugucuuauuuucuuuuuuuuuuuuugaggcagagucuugcucugucgcccaggcuggagugcaguggcgcaaucuugacucacugcaagcucugccucccggguucacgccauucuccugccucagccuccugagcagccgggacuacaggcgcccgccaccaugcccggcuaauuuuuuguaucuuuaguagagacgggguuucacuguguuagccaggauggucucaaucuccugaccucaugauccgcccgccucggccucccaaagugcugguauuacaggcgugagucacugcguccagccuguuuuuuuuuuuuuuuuaaaucaucgcaaguguuuucacuaguugguacuuuuacgucauaucaguggcaacuccugccuuugaaaaugugacuuuuuguagacugguggguggccgucuaguauagggcacagcagugucugaccuggucagagaaaggccagugcuucugaagaaucgggagagagguagacuugccccuggguggcccugccuucugccucccugagcagggacacccaaguacauuuacuacccagaguguguggcuucaggugugugucuuauguuugaucucuccauccgugucaucuucguggacagcuaaauaaaaccagcugaaucagugaaggacuuguugauuuaaacaucagucauacuuuaggucagaugauuaacagcacugauguuuagaaauaugauacugcuuugcacuaguuucacugcauguuaaggccagugaauucaaaaauuaucugggcgugguggcgcaugccuguaaucccugcuacuugggaggcugaggcaugagaaucgcuugaaccagggaggcggagguugcagggagccgagauugugcuacugcacuccagccugggugacagagccaagacuccaguaaaaaaaguaacauagaaauguuuugugucuuucagaaaauuaugcaacacuuagaaggagaaggccuaaaaaaugucauuuuuaccaacuguguaaaggaugaaaaugucaagcagguaggcuuuucgucugugcucucucugacgcuucugcuucaguagguucgaggagcauuauaaacuguuuuaugcuuuaguaagaagcagagcuuuggaaaagauccuagguguugguuuccagcugccacacacggaugcgaucuccuggggcaagugggucucccuguacugagggcacaaggucaggcuguagacgcauuccaggguuguagguggucagagucuuuuggagacucagguagcucauguuuccaguuguaugugguagaauuuucuggcuugauguguuucuucauuaaaagguaguuacagcugucacugaagccccgggucugcccugcuuguuuuugaugggaggggacgggcauaggugguccccggccccagagcucagucugacaucugugaccuggacagaacuccaguuucccaacaccggauacuuggugugcuaccuccagaugaagggugacgcccaguuugccuaugaaauguuggguagaauuccagauaggagguuucuguuuuccuaacggauaugugaaaguggagacacuggaaucccuaauccuguucugagguggcagaaggagcgggucagugcacagacguccgaccugggguggcuccaugaguggguguuuguugcagaucaucccgauggucacugaacugauugggagaagccaccgcuaccaccgaaaagagguugguugguggggcccagagcugggagugggaggcgggcgugggaugggccagccccuccugccuggccucuccaaggagaaggcgcagcgccccaggcagggaggccccuccuuuguccucucauucucuucaguggaaagggccgaggccguccccgcugggugggcagagccucggcguuaaccucccuucuucccugagcugaccuggccugggguccccuugccugggugggguugcagagucucaggcucuagcggccacggugggcccugugaccccucucucugccugcgcagaaccuggaguacuguaucauggucauugggguccccaacgugggcaaguccucccucaucaacucccuccggaggcagcaccucaggaaagguacuggcgcgugcggcugaucaccucaggaaagguacuggcgcguguggcugaugugcugaugccaccaucuuucuuggaggggacgugcccgaggagcacugccagucuucugcugaccccgcagccccagagcacaucuugucucguucaguccaguucacaggagggcugaacagugggaccaggucguucugugaauuucacacuuaauuuuucucucuuuuaaaaucuuuaacaugaagauggcuuuucuaaacuuugauauuuguucauuuauuuaaaucccuuuggccgggugcauggcucacgccuguaaucccagcacuuugagaggccgaggcgggcggaucaugaggucaggagauugagaccauucuugcugaaacggugaaaccccgucucuacuaaaaauacgaaaaauuaggugggugugguggcgggcaccuguagucccagccacuuaggaggcugaggcaggagaauggcgugaacccgggaggcggagcuugcagugaguugagauugugccacugcguuccagccugggcgacagagcgagacuccgucucaaaaaaaaaaagaaaagaaaagaaaaaaaaucccuuugauccagagaauacaaagcgugugaaguagacggggcuggauuaucaggcagggaggcugcaaggccauuccuccauggcguccgccuugccuuugcuggaggguuccuggacuccggagucgcaggcgcuccuuuccucccucugugccuguucucagacucugauucaaagcaggagccccgagcacccuucacugccccgugggcucuuuuccuuaaguauuuucaaguuuaauucaaguccuuguuggcuucauuuuucauauuaauaaggcauuuauuaacaaacccauucaugaugugcaaaucugaaggcuuuaaacuacggugaacuguuauuuuacagagaggguguuuuuggugcuaauuggagcauuguuacagucauuuauucuuuuaaguuuauuuuuaagcguauuauuuuuuaucagugguauuaagugcauuuauaggguuaugcagccagcaccacuauuuucaaauauuuugguuaccugaaaaugaaacucuguaaauacaaagagucacucccccagccuccuacaccccucguuccacuuucugucugugaauucgaugacuguaacugccuccuccaaguggacucacaguacuuggccuuuugugacuggcugaugucaccgaucgugauguccucaagguucgucuguguuguccugagugucagaauuuuauuccuuuuuaaggcugaucaccccguuguguguacagaccacauccugucuuguccauucaucuggauggacacuuguguuuuuuauucuuggguuguuuguccacaguggaguggccuccuugggacacacccugagcuggguccuagagcagccagucgccuguggacagugcugugggaggcaggcugaccuuggggugcagggguggguccaggagggaggugggggacugcguggaaggagcagcucaggucugaccuccgcagucugacagugccuuuccaguccuggggaguuagguucuggugcauuuguugaagaaucucagucucuguguggcuuggaaagugcccuugcugugagcugguuugugacugaaagugaaacaaauuauagccuugggaagcucaucuggcuuuuaguuuccauuuuggccagauauguuuguuacauagucucccugcuuggcugguaaguuguguuuguuacauagucucccugcuuggcuggucagauguguuuguuacauacgucucccuacuuguucugcagcuucuguguuuaguauacauuugagccuccuuuucuccuuuuccuacagggaaagccaccaggguggguggcgagccugggaucaccagagcugugauguccaaaauucagguggaguccucaggggccaggcccagcacucugucaagagcucugcaggcgucuggcaccugccgaccucuguguggcuuccggcugcugaccacgcuucccuccccuccacucaguguccccgcugagcacccccggggcaggcacugccccugcccuuauuccacagucgucauagucuuugcgccaaaccuuuggggaaggcacgcuguuuuccccauuuccagaugaggaggccacuguccagggccaugcaguggucaggacagaccugaguguggcgccccccgccccacccuccacucccuuccuuguguucuccuugggagcagaagacaagcuguugggaccugacgcuuuuauuuauucuccaaauuaagugggaauuagauccucuggggaacccuggagcuuggugagagugacgcugccaugggguugggucccugaggccuuccucggagcauugggugccaggggcugcccaggcuuccugaguggcccaccugggugggaggcugccaccgcggccugaucaugcccucugugcccacacaggucucugagcggccccugauguuccuguuggacacuccuggcgugcuggcuccucggauugaaaguguggagacaggccugaagcuggcccuguguggugagccggggcuggggcuggggcuggggcugggaccggggccccugccaccccaccuuuagggcuggcuuuggcacagggccccuagacgggaguuguuacugccuuugaccugguugcugccagaccuuccucgaagcuuagugugagagcuguaauagugcacagcugacaggcacuggucaccauuccacccugccccaugaguggccuucccuuuccccauuugacggaccagggcagagagguuggucgcaggugccaggcaggagugggggccgggaccacagccgagugccguccucuugguuagugucuuugucaguggcuggccucuuccucacggcacggugucuuugggcuaggacuggaagggauguguuugaacuuggcaggaacauagauguggcuguuuccagugcucaccucggcugcugcuuccacaggaacggugcuggaccaccuggucggggaggagaccauggcugacuaccugcuguacacccucaacaaacaccagcgcuuugggugagugcagugaaugcagggcagcuggggccccuccuccuagucaccucauuuaaaaaaaaaaaacaaacaaaaaaacccccagcauuauaaagguauuauaaacacgguaaccugcacaucguuuaaagcguccaguuggacaaguucgggaguauggcuauacgucugugaaagcaacacacaaucaagaaaacgagcguucccgucacccccagucccugcuccucuuucgugaaaucaaggaaacgagcguucccgucaccccccaucccugcuccuccuucgugaaaucaaggaaacgagcguucccgucacccccagucccugcuccuccuucgugaaaucaaggaaacgagcguucccgucacccccagucccugcuccuccuucgugaaaucaaggaaacgagcguucccgucacccccagucccugcuccuccuucgugaaaucaaggaaacgagcguucccgucacccccagucccugcuccuccuucgugaaaucaaggaaacgagcguucccgucacccccagucccugcuccuccuucgugaaaucaaggaaaugagcguucccgucacccccagucccugcuccuccuucgugaaaucaaggaaaugagcguucccgucacccccagucccugugcuccuucgugaucacaccuuccugccccucccugagcccaggcagccgucuacugucccuguagguugcuuuggguuuucuagaauuccacguagauggaaucacacaggaugugcauucuuguugaucugucacucggcacgauuguugugugauccccgugugucgucguguguuguccgucauucauccuuuuuguugccaggcgguuucaguguccaggugcgcugcagucugucccuucacccguugauggauauguggguuguuugcagguuuuggcuauugcagauaaagcugcugugaacauucauguaccgacaggucuuuguguagauccgggcuuucguuucccuuggguuaauaccuaggaguagaguggcuggaucauaggggaggcauauguuugaguuuuuaagaaaccgccacauuguuuuccaagguaguuacacuguuuuauaugcuggcaagcagggaaugaguccuucaguuucucuaagaucagucuuuaacuuuggccugucugaugggcgggcguguaggggugucgcauagcauuucaauuugcauuucccugaugacagggacguugagcaucuucaugugcuuauuugucaucccucucuggggaaaugucuguucaaauccuuuucccuuuuuuuuuuuuuaacugaguuguuucuuuccuuauugcuaaguuuuaaucuuuuuuuuuuuuuuuuuuuugagacagggucucaguuacccaggcugaagugcagugguacagucucagcucacugcagccugaccuccugggcucaagcgauccucccacuucagccucccaaguagcugagacuacaggcgugugccaccacacauagcugauuuuuguauuuuuuguagagacaggguuuccccauguugcccaggcuggucuugaacuccugggcucaagggaucugcccgccucagccucccaaagcauuaggauuauaggcaugaggcaccaugcccagccuguaaccuuuuucuaauauauucuggauacaaguccuuaaucagagauacgguuuguaaauacuuuaagucugugccuugucuuuucagcccucuuaacaguguuuuccgaggaguagaauuguuaauuuucaugcaguccaguuuaucagcuagaucuuuuccagaguacucuuguugucauaucuaagaaaucuuugcuuaaaccagggucacaaggguuuccucauugaagauagaugguuuuagguuuuacauuuagggcuaugauccuuucugauuuuuugguauaugguacaagcugcagauugaaguucuuuuuuuuuugcacauggagaaccaguuguuccggaaacauuuguugcaaagacugucuuuucuccacugaauugucuuugcaucuuugucgcaaaucgguuguccauauacgugggucuguuuguggacucuaacugugucacuuuucugugugaccgaccgucuugguaacugcuucuaauuuaauaugagauuugaaaucaggcagugcugguagcccccacucuucuuugucaaaauugcuuugucuuuuccugguucuuuguauucucaugcauuuuucagucacuuugucaguuucuacaaaaaucccuauguuucuugaggccggguggcagauuccccugaauuuauaggucagucuggggaagaauugacaauauuguaacacugagucucugacccgugaauauaguguaucucuucauuuauuuaggucuuuaguuuuucuuugcaguguuuuguaguuuacaguguuuuguaagauuuauauugaacucuuuuuuaaacuuuuaaugcuaagauuuaucuuuugauacaaaguagauguuuucaggguaccuaugauauuuugaugcauucauacaauguguaaugaucagaucaggguaauugggauauccaucaucccaaacauuuaucuucaugcuggaaacauuugaauugcucucuucugguauuugaaauauccuguagauuccuguuaacugaagucacucuaccgaacuauucauuaaucaaccucuguccauccccucuuccccucaccucugguaaucaccagucugcucucugucuuaaugaaguccacguuuuuagcucccacauuugaguuagaacaugcauuauuugucuuucugugccuguuuauuucacuuaacagaaugaucuccaguucuguuuguauuacugcaaaugacaagauuucguccuuuguuauggcuaauauuucauuguguuuuauguaccacauuuucuguauccaucauccuuugauggacacuuagguagauugcauaucuuggcuauugugaguagugcugccgugagcaugggagugcaguauuucuucaguauauugauuuccauucuuuugggucuauacccaguagugggauugcuggauccuauggcaguucuauuuguaguguuuugaagaaccuccauacuguuuuccauaguagcuguacuaacuuacauucccaccaacaguguacgacagcuccccuuucucuacauccucaacagcaucugcuauucucuguguuuuuuaauaaaagccauuuuaacuagggugagaugaaaucucauugugguuuugauuugcauuucucuggugauuagucauguugagcauuuuuucauacacuuguuggccauuuguaugucuucuuuugagaaauaauuauucagaucuucuguccauuuuuaaauaguuaugugguuuuuuuugcuguugaguugaauugcuuauauaaucugguuauuaauuccuuguugaguaguuugcagauauuuucuccuauucuguagauuaucuugucagugcuuugauaguuucguuucuugcuucgggucuugccgugccguccaggcugagugcaguggugcgaucacagcucacugcagccucgaacucuugggcucaagagauccuccugccucagccucccaaguagcugggauuauaggcacguaccaccaugccuggcuugcugauuguuuccuuugcugugcagaagcuuuucagcuugauguaaauuuuuuuacauuugccuauuauuauuauuauuauuuuugcuuuuguugccugugcuuuugaggucuuauacaaaaaaaaucuggcccagaccaauuuccagaagcguuucccuuacguuuucuucuagcaguuuugaaguuucaggucuuagauuuaagucuuuuuuuuuuuuuuuuuugagaaggagucucacugugucacccaggcuggagugcaguggcacgaucucggcucgcugcaaccccugcuuccuggguucaagcaguucucugccucagccucccaaguagcugggacuacaggugcccgccaccauaccuggcuaaguuuuguauuuuuaguagagaugggguuucaccaucuuggccaggcuggucuugaacuccugaccucgugauccaccugccuuggccuguaauagccaccgcacccggccagauuuaagucuuuaaucccuuuugauuugguuuuguauauugugagagauggggucuaguuucauucugccugugguuauccaguuuaaccagcacccuuuuaugggagagacuguccuuuccccaguguauguucuuggcacuuuugucgaaaaugaguuggcuguaaauguguggauguauuucuggguucucuggucuguuccacuguucuguguauguguuuuaugccaguagcgugcuguuuuugguuacuacgaauauuuugaagucagguagugugaugccucuagcuuuguucuuuuugcuucagguuugcuuuggcuguuuggggccuuuaguggugccauacaaauuuuaggauuguuuuucuauuucuuugcagagugucauugcuauuuugauaacgauugcauuaaaucuguaaauugcuuuggguggugacauuuuaacaguauucuucugacugauaagcauggaauaucuuuccauuuuuuauguguccucuucaauuucuuuuaucaguguuuuauaguuuuccuuguagagaucuuccacuucuuuggucagauguauuccuagguauuuuauauuuuuguaacuauuauaaaugggauuuucuugauuucuuuuuuuuuuuuuugagauggaguuucggucuuguugcccagucuggagugcaauggcaugaucuuggcucaccgcaaccuccgcuuccuggguucaagcgauucuccugccucagccucccaaguagcugggauuacaggcgugugccaccacgccuggcucauuuuuuauaauuuuaguagagaugggguuucuccacguuggucaggcuggucucgaacucuugaccucagguaauccgccugccuugaccucccaaagugcugggauuacaggcgugagccaccgugccuggccugauuucuuuuuccgauuaccugcugcugauuuuuuuauguugguuuugaauucugcaacuuuacugaaaccuuuuuaucaguucuaauaguuuuuugguggagucuuucaguuuuucccaauauaagauugucaucugugaauaaggauaauuuugacuucuuccucuccaauuugggugacuguuauuucuuucucuugccuaauuguucuggguaggacuuccaguauucuguugaauaaaagugguagaaaugggcaucuguguguuguuccagaucuuggagaaaagcuguuuuuccuuguucaauauacuguuggcugugggcuugucaugcguggccuuuauuguuuugagguguguuccuucuauacucaguuugcugagagcuuuuaucgugaagcgaugcugaauuuuauugaaugcuuuuucagcauuuguugaaaugauuguuuuuuuuccuugguucuguuuaauguuauauguuuauugaugugcauauguuaaaccauccuugcaaccuugagacacaucccacuugaucguggugaaugaucuuuguaacauguuguugaauuuggguugcuggucauuuguugaggauuucugcaucuguguucaucagggauauuggccugucguuuucuuuuucugccguauccuugucugguuuuuguaggaggauaaugccauauacagugacuuuggaaguguuccccccuucaguuuuuuugaauaguuugaguacaguugauacuaguucuuccuuaacuguugauaguucagcagugaagccaucaggaccugggauuuucuuugaugaaagacguuuuauuacugcuuugaucuuguuacuuauuaucgaucuguucaaguuuuuccauuucuucauggcucagucuugcaggguguuuguauccaggaauucaucccuuucgucuggguuuuccaguucguugcuguguaguuguucguaguagucccuaaugaucccuuguauuucugugguauugguuguaaugucuccuuuuuuguuuacugauuuuauuuauuuugaucuuuuuaaaauucuagcuaaauguuuguggauuuuguuuauguuuuugaaauaauuuuuuguuucauugaucuuugguauuuuuuuuuucaacucaauuucauuuauuucugcucuggucuccugaucucuguuauuucucuucuucuacuaauuuuggauuugguuugcucucacuuuucuggugccuugagguucaugguuagguuauuuggagucuucugcuuuuuuuagcguagguguuuguugcuauaaacuuccgucuuagcaacacuuuugcugaaucccauagacuuugauauaugguguuuccauuuccguuuguuugaagaaauuuaaaauuuuucuuauuaauuucuuuauuaacccauugaucauucaggagcguguuguuuaauuuccauguguuuguguaguuuuugagguuccucuuguuacugcuuucuuguuuuauuucaucgagucagaaaagauacucaauaagauuuugauuuguugaaacuuguucuguggccuaacauaugguauauucuguagaauguuccaugugccgaugagaagaauguguguuuugcagcaguugggugaaauguucuguaaaugucaguuagaccuguuugaucuagcauguaguuucacuccaguguuucuguugauuucuggcuggaaacacccuacggagaggggguguugaagcccccuacuauuacuguauugcacucugccucucacuuucaaucuaucaauguuugcuuuauauaucugggugcucugguguugggugcauagauauuuauaauuguuauaucugcuugcugaauugaccccuuuaucaaucguauagugacuuucucugugucuuuuuacagucugaccuguagucuauuuuguguaaguauugcugcuccugcucuuuauacagucuuugacuuuuagucuguucugucaucuguaaguauagcuauuccugcucuuuuuuuuuuuuuuugguuucuguuuacauggaauauguuuuuccacccuuugacuuucagucugcguaugucuuuauagguaaagucgguuucuuauagguagcauauaguuugaucuuguuuuuuauccauuuagccacucuguguuuuuugcuuguuuuugagacagggucucacucuguugcccaggcuggugugcaguggugugaucauagcucacuguagccuugaacuccugggcucaagcagucuucccaccgcagccuccugauaguuaggacuacaggcgugugccaccacaccuggcuguuuuauuuauuuauuuauuuauuuuuuguagaggcgaggucuugcuauguugcugaggcuggucuugaacucuuggccucagaugaucuuuccacauuggccucccaaagcgcugggauuacaaaugugagccacugugccuggccuacucuaugucuuuuaguuggagaauauaguacauuugcuuucaauauuauuauggauaaagacuuaauauugccauuuuguugcuuguuuucugauuguaacuccucucuuccuuuuuuacugucuuccuucgcaugugguuaagagauuuucucuguugguauguuuuaauuuguugcuuuguauuuuuagucuauguauuauauguaguguaccaucaggcuuacaaaaagcauuuuauauuuauaacaaguuauuuaguuauuuuagcugggcguggugcucugugacuguacccuagguacucaggaggcugagauaggaggauugcuggagcccaggaguuugaggcugcagugagcuaugaucgugccaucgcacuucagccugggugacagagugagaccccucucuuaaaaaacaaucauuuuaaacacaugacaccuuaucugugaucacagaggaaagaauagaaacaaaggagaaacugaagaauucuguacuuuaacugcaucuuucccccaaauuuucacguuuucuuauuucaauuuauuuuuuuuuauauuggcucucucuuuccagguugcuguaguuauuauuuuugauacauuuuucuuuuagucuucacacuagagaugugaaugaaugcacaccacauucacaguauuauucugagucuguguguuuacuuuugccaguggguuuuauacuucacauguuuucuuuuuguacauuagugucuuuuucuuucagauugaagaacuuuuuuuuagcauuucuugaaaguugggucugaugaauucccucagcuuuacucuuucauguuugaagguguguccucaguugacaguugcauuuuuuuuuccuucagcacuuugaauauaucaucccauugccuccuggccuauauggauuuccuggagaagucuguugccaguuacauuggagcucuuuuauaaauauauuugcugcuuuucucuuacuacuuguacuacuuacugcuuguaggauucuuucuuuguccuugacuuuugagaguuugauuauuauauucuguaggguaguuuuauuuggguuaaaucuguuuggugaucucugaccucccuguaccuggacauuuaugucuuucugaggguuugaaaauuuuucuguaauuauuucuuugaauaaacuuucugugccuuccucuugcucgguuccuucuugaaccccaguaauuccuagguuugcuccucugaggcaguuuucuguaucuugcauguguucuucauuccuuuucauucuucuuuuuucucuuuccucuucuauauguuuucaaauagccagucuucaggcucacugauuuuuuccucugcuugguccauucugcuguugagagccucuaauauauuuuucagcaaauguauuuuuuacuuccaggauuucuguuugauuuuuuuuuuuuaauuucaaucucuguuaaauuugucugacaaauuugugaguuguuuuucuguguuuuauuggaguuugcugaguuuuuuuuuaacuguuaccuugaauucuugauuugagcgcuuacacguugccaucucauuaggguuggccacuggcucuuugcuuugucuguuugagaaggucgcgguuuuccguuagcuguuguuucuugugcacauaugucugugguuuugcauugaaggauuuguuauccaggcuuuccugucuggcuuuuuuuuucuuggauguuugcuuagagguuuuuugcagcuuacuuucugccuggaguuuuuuucacuucucuggucucauccucagauuugaguucuggaauauugcuggugauauucuuggcacuggauguuugguuuugguuuucuuugagagggugagggaagccagauugcuucuacuucucuauuuggugaugucauucccucuauuaacucuucgcuauuuuugauacuauuguaaaugguauuguuuuuauguucacuuuugauuuuucauugcuaguauacagaaguagaauugauuuuuguauauugaucuuguaucuuguaacccugcuaaacucauuuauucauucuauuagcucuuuguagauuccaguuagauuuuuuaccuagacaauuaugucauuugcaaauaaagaucaucuuacuuuuucuuuuccaguccagaugccauauuuuguuuucuugcuuuauugcacuggcuacagucuucaauacaauugacagguuuuuuuaguauuugagauguggugagaacagacaucuuuuuuuguuccugaucuaagguaggaagcuuuuagucucuuaccauugagugcaguauuagguauggguguuucuuagaugcccuuuaucagguugaagagaacagucuggcuagaggcuuauuaauuuuauugauuuuucccaaagaaucagcuucugguuucauugacuuucuguugucuuuguuuuuuaugucauugauuuccauucgauguuuauuuuuuuauuucuacuuugguaauuuucuauuuguacuaccaauuauugugagaggggcacugaaauuucccacuguaacugaauuucuguuucuucuugcuguucagucaguuuuggcuucguguauuucgaagcucugcuguuagguacagaaacgcucaggagauuguuauguccucuugaugauuugaugccuuuaucauuaggaaaugaucuuuuuuuauccuucagaauauucucugcucugaaaucuuucuugucugauauuaauauagccaccacuuuuguuuuuuugagacagagucucacucuguuucucaggcuggagugcagagguacaauguugucucacugcaaccuccgccuccuggguucaaaugauuuucaugccucagucuccugaguagcugggauuacaggcgccugccaccaugcccagcuaauuguuuuuguauuuuuaguagagaugggguuucaccauguuggccaggcuggucuugaacuccuaaucucaggugauccacccaugucggccucccaaagugcugggauuacaggugugagccacugcgccuggcuaauuuuuuuguguguuuuuaguagagaugggaguuucgccauguuggccaggcuggucuugaacuccugaccucaagugauccacgugccucccaaagugcugggauuucagaugugagccaccgugcccggcccauuugucucaauuuuuguuuucuuuuuuccucucucuugccucuuuaggauugaauauuuuuaaacgauucuacuguaucuucuuuguuagcuuauugucuacaacuuuugggagagguugcuuuaggguguauaguaugucuuuaagugaugaccuuacaauaaugcauuucuguuuuucuuauccugauucuugugccaucaucaucaugauauauuuuaccuuuacauauuuuauaaccuccagauauacuuucuuuccuucauacaguuaucuuuuaaagaaauauaaaauaccagaaaaaaaguuguauauauuuucccaucaguuuaccauccacaccuucucauuucuuuguguuuucuuuucuuuuuuuuuuuuuuuuauugaucauucuuggguguuucucgcagagggggauuuggcagggucacaggacaauaguggagggaaggucagcagauaaacaagugaacgaaggucucugguuuuccuaggcagaggacccugcgaccuuccgcaguguuugugucccuggguacuugagauuagggaguggugaugacucuuaacgagcaugcugccuucaagcaucuguuuaacaaagcacaucuugcacugcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuacuucuuucuacacagacacggcaaccauccgauuucucaaucuuuuccccaccuuucccccuucucuauuccacaaaaccgccauugucaucauggccuguucucaaugagcuguuggguacaacucccagacggggugguggccgggcagaggggcuccucacuucccagacgggguggcugcugggcggaggggcuccucacaucccagacggggucgcggccgggcagaggcgcuccccacaucucagacgaugggcggcggggcagagacacuccucacuuccuagaugggauggcggccgggaagaggcgcucaucacuucccagacugggcagccaggcagaggggcuccucacaucccagacgaugggcggccaggcagaggggcuccucacaucccagacaaugggcggccaggcagagacgcuccucgcuucccagaugggguggcggccgggcagaggcugcaaucucggcacuuugggaggccaaggcaggcggcugggagguggagguuguagcgagccgagaucacaccacugcacuccagccugggcaccauugagcacugagugaacgagacuccgucugcaaucccugcaccucgggaggccgaggcuggcggaucacuugugguuaggagcuggagaccagcccggccaacacagcgaaaccccaucuccaccaaaaaaauacgaaaaccagucaggcgugguggcgcgcgccugcaauuggaggcacucggcaggcugaggcaggagaaucaggcagggagguugcagugagcagagauggcggcaguacaguccagcuucggcucggcaucagagggagaccguggaaagagagggagagggagaccguggagagggagagggagcggagcgggagcgggagagggagcgggagcgggcgccccuguuuuuucauagacggguccugcacucauuucuuuguguagguccagguuuccuucuggugugauuuuacuucugucugaaggauuuccuuuaacauguauuguaaggcagguuugcuagugaugaauucuuucagcuuuugguugucugaagaugucuuuauuucaccuuuguuuugaaagauauuuucucuacguguagaauuccagauugacgggguuuuuuagugcuugagagggguuggucucccuuucucacuugcguggugucugaugagccgucugcggucauguuuguuuguuuuagugcuugagagggguuggucucccuuuuucaccugcguggugucugaugagccgucuguggucguguguguuuguuccucugcugcuuccaggauuuucucucucagugcuuuugagcaacuugauuacgauggaccuugguaugguuuucuauguguuccuugugcuuguaguucauugagauuuuuggaucugggucuuuguaguuuucaugaaauuugcaucauuuugaaacuucauaucugcagguguuuuuucugucccucuacuccucaggaccucaggcaugcagguaucaggcacgcggguaucaggcagguggguaucaggcaugcaguuaucaggcaugccgguaucaggcacgugggccucaggcacacagguaucacguggguaucaggcacgcaguuaucaggcacgcgggugucgggcaggcgggugucggcacgcgggugucgggcaggcgggugucgggcacgugggugucgggcaggcgggcgucgggcaggcgggcgucaggcugcuuggcuuugccccaccgcagcucaguaaagcuuugugccuguuuugugguuucuguugcugugucuucggguucacucaucuuuucuucugcaauguauaaucugcuguucaucccacucaguaguuuucauaguuuucacuuccgcaaguugaguuuggaucguuuuaaaaaauaucuuucguguuucagcuuagauuuaaugucuugucugcuaauucuaacauugggucaguuugaguugacugauuuuucuucucauuagggggucuguuuuuuugcuuuguaggccuggcaauuuuuggaugauauauauauauauauauuuuucuuuuuauuuuauuuuauuauuauuauacuuuaaguuuuaggguacaugugcacaauguguagguuaguuacauauguacacaugugccaugcugguguacugcacccauuaacucgucauuuagcauuagguauaucuccuaaugcuaucccuccccccuccccccaccccacaacagucccaggugugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuauuauuguuggacauuuggguugguuccaagucuuugcuauugugaauaaugccgcaauaaacacaugugugcaugugucuuuauagcagcaugauuuauaguccuuuggguauauacccaguaaugggauagcugggucaaaugguauuuccaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagcagcacaucaaaaagcuuauccaccaugaucaagugggcuucaucccugggaugcaaggcugguucaauauacgcaaaucaauaaauguaauccagcauauaaacagaaccaaagacaaaaaccacaugauuaucucaauagaugcagaaaaggccuuugacaaaauucaacaaccuucaugcuaaaaacucucaauaaauuagguauugaugggacguaucucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaguuaggcaggagaaggaaauaaaggguauucaauuaggaaaagaggaaaucaaauugucccuguuugcagaugacaugauuguauaucuagaaaaccccauugucucagcccaaaaucuccuuaagcugauaagcaacuucagcaaagucucaggauacaaaaucaauguacaaaaaucaccagcauucuuauacaccaauaacagacaaacagccaaaucaugagugaacucccauucacaauugcuucaaagagaauaaaauaccuaggaauccaacuuacaagggacgugaaggaccucuucaaggagaacuacaaaccacugcucaaugaaauaaaagagaauacaaacaaauggaagaacauuccaugcucauugguaggaagaaucaauauugugaaaauggccauacugcccaagguaauuuauagauucaaugccauccccaucaagcuaccaaugacuuucuuuuuuucuuuuuuuugagauggcaucucacucugucgcccagccaggcuacagugcaguggcacaaucucagcccacugcagccuccaccuccuggguucaagcgauucucccgccuuagccucccaaguagcugggauuacaagcaugugccaccacaccuggcuaauuuuuguauuuuuaguagagacaggguuucaccauauuggugaacaggcuggugucgaacuccugaccucaagugauccguccaccuuggccucccaaaguucugggauuacaggcgugagccaccaugccuggcuggaugccauguauuuugaguuucaccuuguuaggugauggauaucuacauuccuguaaaaauucuugagcuuuguugugggacaguuagauuauuggaaacaguccgguccuuucaggaguucuucccauuggcaggucucgggggugguccggggcgccuccuccaggcuugcuccucucuccugggacagcuuuuuuggagcaccagggcacccuugaggcugcugauucagagcucaugcuuggugccuccgagaaguuagauuuagaaccuguguuacucaggguucugaugcuccuaugggcucugagcucaugucuugcuuugcugggccuuggggugaguccucuguuaccggcucaugcugugaccagguccgagggcaccagccuccucaagguugagccugcccucgugggagccacgagacagguuccccucaccccuggcugucaggaagguugggagaguguugggucuggguuagucgggcucccaaggcuuagggugguguuugucccugugaguggcugcucugugcuggccuuucccuccaggccucucugcccagagccugcacugugaggagucagagugcccguuacaaucacugggugacgcuuagcagcggugggugccuagucagcccaugcuggucccugugcuaggaaaacaccgcucaaacacccagccggguggagaggaugcagguguacuggcugccuggaaguuaccgagugccauccuuagcagcaaacagaguauguuugcagauggucugcugugcuccucuuuuaguuuccaggaccugggccugcacagaggccugccuguccuaccccggauagaguggaugaagccugugugugugaacagcuguuacuccucccgcugcggcaagggcuccgguggugggagccgccccccaugcugcuggccguggccacacaggacgaagcucagggaugauucuuagauaguggcucucccccggggcccagcaccggucaccugcagucucaucuuggucauccacagcgccgcagucacugucacccacaggaggugccuggccguggccuuuguggcauucaggaggaagggcccggccuggcuggccgcgcggugucagugcugggcccccuggugcugaccugcagccuaugugcagguacgugcagcacuacggccugggcagugccugugacaacguagagcgcgugcugaagaguguggcugugaagcuggggaagacgcagaaggugaaggugcucacgggcacgggugagugaggucgcugaugcgggcaccggagccucaccccaucacccugggggaccccggccaucccuggaggaggcagggaggagaggaacgugucaaggagcaugcgccgggucuucugggaauggguuucagggcaggggagcuacagaaaguucuggagaggaagggcuuguaguccaggcuuccgagggugagaccagcccugccgcguauugggcagugcuagguggacaccugcaggccucacaugccuggccuuggaggcuccgggcagcguagcucaagcuguuuucuuucugagugugaucccguucccugggcuucccugaugccaucauggagccucuuagggcuggucccucagguggguaagggcugggccuguccugcugugaaggcuccuuccucacugaacccucccgucccccagguaacgugaacauuauucagccuaacuauccugcggcagcccgugacuuccugcagacuuuccgccgugggcugcuggguuccgugaugcuggaccucgacguccugcggggccaccccccggcugagacuuugcccugaacuuguccggguagggagggccggaggcauguggccucccagaccuccugaccugggugguugaggcucaagacagcucacccgguccagaagcuccaugcuggucacuagggugcugugcucucuggcgccccacagccuggccagcuccagggaccccaguugcagggcccaagcaggugggaguggacaccaggcuucccaguggacgucccugagcagcuccgcaugcuugguucucccggagcuuccugcucaggccucuugagaaauggaugcugucucagaaggaguuaaagcuauaaccuguaaccuuuaaaaucuccaguuaaagggccuguuucuuacuggccugugaggugcaccguagugccuugggccuguguguuaaagcugcucucaccagugaaaccuaagaaaugagcagguuggcagcuaggguuuguguuggaggcuuucgguccagugucuugcaguccuacaacaagugagaggcuugcugcca

SEQ ID NO: 191814 - RNA, 21333 nt, Homo sapiens
gcgaguccggaggacuccuuggacugcgcggaacauggcguucugggguuggcgcgccgcggcagcccuccggcuguggggccggguaguugaacgggucgaggccgggggaggcguggggccguuucaggccugcggcugucggcuggugcuuggcggcagggacgaugugagugcggggcugagaggcagccauggggcccgcggugagcccuuggacccggcgcgccccuugcagaggccucccagacccgaggugcccagggcauuccggaggcagccgagggcagcagcucccaguuucuucuuuucgagguauuuugggcaaggacaagcacuucuugcguguucguugucgacaccucgcccacucuuucucaccuugccguguuuccuuugcggcaugucugggaguuuacgugcguuccaacaccggggccuccgucuuuaugcugaucuguggacgucacuuauggggguuuugucguuuauuucaccauucccucauugaaauacguucuaaccuuuaguuauugugcaucaugcuguggugaauaaccuuguuggcaccucacuguuugcauaaauuccuaguacugggauugcuagguccaaaaguauaugcauuuaacgcuuuaaugaucccucauaaauguugugcgguuaauacucccacuggcaugugaucguacccgucuccauaguaauugcaucuaagaacugaggcuacauaggaaaaaaucuuaagguccaugguuguuagguaucagaugcccuauaauggaugaauauuuaaguaaauaauggcacauugacuugcugucugacacaacugcugaaaauguuggugaaaagugagucucgaagugguagcucacacuuguaauaccagcacuuucggaggcugagacggggaucgcucgaggccaggaguucaagagcagccugggcaacauaacgagacccccaucucuaccaaaaauuuaaaaauuagccgggcaugguggcgcaagccuguugucccaguuacuccugagacuaaggcaagaggaucccuugaguccaggaguucaaggcugcagugagcuaugauugagccacugcacuccagccugggugacagagcaagacucuuaucuaccugugggaaaaaaaaaagaaaaaaguuuaauagauccugaagaguuggccgggcgcgguagcucacgccuguaaucccagcacuuugggaggaugagacggguggauaacgaggucaggaguucgagaccagcugggccaacauggugaaaccccauuucuacugaaauuacaaaaauuagccgggcgugguggcgggcgccuguaauccuagcuacucaggaggcggaggcaggagaaucacuugaacccggaaggcagagguugcagugagccgagauggcaccauugcacuccagcccgggcgaaagagcaaaaacuccgucucaaaaaaaaacaaagaucccgaagagucagucguucauccaagaagcccugacugagcucuuauucugugccagacucuguucuaggugcuauggauggagcagggaccaggaccuacaaacacguggagcgcauucuaauaucugugauacucugcaaaacuguuaaaacaaauccuugcggccgggcgcgguggcucacgccuguaauuccagcacuuuggaaggccgagacgggcggaucacgaggucaggagaucgagaccauccuggcuaacacagugaaaccccgucuuuacuaaaaauacaaggaaauuagccaggcgugguggcgggugccuguagucccagcuacucgggaggcugaggcaggagaauggcgugaaccugggaggcggagcuugcagugagccgagaucgcgacacugcacuccagccugggcaacagagcgagacuccgucucaaaacaaaacaaaacaaaacaaaacaaaaauccuugcuaccacuggcccuaaagcaggaggcauagggcugcgugugaggaguaguccauugcaugggcuuccuccaguuuggcuuuggauuuuugagcucucugaauuuguuguuuguguccuuugcacagugucccucccagguugcacccaugccugccccucagggucccccacucccagugaauuucacaccaugcagcauguacuuuaagccauacaucuuacguauguuccagacauuugguaaaacgccguuuauguguuuuucagugacucacaaacauuuuauuuacguaaaugaggaauguacucaggcacccuucgugauaccuugcccucagcaggcacucaacagcaauaauaacuuucauuccuuuugugcuucucuuaacaguucguguuuaguaggagcacaguagcuguuuggggaacgaccuuaagugaauagaugucugaaaugcugugugaaguggggcgcuuaauagguggugagaugguuuuagaaccaggguuuucccucuuugcuucuugacuccuuaaccaguuuucauuaggagaccccuuuggagguuugcagucagucagaguugagugccuacugaguguacugaauuaugaaaugagcacaguucccauuaaccugaauuuuuugcucccaaguaagucuugauuucugauuuaugacugcuuuuuguuguaccccaauagucgucuaagaaaggugauuauuuugagaggccuggggagacacacaugcucauucucgaggguggcgguggugcagagggcagagccaugcucguucuugcuauccugagauugguugcuaucuguuuccuuugcugcuguguuuuuuucugucaguauuaaagguggaagaagguccauaucuuuuucugugggugcuucaaguguuguuggaaguggaggcagcagugacaaggggaagcuuucccugcaggauguagcugagcugauucgggccagagccugccagagggugguggucauggugggggccggcaucagcacacccaguggcauuccagacuucagguacugcccacagucccaccugccuucugcgcuccccuccccugacuccugcccuccccacugcccaguuuauuccacuucccuguccucuuccaaaggccucagagccuuucuucucucccugcagaucgccggggaguggccuguacagcaaccuccagcaguacgaucucccguaccccgaggccauuuuugaacucccauucuucuuucacaaccccaagcccuuuuucacuuuggccaaggagcuguacccuggaaacuacaagcccaacgucacucacuacuuucuccggcugcuucaugacaaggggcugcuucugcggcucuacacgcagaacaucgaugggcuugagagaggugagcccucugugagucgcacacauucuuuuucucccacggaggcucgggugccuguuucucccagggaggcucgggugccuguuucucacaggggaugcucgggugccuguuucuggggacggccaaaaccuaucgcuuaugcuucuuccuugggacuuuuuuugagccaacuaguuagggcuuuguucccaaggaaaauguccucuggguguuuaaaggccacugcuuguucuccugcauaccugcagagcuguguauuuugggcagaaguugacauuguuuugccaaucuggugugaugaucucuuuuuuucuucucucuuuuaagaaguguauuauggaauuuuuuugagcacacacaaagagagcaauguaacgaaccguccuguccucaucaccagcacacagccaguucuuccugcguccucaccaccuucuuccaaauccccagauuauuuugaagcaaaucucucacaucaugaauuuaaucuagaaauaaucuauaaacacaugaauggauagcucuagagaauacuuuaaaaacaacuccggccgggugccggauuacaggugugggaucacaccuguaaucccagcauuuugggaggccgaggcagguagaucaccugaggucgggaguucgagaccagccuggccaacguggcaaaaccccgucucuacuaaaaauacaaaaaauuagccaggcgugguggugugugccuguaaucccagguacucgggaggcugagacaggagaaucucuugaacccagcaggcggagguugcagugagccgagaucgugccacuucacuccagccugggcgacagagggagauucugucucaaaaaaauaaauaaaaauaaaaauaauuaaaaaauaaaaacaacucugauagugauucacacugaagaaucacuaguaauuccuuaauauggucacacuuagucuguggugauuucuugaccguauccauauggugcccaaaccagcgauucacagguugugccaacuucuggccgugcaccuaacggaagcacuugguggggccuuuuccuuacgugcagugaugcagacaggugcugggacagucagcucuccgggagccaggcucccggagagacugcugauguguugucaguuaaaaagagguggcaccuuggcuccaggaauguguuuccuugccagaaggauccccugacuuggaaccacagaggcagcagcggaugccccauguuggugggcucuucucccagaggugcagcagggcaggccuugugggaaggugggagcuccuggcugugagauucagcacugcugaguuagggcagcgacagggacuugggaagccuccugcagcugggacccuggcugugccaccgcagccuuucagaaccaguuaauacuaacacaacuuucauaagaagucacuuuuugucuguuucuaccaagcaauucuuuuggaauuuaugauauuuauauccucauuuuaacuugguaucuguagaauagaagauauguuccuggauauuagauauaaauuuuugagacagggucuuggcucuguugcccaggcuagagugcaguggcaugaucauagcucacuauagccugaacucuugggccgaagugauccuuuugccucagccucuggaauagcugggacuacgggcaugcacuaccaugccuggcuaauuaaaaaaauuuuuuaagacaagucucacuauguugcugaggcuggucucaaacuccuggccucaagugauccuccugccuuggccuuccaaagcacugggauuacaggcaugagccacugcacccagccugguauuagguguaauuuuuuuuuuuuuuuuugagacagaaucucgcucucuuacccaaacuggagugcgguggcacgaccucagcucacugcaacuuccaccucccggguucaagcgauucuccugucucagccuccccgaguagcuggcacuacaggugccugccaccacaucuggcuaauuuuuguauuuuuaguagagguacgguuucaccaugauggccaggccggucuugaacuccuagccucaaaugaucugcccaccucggccucccaaagugcugggauuacaggugugggccacugugcccggcuggauauaauuuuauuugagcuuuuaucaaaugguuuuucguacugaguuuugacaggcuuuguuuuaaccgugauuuggcuccagcuaggugccccuuugcuccccugccuuauucugguugauggcgcauguaggugauacgggcaugaaaaccaggcuugaggacaucacaaccccaaggggcugugccuccuuccaggaguccugccaagcccagaaguugugcucuuggccuugcgugcucaucucggaggcggcagcaacacuucgcuuuggcuugaauuucagugucgggcaucccugccucaaagcugguugaagcucauggaaccuuugccucugccaccugcacagucugccaaagacccuucccaggggaggacauucgggugaguuauccugcuguugguuguccuucugcaguuugcuguuggggugaucuggaaaagugguauuuuauaagcauugucucgaaaggacaguugaacaauaauagugugaaacauuuuauuuguaaauuagaaaaucaauacaugcuuguaaaaaaauuuaagacaauauagaaauauguagggaaaaugaaucucccuucagccaauuccagcugcccacuuuuuuuuuuuuuuuuugagauugagucucacucugucgcccaggcuggagugcagugggcgaucucggcucacugcaaccuccgucucccggauucaaggaauucuucugccucagccuccuaaguagcugggauuacaggcgugagccaccacgcccggcaaucagauggccuuuugugccgagcuuauuuccugaaaauguuucucgcuccuucgccuuguagcuuguguuaguauuucauccuguuucauggcuaaauguuccacugauguaugcaccacaguugguuuguuuguacauggauggguguuuggguugucccaccuuucugcucuuguguauaguucugcuguggagcauaugcaaguauucguuugagaguccuuguuuuuuauucuuuugaguaugauaccuacaaguauugcuggguaacuccacguuuagcuauauuuauuuauuuauuuuuugagacacagucuuacacugucacccaggcuggagugcaauggcgcgauuucggcucaauacaaccucugccucccggguucaagcgauucuccugccucagccuccugagaagcugggauuacaggugccugccaccaugcccagcuaauguuuuuuguauuucuaguagagaugggguuucaccauguuggccaggcugcucuugcauuccugaccucaggugguucacccgccucggccucccaaagugcuaagauuacaggcgugagccaccaugcccugcccauguuuaacuuuuuuguuuguuuguuuugagacggagucuagcucuuaucaccaggcuggagugcaguggcgcaaucucggcucacuguaccauccgccuccuggguucaagcgauucuccugccucagcuuccugaguagcugggacuacaggcacacaccaccacgcccggcuaauuuuuguauuuaguagaguaguuucaccauguuggccaggaugucucgaucucuugaccucgugauccgccugccucuuucucccaaagugugggauuacaggcgagagccacugcgcccggcccguuuuaacuuuuugaggaacgaauauacuguuaucugcagaagcuggaccauuuuacauuccaccaacagugggcaaggguuucaucuuuuccacaucccaacacuuacuuuccauuuuuuaauuacagcuaucccagugggugggaggugguaacccacuguagcacugauuggcauuuuccuaaugauucaugauaucaaacaucuuuccaugugcuuuuuggccauuuguauaucuuuggagauugaaguccuuugcgcauuguuuaauuguguugucuuuuuuauuguuaagagaguccuuuauauauucuggaagcuagauccuuaucagagacaugauuugcaaauauuuucugucauucuguagguugucuuuuuuacuuuguugaugucuuuugaugcauagaaguuuugauuuugaugaaaucuaguuugucuauuuauuuucucacucuuuuggaaucauaucugagaaaugguauuguuuuacuccuguuuucuuauaagaguuuuauaguuuaaagcuuuuacauuuaguucuuugauccauuuugaguuaauuuuugugugcgcuguaagguagggauccagcuucauuuucuuuuauguggauauguaauuguuccagcaccauuuguuuaaaaaaacuguggucuuggcauuguuguugaaaaucaguuggccauagguguauggguuauuucuagagucucaauucuauuccauuguuaucuguauauccuugugccugcacuauaauguuuugguuacuguagcuuuguaguaaguuuugaaauuaggaagugugaguccagcacauaguagaaacuugauauauacguauuauuguuuuggucaacucauucauugaaugaccaauuuauucaacaaauaguuuagucuccucagugccaggcccuuugcuggguucuguggaugugaauagaaauuaaaauaagguggagucauccaacaguuacaacugggugccauacgaauuuuacuauaaauauguacuggacacuacacugacucagcuguaggaacagaguaggcugggaagcaccuuugagaugaggccgucuggauguaagagucuguuucuggcagcagagaccuggagugugggaggccugcuugcucuguuaggguuugaacuguauccugacgaucaugggaggcauuggaggauuuuuaggcaggaaaaugaugugaagggauuugcauuuaaaagagauuauuugggacugggcacaguggcucacgccuguaauuccagcacuuugggaggccuagacaggcgggucaccugaggugggaagcuugagagcagccugccaaaauggugaaaucccaucucuacuaaaaauacaaaaauuagccaggugugguggugcaccuguaaucccagcuacucaggaggcugaggcagaagaauugcuugaaccugggaggggagguugcugugagcugagaucgcaccacugcacuccagccugggugacagagugagacuccaucucaaaacaaaauaaauaaauaaauaagagaauaaaauagauaauuugggcaacagguugauguuaauuccccaccuuuguucuucuccuucaguacuguguuggcuggucugaaucuuuuggcuuuucauauaaauuucugaaacuguugcuaucuguucucugccuguuuuauuuuuguuguuguuguuuggauuuuuuguuuuuuugagauagagucuugcucuguugcccaggcuggagugcagugguaugaucucagcucauugcaaccucccccucucagguucaagcgauucucuugccucauccuccugaguagcugggauugcaggcaugcgccaccaugcccagcuaauuuuuguauuuuuaguagagaugggguuucacuauguuggugaggcuggugucgaacuccugaccucaugauccacccgccucggccucccaaagugcugggaugacaggcaugagccaccgugucuggccucucugccuguuuuuuaagacuuuugucuuuggaguuuugcgguuucuccacugugguuuuccauaugaauuuucuuuuauuucuucugcuuaaaauuuguaggccaguuggucaugguggcucacgcccguaaucccaguacuuugggaggccggguggguggaucgccugaggucaggaguuugagaccagccugaccaacauggagaaaccccauaucuacuaaaaauacaaaauuagccgggcgugauggugcaugccuauaaucucagauacucgggaggcugaggcaggcgaauugcuugaaccagggaggcggagguugcggugagcugagauuaggccauugcacuccagccugggaaacaagagcgaaacuccaucucaaaaaaaaaaaaauaauaauaauaauuguaggccuuccuuaagaaaaauaaaauaaaauucuaggcugggcgcgguggcuccugccuguaaucccaguacuuugggaagcugaggcggguggaucaccugaguuaggaguuugagaccagccuggccaacauggugaaaccccgucucuacuaaaaauacaaagaugagccauuugugguggcacccaucuguaaucccagcuacucgggaggcugaggcaggagaauugcuggaacccaggaggcagaaguuguagugaaccgagaucaugccacugcacuccagccugggugacagagcgagaugccaucucaaaaaaauaaaauauaaaauaaaauucuaagcccugcaaccaacugaauggagcccuccccuuggucaagggaaccccagagaaaccuuggaagcuugaguuccuggccguagcaggagaggaggucagacgcgccucacuguaccccucccuccccagccaccauuaggcuucuucacuaagggcuaaacagaaaccagcccuuuucaaagacucuacacugcuaauguggauuacugguuuaucuucccagauacagauuaaagacaagaugagauuaaugguuccuucacccuucccugagaggucugcuuaguucucuuccucuguuuccuucuaucuuagguaaaauguacauuuacugggcacuuacugaagucucacaaguacguaaccacucaccucacagccacccucccucuuugaaggaccacauguaauuacuaaaccuccugagaaccucuugggacagaaacaagcacagaugugccgugacucauguuuuuccugugggcacccucaggcuggcucaguagcccucacuugcuugagauccugaaucugcggguuggcgucuuucaugguugcuggaucauacucugccguuaucucuucggauaugaguugccccuagcccacuaucuggccccucucuuuagggaccucugauugaacauacauuagaccuucucucuccugcuguuccugaucacucuucuguccuguaauugcugcuucuugugcugcauucuggguaauuucuucuggucuuuuuuccaguuuacuaauauuguauucuguuauaagguccuuccauugaguguuucuuucuuucuuuuuucccaaacagcaacucaaaacagacauugaguuuuaauuuugguuccuguacuuuuuauuucuagaaguucuauuugguuauuuuucaagucugcuacauuauuacauaauuuuuuaauaauuuuauaucuuuaauagauaguuuuuuguuuuguuuuguuuuguuuuguuuuuugagacagagucucgcuuuguugcccaggcuggagugcaguggugcaaucucagcucacagcaaccuccgccucccagguucaagugauuccccugccucagccucccaaguagcugggauuacaggcacgcaucaccacgccuggcuaauuuuuuguguuuuaguagagacaggguuucaccauguuggccaagacagucucgaucuccugaccucgugaucugcccaccucggccucccgaaguccugggauuacagagcugagccacugcgccuggccuuugauagauauuucaaguucaucuuuuuuuuuugcuuccuuaauuuuuuuuuuugcuauaccccaugccuccaagauaacaguuuuuucuuuuuaauuuaaauauaauacaguuuuacuguguauccaagaauaucugaaaucuuucgugggucucuuucuuuugucuuuuguaucuguugcuuuuugcugggcugagccugcuuaaaacaagccccguuagcuguaaagguuuaccuuagaaagucaggugucuuccucuguaacucucucccuuuuccaucugcuccaaggcauuuauuuauauuaaucuugacgcaaagggaaguuguguccacuucaccuuggccaguaaggaagcaguguuuggcagauguuguuacuccuaauaaugccagccagugagugaagcugaccugaaugccucccagggcugaggcaauggcaugaucaccgaagcucaaaccagagacaguuucaccuuucugacugaauaguguucgguguaggccaaaugccugcagacuacuguuugaggacugguguggucuaccagguguuuccuuagcgccuggaugucucuggcugccaucccagggauagagcaugguguuagauacgcuagaugccugccgaaguaauuaugggugaaacauaugauguccaagauuugcuuuuaaaggcuccaauaccuccucccagauuccggagggcugugaaacaauuagcuaugaaaacugguaauuccugaagcuggguacauggggguucaugaucccucucucaccuuuuuugggggagaauguuugagacuuuaauaagaacuuguugccuuuuccuuuuacaggguguugcaggcaucuuccucaggccuguuuucucuguuuuccaggcugacgugauggcagacaggguuccccgcugcccggucugcaccggcguugugaagcccgacauuguguucuuuggggagccgcugccccagagguucuugcugcaugugguugauuuccccauggcagaucugcugcucauccuugggaccucccuggagguuugucagcaggccugugcagggaggaggcuggagggcaggggaagggagggguacaggagucaucucaugggcugucggcaggccugugcagggaggagucuggagggcaggggaagggagggguacaggagucaccucaugggcugucggcaggccugugcagggaggaggcuggagggcaggggaagggagggguacaggagucaucucaugggcugucggcaggccugugcagggaggaggcuggagggcaggggaagggagggguacaggagucaucucaugggcccuuccagggcuggugccacuuugggaaggugaauggauucagcugggguuccaggcugagggagcagcagccugugcaggagacaggaaggugggaagcugcugggcuuuggaggugguauagguguggguggggcaccacgugugaggagaagggagaaggaugggggugugggggcgagguggaggggcagggccucccaggucagaucaggaauacugaugcugcagugggaggagugauaaauccacagggacuggcccggggacguagcugcacccuuggggucagggaggccuuuggggaguggagaguggagcaagcagugccaggaggcugguccuggagaagguggagcuguggucgccugagggauggcgaggagggggacuggacucgcagucugugauguuuuggggacgugagaaggaggcgucuggcuuggucuguaaggucagggcacuugcuggugaggcgugauuugggagggaggaugcccagcucgguucugugugugucugaggugucgggaaacaugcccuggauguguucaagcagcuguucugcgucugcgucugcagcucaggaaauuccuaaaagcugugaugagagcaagaaaugagaccaugaagucagugugugcgugacuggauguaggcaccgaggacagaagggccagaaagaccugugcucagaggggcccagggcagccacaggggcccagagcauguguuuguucaggcauucauugugugcugggcccugcuccagugcuuuggacauacacggucagaugucaguguaagaaguuauauaguuuguuaggagaugauugauguuaugagaaagauaacaaguaggauagaaaggcuagaaggguugggaaccagcugcagugucaagucaggcagguggaguuggaucuaagaguuuaccgaggugaggagggucuggcaggggacacugcacaggugacaagcagcaaggaggguggggcgaagucagcauugauggccacggggcuggagcagagaagaagguggggcacaagugucaucucaugggaggcuggcgccaccucagaaggugaauggguucagcuuggguuccaggccagagucugaaguugagaggacuccguugggugcugggcugugagcccaccaugggggcaagacugggagcagcagacccagcagggcccuuguagguaaucaccggcuggcacuggcugggggccagguaaagccagcagaggcugaggggugcuggagucugggugugugugaacgcagaguggguacgcuggcacagugcaugggaggccguggauucccaaggaccccagggcuguggcuggagcagcuggaaagacggagccgccgcuuccugagauggagaagccugguagguggguuugggggagcucaggaacucagccuuguuuccacggauuugaggaugugcugcggacuggagguguugagcagguggacaugagucuggaguccaggaaggcccagaggcaggagcuggggugcuggagugagcagacaggagagcccaggguguggacagacaugagaaugccaugcuaggccuaggauggagggacagacacaggaggagcagucagaggggccaugguggucagcacagugugggcugagaccagcugaccgugcuggccaccagguguggacacuugggccaccagccaucuuuauuguugaagugaaaugaaaauggccuuuuuccugauuauaaguguaucaugugugucuuugaaaagauucguacauuauauaaagauauaaagcaaaggaucaacuuuuuaaucccaccaacuguuagcauuuuauucuguguccucucagcuuucuuuuuuuuguacaaaugcauacguacagaugguaauuuuaaacuaaaaguuggacagcacuguacauucuauucugcagccugcuguuuucacguaacaaugugaguccauggagaugugcugcguuguuaaugccaacaguuucccuuacacggauaugaggucccaacugagaaacccaugucuguaaggcuggugccaucaugaacugaaugagcuggugucacgcacagacucuaucucaugugcuuuguggacgaaauguuaauguguuugacuguggaguaccacuccagauccccuuuaggugugacauaacgugggauguaaaccauaugaucuuuucuaaaaucucaaaaauucugaaacauauucagccacaagagcuuuaacauagauuuuguggauuuaauacaaaauuuauguaagcaauuucuuacugauggacaaugauaauaaauaguauauaauuuuuacauuaaaaguaaugcugggccaggcaccguggcucacaccuguuaucccagcacucugggaggccaaggcaggaagauugccugaagcuaggcauuugagaccagccugggcaguauagucagaccucgucucuacaaaaaauaaaaagauagccaggcauggucuguguaguugcagcuauuugagaggcugaggaaggaggauugcuugagcccaggaauuugagguuauagugaacuaugaucaugccacugcauuccagccuggguaacagaaugagaucccgugcuguagugaauaucccuguguaucauccuuaucuacucaugcaaguacuccugaaggguaaaugcuguagugaauaucccuguguaucauccuuaucuacccaugcaaguacucuggaaggguaaaugcugauaaauacugagaacuugccuuccggugaauaucccugugugucauccuuaucuacccaugcaaguacuccugaaggguaaaugcuguagugaauaucccuguguaucauccuuaucuacccaugcaaguacucuggaaggguaaaugcugauaaauacugagaacuugccuuccggugaauaucccugugugucauccuuaucuacccaugcaaguacuccugaaggguaaaugcuguggugaauaucccuguguaucauccuuaucuacccaugcaagaacuccugaaggguaaaugcugauaaauauugagaacuugccuuccagaaagauguaacaauuacacugccacaaacuguguuuuuauguagccauuuuaucacauccucaccaaaaccaaaaucacacaaaucaaauugguuaaaaaaugcauguguguguguggaggggggugcggauuuugccuuucuguaguaaagaaugaaguucaucuuuucauguuuauugccaguuguguuucuucucuuuggauuguauauuuguaccucuugaccauuuuucauugggucauuauaaauuagcaauauaaauuaguuuuaauuuuaguauaaauuaaauaauauaauuacauuuuaauguuaauauaaacuucuuucuuuuuuuuuuuuuuuuuuuugagacagagucuugcucugucucccaggcuggagguucaguggcgcgaucucggcucacugcaaccuccaccucccaggcucaagccauucuccugccucaaccucccgaguagcucggauuauaggugcgugccaccacgcccagcuaaguuuuguauuuuuaguagagacgugguuucacuauguuggccaggcuggucuugaacuccugaccucagcugaucugcccgccucggccucccaaagugcugggauuauaggugugaaccaccaugcccagcuguuaauauaaauuucauuauaaauuagcauuauaaauuaguucauaaauuauauguuuauaaaugaguuuaucaauuagcaauauaaacuauugucauauguuguaaauauuuuugcaguuuaugaugaugagagguuuuuaaaaauuuuaaauuuucuacauaguaguuuuauguagauaccgagauaauaguauuuacauagucagaucugucauuuuccuuugccuuaucugacuucaguuuuuacgccuagaacguucuucccuauccuuacuuguaaauccuuaguuuucuucaagaacuguuuuguuuacauugaaaccuuuaauccauuugaauuuuuuucagugggagguaggaauggaguauuuuccucccagauaaugagccaguuuuaaugccauuuauuaauguauccauuuuuuuaccuuguuccucuuaaaagaagcuuugagagcuguaugaagaagccugauggcaccgagcuaggccucucuagaggcuggguggggaagaccauggagagacguaacaguaacuccugcucgggggcaccagcucgucugggugcccgaugcuggugguggcugucagagcaagcagggcuagccagaggagauggacgagucugugcuguugucccucugcgucaugcugggagacagcgagguggggaggacagggagaacagaacgugcucacaaagaggaggcaggaagguuggaucccugaugagccuuggaacggagguggggaaaagcaaggauguguggaaacagcaagaagugggagagagagagagaggcggaggggagaaaaccgucacggaggccaagcggcaggagcucagcugaagaaaugagauuggugguggguuuucccuauaucgcaggcucugacugccaaucugcugcuccuccaaggccucgguggcuguggcaugaaacauccugaggagcuuguaaaguggacacugugccccucacguuuggcccauuuuucagguggagccuuuugccagcuugaccgaggccgugcggagcucaguuccccgacugcucaucaaccgggacuugguggggcccuuggcuuggcauccucgcagcagggacguggcccagcugggggacgugguucacggcguggaaagccuaguggagcuucugggcuggacagaagagaugcgggaccuugugcagcgggaaacugggaagguacagacugcugaggaggaccauccaaggggcugcccuucucacugcucuaggguaugguccaccugauauggagccccguugguuaacacaguaacaguaauagcugaugaugcugugaauccugcaccaggcacuaccuggaccugacuggguguuacuuucaauaccuccauuuagagaugaggaaacagaugcuaacaggccaagcagggacacgguccagacacucagggcugaugagucuguauucuuaacagacuauaggcguuaccuucacucccuaaaauaaagcagccaacagugucccucuaaggccugguaugugauucuaagaugauacggguuaaagaacuuugagaagcuaaaguucucugcaucuaugugggaugaaggcuacaugagugaugcuuuucggaaguaauugguaugagagccauugaucaauuauaauccgcugaggaaagccaaagagccuugaugcuuucuaagagauuucaaaccgccuauaaacaagugaaguuacagaaaaugcaguuucccauaagaaucauguagcauguguagccuugauauuaaggguuuucaaugggaggugguagcauuaagcauuuaaaguccagugucaugauuacaggcagguguaacacuguccaaaggggauuucaccaguguauuagucuguucucuggcugcucauaaaggcauaccugagacuggguaauuuauaaaggaaagagguuuaauggacucacaguuccauauggcugugggggccucacaaucauaguggaaggcaaagcaggagcaaaguacugucuuacaagguggcaggcaagaggacgugugcgggggaacugcccuuuauaaaacuaucagaucuugugagacuuauucacuaucagaagaagagugugggaaagacccgcccccaugauucaguuacuuccacuuggccccacccuugacacauggggaugauuacaauucaaggugagauuuggguggggacacagccaaaccauaucaacuacaauauaucacaguugaugcuccucuugccuuccaaggcagaugucuuaggaaauccugauccuuuuuccuuguccacagcuguggcugccucauggcucagggccauggggucagcacucuccucaccuccaccaguccaagaccuccaaccucugguugcaggcugauuuuuuaccaaucauggucacuucauuauggaggcagggaacccagcuaacaaugaggcuuaaacgcugagaggcgagugccuccuggccagcucacaaggcagcggagaucuuagaucagcccagcaggcuuuuuugagggauccuuuuccugcuccaacuucauauuuucuuuuuuuuguaauggaguuucacucuuguugcccaagcuggagugcaauggcacgauuuuggcucacugcagcccugccuccuggguucaagugauucuccugccucagccuccugagcagcugggauuacaggcaugugccaccaugccuggcuaauuucuguacuuuuauuagagaugggauuucaucauguuagucaggcuggucucaaacuccugaccucgggugauccaccugccucagccucccaaagugcugggauuauaggcaugagccagcaggcccggcccaacuuccuguuuucauagaaaagcagauuguaacucugguagcuccuguggaguuuuggaaguggcuuaauaggauuugaacuguauaaucuaguuucagagaaauguauguaaaauggguuaugauuucauuuucuguuuuuuacagcauuacuauccaagggguuacuuuuccaaauagugaaugcuuuuaagcacaugagcaucaguacauauugauuuggguacuuuaagacccauagaaugaggcucuccauuuagccacccuguucugcccaggccugcugggauccucuuagcccagcacagcagcagcaguauuugcagaaagcagcuuguuuugugaaauauuuugcaugucugcagcuagagcuguuugaacagagaucugcuggccugccuggguguguaaacagauagcugauacccucugucuucuguauuccagcuugauggaccagacaaauaggaugauggcugcccccacacaauaaaugguaacauaggagacauccacaucccaauucugacaagaccucaugccugaagacagcuugggcaggugaaaccagaauaugugaacugaguggacacccgaggcugccacuggaaugucuucucaggccaugagcugcagugacugguagggcuguguuuacagucagggccaccccgucacauauacaaaggagcugccugccuguuugcuguguugaacucuucacucugcugaagcuccuaauggaaaaagcuuucuucugacugugacccucuugaacugaaucagaccaacuggaaucccagaccgagucugcuuucugugccuaguugaacggcaagcucggcaucuguugguuacaagauccagacuugggccgagcgguccccagcccucuucauguuccgaaguguagucuugaggcccuggugccgcacuucuagcauguuggucuccuuuaguggggcuauuuuuaaugagagaaaaucuguucuuuccagcaugaaauacauuuagucuccucaaagggacugcagguguugacaugaguuggaaagggaacccugggauacguggcguccccucuauuggaacagucugaggacugaaggcauuugucccuggauuuauuggagacggcccagcuccucccucugaagguggucacauucuguugacucuccauacucagccucuccuccagaaacagaucuguuccagaacauuccagcacuuucuaucuggccuccuuguccccacacuacgcccccccacccucgccagggcuuccucuagugacacuguuagagcuaaucucugagacagggaaggcauuacucacuuaaaacccaggcugaguccuggccaccugcuggauugugacauaggagguggaauccacugaacugcuacuucugcacaggcuccuucuccuggggcuguacccaggcccagcccugauggcucacccugucaggcaccagcugcucccuccugggcucucacccaccugcacauccuccuuccuagcaucacauuaccugcguguuuccccagacaaaagcacuucccauucuugaaccuugccuacccugggcugagcugacggcaauagauuuaaugacagugacucccaggaaggggguccugugacuuugcgccuuaauaagaacaaaagguggaauuggugaccuaggaaaacuguugaauucuaaaaagaaugaaguuaguuucuaacccuaguuaauguuccuuuuuuauuuuuugagucuugcccugucacucaggguggagugcgguguuaugaucucagcucacugcaacuuccgccucccggguuuaagcgauucuccuggguagcugggauuacaggugugucccaccacaccuagcacaugggcauauuuguaauagagacaagguuuugcuauguuggccaggcuggucucgaacuccuggcuucaagugauccacccaccucggccucccaaagugcugggauuacaggcaugagccacugugccuggccccuuuauuugauaauuuacacauacauuuuuguccaaaacucuucuuuauuucaagaugauguuucuguggcuaugugugguaugugguauaaaucucaaucuaugguca

SEQ ID NO: 191815 - RNA, 1324 nt, Homo sapiens
cuggaaccaggcacuuuuaaucguggaaccgaggggccuggagugugaggagggaggggcaggaucgggggcagaguuagggcccgggaacucucggguuagggugaagaccccggggucugacugguucagccuuaggugcccauguuggggcuggagggccccaggaucaggauggggcagggauggaggccccacagaaggagggccaggcuccggggagucaguauugggccccaggggcagcagccuggggucaguguccuggggcuagugccccagaucaggacccagccugucagucauaguccgcgucaucaaacuuggugcugaagaaggcggcagaguccuuggccagccgggccaggugcagggcaccagucaccaccagccccaggagcagcaguggcggcaccagcguccacaucgcggccaggauguuguagcacuuggcuuuggagccaaaacgccgggccgcuuccaggucaccaaccaccuucugaucucgggccugcagagagaccagaccacagggccagaucucuauguguccucggggccugggggcccuuccccacccacacccugggcaccuggaaggccccuacugcacccaaaaucuggauggagggguguggccugaggagauacuccuuggggccccagcuauggacccgggggccaucccaggccagugucagccuaucagagcucucuaugggugagggucccccagggugcugagacaccccccacccugccagccaggagcugaagucaaagggaccucuguuccagaagcccacagcaugugaacccccucuugauugcagagaccucugugggugccucccaauggccucugugcucuuggaugggccagaccccguuaagaagaggccccccggccuugccuucgugaggagcucuuucccggccauacugauagcugugcccacagagccccucacggacaagcagagccccccgcggcccccagcacggcaaggaccccccacggagcuccccaucccucccccuuccccccaccuugauggaguaguggagccucccccgcaaccucgguagggccccugcccaccuugauggaguaggccagcgccaggaagccgaggcaacacagauucagguagagggugcugaacaccgaccagaucaaguggucucgaggcggggggugcggggcccccagugugagggcugugugggcaccggccuugcugggcgugggggcccggguguccucgcggggauacgccguguccauggguuccagcgccgucucuuccacacucagacuggu

SEQ ID NO: 191816 - RNA, 41108 nt, Homo sapiens
caaugcaccgcacacccuuuacuggccggccccgcgcugcucuccuaagaccccgcgggccagcgccgcgaccccuucccagcgcuccucgcgcugugugcggcgcguccucucgccggugacccggugugcguggggucgaggcgccgggcggaguggcuccgggccgaaacgccaugcggaggggcgagcgcagggacgccggagguccgcggcccgaguccccggugcccgcgggcagggccucgcuggaggagccgccugacgggccgucugccggccaagccaccgggccgggcgagggccgccgcagcaccgaguccgaggucuacgacgacggcaccaacaccuucuucuggugagggcagugggcggccgcggggcggcgagggugcccucgaccuggggguuccggcaccgcuggccuggggguccccggcagcgcccucucgccgucuuggaguccaggacuguggccggggguuugaggguguggcagcaccgccccccgggucccggggagcggccggaccgagcucccgacgccgggucgggcggagggcggcgcuguaggugggggagacccugggcagacccucccugcggccgcuuugcgucucucucgccgcccuccccaccccugcccgccuuggcucugaccgcgcgguucugcgauccagaccccuuccccgccacccgccuccagcgucaccccagaaacgcuuucucuguccugcugucgaagcuucaccugugucccccgucauucugccugugguugcuccucagugcuugcggcugcacgaaaucaucuugugugucgcgcccgaccccacguggcgaucguguugauuagcagaguguugugcgugcuucaggaauguagucgguguucgucgaauccaggcucuguuucucuccucaguugccccuagcggggccagcgccuccucccugcacaacucagcccuagcuacaccuuggggucccccuguccgccacucugccuuuaauggggguggaaaaggaagaggcccccgggagcagcuggaguguggcacucuguguccagacaggcuccaggugccgcuccuacucccgacagcugcgacccugggcuggcccuuugccgaugcuccucugugagaaggaucaagccgucgaccugaaagcaggcuucgugagaggaggguuuggcucuucuugacugcaaggugcccaguucccauccuguggaaggcccgggggcacaggggcaguagagguggggucagccccaggaaaacgugugggagacaggcgccugcggccagcaguggaaggaaggcuuuauggacgcuuccaagagaaccaugcugugggauggucggagagcaaaucugaggggcgaggagggccugauggaggaguaagggacuugucaggggaaggcgccaccacagacagggacuuaaccgguccuggccugucaccgcagccgaagcucuggagagagacuguccaaguggugggaaagcagguuaggguggaggaggccccacgcagggucuuccgugaggugugggcagcugcuguugcagggagggcauccgagcucuccuuuggggagaugaguguaccggguggcugcggggcccucgggagggagaggagauggggugccugccacguggacccucuggcuuccgggcccuguggacaucaggccucuccaucaggugcccugccacaccccuucaggcuguccucccgcagcacagcuggggaccaccggagucucugagguccuggagcaaggagaccagacuggcucuucugaggucccggagcaagaagaccagacgggcuccucugacaucccggagcaaggagaacagacgggcuccucugaggucccggagcgaggagaccagacuggcucuucuuguuucucauuuggccguucagcacauuguggggaccccuacugccugucaguuaccguucuacgggacauagcagagaacuaaacaagaagcuuagauucuggugcaggcauggaacuucagaaggcucaaaaugugcuggcugggugcugaguguggcaggagccagggggcacaugcaagccugcgcagcccacccaguaccagggaagcaggagcagcagcccaaagguaggagggggccggucucuuuagaagcccagaccaguggucccugcccacaagggguguuugggacacagacggcugggcgcagcagagcuugccugucaggaggccaagggggucaggagggcucuccaggagcgggugcagcggggcuggcugguccagguaccuccuuccugggucuucuggguggguggcucuggcucuggcuuuccccucgacccugucccuguagagacgcauggggcagguucuugcugugccuccucccuucccugugcagaggaaggagcuucacgcuucuggguggcagguaacucaaugccugccuggugagaauucauuaccugcagagccucacacugaccuccugaguccaccugcacugacuugcugugcuggcauuuuuuuaacucuaauuuuguguuuuagagaguuuuacuuuuuauuuuuuauucauuuuuauuuauuuauuuauuuuuaauagagggucccccuguguugcccaggcuggucuucaacuccuggccucaagugauccuuccgccucagccucccagauugcugagauuacaggcaugcaccaccacauccagccagggcguucauuuucaaggaugggugcacuuccucgggccagugacggcggccaugugugaauuuuguuucucugugacugcuugucagccauagggauagggcgugcgguucgauucagggcuugacuggcccugggagcacgaggcugagcucuccuucucuggauucauucaggguagcaaggacaauuauggggaacauccagaggaaaacguuuagauccacagacuccgagaagcccugugcgaagauguggcagcucaugcggucuggaaauuguuugggagaacacuuggggaccccuuacccuggcgaggugccugugaacguugccgccugucugugggagacgcugaagcagcuucggaugaccacacuugcuaaccaguucccgagcugggggccacugugauguucugagaguuuuuauuguaugcuugugucuuggaauggggugccucaaaugagccuucucagugaccugaggacuuuaugugugaggugaccucugaccuucagauaccccagguuucuggaagaugccuuucuccaucauccuggaucggggcuuucccagcuuugccuacaccugggaggcgcgaguagccagaugaagucuuucuggucuugcuggucagagccagaagggccagugcccgguccaggagccucucgcaggccuugggcugcccauccaggcguggccuuuccuuggcccuuuggacgacgacgccgcguuuuccucuuggucucggccucccugcccaccaugagaguggacaugagagugaccaucuccaaggaggcagcugggucuuuuccacuccccauggcagggagccagcugucuucacgcccucacccuagugaaguggcugaauugccaggauugaucacagcucuguucugugucugaucacaggacauacaccguccugcagagucugcaggcgggugggaggagccauugaacagaccuggcguccugggagggacacggaauucuucccuugagagucucaugcuaucuugagcggcacucugucacuuccaagauguguagacgucgugcugcguguaggacaaggacuggagcucacuaauacggaccuuacuuuccaggagcguuggauuugagcagcucugagauguguccuccugcagggcugcugugccuggugcccuuucucugggucccuuacccucugccucccuuccuguuggguccucuucauucccauuucugcuuccccagggccaggagggugcugggcacucgguggccaccucaaugacagugugcacauuuaccugaaggggcgaaggguuaccuuuauauuucagguaaucucuguguuuuggggaaauggaaagaugguguuggguuaggguugaucaaugaucagcguuucccugggcuacacaaggagugaguguuggguugguggccacuuuagaaaccacaggaaggucucugucguggaaagucguauuaaaggagucaaguuuuacgccuguaaucccagcacuuugggaggccgaggcagguggaucacgaggucaggaguuuaagaccagccuggccaauauggugaaacccggucucuacuaaaaauacaaaaauuagcugggugugguggcgggcgccuguaaucccagcugcuugggaggcugaggcaggagaaucgcuugaaccugggaggcagagaucgcgccaguguccuccagccugggugacagagcaagacuccaucucaaaaagaaaaaaagaagucaaguuucaauuuuaacuuguguuagugugugauccugucuuugugugcuguggaacuuggugcuggugggacacaggcugcucaccccaucccuugagcuuugcguuuauuccugggauucugcaugugaaugggagccugugcuguaucugggagaugcugacuggguugcaggcacguccgagggucaggguggggccgagugcagccuccuccuccagugggccuguguguggagugguggcauucugggugucccugaggccuggucguuuccaucuucuuccugagcccacauggagaugacgagggguuuccugcuggucucuugcagaacaggguugagugguguccucacguugaucuagcuucugggucucccauucugcaugugagcagguugaugggcuguugucucuuccacgguuagccucccuuaggcuggggcuccuucaccccucuuuucuuagagacauuacugcccagagugagaaccccucacgugggguggccgugugguuccaagacaggguccuguggaggcccuguuagcuuccccacuggaggccucccucacagcaggcuccugucccggcaucugcacuccagccaggcagaguccugcucccgugcacaccacacccugucugucugugcugugggcccuuggcgggguucugggugucuggagccccuugaccuuguuccuccuacaaggugaccucgucaggaagccccaggaugagacugucccuggcuccuccaaaggucacuucagacaugugcacccuuuggagaggucccugcuguuucucagaacugcuggggauggaggcugagcccgagagugcuugcuccucgcgcucccuucuugcuauggucuccggagaugccucccaggccacgagcccuccuggcgugguuuuacugggaccuggcuuugcaacaaaaauaguuguuuuaaccucccuaaccacucccaucccucuuuuguuuuucucuauaacguguaggguuucuuagcucuccuguauuggucucacuccacuggaaggaaggcucaggaacgcaggcugugucuucucccggguguggcuggggcgggggcucagggaauggcugugauggcccaguguccaggaggcuccgggccccaccccccgccuugcugcaugaccuucacagugucacuuaccggcccugacuugccugcgggcaccacgcacacggcaugaaggugcccuggcccggggcacggacacagccagagccaccgcgcuccuggcugucaucacgucguuggcuuugcgaucuaaaccugcuuguuguuuugguuuuucuuucuuucuguuuucuuucauucuuuuuuuuuuuuuuuuuuuugagacagaaucucacucugucacccaggcuggagugcagggaugugaucucagcuuacugcgguccccgacuccugggccgaaguaaucuccccucacccucccucuucccaaguagcugggaccagacaugcgccaccacauccaguuaauuuuuuuuuuuuuuugguagaaauagggucucacuauguuucccgagcuggucuccaacuccugggcucaagugauccuccugccucagccucccaaagcucuggaauuacaggugugagccacgguaccugcccccaaacacuccugacucuucuuauccuaaccggggucaucuuacucuccucaccgaaaucugaugucaccuguauggaggaaagggugggccucauggaggggcaggccagggacaaggggacuccugggccccagcugagcccagcccguuuccccucaagggcugucuccaggaggacacguucuguaaguguaguguucagcagagggugaguuucugggucgccgaauccaggcacccuuaggaaugggggccuaagagggccuucugacguggguucucugcugugauugugggcaggucucucaguacugaagggccccacgguguggagcucagcaggaaggcugagguucccugcgguuuccucauggcuuaggacucaaaugcaaauguaucuaaagaaaaaggugguugauagucacaaugaaacuuuuauuuaccucugguugucuuaaaugccuaguauuguaaaauauggcagaagaauucacuuucaugccuguaaucccaacacuuugggaggccaaggugggcagaucccuugaguucaugaguuugagaccagccuggaaaacauggcaagaccccgucucuacaaaaaauacaaaaaaauccaaccugacccacauggcaagaccccaucugcacaaaaaauacagaaaguuccagccuggagccuccaccugcaguccugcagcuccacccuggcucuucaugaaaucggcuaaguccaggugugggugcguucagugcagcacccacgugcaggugacacgcccaugcaccgccacaaccacgcucacaccagaacauuccaucauccggaaggcccgugucuccgcuccagucugcuuuucguggaugcaaacucauuuccuugagucgugugugggugacagcagaugggagguuucuuuugugccuggcgucuguagcguguuuuucuuuuucuuuuuuuaucuuuugagacgggaucucacgauguucaugauguugccccggcuggucuugagcuccuggcccaaaacaguccuccugccugggccucccaaggggcgugucuuugagaucuauccacguugaggucguugccagcagcacauuccucugagugcugagccaugcuccgcuggucggagggaccacaguguuuccuccacugauagaguuuugguuuguuucccguuuuagguuauuauaccugaaacaucugcauguaagucuuugacuggaccuguguuuucaucugucucaggcccacguuugggagugugucuuugacuggaccuguguuuucaucugucucaggcccacguuugggaguauguggcuggcuggauagcagacguagcauaggccucacuuuucugugccguuuugcagucccaccugcagugcgugagcaucuugcuccgagaccucaccagcacucugcauugugauguucuuaauuucagccguuccagcagaugugcacugaugcugugucguggcuuggauuugugaugcuuuuaauuucagccguuccagcggauguguacugauguguccuggcuuggauuugcuuucacggugaccagugcugcuccucguuuguucaugugcuuauuggccauuuguauguuuuccuugugaagugucuguucaauuuuuugccuauuuuuucauuaaauuguuuauugagcuguaugaguucuuuauaaauucuggauaaaaaguauuuuuuuucuuuuuuuuuuuugagauugagucucgcucugucgcccaggcuggagugcaguggcgcgaucucggcucacugcaggcuccgccucccggguucacgccauucuccugccucagccucccgaguagcugggacuacaggcgcccacccaccacacccggcuaauuuuuuguauuuuuaguagagaugggguuucaccguguuagccaggauggucucgaucuccugaccucgugauccgcccgccucggccucccaaagugcugggauuauaggcgugagccaccgcgccuggccugauuuuuuuuuuuuuuuuuuuuuuugagacagaucuugcucugucucccaggcuagagugcaguggcacaaucauccuagcgcacugcagccucaaccugggcuuaagcgaaucugccaccucccgaguagcugggacuacaggugccugccaccacgccuggcuaauuuuuuauagagauggggucucacuguguuacccagucugguccugaacgccugggcucaagcaauccucuugucucagccucccaaagcguugggacuacagacgcgugcagccuacaaaguuuuaucagauauauguauugugaauauuuucucccaguuugugacuugccuuuucauuucuuuagggcacaaauaguuuacauuucauggaggcaaguccugggcaacaugcuuuaagugcauuguucacuuaauuuucaugauguccuuggaagucagaagcuuccccauuuagauaugaggaaacugaggcacggaggggugcaucaucucuccaaggacacacuccaguggauguaggaccuggguuagacgugaggacacacuccggugaauguaggaccuggguuagacgugaggggacacuccgguggaugucggaccuggguuagacgugaggacacacuccgguggaugucggaccuggguuagacgugaggacacacuccgguggaugucggaccuggguuagacgugaggacacacuccgguggaugucggaccuggguuagacgugaggacacacuccgguggaugucggaccuggguuagacgugaggacacacuccgguggaugucggaccuggguuagacgugaggacacacuccgguggauguaggaccuggguuagacgugaggacacacucugguggauguaggaccuggguuagacaugaggaaacugaggcacagaggggugcaucaucucuccgaggacacacuccgauggauguaggaacuaggucucugccuccauuugcagauggucaugcagagggggucucaggcgagugucuggcacaggcaguggcuggggucugguggcccccaguucugauacuaggcugguugugggcuuuuccaccagcgaugggacaggacaagacugcaaagggagcgcccugccuccuccucccacgucugggcucugacaggccagaggacgggcagacccacggcucguggcucacuccagcuagcagcggucacucugcaggccucugcucaggccccuucucagcucuuggugucuugggcugcugcacugaaucucagauguuauuucaugaacccaaagaguuguugucucggcuugucuugcgcagugaaaagcgcguguuuuacguguccaguugcucuuaauagcagauaccugcccuggacgccaguggcagcaugugcccucugagcagcggccuucagcuucccaggaacacggggcucuuccuguccagccuccugggggcuggucucagcccugacuggccagcagacgcagggucaucucggaguuacccagcuagggacucgcagccaguugcugguugggaguuggagaguggaguuuaagcccucuccuugacguagagaggauuuggggccuguuacgugaguauuuagcaaugcugcccaagcucugacaccaugcuuaugcguuuuuggauuucaggcgagcccacaccuuaaccgugcucuucauccucaccuguacgcuuggcuaugugacgcugcuggaggaaacaccucaggacacggccuacaacaccaagagguaagcugcccucuuguccugccuucugaaacugcccugugccccgugugguggguguggcacccuuacugcucgggcugccgggggcucagaaggccuucaccagagggcugcguggggccgccggccucucccuugagugugucugaugugcagacuccagggcugcccuuggugcugcguggcguucccggucagcccccgucgccugucacugggagccaggagucugugucaucuccacgugaccggcagccugugcugcguuuccucugaguuuugcauguugagguuggaacgagcugcagcagcuacagggcugagcccuugaguuugggcgucuccgggggugagguuccugcgguggccgcgugcugguuccguuagccagcggggcucuugcacggacaggggccgacacggaccgcagaccaucuggucagcagccaagcgaguaaacucgucuucucagguuuaucuccacaggcaggcaggcuagaccuuggguguguccucugccugaauuccauggauucugacgccagucucagaagugcguguggaagagaagcugguuuuagagccugugaaucagucuugaguuuucugugccugacucuccucucgcguugcucuuccgacgcgcgcacagggugugucugcccagggcugccuccugcccagcaaggcugcugacaccaucagggccuggccccacuugcuccggcgggauggugggaggaagccggagcagggucugagaccagcagcaggauggggacagagguggaaggaggcauuggaggccuguuggugucggggccacaaguuggcucugguuggcgggagcccugggguuuguaggacuuagcugucccuacagcucuugggccagcacuucauuuuguaaagcaagagucucgcuaucuucgugacuguuggguggggugaugggugggcauggugugaacgucaucacgcuugcacgggcguugguggcccuguuugcccacugauuugacaccagcccugugggcucuagaacacaagcaugcccagugcccugucuguaggggagcggaugcuuuagaaucacgcacagcagaccucauaacugaguccaucucccugggggcaguggggcauuucugguuagaaauuacuguugaggugccuggacccaggacucugcagccugcuccccagaugagcucacccuccauccucaccugggaggcgcagguggccucuccuguccuggucucccuacccugcuccuggcugcaugcucuguggguucucucccaccuugcugucaucccucucccagucagcuuugcuggcccuucccccuuuuucugagccugaggugccagcuugcucccaggccuggccuggccagugccucccgugcuccaggcccagcucgcuccuucucccuuucuuaggcagucccagcgggggucacgugcagaaccugcaggcccggugugcacuguguaacuaggcuccagaaauagaugagggagcaugugccgugccuggggccccuguggaggggccaccuggggacgcuggaccuguggcucuggaggcagugaggcagugggcaggagccccgugugugccuagagggagcuuucaaggaggacuuggucuuucuugaauucauccaucagcaccuggcuaggagggucuguggcaucugccgggcacagcaggguagguggauuaggaagcaggaccgggucucaccucaagugucccacauggcaagaauugucaagagcaggagugcagggggugucuugggagcacuccccgaaagcauucaccaggcccccaccaggcgcaucacaaagccucaccaccccaagccaggcccugcccucccaggccugguuccuaugggaagcacuaggugacccagacccagaggggccaggagcuuagaccccugagggggcagcaguggugggcacgucccccacuucacccagcacuggccucuccugaguggcccccgacgugagaggcuggguucugccauccuguccucuccagcagggagccccugcguguguucauugagaggggccaggagacgggaauucacggggcccugggcacucuucucugagguucuguucuggggacacuaaacgcgcucccaacucacauucucuuucccccucacccucuuugagggcacaaaagaagccaccuguccuucucugcugcuggcaccuagaaccugcucugggcuccuuccuggaaggcucggcugccccaggucacccuggcacugaccguggcucuguggcuccuuccagugaaauugccguggugcaccuguccugaguccauucucauggccuggacccgcacugcugcacaccagaagcccagcuccugggcagccacccuaccugccccuacgcaggguguccacacagaggguguccgcacacagggugcccacacacaggguguccccacacaggguguccagaaggcugugggggcugguuuacuuuuaauacuagaauuaucugauguccucaaggguagauuuucuuauauagaaaauaccuucuaggccaggcgcgguggcucacgccugucaucccagcacuuugggaggcugaggcgggcagaucacgaggucaagagaucgagaccaaccuaaccaacauggugaaauccugucucuacuaaaaauacaaaaauuagccgggcgcgguggcucaugccuguagucccagcuacucgggaggcugaggcaggacaaucgcaugaaccuaggagguagagcuugcagugagcugagaucgcacuacugcacuccaccugccgaaaaagcgagacuccgucucaaaaaaaaaaaaagaaaagaaaagaaaauaccuucuagaaauuaggcuuaauuuuauuuuuuauuuauuuuauuuuuuuuugagauggagucucgcucuguaccccaggcuggagugcaguggugugaucucggcucaccgcaagcuccgucucccggguucacgccauucuccugccucagccucccgaguagcugggaauacagggcccaccaccaugcccagacaguuuuuguauuuuuaguggagacgggguuucaccguguuagccagguuggaauuuuuuuuuuuuuuuuggucaauguugaccagguuggccucgaacguguagccucgccuccccaagcgccagaacaaacagccugagccacugcagcucccagccuuauuuuuuuguuuucagacagacucucgcucuguuguccaggcuggagugcaguggcacaauccugguucgcugcaggcuccaccucccggguucccgccauucuccugccucagccucccgaguagcugggacuacaggugcccgccaccaugcccgguuaauuuuuuguauuuuuaguagagacgggguuucaccguguuagccaggauggucucgaucuccugacuucgugauccgcccgccucagccucccaaagugcugggauuacaggcaugagccaccaugccuggccagccuuauuuuuaaaaauuaauauuuauguuauuaaaguuaaaaaguuauaaaacuagugugucuuuauucagcuugcugucauuguucuuuuuauggaucuaacagguuccccaccuuaggggaugauuuucuuuuucuuuuuuuuuucuuuuuuuggagacagggucgugcucuguugcccaggcuggagugcaguggcgugauggcccacugcaaccuucaccucccagguucaaucaguucuugugccucauccucugugguagcugggacuauagccgugcaccgccacgccccacuaauuuuuuuauauuuugguagagacagguuucaccauguugcccaggcugguuuugaacuccugagcacagacaguacacccgccucagccucccaaauugcuaggauuacaggcgugagccacugcgcccggccccguuuugcuuuucuugagucaacguuauugaccuauaauuuacuauaaucugugucugauucacgcguacggcugaugaguuuuaacagacucagagccccgugugcccaccacugcaugggggugcgaaaguguucacuguucccugcgcucagagugccucaccccggcucgggcagugcggaggcaucuccccugcgcucagagugccucaccccggcucgggcagugccagugcaucugccugggugagagcagggucugugcugccggccccggcuuccugugaacgcaguugcuccuccggccuggccucucccgcuggagggcagcuucgcggcauccuugcugugccugccggugggcucacuggggagcuuccguugcguggacacggcaccguucacugaucugccuguaugggggugacccugggggagaguccagcuuuccucaccaguccauuacauuuuuaucccauuuuaaacuuaguaaauuaaaccucuucacacauuuuacucaauaaaauacauguaacauauauaaauguaauacacuuaaaauauaaauauccuuacuuguaauacauauaaaacauaaugcauauaaauauacucacagugcugaagaauaacaaaguuggacacagaaacuacacaauuucaagacuuccugucaaaaaugcaccgaaauaccgagcccagaaacaggcgcgcacgacugcaggcagccgauccuugacaaaggaacaaaggcaaguccauggcgaagggauggccuuuucaacacuggcgcuagagcaacagaacauccacgugcaaaucuagacacagaccugacacuucucacaaaaccuaauucuaaauggauucuagauaagccuaaaugugaaaugagaagcuauaaaacuucucuuuuuguuuuugagacagggucuugcucugucacccacacuggagugcaguggcgcagucacagcucacuguagccuccaacuccuggccuccagcaauccuccugccucagccucccaaggagcuaggacuaccggugugcaccaccacacccagcuacuuuuuaaaauuuuuuguagagauaaagucucacuguguugcccaggcuggucucaaaccccugcuuuggccucccaaacugcugggauuacagaugugagcuaucaugcccaggcauaauuauaaaacaucugagcuaucaugcucagccacaauuauaaaacaucuuggagaaaucacaggagaaaguauagugaccuuggguuuggugauaauaaaauaccaguagcacaauccaugaaaauaaaaacuugaucaauuggacuucauuacaauuaaaauugucugcuggguguggugguucaugcccuuaauccuagcacuuuggaaggccaaucuaggaggauugcuugaggucacaaguuugagaccagccugggcaacauagugaggaccaccccccccccaucucuacuaaaaauuaggaaaagauaaauuggcuaauugugguaguacaugccugugguuccagguacucaggagaccgaggcgagaggauugcuugaacccaggaggucuaggcugcagugagcuaugguagcaccacugcacuccagccuaggcgacagagugagaccuugaaaaaauuaaaauuucugcuuuguaaaagacacuguuaagggaacgaaaaggugagccacaagcuguugaaaauguuuacaaaacaccuaucugauaaaguacuuguauucaaaauaugcaaagaacucuuaaagcucaagaagaagaaaaacaggcugggcaggguggcucacacuuguaaucccagcacuuugggagguugaggcagaaggauugcuugaggccaagaauuccagaccagccuguguaacauggucuauuagucuguuuucauacugcuauaaagaaauacccaagacuggguaauuuacaaaagaaagagguucaucgacucacaguuccgaauugcuggggaggccucaggaaacguacaaucacuguggaaggcaaaaggggaagcaggcaccuuccucacaaaggcggcaggagagacugagaacgggcacaggaaaaacugccacucuuuuuuuuuuuuuuuuuuuuuugagacagaguauugcucuguugcccaggcuggagugcaguggcaugaucuuggggcucacugcaaccuccgcuuccuggguucaagcgauucuccugcuucagccucccgaguagcugggacuacaggcaugcgccaccucgccuggcuaauuuuuguauuuuuuaauagagacgagguuucaccauguuggccagguuggucugaaacuccuggccucaagugauccgcccaccucggccucccaaagugcugagauuacaggugugagccaccgcgcacggccaaaacugccgcuucuaaaaccaucagcucucgugagacucccucacuacaugagaacagcaugggggaaccgcccccauaacccagucacuucccucccuccacacguggggauuacaauucaagaugagauuuggguggggacacagcgaaaccgugucacauggcaaaaccccgucucuacaaaaaauacaaaaauuagccaggcgugguggugcacaccugcaguuccagcuacucaggagucugaggugggaggaucccuugagcccgggaggucaaggcugcagugagccaagaucacaccacugcacuccagccuaggcaacagagcaagacccucucuuucaaacacaaaccugggugacacccacucggaaggcuaaggcaggagaaucacuugaacccaggaggcagagguugcagugagccgagauggggccacugcacuccagccugggugacaaaggcaaaacuuugucucaaaacaaagcaaaaccugggugaaaggucuaagcagauguucaccagggaaguuauucagacgggagauugcggugggaggauacccagcaucauuuguccuucaggaacuggaaacagggagacgccacugcauacccgacggagcagcuaaaaccuuaaaaaccgacaguaccaacgcuuccaggaacucucacccauugcuggugggaauacaaaaggcuaaagccgcuuuagaagacaguuucacagacucucacagaacuaaauauaaauauauucuugggcuggacguggugguucacgccugucaucccagcacuuugggaggcugaggcagguggaucacgaggucaggagaucaagacaagccuagccaacauagugaaaccccgucucuacuaaaaaugcaaaaaauuagccuggcaugguggcaggcaccuauaaucccagcuacucgggaggccaggaggcggagguugcagugagccgagaucgcaacauugcacuccagcccgggcaacagugcgagacucugucucaaaaaauauagauauagauauagauagauagauagauucuuaccaugcaaucuagcaguuuugcuccugaauauuuauccaacugaauugaaaacuuauguccacauaaaaaccugcaugcaggccaggcaugguggcucacgcuuauaaucccagcaguuugggaggcugaggcaggaggaucgcuugagcccaggaguucaagaccagccugggcaacauacugagaccccaucucuaccaaacuaaaaaacuuagccgagugucacagcacacacacauggucccaccugucaagaggcugagugggaucucaagcccggaaggcagagguugcagcgagcugugauugagccacugcacugcagccugggcaacagggugagaccccaucucuaaaagauaguaaugagcauuaagccacugcgaccgggaggaaccuuaaauacauguuucuauaaauacacauuccuaagugagaggagccaguugagaaggccgcgcacugugauuucagcucgaugaccuucuggaagaggcaauaugaugugguagugaaaacaucaguuguuucccggggaaaggggagaguggauaguagaaugcagcauucguauggcagugaggccacucuguguggcaccauccugguugguacaugacacugcguuuguccgaaccuguagaacuggacaacacgagcagaccgugugcagauuuuaaacauucauugaggagaugggggucccggcggggaaggccgacugacaagaaucuuaacuacugcagaugcauuccgugaccuuccugaaggguguucagaggaaggugcugaguaacuuuggaaaugagcagugucuauaaggccagaggcaaaaggaauggcacagacgcugcucuagucgauaaaguuuugcugcacagaggugcugacuggcagcucugucacugugguguguaugauggcugugggaggggagucucuggauaaucagagaaggaggggagucucuggguaaucagagggaggaggaggggagucucuggguaauuggaggaggggagucucuggguaaucggaggaggggagucuggguaaucggaggaggggagucucugagauggaggggagucucugaauaauuggagaaggaggggagucucuggguaaucggagggaggaggggagucucuggguaaucggagaaagaggggagucucuggguaaucggagggaggaggaggggagucucuggguaaucggaaggaggaggaggggagucucuggguaaucggaaggaggaggagggcagucucuggguaaucagagggaggaggaggggagucucuggguaaucggagggaggaggaggggagucucuggguaaucggaaggaggaggaggggagucucuggguaauuggaaggaggaggagggcagucucuggguaaucagagggaggaggaggggagucucuggguaaucggaaggaggaggagaggagucucuggguaaucggaaggaggaggagggcagucucuggguaaucggagggaggaggaggggagucucuggguaaucggagggaggaggagggcagucucuggguaaucggagggaggaggaggggagucucuggguaaucggagggaggaggaggggagucuccgggggagucucuggguacucggaggaggagggcagucucuggguaaucggagggaggaggagggcagucucuggguaaucggagggaggaggaggggagucucuggguaaucggagggaggaggaggggagucuccggguaaucagagggacgagguuggaguggccgcugugaugguggauuaccauugcacguuuagcccagaagagacaaagaugguuaaacagugugugcgcagugguuaauggauacacacagaucuuguugcuguacaagcugagggggccuagaaccagcuaugcuugcagcagugagcacacccaggcccagauccugguuccuagugcccuccaguccacggggccagggcucugaggagaaauggcugauuccagcaccggggcaggaaaugcccaggaucagcugauccuggcaguuccagaaagugaggagcucuguaaacaaaaccccacagucacgggauugcgucccagugaaagagccucccaguggccaaagagcaacaaaauaauaaaguaguauuagaauauaacccagaguagaaaauaaacauccacgagcccauagugauauaagugauugaguaaauaaacagagggaacaagaccaaccuucccugcagaagguuuucaguaaaugagguagauccccccauuccaggagcuggcgugagcucccggcaccgcugugcgcugcgcguggugaccugaccuccuuccugggcgugcagcacggagagggcagugggaggaggacgcugcagccgaggugcccgcagacacccccaagcccaguggucaggucagcaugcacuggucauguucauggcguggccgacggggaggcugcugccccauccucccaaccccgacgaccccagcccggccaugcagaggcauagucgaccaucucacuaaggaacauuccacagaauuccugaccaggccuccuccaaaccauccaggucaucagagacaaggagagucugagaaaccgucccagccucggggagccugaagagacagaacgaguagaugccauguggcuuccaggaagagauuguugggggcggggcagggggaaggacaucaggggagagcgaaggaaguguaggccucagcagcuguguggcagcacuggcuuauuuauuuuuuauuuuuuauguuuauuuuauuuuauuuuuugagacagaguaucacugugucacccaggcuggaguguaguggcgugaucucggcucacugcaaccuccgccucucggguucaagugauucuccugccucagccucccgaguagcugggauuacaggugccugccaccacaucuggcuaauuuguguauuuuuaguagagaugggguuucaccauguuggucaggcuggucucgaacuccugaccuugugauccgccugccucagccucccaaagugcugggauuacaggcgugagccaccgcacccagccagcaccggcuuauuaauggugagauguuaaugggaaaacugggccugugagauaugggagcuuuuacuauuuuuacaauaauucuguaaaucuaaaaccauucuaaaauuaaaaauuuauuuuuaaaaugcaauauauuuguuuuccuuuuaaagcacuucccucauucuuacccaacgggacacaccuucucaaguacuuaaguaauucuuuuuuuuuuuuuuuuuugagacugagucuugcugucacccaggcuggagugcaguggcgcgaucucagcucacugcaaccucuaccucccagauucaagugauucuccuacuucagccucccgaguagcugggauuacaggcgucugccaccacaccuggcuaauuucuuauauuuuuaguagagacaggaguuucaugucggccaggcuggucucgaacuccugaccuuuaaugauccaccuaccucagccucccaaagugcuaagauuacaggugugaaccacugugcccggcaaguaauucuuaugaacaaauuagccuuauaaaguugucauaaacauuaugugauguguggccagguuagaguccugugugacccggucugagcuggccucugggcagcaugccgugugggggcugccacaagcugauucagggagcaccggccuggggugacgcacgccugucgggcggagggcggccuggggugacacggaugguggccugggaugacacgcgccugucaggcggagggcggccuggggugacacgcaccugucugguggauggcggccuggggugacgcgcgccugucgggcggaugguggccuggggugacguggauggcggccuggggugacgcagaugguggccuggggugacgcggauggcggccuggggugacgcagaugguggccuggggugacguggauggcggccuggggugacgcggaugguggccuggggugacgcggaugguggccuggggugacgcgcaccugucugguggauggcggccuggggugacgcgcaccugucgggcagaugguggccuggggugacguggauggcggccuggggugaugcagauggcggccuggggugacgcggauggcggccuggggugacgcggauggcggccuggggugaugcgcgccugucgggcggaugguggccugggguaacgcggauggcggccuggggugacacagaugguagccuggggugacgcggauggcggccuggggugacgugcgccugcaccgggagcagcuucccuuggccagugcccauguuccucuuuucauuuuuaucuuuucuggggaggguagggggacguuuuacugucuuuccacugaauguuaugacccuccccacgccccuuggaggcacagcugagguggggccuaugucuggcuccagggggcccugaaagguacuuuuuacaccucccaccccucagcacugagagaccucgggagggguaccggugacagggacgcgggccccaccuugcugaacccagcagcgagggcaucucugccucugucccuggaggcugacagcgguagugugggagcuggggccuggguggagaccgggucagaaacucagguuucgccugggugggccaugaauguccugccgagggugagacccucagggcucuggguggagagcagcaccugcccagaagcaguagacccuugucccggcugcaccaggggccagcgaccuugugcccuccuccauccugcaagccucgggcggugcuuggccucaccugccucugucuacucaggacuuugaggccaggcacuccugcaggcagagaggggaauuucugagacugaaguuguuacuggguauuuuuuaacagcgcugucuuaaaaaauagauagcgugucucuguggccccgucuauucuugcggccacacgaacgugcgugugugugugcagcuucccucacggcagccaaaacccagaggccgcccagcgugcgaacacgccaaggugugacugucggcacggcacugccgagccgugggagggacuggguggugcagcggccaguggaucucagacccugagcugagcacgacuggagaggaugggugcauccgagcgucugcagagcacagagcgcguccgcagagcggguccacaccuugggugcagcgagcggaugugagcagugugccugugaccagggcugucugcacauccgccggccuaagcugcugcucaccgaaacccacugggacucuggcugaggccggccccaaggagcuuugccgaggagggagcaccuugccccugcccagagcggucccucgcauccuccuucccgugaaccugcaucuuugguugcaguuacagcucucacgcuuccaucuuaugaaucacaggagucccguugguuuuggaugaguugacaccaaaaagacacaggagcucucuagagacacuuccuggggguccugccgcguuggagcagggaggcaguagcuccugacgccuucccuccuacgugggcuuugugaucacugauggucacaugcggggcauucgguggccucuguguagagccagugucuuccugaugugacacugggaaccaccagcagcccaagcacagggaccuucuccuggccacugggcgggcugcaaaugugagggcgaauguugggugcagggugguggagguagcugggccuucccugccgcggaggaggcaaaugugagcgcgaauguccagcccagggugguggagguagcugggccuucccugccgcggaggcggcaaaugugagggcgaauguccggcccagggugguggagguagcugggcuuuccccgcggcggagucgcccagcucugcccgaggccccuuccucccgccccagcaucaggggcuguuccacaaugggugucugggggucccugcagccucccaccucccuccugggagaagccugcacacacugaggggcuguuuguucuuuauuugcagagguauuguggccaguauuuugguuuucuuauguuuuggagucacacaagcuaaagacgggccauuuuccagaccucauccagguaacuugccauuuccuuuuccgugugccccuguggcauuucuguucugagcggccacucugugucugugcugcugggugugaguguccuguccuccccuccgccuggccccuccccgaggccuccgaggccacuucccacauggacaagggcgugggguucugagcuggccgugugcuccuccuccaaccaccgagggucucuccaggccuucucuggcccuuucacucuucccuguccagggcucuccagcccuucucuuccugcuucugccuccucuuuccacagaccagaguggccgagggcuccagauggggcuaugaggccgggggcaggugggugagggcaccagauggggcugugaggccagggacugugggcucuaggugggacucugagaccagagggggcgggggugggugagggcgccagauggggcugugaggccaugggcgggugggugagggcuccagauggggcugugaggccaugggcgggugggugagggcuccagauggagcugugaggugccgcccacccccugcccuugaagugguugcccagcgcacucugccucagccaccaccccaccuuauggcccugaguucuaacaaacccucgugggccagagcaucccgccaaucucaguguacucugucccccaagucccaccccaggaaggcgggcucaggcuucuguagggucgguuguuuccccugaguggccacacgaaguaauuagaaacauuuucuguuucaacaggaguauguauuauagaaaauuucgaaaauacaaagauacuuaaaaauaaagcuacccacaaauaauaaccacuguuaaauuuucacguguuugugauacggacauauucacuuguuuguguauacggacauauucacguguuugugugugcggacauauucacacguucguguacggacauauucacgcguuuaugauacggacauaaucaugucuuuguguauauggacauguucacgcguuugugauacggacauauucacgaguuugugugauacggacauauucacguguuugugugauacggacauucacgcguuugugugauauggacacauucacguguuugugugugggacauauucacgcguuugugugauacggacauauucacgcguuugugugauacggacauauucacgcguuugugauacggacauauucacgcguuuaugauauggacauaaucacgucuuuguguauauggacauguucacguguuuguguguacggacauauucacgcguuugugauacggccauauucacgcguuugugugauacggccauauucacgcguuugugugauacggacauucacgcguuuguguguaggacauauucacauauuuguguguauggacauauucacgcguuugugauacagacauauucacgcauuuguguguacagacauucacgcguuugugugauacggauauauucacgcauuugugauacagacauauucacgcguuugugugauacggccauauucacguguuugugugauacggacauucacgcguuuguguguaggacauauucacgcguuuguguguacagacauauucacagccucgaaagaguggaauccugaacacguggcuuugugcauucuccacuucagguucaacgacuuuagucauuuccuuacuaauuuuuaaaaugacuuuaaucauuuagguuuaaaugacuuuagucauuuccuuacuaauuuuuuaacacccgaaauuuuaaugacugcuuguuugcugucauuagaauguacuacauuuaacuaacuuauuuaagccauaauauuguauauuuagagaguuuccaguuuuauuuuaauaaacuaggcuguggugaauuuuuucacguaugcucuguguaaauaucugauuauucauuuaauaaaaugucccagaagugaguauugaauuaaagggcauacacaguuuaagccugugauauguguuauaaaauuggccuccaggagagcagugucugccccagggucagugccaugguggugagugaagcucccccacccacagaggcccugagcagggagccguccggugacccaagcaggcuggucuugcuggccccuuccuugcccagggccuugagagagggcuccuugagugccuggcaggccacucugcuggcugacagcugugugggaagggcccagggcccugucugcccagccggcugagcacagacggucuugccuccaagggguuuggauuccucagcagagccguggaaggugcagugauggugagaaacugcccgucacacagugaaaagccuggcgccgugacggugagaaacugcccgucacacagugaaaggccuggcgcggugauggugagaaacuucccggcacacagugaaaagccuggugcaguuacgugcuuguuggguggauuuggagggaagaaaagcugccggaagcucaacccauggccguccuugcuuggagaugcaccaaaucccuccuggguggcggcaucacuggggacugggacgcagccgugagugggacagacuggucagcaggcagcagcuuguccuggcaugugaccccuggcacagggagagacucccgggagacccucagcucugagcagucaggagcucuggcgcaggucaccuggcgggauguggagcaucugggccugaaggucuuggcgcuuccaaaagcuccggccgcggcgucucuugaguuguggcucguccccucccacugggcaggacuggggguuccugggguguucaguuuuuagucugagcucugcucuaccuuucuucuguccguuuaguuugcuuggcauaaauuccauauuacuuugccaaucuucgauuuauugacggggaagccuguccuggagccaccuucuuccacgcgucuuguuaacuugggggccggcagggagcccucaacucucugcagucacaacacauugaaguggacaagugaugaguccugugcagcggaggcucuggguggggggcagggagaagggcuuucuccagaaagguggucccugugggcucugcccaccuucacacuccccugggucuggcccaggaaugcccaguccggcagcuguagccguagccauuagugacugggccucaugaggaggaguggaaaugggcccagcccggccaucuggggugcugcuuucuuuggaaacuugaguuggcugcagcucugagggagguggaacguucugggccacugaggagggcaucccuccugugugaacggcauuuucuuccuggcucccucugaaggcugugucagccacagcauuuccagggcugcugaggcugccugucugucuuuccccucuggugugauguuuagaaagacaaaugagugcuggggccugggggguggcccuggggucagggaggugcuggagcugcuccgggaagcgacccaggaaugcagaccaagggccugcuggguauuccggggcggcagccuggugcuggucgggugggaagcgugaguggggagaggaguccgagaugccaccuuucugaucuggggagcuggggccuuccccaacaggagaaacaugagaaagauucgacuuggcagugcggggagggaaguuaguacuggucguggugaccuguggcccgcucagaacaugaugguuucauggguguagcuguccccucagagagcgccugcaggccgggcaccugcuccgaaggcguccccuucaguuggcgagcccuuguggggcgagggcugccccgaguuaauuucaccacgagccccucaaacucuugggccacugggaaguuuccagguucuucuuaucccaaggcgugaggaagaaguuugugaucucagucgucugucuugggucccagaccucccugugcagcuuuuccuaagaacgccagggcguuuguauuuccugccaaugauggcggcuuuucaugagccacgggggccgucuuccccugaguacgucggggccuccugcguuuaguccgaaaaccucacgucugcacgucuugccgugagcugcucggagccgugggaagucaggaauugagggaugguuucauguuagaagucuguuaauguaacucaucacaucaacaugaaaaaauugauccccuuaaaugcagaaaaacaaaaauucacauucauccaugacaaaaacuuaacauacuggaauugaaagauuuuuuuaacaugauaaaaaguauccuagccugggcaacaugucgaaacccuaucucuacaaaaaaaaaaaaaauacaaaaauuagcuggaugugguggcacguaccuguggucccagcuacucaggaggcucagguaggaggauugcuugagcccaggaggcagagguugcagugcaacaagauugcacuccagccugggcaacagagccaggaccuugucucaaaaaaaaaaaguggccagccacaguagcucacaccuguaaucccagcacuuugggaggcugaggcggguggaccaucugaggucaggaguucgagaccagccuggccaacauggugaaacccugucccgacugaaaauacaaaaauuagccgggugugcuggacaccugugagcccagcuacucgggaggcugaggcaggagaaucacuugaaccuggaggugaagguugcagugagcugagauugcaccacugcacuccagccugggcgacagacuccaucuaaaaaaaaaagguauccaccaaaaaccuacuccaaacuuaacggcgcaaguuuagaagcaucacucguaaacacaaggcagggaugugugcugacugcuucugugcaacaauuuaugggcaaaagauuugaguacuggaauggaaaaaaugaagaaaaaaaauucacuuuucagagagaaauugugccuaauucugaguuacagcuuucuuuauaaaggcucucccaggggccugugaagggcccagaagagacacugggugugaaggagccaggagccggccuggggcugagcggggccguggaggccuggaccgggcgcacuaacguucugucgucugucuuuguagcuuacuggagguuuuggcucugcgugaguguggucuacgagcuguuucucaucuuuauacucuuccagguaagcuguuuuucuggguuggauaccugggaacuuaggugacaguguggccccaggcauggugacaaaggaggccuugcccacacagcccucgagugaugggaggaagcagggcuagacccccacaaaguaggccgagcugcggggggucuccaggagcaucugugcggcccuugagugauggggggcagcaaagcuagaccuucaaaacguaggccgagcugcggggggccuccaggagcaucugcugguggggcgcugacuguggccauuuagcagggccacacuuaaggagggcagggccaguggugcaggcacagaagagggcagggccaguggugcagcugccaggguggcuuugcccacagcugucguaucugagugcugguggggacugggcgugaagggagccgcaagucagguccugcgaugcaggccagcgucugcauggccggggcaaaucugggccucagaggggaccccagcgccaagagggacggggucuuuguuuuuguguuuugugguugaccagugugacugugugugcuucuuccccauccugaccacauucugcaagacgagcagggugcaggugggagacgcagcuccuuuguaaauccugggucaggcuguguugcugcugcaaaugccuacuuuauuaauacucuuuguucuguuuaacuuaguguaaacacacauuuuuggggcugucuucagcuuacaaaggacuuuauuauucccaaucuuaaaacuccaucagugcaugaugagauuuuuuaucaucguggcaaaauugacuuuucugaggcaguguacauucugugaauuuuagcauuuguguagacuucuagaaacacaauuaggacgcacaagaauuccacuggcccuaaaacuccuuuguguuaccccuugguagucauacccggcccugaccccugacagcuggugaggguucgcuucugucucuucuagaauggaaucguggggugggcagccucuucccacccugcacagugccucugagguucacccaggaucaugcggugggcagccucuucccgcccugcacagugccucugagguucacccaggaucaugcggugugcagccucuucccgcccugcacagugccucugagguucacccaggaucaugcggugggcagccucuucccgcccugcacagugccucugagguucacccaggaucaugcggugggcagccucuucccgcccugcacagugccucugagguucacccaggaucaugcggugggcagccucuucccgcccugcacagugccucugagguucacccaggaucaugcggugggcagccucuucccgcccugcacagugccucugagguucauccagguugcaugugucuuccugcgcuccucuuucuuuuacuauuuauuuuuugagacgacgucuuacucugucacccaggcuggagugcaguggugugaucucagcucacuguagccuccaccucccggguucaagugauucuccugccucagccucccaaguagcugggauuacaggcaccugccaccaugcgccacuaauuuauuguauuuuuaguuucaucuuguuggccaggcuggucuugaacuccugaccucaaaugauccgccugcauugacagggcacgguggcucaugccuguaaacccagcacuuugggaggcugaggugggcggaucacaaggucaggagauggagaccauccuggcuaacacggugaaaccccgucucuacugaaaaauacuaaaaaauuagccgggcguggucgcgggcgccuguagucccagcugcucgggaggcugaggcaagugaauggccugaacccgggaggcagagcuugcagugagccgagaucacgccacugcacuccagccugggcaacagagcgagacuccgccucaaaaaaaaaaaaaaaagaucugccugccuuggccucccaaagugcggggauuccaggugugagccaccacgcgcggccugggcuccucuuucucggcagugacaguuucucaggccccuuguuuuuggugagcuggacgguuucgaggauuggucaugaucuaguagaauaucccucaagugacauuugcaauugggaagugugaguucacccaguuuguucuuuuucaagaugguuuugaaucaucugggucucuugcguuuccaaaugaaugugagggucacccuuuccauuccugugaaaagaacagguggaauuuuuuauggggauugcaucgaaucugcaagucuguuuugggaguagugucauccugacaauauuaacuccgucaguccuugaagaugggauggcuuuccauuuauuuaggucuuuaauuucuuccaacaauguguuacaguuuucagaguuuaaguuuuguacuuccuuuauuacauuuacuccaauuauuuuguucauugugugcucuuguaaguggaacuguuuuaauuuuacuuuugcauugcucguuacucauguauggaaauguagcucauuuuuguguacugaucuugcguccugcaaccgugcugaacugauuagcucuaauaguugugguguuuugggguagacucuuaagaauauucuauauucaagauuaugucaucuacaaauagagauaguuuuaccuguuccuuuccaaucuagaugucuuuuauuucuuuucuuuuuuuuuuuuuuagacugaguuuugcucuuguugcccaggcuggagugcaguggugugaucuuggcucaccgcaaccuccgccucccagguucaagcaauuccccugccucagccucccgaguagcugggauuacaggcaugcaccaccaugcccagcuaauuuuuuuuuuuuaauuuuuaguagagacaggguuucuccauguugaggcuggucuugaacuccugaccucaggugauccgcccaccuuggccucccaaagugcugggauuaugggcaugagccaccgugcccggccgaugucuuuuacuucuuugcguagcugcccugcccagaaccuccagcucaauguuuccuagaauaggcaaggaugggcuuuuuuuuuuuuuuuuugagacggagucuugcucugucgcccaggcuggagugcaguggcacgaucuuggcuuacugcaagcuccgccucccagguucuagcgauucucgugccucacccuccguaguagcugggauuacaggaacaugcuaccacacccgacuaauuuuguauuuuuaguagagucgggguuucaccguguuggccaggcuggucucagaacuccuggucucaagugagccaccgcaccugacuaauuuuuuaacuuucuguggagaugagguuucgccauguuggccaggcuggucucaaacuccugagcucaagcggucugaccccuuuggccucccaaagugcugggaguauaagcaugagccacugugccuggccagauggacauucuuaucugauuccugaucuuaggggaaaagcauccagucuuuaucccacugaguguguuagcugugaguuuuucauagaucuccuuaccgaguggagaaaguucugugaguuuuuuguagaucucccuaccgagugcagaaaguucugugaguuuuucguagaucucccuaccgaguggagaagguucugugaguuuuucguagaucucccuaccgaguggagaaguuucugugaguuuuucguagaucucccuaccgagugcagaaaguucugugaguuuuucguagaucucccuaccgaguggagaagguucugugaguuuuucguagaucucccuaccgagugcagaaaguucugugaguuuuucguagaucucccuaccgaguggagaagguucugugaguuuuucguagaucucccuaccgaguggagaagguucugugaguuuuucguagaucucccuaccgaguggagaagguucugugaguuuuucguagaucucccuaccgaguggagaagguucugugaguuuuucguagaucucccuaccgaguggagaagguucugugaguuuuucguagaucucccuaccgaguggagaagguucugugaguuuuucguagaucucccuaccgaguggagaagguucugugaguuuuucguagaucucccuaccgaguggagaagguucugugaguuuuucguagaucucccuaccgagugcagaaaguucugugaguuuuucguagaucucccuaccgaguggagaagguucugugaguuuuucguagaucucccuacugaggggagaagguucugugaguuuuucguagaucucccuuacugaguggagaaaguucuaguauauuccuaguugguugaguguuuuuaucaugaaaaguuguuagauuuuuguuaaaugauuuuucgcaucaagugagaugaucauauggguguuuuucccccuuuguuaauaugaugaauuacauugauugauuuucuuauccugaaccaaccuuacauuccugggauaaauccugcugggucccagggugugccuuuuuacauacugcuggacuugcuuuccuagcauuuuaucuaagauuuuugcauccauauuuguaagagguacuguccuuuaauuuuccuggaaugucuuguucuggcuuuggcaccaggguuugugaggaugucugacguuuucucaguauuugucuggggugaaggcgcgcacuggcaccaucaccaugacguaucccuggcgcuguggaccuugacugccuggcgagaugugucugucaggcuuuccacugucaauccauagugcauucuccacaaggaggucacuggugcagccugcauggagggaggggaguuucguugccccccuugguguguggcgucugcacguugccaggaauucuugugcaugggagagauccugcuucucuaccauuaguuauuccaucauguauuuauuuauaucaguguggacguacagauacuugucuuacacuugcauauuuauuucagcgcugcucuauuuaucguggugcccaaauucuuuugccaaaaggaauuuccacgugguuccuguauugcuuucacacacccucacggaguucuuggcuuuucguuuuguuuuucugaggacauccugacuuccuagcacugcgggaugcuccaggcuccuccuguccacuccccacccugguccuggaaucagccccuucuccaagagccuuggguccuuacugaauauuaggaacugaggccuggguguugggugggcugcgugguccugggugccauagcucacagaggacgggcaugugugcacucacugugugugcaggcgucuguaaacacagccagugcaggggugcgugugugcugugugcgcaggagaguguaaacagugcacgggcgcgugugugcucacugcgcaggcaucuguaaauagugcaugggcgugugugcucacugcgcaggcaucuguaaacagugcaugggcaugugugcucacugugugcacaggcgucuguaaacugcacgggcgugugugcugugugugugcaggcgagcguaaacagugcacggaugcgugugcucaccgugugcgcaggcgaguguaagugcacgggugugugugcugugcgcaggcgaguguaaacugcacgggcgcgugugcucaccgugugcgcaggcgaguguaaacagugcacgggugcgugugcucacugugcgcaggcgucuguaaacagugcacgggcgugugugugcucacugcgcaggcgaguguaaacugcacgggcgcgugugugcucacugugugcgcaggcgagcguaaacugcacgggcacgugugcucacugcgcaggcgagcguaaacagugcacgggcgcgugugugcucacugugugcgcaggcgaguguaaacugcacgggcacgugugcuuacugugcacaggcgaguguaaacagugcacgggcgcgugugcucacugugugcgcaggcgaguguaagugcacgggcgugugugcucacugcgcaggcgaguguaaacugcacaggcgcgugugugcucacugugcgcaggcgaguguaaacugcacgggcgcgugugugcucacugcgcaggcgaguuuaaacagugcacgggcgcgugugugcucacugugugcgcaggcgaguguaagugcacgagcgcgugugugcucacugcgcaggcgucuguaaacagugcaugggcaugugugcugugugugugcaggcgaccguaaacagugcacggacgcgugugugcucaccgugugcgcaggcgaguguaaacagugcacgggugugugugcucacugugcaggcgaguguaaacugcacaggcgcgugugcucaccgugugcgcaggcgaguguaaacagugcacgggcgcgugugcucaccgugugcgcaggcguguaaacugcacgggcgcgugugcucacugcgcaggcgaguguaaacagugcacgggcgcgugugugcucacugugcgcaggcgaguuuaaacagcgcacgggcgcgugugugcucacugcgcaggcgaguguaaacugcacgggcgcgugugcucacugcgcaggcgagcguaaacagugcacgggcgcgcgugugcucaccgugcgcgcaggcgagcguaaacagugcacgggcgcgcgugugcucaccgugcgcgcaggcgagcguaaacagugcacgggcgcgcgugugcucaccgugcgcgcaggcgagcguaaacagugcacgggcgcgcgugugcucaccgugcgcgcaggcgagcguaaacagugcacgggcgcgcgugugcucaccgugcgcgcaggcgagcguaagcagugcacgggcgcgcgugcucaccgugugcgcaggcgaguguaaacagugcacgggcguguguguucaccgugugcgcaggcgaguguaaacacagcuggugcccuggugcgugugugcugugagcacaggugucuguaaaugauguaaaccucccuugacgucaggcccaaaagccugccuugcccuaaggucaagagguguaucuggcugaugccagcgucugggugaggaaagagcagguuccacaagggcgacuccugugaggguguuggccugagcgcgcaugcggggaggggucggggugggggcggcgcgccgcaguaacucagggccccaucccgcucccgucuguccagcgguccuagacccccauguccugaagcgcaccugugcccaccuggccccggggagcgcagguguggagauggggugucgugccuggggguuccuuccccacgcgcugccccaccaggauuucccugggguggggagggcugcugagacagggcgcugcccuccuccagggugacugagaugcaguuuacaaccaugaucuccuggccgggcgugguggcucacggcuguaaucccagcucuuugggaggccgaagugggcggaucacgaggucaggagaucaagaccauccuggcuagcacggugaaaccccgucucuacuaaaaauacaaaaaaaaaauacuagccgggcgugguggcgggcgccuguagucccagcuacucgggaggcugaggcaggagaauggcgugaacccaggaggcggagcuugcagugagcccaguucacgccacugcauuccagccugggcgacagagcgagacuccaucucaaaaaaauaaaauaaauaaacaaccaugaucucccguuucaaguugccaccacuaacuguagccccgcugacgggggcacuggccuugcagacuguccaggacggccggcaguuucuaaaguauguugaccccaagcugggagucccacugccagagagagacuacgggggaaacugccucaucuacgacccagacaaugagacugaccccuuucacaacaucuggguaagacgccgggggcccugaggcgagccccuccccagguguggccccgugccggaccaggcgccauccacgcuccugccucgcaccccucagcccacacuuggggucuccuggugcagagaugugcugaggcccuguccgucuggauggugcucauggugggcagggggccccugcucucuaggcugucguggacguggucuccacaggccacggcagcaccugugagucccuggccuucuucccggggucuggcaggugcugcucaggugugggcugaucugccgguguggggaguggggguggcugugccccagggucaagggucauacccugucgcccacaggacaaguuggauggcuuuguucccgcgcacuuucuuggcugguaccugaagguacggcaccuccucuucccggccuccccgccccgguucugaggccugccgugggcucuggaccguuucuguccauggaguugagcucagggugcucugaguguggugggagggugucgcacugcagccacccagagguucgagaagccguggggcucccggaccucccagaagcccugauccuggucggguccccgcuccguccucagggucggggcgguggaaagaggcggcagggcaggaagucccgccccugccugggcuugggcacugccccaucccacuucugagggacccugugcuaccuauggggcuaagagcagugccugcuugacccugcagcccacccuggcagaguuuggugucaggccccgggcacggggaugcugccuuguuugcugacagucguacaucgaggcugcuggaggggcagccacccaccccacgcucacccugagaccucacugggggcccugccagugcugucgacuccaagaaugcugccagccggggugggggcugcacgcacccgugggcagggccgggcguggccugcgucccauacucuggcugccagccgggugggggcugcacgcacccgugggcagggccgggcguggccggcgucccauacucuggcugccagccggggugggggcugcacgcacccgugggcagggccggguguggccggcgucccauacucuggcugacccuggcgcccacagacccugaugauccgagacugguggaugugcaugaucaucagcgugauguucgaguuccuggaguacagccuggagcaccagcugcccaacuucagcgagugcuggugggaucacguaggugccagcacagcccccggggcagucggugcaggcugaggggcauucucggaaccccugugcccagcgcggccccuggacccccucauucuccccggggggcagugggugcaggcugaggggcauucucgguuccccugugcucuuccgggguccuccucggggggcucguuaccccucaccccugcaacgagugcuggccccucccugcaguggaucauggacgugcucgucugcaacgggcugggcaucuacugcggcaugaagacccuugaguggcugucccugaagacguacaaguggcagggccucuggaacauuccgaccuacaaguacgucgugggggcugcgagggcagggccggguggggguuaccuggaggcagccucagcguccgugcuccagcagaccccgagcaccaggcccguccagugugcggcucaggaggggugaccguggggcuuugccuccuggaaccucccucugaccuggugucacucaagcccggccgccccucacaguggccauggcgucugacccacguaccucccuccucaaucccuggccggccuggcgcaggggcugugggaucauuccgugcuucucccucccuugguugcuuugguuaugaaauaguugcagguacuuugucauuaugacuuuggaauuuaaaaaagaaacagaagucuaaggaaaggccugggggacgggggucuccccuccugccugugggugccccggcucugccuggcucugcagacauggcuagcucacggcaccguggagcgcccucugaggcgcugcagccacugcucaagcuggaagagacugaacagcagagggccguggagaagcagggcuuguagcuggguggccagaccucggagaacagccgggcagcagcuggguaaccaggaacagagucuguggcccgauggcacagggcggggcggggugaccaagagcagagcucguccgauggcacagggcggggccgggugaccaggaacagucuguugcccgauggcacagggcaggguucggugggcugccuuccucaggcugccggcucugugguucccaggggcaagaugaagaggaucgccuuccaguucacgccguacagcuggguucgcuucgaguggaagccggccuccagccugcgucgcuggcuggccgugugcggcaucauccuggugguaaggccgggcugccucgcgacggcgcggcgggcggggggccagagcuggugcucacccucuccuccccuaguuccuguuggcagaacugaacacguucuaccugaaguuugugcuguggaugcccccggagcacuaccugguccuccugcggcucgucuucuucgugaacguggguggcguggccaugcgugagaucuacgacuucauggaugacccgugagggcugcggcaguccggguggagacacccccggggggcaggggccggagggcuggggagcagagccugggaggccggagccugggcaaguccgccuggaggacccugcggggcccgggacgcugaacccccugcugccccugcaggaagccccacaagaagcugggcccgcaggccuggcugguggcggccaucacggccacggagcugcucaucguggugaaguacgacccccacacgcucacccugucccugcccuucuacaucucccagugcuggacccucggcuccguccuggcgcucaccuggaccgucuggcgcuucuuccugcggugagucagggcagggcgcguauguucugaaggagggccgcuguccgggucccuuggcacaggcacugugggaguuuggugucguuggugucucacugucccugcuucaacccucuggccgccucugcgggaggcgccuuuccugacccagcccucggggccuucgcucugcacugacagauccaggcuccucagggcuccagucugccacggcugccgucccagggccaggguacccggcacccacccaguccauuccggaccuccacagggacuaggugccagcuguccauggggccugcaguggggcuggugugggggcagguggugacgcugcaucccgcuccccagggacaucacauugagguacaaggagacccgguggcagaaguggcagaacaaggaugaccagggcagcaccgucggcaacggggaccagcacccacuggggcuggacgaagaccugcuggggccugggguggccgagggcgagggagcaccaacuccaaacugaccugggccguggcugccucgugagccucccagagcccaggccuccguggccuccuccugugugagucccaccaggagccacgugcccggccuugcccucaagguuuuuugcuuuucuccugugcaccuggcgaggcugaaggcgagggguggaggaggccccagcacagccucaucuccauguguacacguguguacguguguaugcguguguguacgcguguguacgcgcguguguacacaugcguggccgccuguggugugcacgugugcucugggcuccgaggcuucuccagagcugggagcuggcuggcguggcaagggcaugcucuggggcagugugucccucaggaaccaggguccucccuccccuuucugccuggucagccccguggccucuggcccaccaagcucccugucacccagccauggugugguccaggcagggacaucucgguacccuuucugcacuccgugggcccugggugcgcugaggccuggaggcgucuacacuggcuccacauccacuucccccgcagcucgugugggcgcucguccacaaacacuccguggcugagaggcagcggauccaggcagcgaugcugagccaccuccuccgagccuuccuuucacacagaccaccccggaggacacguggaugauggggucagagaucacugagcugccccucaagggggccuggaacccgggugcuggggucaugcugccuccguggcuccaaggugagggucaucuucacgagcaaagagaaccaauaaagugacaacgaacgucugaggcuucca

SEQ ID NO: 191817 - RNA, 12310 nt, Homo sapiens
ggcugcgccugcgugguucguccucacguggccgucaagcccucuagugccuuagauuccagcgagcuacgcaagcaauccuggcccagccgagcuugcuuccccaaaucccguaauccuugaccuuauucccccaaagaagcggccucccgggaaggagcgcccuggcggagaagacucgaacggcucccacagccgggcguugggggaaaggugggcggucuuggucgugcgaggucggggagggaggguccuccgcucuccauugcggagcuucgcuccgggaccaccgggggaccggacgccgggccgcgaagcugccgccuggggcugcggggaggagagcaacauaacuggaauggcacuuaggggccggugucaggguugucaccgggguuggcggaaaugacgaaggggccccaggcacgucguguuacugggcgagguuccagccaaggugcccacgcgccuugggggaaaccagaggacuucugcaccguuucccgaggacaguuuggcaguguuucagaagggccuuagaaccaggcaggcccccuucuaggaugguggaaagccuaaagaucugaaaacggucucaagugucgucuuagcgauuggcugacuaaaccgaaugcaagccggagacugcacacgauguugccguuaacaguuacacugggccgggcagucagaggcaggcggaucaccugaggucaggaguucgagaacagccuggccaacauggugaaaacccgucucuacuaaaaauacaaaauuagccgggcgugguggcaggcgccuauaaucccagcuacuugggagguugagguaggagaauggcuugaacucaggaggcggagguugcggugagccgagaucgugccacugcacuccagccggcugacaagagcgaaacuccuucucaaaaaaaaaaaaaaaaaaaaaaaguuacauuaggcugggugcgcugcagccuguaaucccagcacuuugggaggccgaggcgggcggaucucuugagcccaggaguuugcgaccaacauacugaguuuggccaaaauagugagacccccgucucuacaaaagauagaaaaaauuagccaguugcgguagugaacgcuuguagucccagcuacuugggacgcugagggaggaggagcacuugagcccuggaagaggaggcugcagugagcuauuuucucaucccugcuauaacgaauuugucacaggcuguuuuauaggccuggagcucagaagcccgaagugaguuuuaggagguuaaaaucaagguguuggcaaggguaguuccuucuggaguuucccaaggagaaucugcuucuuuuccucuuccaacuucuagaggccaccuucuuccaucuucaaaaccuacugucucugcauaagaacucucaugauuauaugccggccgcccagacaccccaggguagccuucacaucucaauauucuuaauauuugcaaagucccuuuugccacuuaagguaacaccacagguuuggagauuaggagguggacaucuuucagggccauucuuauuuuaaaaaauguacugucgauaagaauaguuaaaauguaaaauauuugaagggauuuauucugaaucgaauaugagugaccgcggccggugacacagcccucaggggauccugggaacaugugcccaaggugguuggggcaguuugguuuuacauguuuuagagagacaugaggcauuaaugaaauacauuuaagauauccauugguuugguccagaaaggcgggaccaaacaaaaaaaaaaagauuuugaacaugcuucccgagcucaggcaugaagaacucuugacugacagaaacggaggguguguccaaaguuuugaggacggccgagcggcgcuccaaaacccguccucacagccucgccccguucgccucagcuacaacaaaucaucgucaaccuguuccaccuucuccagucugguagcaaaaaggggugucucagguuugcuuuauuuuauuguuugggcaauuccuggaauccggccugcuugugggaggaggcaggggccggucccucgaggguggugggagcugccagagcuggagggauggucugggggaaggcggcuguacgguggaaaggcugguuggggccagagugggaaacgggaugcggacgucaggcuucacccccgacccaggggggagugggaaagcugggguaguagcugggacgaggcccgggggcugagcccagagggucgagugggcgacgacuagcgggcgcggcccccaggguggacuccccgccagccccggccuggaggcuccgcccgcccccgccugggcggaaggaacgcggagcggcucuggccuugggucugcggcggcggcgucgggugagcgucccgggcggagcgggcgcgggcgggggcagagaggcaggggagacccccuucguguuuuugugagguuuccucccagcccuuuagucugcagcaggguguccagaacuagcagguucgagggacucgacgcgggcgcgggcgggggucccagggaccgggaacuuuugcgcgucgccugagcguggcccgugucucccuagaggguggccccgcgcccccgucacgucggaacauaaggaccugaauuggccuccagacggccccucccauguggcuccccaggguggggcccaggccuugggugcugcggagaccucccuccguaagguugagaaagucuggucuccggauaagggaccguuagggccucuguucagaucccugccucaaccaaagcaggcugccagcuggugguaguggguuccugaaugugcuuuuagcuuuggcuguguagggagccagggacuucuccagucacagagaagggcguuuacucccgcauuuucaugggguccucagugggauccgugacccacagagauucagaagggccuuucugggauacaacagggucuggccaagccugagggguagggacggggcuacucccgcagcgcuaguugcagauggucacgggagcacuggccacccugagcucccaccaagcuuucccaggaggaggacacccuggggccaccuuucaucuggcugcagaggacacaggagugucaggcuggauuuggggagcgugugcacccugggcagcccccugaggcucuccuuccacccgcccucccgcccacagugccuccugaugacuagauucuggagucagaauuugggugaccacacccuggucgguuuugcucacgugcuucgggucgguuggauucaguuccuccauguggggccgugggaugucaccacccuuugccacuguccuugcaggccgggcgcccaggcguguggacccgagcccagccuugcgucuuuccucccaguugguaccaggggccucuugccuccacucaugcagaguggaccagccgccucugaagcagccccggggagaggagugccaggcacacagacucaggaagcugggggugucagggcaccaggagccucucaagcgguccuguuggccgucuuucugaagggcagcugggguugcaucauuuccccaaguggauccugccaacuuucuggggcuucuggaugagagcccucuccccaccccacccaccccuccccgcauuguggcaucagugcugcugcuuccagggagccuuccuggccauccaagccuccucuccagguuccugcccugcuguaguccccaggccagugcuuggcaggugcucagggaauguauccaccaaccaagguuugggguggcugucucugccugaccacuuuccccaggccccuggcggguaccugagcugugcucucagggccucaggaaccuccuuccauauucagggccugugccuggggaggcuucaggguguagcagcugugcccaucccaggcugacccacccagcuugccugguagcccagccucugggcuagugugccguggggcaggggaugugcuguagccuggugcagaguccccaaccccagaagggggccauggaagcugacaccccaaguggccgccccccugcucugucuugcuucggacacuguggccggguccaggauccuggcauccugggaggucucuggcuuugugggcagccugccuggcccgcacagucugccuguccugagggugagacacaggucaagcccacagacccccuugcuccccugcuggggccuccaggcucacagaccaccccacccuacccuguccuugcccaagcaaaugagaggcaggggcuucccgggcugcugcugucccgcccucuguggggcaggaggaggugcccacagaggcuggguggugauagccaggagaugggcuggcaucugcauuacccaagcucugcugcccaugguggccuuucugggggugggugcuggucccugcccccugccccaccccugaugucugcuccagagacaaagguggggagggugcugaagaggaaguguuugcccagggagaggcugcggcuccuccugaaacaucagcccuguggguccuguuugcagaaucuccggccugugaaacugugaggggauucggccaagacguccucuucccucugccucccacccaggccacucuucaccuccaccaugagccuggacauccagagccuggacauccagugugaggagcugagcgacgcuagaugggccgagcuccucccucugcuccagcagugccaaguggucagguacgcuugcucucgggguggccuuggggugcugguggggcaggcuggcggguggcggcucccucugaagggugcauugcucuggaacgccuuguuuguggacaugaaguaugaauucugugcagcuaccacgugcaugagaugugauucuuguguuucuuuuugacaauuuaggaauguaaaacccauuccaggcucaugcagcaugggcugaggugggcgggccgaggugggcggccacuggccagugggucucuggcuccggugucucagcuccucucccucccuuggagacacgagggcaggacacagcuuggguccccuccgugagccuccauggggcgcugcuugucccugccaagcugggggcugggaguccucggcccucgagguccucacaaacccagcagcuucacaagcaggacacgagugccugggugggccgcaucuuuucucuuuuuaccuggugauuucaaguagugucagguuugcggaggaguuacgaggaccggacggggcucccuggugaggugguccuguguaccugcggacgcuagcucuggcccagcaccuccaggcagggucugcuuuuccgcccugcccuuuucgucuuccucacugguccaggauugcguggcccucagcccucugucuccuuagcccucucccgucugugacuguccccucgucucucuggguucuugguggucugagggucuggccaggcuccugcaggacguccucuguuggggcuugucuggugguuucuugugguugaaguccuacaguuuuggcaggaaugcagggagaugccguggggccugccaggagcguccugucacaggcgccgucugccacccucuccacugugacgccacugccuuuccuccugugacugaucagugccuucgagagauacuuuaaauucuuuuuauuuuuagagacagggcauugcucugucacccaggcuggaguggcucccucauggcuuaugcggccucaaccuccugggcucaagugauccuccugccucagccucccgaguagcugggauuaugggcaugcgccaccacgcccggcuacuuuuguauuuuuaguaaagacgggguuucuccauguuggucagguuggucuugaacucccgaccucaggugaucugccugccucggccucccaaagugcugggauuacaggcgugagccaccgcgccuggccacgugcgagcaucuuaaacaaaacuuucauggaacaguuccuccuuuuuguuucauuucugaaaugucuugugugacuugccuugcugucuucugggcccacugauagguuguaaccugcacgugggguggugguggaggcugaggccagugcugucugcgugguccacaugacccuggggucugcucacaggcuggacgacuguggccucacggaagcacggugcaaggacaucagcucugcacuucgagucaacccugcacuggcagagcucaaccugcgcagcaacgagcugggcgaugucggcgugcauugcgugcuccagggccugcagacccccuccugcaagauccagaagcugaggugaggcggggccuggcacugccucuggccuggugcagucugcuuugguagcccggcagcaggggacagagccgccaggggcgcgugggcagcugcagguggacaggcaguggcagcagacauuuccaacaucagccagaggcacacaggccuggcggucucacagcgggggggacagggcccuuccugccuuaucccagcccccgcacccaagaucuggcccugcccgccaucccuagccuuccagcaucaccacagacccccacugaaaggugugucugcagacaagguuucccugggucgagccacaugcgugcccuccuucacucggccuggagaccccagaccccagagccccguccagggaaggagcagguauagaccugccgccugaagagugcugcuccgggcucugggcucuggcaggcgaagggcguggcagcuuggcucaggggagcccugcugacagccagguaugcuccagccuccagaacugcugccugacgggggccggcugcgggguccuguccagcacacuacgcacccugcccacccugcaggagcugcaccucagcgacaaccucuugggggaugcgggccugcagcugcucugcgaaggacuccuggacccccagugccgccuggaaaagcugcagugaguuuguguccugccccagggcccaugcuggccgcugccugucccccagccagcccccuacauagaacaucgccugccaggagccgugaggaggggacucaggucacaggggccuuguggugcucuccuuuccccaugaugcugggucuggggccuuguggugcucuccucuccccaugaugcuggggcuggggggaucugucaucacccucccuccccauccaguuguccuuugcaaggcacagcugccccaggacccgacggugggaacagaugccuggccgugagucagguuccacucaccgccucagugugugugggggacccggccauugugaguugaccacagccugggacgugcagguggcccugcccuccagaggcugguuucuuucucccgggccugguugggccccaaagucugagguccgggagggggugagggguuuccagaaggaaugccgguguccacagaggcccgggccucuggaugagucugugggggucccucagcacugacaccugaugcccaggcagaagacugaggggagaugagacaccagcacaccccgugcucccugguaucacacccuuggcuggugcacauuccuguguggugcugagcucugcugucccccaggcuggaguauugcagccucucggcugccagcugcgagccccuggccuccgugcucagggccaagccggacuucaaggagcucacgguuagcaacaacgacaucaaugaggcuggcguccgugugcugugccagggccugaaggacucccccugccagcuggaggcgcucaaguaggcacugggccuugggggggugcggggugugggcuagggggggucccgugcugccucacgugugacccguguccccaggcuggagagcugcggugugacaucagacaacugccgggaccugugcggcauuguggccuccaaggccucgcugcgggagcuggcccugggcagcaacaagcugggugaugugggcauggcggagcugugcccagggcugcuccaccccagcuccaggcucaggacccuguggugagucaucuccgcgaggccuccuucccggagggucgggcggcgggccguccucagagcucucccccgccccugggcucaucucaggccaugagacggugcugaggaaagucuguggugguccauguccugcaggaucugggaguguggcaucacugccaagggcugcggggaucugugccguguccucagggccaaggagagccugaaggagcucagccuggccggcaacgagcugggggaugagggugcccgacugcugugugagacccugcuggaaccuggcugccagcuggagucgcuguggugaguguggcugucggggcagggcccugucgcccaagagagggccagggugaccgaggagaccaggggaggagugagcgacuccagggaagcugcugggcucagcuccgaccuucagaaugcauaggccagggagcagccugugguuugaugggaacagugcuuggggccaaggaccagguguaggugcccacuugcugggaggcugucagauguuuuugcucagguccacguggggccuucaggggaagggccagucgcagcugugggccagccugggccccugccaggcgucaguccugucuguguccacagggugaaguccugcagcuucacagccgccugcugcucccacuucagcucagugcuggcccagaacagguuucuccuggagcuacagauaagcaacaacaggcuggaggaugcgggcgugcgggagcugugccagggccugggccagccuggcucugugcugcgggugcucuggugagugugugagggacacgaguaugcacauuugggagaucauaugcccgugugugcacacaagggcgagagugcacgaguaucugugugagcacgaguguccguguguaugugagcacacaugggugaggcgagugugagcacgugugugagcauaugagugugagcauggguguccgugagcaugugagagugagcacguguccgugugagcacgugagugagcacgaggguccgugugugagcacaugggcaagaaugagcacgaguguccgugugugagcacaugggugagcacgugugugugagcacaugggugagagcacgaguguccgugugugagcacgugagagugagcacgagggucagugugugagcacaugggcaagaaugagcacguguccgugugugagcacgugagagugagcacgaggguccgugugugagcacaugggcaagaaugagcacgaguguccgugugagugugagcacaugggcgagagggagcacgagugugugugagcacaugggcgagagagcaugaguguccgugugugagcacaugggugagagcacgaguguccgagugugagcacaugggugagugagcaugaguguccgugugugagcacgugagagugagcacgaggguccgugugugagcacaugggcaagaaugagcacgaguguccgugugugagcacaugggcgagagugagcaugaguguccgugugugagcacaugggcgagaguacgugagcacaugggugagagugagcacgaguguccgugugugagcacaugggugagagugagcaugaguguccaugugagugugagcacaugggcgagugagcacgugaguguggcacaugggcgagagugagcacgaguguccaugugagugugagcacaugggcgagagugagggugcauguucauguacugggaaaggcgggcuggcggcaccacucuggcuuaguucucauuuuaacucugaaagucagaggucauguuucaugaagccugagagcuucacggagcuccagccuaccuggccacccugugguccaucuuccuggaagccccgcccaccuuucucccuugcgggaaccccgccugugucaggauguuuuuccagauuuguuuucuuuguuaaagcacguucuuuugcagcuuucuaagaaaagguuuugcaggagguaauuuuuggggucuugugccccuguucuguccuuggaucauuuagccggguauagcaugcaccauuaugcccggcuaauuuuauuuuguuuguuuuuuugagagagucuugcucugucgcccaggcuggagugcaguggugcgaucuuggcucacugcaagcuccgccucccaaguucaugccauucuccugucucaaccucccgaguagcugggaccacaggcgcccgucaccacaccaggcuaauuuuuuguacuuuuaguagagaugggguuucaccguguuagccaguauggucuugauauccugaccucgugauccgccugccucggccuccuaaauugcugggauuacaggcgugagccaccacgccuggccuaauuuuuguauuuuuaguagagaugggguuucaccauguugggcaggcuggucuugaacuauugaccucaagugaugagccugccucagccucccaaagugcugcgauuacaggcgugagccacugugaccuugugugcacgaucugcuuuuucucguuggcagcuuuucaagcucucuuuguucacuguguuagggguuccaugugcuuggccuugaugggggucuugguucuuugugcuggauacuugguucuacuaagaaaauauaccuuuggugauuuuuuucucucuccuuucuuauguuucuuuuuuggugugcccaugagccuguccugaugucuuguggagugacccucuaauuauguucuccaaauuuucuuuucgauguuuuguuuuauuuuugggagauguucucauuuaccagccagucuacugaauuuccacccucaguguuuugucuuuuguuugcuguuucccgugugccucucgccaggggcuuuccguggguggcuggucauccugggcugggcaccaggugcagagugaggcccgggagcccuggacagugagcccugcaggccgagucauggcugcguuucucgagggcuuccuccugaugggggauuuucaguucccugccaggggacaccauccuggcugccaggaccuuguggguguuccagauguggagaggaaccuuggguccuggucacugcagacuuguucccccugagccacucacaggguggggguccugcagcuucccuggcccccaccuuggagagguccagugcaacuccuuggcccugcuguccggccuguggcggcuccaccccgggaaguggguguugggucuucucuaucccauccucuuuugucugacccguucucuugucucucucuggagccuaaagucuguuguccacucuguucuugucuugguacccuccauacccucguuuccccacagcugcuccucagucucuggcuggcuucuccuuugaagcccacgcagccagacggugucgaggugacaaggggguggguguggcucucuggguggacgacaucucucuccuguccuuucuccucccugcagaagaucucaggcgagugaggcugcuugugccucgcuugucugugccuuccuuguccgugguggggaaccugcccagggccacagggacggugagccuuggggacggccccaccugaggguccugaguugccgagcacagguguccgucgcgccccccaggcccaggccugcucugccggucagugcggugccaggcacgcccggcacccugacccccgcccugcuucacccagguuggccgacugcgaugugagugacagcagcugcagcagccucgccgcaacccuguuggccaaccacagccugcgugagcuggaccucagcaacaacugccugggggacgccggcauccugcagcugguggagagcguccggcagccgggcugccuccuggagcagcugguguaugugcacgcgcugggcggguggugcggccagggcugcccagggaggaaggcgggggugggggaggacacgggcccaugccucccuucuggccugugugcagccuguacgacauuuacuggucugaggagauggaggaccggcugcaggcccuggagaaggacaagccaucccugagggucaucuccugaggcucuuccugcugcugcucucccuggacgaccggccucgaggcaacccuggggcccaccagccccugccaugcucucacccugcauauccuagguuugaagagaaacgcucagauccgcuuauuucugccaguauauuuuggacacuuuauaaucauuaaagcacuuucuuggcagga

SEQ ID NO: 191818 - RNA, 43016 nt, Homo sapiens
ugcgcggcggcggcgcgcgggcgccuggggcgggacuuccggcgcgcuggagcguuuuccggccgugcguuuguggccguccggccucccugacaugcaggugagccccgcggcggccggccccugcuccuccuccuugcacggccucaguuucccucccgcaaagugggcgcgccgggcagcgaggcucggccccgggaggacgggcguggggucgcgggcgacgccgggcgggugcgugagagagagcaagugugugagggggcgugugagagggugugaggacgagggugagagaggguugcuaugagagcgagggugagcgagagcggggguggagggcgaguguggacgggggcgcgugucggggggaccgcgagugggagguggagcgcgugcgcuggggcgagcaagccugagagcuaggcgcgcuggguggaaggggccugagugcgcagacaagggauguggccggcgggugaggagugugugagcgcgcggcucguguggcagagugguggccaucggguccccaggacccccagagggagcagaggcaguagggcuccaggcgggcugcccucccagugaggggcacgcgguccccgugaagggugggcgcaucagacgcgaucccacccacccuugguucagccccaacccuugaagcuuccauugcugacuguccaaacuggagggugacccgcccgcccguccgccucgacuuccugggcucuaguaaucucuuagccuccuagcuacuugggacuacaggugugcgccagcgcacucagcuaagaauuuuuuuuuuuuuuugagacagagucucacgcugucacccaggcuggagugcaguggcgcgaucucgguucacugcaaccuccgcuucugggcuuaagggauuuuccugccucagucucccgaguugcugggaguacaggcgcacaccacugcacccagcuaauuuuuguaucuuuuuuagagacuggguuucaucacguuggccaggcuggucuugaacuccugauggggugaucugcccggcagaaaaauauuuuuuguagagaccaggucuggcuguguugccaaaaccagucaaaaacuccuggccucccaaagugcuaggaucacaggccagagccgccaugcaccaguuaguucuucaaaacacaacagaacaggaguugucagugcguccaucgcagaauagaguuagcucugauuggcugcugucgcucuacacauguacacacaugcacaacacaugugcacacaugacauacacgugugcugggcugugacguaaagugcauuucuuacugcuggucuccaugaaaagcauuggaaagccccugcugugacucccaucauuuccaucaacaccaccgaggagguccuggaccuacggacugggagcgcaggaaagugggagcaguagcgcuccaccuuaucuuguuacagagcgguuucugggaccccuuugggugaccagggucggggccugugccucuucauaacacaacacauucccuuugugugcggggccguucugcccaagggaaggucauuggcauuuggggaagaaacgguuugaugcaggaacacagugugugugaaccugggagucuguguuaugugaagagcaugauggagaguguccucacgggccucagagccgagcggccggugagcaguggggagcgggagagguaccaaagcccagacaagggccugguugcagugugagcaccccucacacaucacacacaccaucucccuggggcaguugucuggaaaguuccauggcaagucaaagaagcagcccagcauuugugagcagccuguauccaagcacuccaucacagagcgggcaaguuaagcgcgaguggacagaggcaguacccuggccuuguguucaguuagguucuccuaguguccccucugcuggacacaugcuggcaggacugucuuccucuuccacccuuuccucuuccuucccugaagugugaaaucacagguuggggggcagggaggucauaggcagaggggccacuagguggguggacaguggcccuguuucaaaucugcaggacggcagguaggggcagagacccagcccuauagugguuggucacuggguaccugagugugcccuccaguuacuccugggccaguccccuggagaaccaccguuugguuuuucauuccuuuccuuccucccugacccagauuuccacccagaagacagagaaggagccaguggucauggaaugggcuggggucaaagacugggugccugggagcugaggcagccaccguuucagccuggccaggcaagugauucugggccgucuucccugugccauggccagaacccuccccaccuucccuggggcuguugcugacucagaccaagccucagcugcagcagaaagauaguggggcuaaggggagguggcagcaggcugcugcccuugguucugauucugggauguaucacugaggagaggggcuggagagguugaucggggcagaggguggugaucugugccugggccuucuuauucccccugcacagccucucggaacugccguggcuguucaagcacucacugccuuugccuguggcuccauguacugggugcugcugugcuugcccugugaguucccuuccuaacuccccauaagccugcaggucaggcugucuuguggcucccugccuccuaggugggggagcuucacugguugaucuugcuccaggagcguguucuuucuaugcagguguguuguggguguauuggguaccaaagcaugcaaacucccugccuggggguagccacagucuccucagucugcaccaggagcaccagucucacccagggaagagacagggcaaaguggggcagcgugugccucugcagaagaaagcaggucaaggggacgguuucagaggaagugaaaacagguuccuggccagggagucuuuuggguaggaggguaggcacugugguaggccuggcucuggcagcaucuucugacaggugcaccugccuggcugggguuccuggagccucuugggccugagcucccauauacucaggagccugugacccaaggggaaggccaugugcccagcugcuggguagugaguugggcugagcuccccaccugucagguaucugccucugcccaggcugugugggccucucagcuggucuagaggggucugugcugccagagcugugaaacuagccaagagcuucuucccagcagugucccaaagcuucaugaaggacuaacagucuggcugggcuaugguggugguucagcucccaccgccgcugcccccaaccccagugaaagauagaaaguagaaucacuuuuuuuuuuuuuuuaaagacagucucgcaccgucgcccaggcuggagugcacuggcacuaucucggcucacugcgaacuccaccuccuggauucacaccauucuccugcuucagccucucgaauagcugggacuacaggcgccugccaccaugccuggcuaauuuuuuguauuuuuagcagagaugggguuucaccguguuagccaggauggucucgaucuccugaccucgugaucugcccgcuucggccucccaaagugcugggauuacaggcgugagccaccgcgcccggccggaaaguagaaucacuuuuguugguggccccuagaaccugaaagugaacaguguaauaaaaguuuagugcaggaagaccagaagauacagauaaaguaaaagagaagaaacaaugaccaguaauuccagauagccugcucauuuauuuuuuguuuuguuucuuuguuuuugagagggaguuuuugcuccuguugccuaggcuggagugcaauugcgcgaucucggcuuaccgcaaccucugcuucccagguucaagugauucuccugucucagcgucccgagaagcugggauuacaggcaugcgccagcacgcccagcuaauuuuguauuuucaguagagacaggguuuguccauguuggucaggcuggucucgaacucccgacuucaggugaucugccugccuuggccucccgacguggugugauuacaggcgugagcccccgcgcccaggcuacuuuuuuguuuuguuucuuaagcuuccacgugaagggcaugucguuugcuuucuaccaccccucccuacaugcuuucucugugggacugaacuguggaaguucugucuuguagcgucuucauugaccggcacaccacgagcauggcagugccugucuguguuccagcaucugggagagccagguccaugaacauccucauguuuucaacguauguggaaaaucccccauggcugggcgcgguggcucauuuugggaggcaggcagaucacgggaggccaggagcuugagaccaaccuggccaacguggcgaaaccccauuucuacuaaaaauacaaaaacuagccggaugugguggcacgcgccuauaaucccagcuacucgggaggcugagguaggagaaucgcuugaacccaggagguggagguugcagugagccaagauggcgccacagcacuccaguguggugacauagcaagauuccaacucaaaaaaaaaaaaaaaagucccacagccgggcgcaguggcucacaccuguaaucccagcacuuugggggggccgaggugggcagaucaccugaggucaggagguggagaccagccuggccaauguggugaaaccucaucucuauuaaaauacaaaaauuagccagguguggugguggcugggaucccagagugcugggauuccaggcaugagccaccguucccagccgggacauuuuuuacuggaaugucuuuucuugauuugugagauuuauuugcauguuaugaauagauuauggguagaaauccguugucaaguguguuccaaauauucuuucugguuuauuauuugucuucacauuuccuucuuuauuuccugaaugaaagucuuacauuuguauguaguucuacuccagugguauuuucuuuccuaaucucucccauugcucauauagcuggaaaagccuucuccacccugagacugcauaaauagguagcuauauuuucuccuaguacuuaacguggcaucaccaccaucaucguuauuaucguaggcuucucugagccuacgauuuuuuucuuuuuuuuuuuugagauggagucuugcucuguccccaggcuggagugcaguggcaugaucuuggcucacugcaaccucugccuccuggguucaagcgauucucuugccucagccucccgaguagcugggacugcaggugcacgccaccacaccuggcuaauuuuuauauuuuuaguagagaugggguuucaccauguuggucaggcuggucaugaauuccugaccucaggugauccgcccgccucagccucccauuaaguguugggauuacaggcauaagccaccgcacccggcccaaauauuuaauuuuuguaggaucucacuauguugcucaggcuggucucgaacuccugagcucaaguaaucuucccaccucggucucccaaaguguugggauuacaggcgugagccgccacguggcccagccuguggcuucauuauuuuacacuuaagcccuaccaugguuuggcuuucuuuggguuugaaggaggaggugggaaccaaugcuuuucuagauugccagugguggucagggcggccuugggcugugaggggaggguucuguggcugauggugaggaagcuucuuucuggguaucuaggaggaaccaguggcucagucaggaggcccaggaguacuggagaauagacuguggccgccagggcugguccaggucagggcucugucccaguggccaaggguccauccagugccaugaggacccaggcccuauuaggagaaaguggccccaucagcagagggguugcccaugugcugcauuucucugccgguuguuugaaugugcucugcuuucccugcagcccucuggaccccgagguuggacccuacugugacacaccuaccaugcggacacucuucaaccuccucuggcuugcccuggccugcagcccuguucacacuacccugucaaagucagaugccaaaaaagccgccucaaagacgcugcuggagaagguaaggguggccuggggacuugaggugacuguacuggcugagggcugauccaucauccucuucuuucuguccacuggggccugugagccaggaggcucgaggggcuuggcuccucacaaaggcaccugaugagcccgcagccgguggguggccuguguggcucuggggcucuggccagucagcaccucugagugagcagccucuggagccagguuuugagggcaagcagggugccuccccacucaccccacguggggcuuguuuuaugugccaguugccaguuuccaugcucuaccucucguuuauaucaccugcaucuucaucuugcugucuuuaucauggccuugagcuguguuugccucaugcuuuuugggacguuccccugggauggcccuggggauugcaccuucaaggguguaaacucauagaaccaccucucagccccagcaguccccaugccgcuggccagacccugccacaggacuguaacugugaccuaguccuggacuggcagaugcuuucucugugcuguaugggggcaaauaaaccaugcaguggacaucucucucucacggggccgcuuggggcgaggucaaggggaggcugagccgggccacagaguguggacagaagagacaaguugauaacuggauggaagguuuccaggagcagagguggaguaggggcaggugugacauggcaggaaaagacucgcauuggccagggggguggcaggcagugguugaccagcaggguugcauuggugggggugguggcaggcagugguuggccaguagggucguauuggcgggggcgguggcaggcagugguuggccagcagggucacguuggcgggggcgguggcaggcagugguuggccagcaugguggcgugugccuggcauguucuuuucuuuuuuuuuuugaggugaaguuuugcucuuguugcccaggcuggagcgcaauggcgcgaucuuggcucaccgcaaccucugccacccagguucaagcgauucuccugcuucagccucccgaguagcugggacuacaggugcccgccaccaugccuggcuaauuuuugcauauuuaguagagaugggguuucaccauguugaccaggcuggucuccaacuccugaucucaggugauccaccugccucggccucccaaaguucugggauuacaggcgugagccaaugcacccagcgcaccuggcauguucuuguccagcaaagcguauggcccuggagugcccggauggguaucgaguggccagagcuggugcagaccguccacccucacaugcaaggagggagccaccauaacugucugucugccugccugccuuccagcccggagcaagggugggaaaggcccuguaccgucggccagugucuguugacggccagagugcuucugaauugaauugccugcuguggccucgauccucaacauacagggucuccgggucagcagcacuguguggauccagagacucggcugcuggcugaauggaagggacuugcuggguggggcucugugcucuacacuguggacagaugacugaggcuuuucucucacuccuuuuauuucagagucaguuuucagauaagccggugcaagaccgggguuuggucgugacggaccucaaagcugagagugugguucuugagcaucgcagcuacugcucggcaaaggcccgggacagacacuuugcuggggauguacugggcuaugucacuccaguaaguuggggcccucacagugcagagggagguccugaggcucaggugggcugcccuggccccgugauggccucuucuggccagucagugaugggggucuauguucugaucucccggagcugcugcugcugugaggcuacggugggagagaugccauucuggagaugucagaguguaagacccugggggucucuccaggggcuugcugugcugaucucuguggguucccccugaauccagaggugggcucgcaggucgucuggggucaggaaguggaugugcagagccaacccugggccagggagggguggguucucacacccagccuccucuucucuugcuguucccagcugccagccugcagcaguggugugcacuagcuccagguggggcuuaagacaagcaccagucacuuuuggugaaagggaugucguggccugggucccaggcugugaguggcaguccagaguaggagaaggauaccccaggccaggagcugaugucaguccgggcugguaucugucuacgcuggccagcccugggcacguccagaggcgccagaaugacagcaccauggugagacaggugcucacucaccuguccuccgucugaugucuccaucuuuugccaguggaacagccauggcuacgaugucaccaaggucuuugggagcaaguucacacagaucucacccgucuggcugcagcugaagagacguggccgugagauguuugaggucacgggccuccacgacguggaccaagguucucauccuuccugcuugacugugcuugccccacaggcugaaaagagugugagugcgagagcaggggugugugugugugaguagguaugucucugugggugucucuguaugggagugugugugugucucugcgugauuuaagugugaaugugaguguguaagugugagacugaugaugugggagagaagagauugugaguguguugaaugugacugucgguguggacaugucuaagugugagacagugggugugaguguugaguguggugacugugagaaccacgcccucaccccuuggggcccagccggcagagcaggcccauggugugggcuggugugcuaagugggaaggugaguguggagcagggcaggccugguagaggggguuucugagguggucgccacggugggacccucugcaaggccaaguuggugccucagaguguuccgcccaggucugcgugugguccagguggcugugaggguggccuucccuugcacuuccgggcugcacacaggcgugugcaggacaggcucuacaaugacucaggcagccucugggcagcaaacggcacgggccauuggcuucuccuccucugucccucucucagcgauuuucauucaaugccagggaggaaggugggguucaggcggaggcugccuccugauggcacauccugaccugaugacgucugcccgaguuuacguggcugcgccuugcguuugggcucggacagagagaaauggcaggggaaguguuaggcaguuuuggaguucagagagcaggagugguuuucccugacacugagagaaccguggggaggugauggaaugucagccagugucagggccuggcgggucuggccaucccucagcucggagaaacccugaccguccccaggcccuaggaugcagcugccuguuccccuggccggccacaggcucugagcugucccagcucagggaggguaagcucagagcugcucugcagggucaggaagggggccuuggccagaaggguggagaguuggggucaggaagaggguguggagagccagcccugggccagggagggguggguucucacaccugccugcccgccccugcccuucccauugcguauugugcggcugccacguuuuccuccucagguaggcugggucuuccaguugggcgcacgugccuguguugacuguccccuccaugucccacaggguggaugcgagcugucaggaagcaugccaagggccugcacauagguaagugcggcaggccaggaguggaggcccugauggcucaaacugcggggguggacaggugggcacuggggucuccacguguuccugaucacccggcugugcugcugcggcacagguuacuuugaccgcucagagaugaggcuggcccuggccuggcauucacagcccuuagucuggcuggaguccugagcucuccuccccacacaggcuguggcccuccaaagccagcaccuccuuggccaguggcauugcccuaauuguucucaaucccauuucuuccuucauucacaugaugaguccuaucagggcagcuggggccaagcccugggcuuggccugagggugaugcugacccuggcccaucugugccccuguagcucacggcuggggaaggggggacauguguccccacguccaguagcagccucagaggcaguggauuaagagcacaaguugccaagggagagacucugggggaugcuagaagcaggugacagggcugagcuggagcagccagagucugucccagccucccuccuguaagguggggccacaaccaugcugagccguguggggagcuggugucaggggaccaggacugucagugucugcucgcuccuuccccaccaccccucccucuccagccugugaggcucugggacauccucucuggacaugugggugcuccagguggccucccugccccucacugucuggucucacuucccucuggaggccaaggggaugccuuuuugaggcagcaaacagcaggggcccuccagcaucucccagucacggcccccgugugugucuguugccccugcagugccucggcuccuguuugaggacuggacuuacgaugauuuccggaacgucuuagacagugaggaugagauagaggagcugagcaagaccgugguccagguggcaaaggugagaccugugugcugcuccagccucugagcacagccccccgggucccaccuggccgucuggcugggccucccgcgaggccuccacucggcuuuucugucuucugcccugggcaccuucuggugcagcccccaucuuccagggaaggcagcaucagccaggcucaggcugcugcucgcuuucuugaccauggguccucuggaggucccaggcaugggagaccugucugcugggccaggguucuucccuugggcaaagcccagcugccugcuacccuccugggaggggacccagcccugcuggcugccaguaugccugggccucgggucagggagcccccagacccccggggugggguugggggaggugcaugggucggcagaaugcacgagaccacuggccccuccacuccuguuccucugggacccccacacuuccuccuucagacaggcccuucugggcauacagcccaggcuugggucuugccucgugagugaccaggccacaaccugaccaugugggccgagguggcgggcuucuugucuuuccacccaucccuccugggccuccaggcccuccucaccugugacugcuucuuucagaaccagcauuucgauggcuucgugguggaggucuggaaccagcugcuaagccagaagcgcgugugagugggcacagguggugguggguggcccuccuccuggcccugguguuugaaggaggcuggaggaaagaccagggguuuggggagggccuuccuuccacagucccugugccugggguggggacggggcugcacaaaagauggacaccugcucagagaaguggaagcagccuguggcaggcagccggcuccgaacagaaaaguggaagcagccuguggcaggcagccggcuccgagcgcauugcugcgccaggccugaugccucccuugggcggucagaggaacucgaggacccucauucaugaggucuuggcaagagaaagauggcccagauggugacagcagguugagcuuggacacaagcagaaacuccucacugagcuucggggagccuuccugggggugucccugagcacggccaggacccgugguguggaccgccauggcggccucuggggaaugccucccaggcccccaggcuuuguagcaguccacuccaccgggaggcggccacagcacucccucacgccuccuuuugccacaucagagcccagcccacccaugacccucgcggguucccacucccugugggccacaugaccaggaacggagggagugauaggaagugccauggcucccccaccuggccuggacuggacugaccacagcccugaggaauggcccuuccuugguccugcccaagcagcccugccaacucaccgaaacagcuaccuucccuguucugccaaagugggcgacugccccgcaaaagauagcagggggacaguacugcuccccaggauguugguagggggcguccucgacaugcucaggacagguggacuccucucacuccacugguugcaacgagcgaggauggugcggucuccaccgcgggugccuggacagcagagcccuauggcagcuguccagcccuucagccuucugugugagccguggguucuggaaucggcucccccgcccccaccaccugaaguaguucugguugggcuuuaagagcccgggccugagcucaggcugcaugguguccccugcagcagccauggcacuuucaucccauugcugcugugggcaaaggagcugcagguccaggcucugcccaccuggggcagcguccccacacagaucuuaagcuugagggagggaagggacauuguugaggcagagcccaugagggguagggcaggauuccugcccaggggcucagaggacccucagccuggagccgguacaggcccugccccugugaguggcuccagccucugcagcccugccgcuccucccacugugcucugagggacucacuggcugggaggcagcaguccaaggcucuucccggaacugcucccaggccccggcuccagaagagcccuggaguccuguuuccugguguccagacccccacacccuccgccagcaccccucagugugguuccccacuggauccuggugcccagauccccacacccuccgccagcaccccucaaugugguugcccacuggauccuggugcccagaccccacucccucagccagcaccccucagugugccccccaccggauguguccaagaggcuccucugucugcuucccuccugggaggccuggcagcagcaggaagacaaggagcugugugaagggaggcugggaggcgcacugcaguggggguaaggauguccgcaaggcuauggggagccugucgucugcacagccucugaggggccccagcuuugccggaggaucaggugccugcguuccuggcugagggacaaucccaggcccugccuugggggguucuugcugagccgugggcaguggacccugccggggcugaccuuccauuacccucugaggagaggggugucucagcaggagacagagcccgccugcuuccagccuucucacuaauccugggagagugggucuauuaaccagagauuugccacacucauuuccguuucagagcauuagguaggcagugagauggcaccagaggcuccucaggagauagccucuugucugggguggaggcuggaggugcugagacagccucgugucugggguggaggcugggggugcugagacaggcucgugucugggguggaggcugggggugcugagacaggcucgugucugggguggaggcugggggugcugagacaggcucgugucgggguggaggcugggggugcugagacaggcucgugucugggguggaggcugcaggugcugagacaggcucgugucugggguggaggcugcaggugcugagacaggcucguugugucggguggaggcugggggugcugagacaggcucgugucugggauggaggcugggggugcugagacaggcucguugugucugggguggaggcugggggugcugagacaggcucgugucugggguggaggcugggggugcugagacaggcucgugucugggguggagucugggggcccugagacagcuuaguuucugugguggaggcugggggcccugagacaggcucauugugucugggguggaggcugggggcacugagacagccacacgucugggguggaggcuaggggugcugagacagccucacgucugggguggaggcugggggugcugagacagccucaugucugggguggaggcugggggcccugagacaguuucgugucugggguggaggcugggggcacugagacaggcucauugugucugggguggaggcugggggugcugagacagccucacgucugggguggaggcugggggugcugagacagccucacgucugggguggaggcugggggugcugagacagccucaugucugggguggaggcugggggugcugagacagccuugugucugggguggaggcugggggugcugagacaggcucguugugucuggauuggaggcugggggugcugagacaggcuuguugugucuaggguggaggcugggggugcugagacacccucaugucugggguggaggcugggggcacugagacagccucguugugucugggguggaggcugggggugcugagacagccucaugucugggguggaggcugggggcccugagacaguuucgugucugggguggaggcugggggugcugagacagccucguugugucugggguggaggcugggggugcugagacaggcucgugucugggguggaggcugggggcacugagacaggcucguugugucugggguggaggcugcgggugcugagacggccucguugugucagggcucgacgggucauuaacgucagggugggagggcaggaggcaguagggggauugcugagccggaguggccacugcaggggaggacgguugggagcagccugcgagcaccucguguccaggcuccugcaggaagguggggagcugcgggaagguggggagcugcaggaaggucgggagcugccagcauggcaggggcaggcaguauccaggcuccucagagcagcuuggcagauuccuuugggcauucugcugccugggagcugccucagcacaguccugccucugaccaccacuugggaccccagcccgcauugugccaggcccgagacugggcucagcagguucggucccaugcacugggcccuggacagaggcucaggggcagcuuuuccugcagaguuuguuggcagugcccuuagaagggauguugcugccucuggucccuccugagcucuggaucagccccuuacaguuguccgcaugcccagaggggcuguguuaggggcgcucggagccaccagugccagcagcuggcaguaugagggggucugucgugaggagcgcuccgggcaaugcugcagcacuguagcugcagcucacgucgccuccggggcccauguugucuccugggggccuggguagaccugacucacaccuguccuccuugaaggccagcucugggccacaccgugagccugacuguggguggacacccaggcucccugggccccucacagaguggcugggggcaccuuuuggcccucaggucugguguggcccuggaggaaggccaucccaccaccauccuggggagcuguggguaccugcagacagcauagagcccacaggcugggaaccaggcaggagacccccagguagggucagcuuccccaggcaucugggcagggcuuacucugcucacuuugcucugguguuucaggggcgggggcagcacccuccuugaccaccaccucuaaguggcgcacagugugugacagccucugguacccauagaguuguggacacagcugcagaggcgugaggacgggcugcccaaagacacugcuccccacugaggacuguaccugcauugcagccggcagaacuaacaccagaugaugugggccagaguuacccaggaauugacgggggcuuggcuuggaaaaugacagucccacuugggccaugucagggaaacaggagcugccacuaugcagcaguugcacaugccaggcccugguccuggcaccauugggagcaccagggccucuggguacuggcugaggaaccgucaccucguccugaccuaacccgguucucacugagccccacagaggcuugugcuggaguggggcgggaccuggggccaccaggggccggcucuugccccacucucaguccuccugucauccccuaaggggugggucuccuccccagauggggcugcucccaggggccugcagcgugagagugacagucuccuacgugcgguaacagccagagccugcccaguguggacguaucacccugaaacccagcuuugcagcagcaugugcuccaggccaguuucugcagaggccaccugcaggguagacucaugggcaccagcgugugcacacggccggccugggguccugacggcugcuccuaggccgugcuaggagggaggcuagugccaucccuuggggaacacugccagccugcucugagaugcuccugcccccuccaccuccaggggccagaggaggccuaacugcugcucccugucuccugcccugcccggugcccugcccucuccuucccugagcuacaccaggcagguggggcccuuggagugcccugcggccacccucggaucaguguccugggccugcugggggccuuuucuuaccugguguguccuuuuuuuuuuuuuuuuuuuuuuuuuuuuugagacagagucaugcucuucagcccaggcuggagugcaguggugcgaucucagcucacugcaaccuccaccuccuggguucaaguaauucuccugccucagccuccugaguagcucggauuacaggaaccugccaccacacccugcuaaucuuuguguuuuuaguagaggcgggguuucgccauguuggccaagccgaucuggccucgggugacugcccaccucggccucccaaggugcugggauuaccggcgugagccaccgugcccagcuuuuuuuuuuuuuaaucugccaugucuuuaggugucuaaagugugauguacacacguggggcugucucugguuguuggagccccucuuucuggggauuccugggguacugcacaggcccccacucuagggggcccacuggggcaugagacaguguuguuggggcuacauccagagauggauaggaaguucccacgaaggggcccaccugcccugcugcagggugucaggcuggggaccagccccaccccucccugaggcagcgggugucacagaacccugggagaggccucagugccaggcacugcugaccccaucucucgguucuugcaggggccucauccacaugcucacccacuuggccgaggcucugcaccaggcccggcugcuggcccuccuggucaucccgccugccaucacccccggguaagugccgcucuugagauguggggguggcuguggagggcucuggggucgggggcagccagugcagggugucggccaaagggcccaggcccuccugcucagcacccaaaccucaucccgucuguauagaggcuucagcugccacacacucugugccccugugcugggcacagagaaggcuccaagucagcacgugagucccaggggcagaccugggggccaaguggacagaagcaggcuggguuggggagucacagaggccaggcagggcuggcuuggcugggggcaccccagggugucgaggcagaagucccaggguucugcccagggcagccccucaggcagacacugggcuucccggccugccacucuggaaagcugccagcccucugcaccucugcagccuccucucccuccagaggcagagaggugacugcgggccacucgcugugugcgguugggugcacccccaaacccaagguuggcuagagggacucacagaagagccaguuugugcucacaggaggcggccacccugcacaugccugugccagcacaggccggccaugcccucaggguagcaccccuggcuaaggaggcagcuugguggccuccuucacagccuguagguugcugagggcccuuugcacagucaaccgacuuuucucuccaagcuuuccagggcucuccgcugaucagugugggcugcaacugggcaaggcagugcugggacagacacagcagcauguccugcagaccagguuucagaccugugcccgugguccugcugucguggccagguuccuccccuggagcuggggcaggcagugcuuagacccuucuggcucccagcacagcgcaguugcuaguuccuguugggcucagacugauccuuugauggaagacccuggaaaguggaaagcagaagaggugcugagagcugagcccugggggcugcuucgugcauggccugagcuucuugcacacguacccagcauugugcagacagaacucccucugccugugaccaggcguuggggguccugucccaggccgagcccuggggagccucccgucugcagcacugcugugugcccuggccccucccucucccuuaugugccagcugggcugaccuguggguggugcuggugggcaggggccuggcugugccucggcaguucugcuccugcagcccagcaaccucagccuccccggcaauaacgggcccaaguccagggcuggggucucaccugugucccggguguggggcccccacgcugcgucuuuuucuuuucuuuuucuuuuuuuuugagauagagucucacucugucgcccaggcuggagugcaguggugcaaucuuaucucacugcaaccucugccucccaggcucaagugaucccccaccucagccuccugaguagcuggggcuacaggcacaugucaccacacccaguuaauuuguguuuuuuuuuuuuuuuuuuuuuuggaaaugagguuuugccauguugcccaggcuggucuugaacuccugggcucaagcgaucaucccaccucggccucccaagccaccguggccagccuuuuccgauguaaggcacuaaugucugaccuguguucccaggguuugaagggggcuggcaggggcuggcugugaggacacguccuuccagagcugacagcaccugucucaggugguugggaggacuacaggccuggggcugggugaagauuccucggggcagcagacacuccuuguccagaggccaugggcauggccaccucugugaggcacugauuucauggggcucccagguugcccuuugugcuuaggggagcugcagaagcagccaucgguggggaccagcucaggagcccagggcaguucuugaggcuggggcagaggaccaggugccugucuucugcugguggcagccucugccugagcuucuggcccuaggcaggaagugggcaguuggagcugggccaggucccugccccucaccccacagcaaccaaagcucacaacuccauuugcauggcgcugguggggguugcagcuguagggugggaugcacgccagggcuacgggcacggugacgaggcugggggcggggccgaggcccacgguggggguccccggggaagugggacccagcucgggggagggcugggcacugcuguugugcgcccgcuccacuggagcacagggcugugcccucccagucggcggggccggugaaggugcugaggcucccguggguucucccgagacucuggcuacagccccagaggugaggagggcuguuuugucaucuguuuauccuucccccaucccacucugagggaagagcagccacugcagaggagccucguaaaucccugucccuggugcuuuugcagcagcgcguaauugugcuugucacucaccucccaagagcagcgcugccagcacacaggcucgcucucuccaggggcacugucuguggaacaauggccccuggagagaggucugcgugcugcggggaggggcaccccagucgccaaaugccaauuuuaucguguccuucgucagcagacagaggcagcccuaacucagcugccacagaccccagggugucugguccuggaacugagcacucugcggaccuccagcccugcucccacagucagucucagcaauggaggagacccaggggcaaagccacagcguaaaccccacaggccagugggaccaacaggcuguccccaggugcccaugugguggugccauccuuaacaugggagcagaacccuugggucacucucuaguuggccccuuguguuuucugggcauuguuagcuacugggacccccuuggguccagggagcugaccucaggaacccaggaagggcugguuuccuuccugggcccugcuggcgccguugccggccuuguugucagugguccacucugaggugggcggggccgcgacccuggccagcuccugcaagccccgugguucagggccggccaucgcuauauguggagcccaacucagcagucagagaaaggugacgcaugggggcgccgucaccguauccccagcaagcacguuugcacagaggccccugcucccgucgcccaccugccucuugcccgcagccucaggggauggggcaggccgcgugcuggcaguguguguugaggccucugugggggaccguaggcaccccgugcgguguggacgggccgagguccaggcugaggucaggccccaaagggccaaagggugcuaaccggccagucagggagcgggcuaggccugcaggcugaggaacaguagagcagccaucgugagggggcgaggacgccagcagcagcagacaggggccaggggacccaaggccauggggagcgggcuaggccugcaggcugagaacaguagagcagccaucgugagggggcgaggaugccagcagcagcagacaggggccaggcgacccaaggccauggggagcggguucagaaaucucugacaggugggcagagggggaggggagcuguggguggaggaacagcuguggccgcuggcugcugggggcagaugcccugagcaugggagauugcagggacagugaugccagcaucuguuaggguuggggaaagguauucccuuggacugcuauggggccugacagugaugccaccaucucuguuaggguuggggacuggcauucccucagggcugcuguggggccuggcucugcagguggcaacuauagggccaggcgguguggcuggcagggacuagggaccauaggccaagcccacgccuuccucacauucagccuggagggaggucagcugaauggaggucagagacuauggcucuccccugcuggguggcuggaagaugacagucuagggagacagggaggcuaagcccacagggucugguagcuggagugcaggagcagggaagagaugggcccaccccagcagauggcggcgggagggguugacguggagccgacguuccuuuugccuggcgucaacuacagugaugcagaugucacccagagauggcagcuggucggccgagggaagagggggcaucugccacgugggcccagugucaggaccaagguggguggguggggguuucagggaguucgcagguagaacgugagagucgugcugugcuggagggacgguguggguacauggcaggagacugugggcucacucgugucaccgucuccccucggaucugggaggacgcuguucuggaggccgcagccgccccggccucuggcagcugugggguccacguggcuggagggaccuggucaggccccagccugggauuguucagugugaggcagccagcugggcagugcacccccagggcccuggggcacagagcggccugucucagcacaaagccugagcaggggcagcccgggaagagcagagcgcguccagccgucuggagggggaggggcacuggcguugcugugggccccgggguccaaucgaggccaagugggcaggcacuggcguuggugugggcccggaguccagucgaggccgagugggcaggcacuggcauuggugugggcccgggguccagucgaggccgagugggcaggcacuggcguuggugugggcccgggguccagucgaggccgagugggcacucaacuugcaugccgcugccugcauggggcccacccacgacauggcgaugggagggucggcagcuggcugugaugagcuccuuuuccuucuuuccuuccucccggggcuuucguuccucagaaaugaaugcagaacaugguguuuucggugugagcaguaauuccuguucaucggaagucacgcugcgucuaauccgugacaagcuguuaccucauugcucagccguggugauccccucuuguccaggugccacggggcacggagacagauggcucugcugccggcucucgcaugugucugggugaaggacacaggcuggggaggacaccuggcaguggcccuuuugcaguguuucuugcaaguaggaggagguccacauucccgggugguccucagggccagcaccagguggggguuggcaggaccgggggcacaggacuggugcccuccccucuuucucccacugaucaccaccgugagcugcuuccgccucugaauggggccugcuuuguucccucguguuguguuaccacccuugaaagcgugaggaccguucuuagccugcggccgugguuggugcccagcuguagcaaaguuguugggucaguggguggcugcgugagccccgaagggaaaaugcaagcugugccacaggcaugucacaugucagcaugcugcacugaggggcgugguguggagccauguccccuggcaggacugccccuuccugcuuggggaugucguggagcugcauuucugguggacgcauggggagcauucgugguuucugugccacauucuguagcuggugggaaccagauccuggacacguggccucaccuaccaaggccuuguggagugaagccagcucugccaggagugccugguguggccaaggccaugaggugguggagggcauggcgcccacgagagggacaggggcguugcagcaccguggaugugggggaggcacacgagcccggcucacggcaggaccccacaugucugauagcagcgugugaagcgggacggggugcuuggaagggcaucaugggcacaggggagggguuggacugugggacaggccccugcagaguagaagcugcggcugacagggcugccaugagauuggcaaaguaggagccaaagggacaggcaguccugcuggccaugguccuaggggcagcaaaggcccaagucagaagcagaaccguggagcacgugagaggaaggagugacagacacagacaacucggaccaggaugugggugcaucagaagacaccacaaaggagcgagaagaccagccucucgccagguggacgaugcugcccacaccacugaccaagagcacaugaccaccugagagagcuagaggagagaaaaugggaacacgguggugggaaagcaacgacgggcugcguguggagguacgcgccuguaaugccagcauuuggggaggcugaggcaggaggaucgcuugagcccaggaguuugagaccagccugggcaacauagugagaccucaucuuuacaaaaaauuuaaaaguuagcuggacaugguggcaccuguggucccagcuacucgggaggcugagaggaggagcuugagcucaagaggucuugaggcuguagugagccgagauugugccacugcacuccagccugggcaacagagcaagacccugucucaaaaacagaagagaagaaaagaaagaaagcaacaaagaccccagagaacagcgggcaggagaccuggacucugaaccacgagaggccacaguggaugcgugcauggagcugaugggcaggccaggagaugcucaaccauguuauucaugagagaaccacaaaugaaagccacggggagaucauggcucaggagcagccaggcugggauggaaccgacgcagccaacgcugccuggcaucugccgccaggaccugagcgauguggggcugugagcuggggggcucugugugggaggggccaaggugccaccugggaccgacucggagaggcgcuggcaagcccgaagcccaccuuccggcaaggccucuuccuggugcagucggcaccuuuuugcuguguccucgcauggcagagagcuguggugucucuucucauagggacacuaacuccaccauggggcgcgucaucauggccucgucuagcucuaaucaccuccuaaaggccccgucuccagaaaccaucgcaucagugguuagggcuucaacauaaccauuuguggggacacaagcacccuguccacagcaagaccgauucaucaauugucuugcucuguugcccaggcuggagugcaguggcaugaucagggcucacggcagccuccaccuccugggcucaagccauccucccaccucagccccccaaguagcugggacuacaggcacauaccaccacacccggcuaauuuuuuaauuaauguggagacagagucuugcuguguuccccaggcuggacuccaacuccugagcucaagagauugaccugccucagccuccccaaaugcugggauuacaggugugagccaucacaccccgccauuuuuccuuuuuuuuuuucuuuuuuugagacggagucuugcuuugucgcccaggcuggagugcaguggcacgaucucggcucacuguaagcuucacuucccgguuucacacgccauucuccugccucagccucccaaguagcugggacuacaggcgcccaccaccacgcccggcuaauuuuuuuguauuuuuaguagagacgggguuucacuguguuaggauggucucgaucuccugaccucgugauccucccgucucggccucccaaagugcugggauuacaggcgugagccacugcgcccggcccauuuuuccuuuuugaaucaacuaaaaaaggcaagaggauugcuugagcccagaaguucaaggcuguagugagauaggaucgugccgcugcacuccagccugggugacauagagaccccaucucagaaauaaaaaagaaaugaucuuggguuucggugagaggaccuggguggaggccucggcccagagggagguugcagggcaggaagguuccaguggacaacuggauuuggggcugaagucuuaggggcacuuggcuauagagaagggcccaggcacugagggaggccaccgggagugaugggcauagugcugggagguguuugucggggaucuggggaggcugaccgugccugagcgguggggcuggcaggcaucaggaaaagaggucggggcugaggggaccauggaugaugcuccacguaccugcaggccgggacagccugggguggacagacucuggggccugggccucucauugugcucagcagaggaggaaggcccagaccuugguccugguagacucaaggcaggggcugggauaaaacugcacaucuggagaggcgcuccucagaccugccagguggguccagggaucugcaggaggugucuugggcccucaagccccugacagaagccccagcacugaggcccuuggcgugguccagauuugguagcccagugacccuugagcagaggaggggucacaacugagggagaucagggcccacugccucacagggacccccuccccucacuucagugcaugcugcuccuccggccgcgucccccaugcuguuguccuacguccugcugccguggggcccuccgcccccucgguguugaccuucauguacugcuccugucuccccuuggcuuauagaucuggguguggaggggccguaggccagcacccagcucucccugggccaggcgggaaggcugccccaggagacacuaguccccaguggauccaggucaggaaggagcagguccccgagggaagggcggccauccagagauggcccaggggccaggcagacagaacagggccgcuuccuccgcggugcccaugccacagguguccgcagccgaccaccugcccuggcgccccuucccccaugcuggggaaugugccacacagccuugcuccaucccugggagccaagcacuuguccuucccgucuaccugcugagguccagugagggcuuuggacagccuggcugggccaggccgacccugagugggcuugagggcugcaucccaggagcugcuucugccuucagggaggcuuugcugcagaccccgggaggggacgcuccugggagccuggaucagucaccuccaucucagcaaccccagcucuugggaguggcccauccucuuggccacucuccacugaccuugccccuccaugggcagcccuggcccaggucuccccgccauuaggucugucauucucagcuguacccuggucucagagaggccucugggccccgaugaccacaucccccugugucucccagcccccagccucuguggccccaaccaagcugcaggcuguccccaccccagaagaacacuuuuccccuugggaaaagugacccaaguccccuacaggcagcuugcucgaaccgcagcuggggaggggcuucaggcagggcauagcagccugagguggcugcaccugucuguuacaggaccgaccagcugggcauguucacgcacaaggaguuugagcagcuggcccccgugcuggaugguuucagccucaugaccuacgacuacucuacagcgcaucagugagugugggcuuggggggcuccugggcacagcaaacuccacagugcagcagugaguguggaccuggggggcuccugggcacagcugaugcccucuugccugugguucugugcacaaggucaccugcugagucuggacacccaccugagggaagccagugggacugcaccugccccaugcccugugguggucacguggguggggcccugccucugguggagcugggucacggccagagguacaggcauaguccugcugcugcccgaugccgcccuguccucuuucgccugagccacacuguugugggagggccgugugacacaggcgcaggcagggagaccucaggaaggaugcccagaaggccuugugucugcugaccuccuucccacugugucaugcggacuccugccuguggcuguggggugggggccgcacaugagugccuggcccuggguguguugucccucaugggcccgcucugcugacagcccuuucugaugggugauccuggcccuggacaugccucauggggccacucugcugacagcccuuucugaugggugauccuggcccuggacgugacgucccucaugggcccgcucugcugacagcccuuucugaugggugacuucuguucuuuacaacucucuagaggugucagccgcagcauggggaggaugcaccccucaguggagggccccaaugauggcucaggugcggggcccucccuguugcugaaacucgcucaccccuugcccugcaggccuggcccuaaugcaccccuguccuggguucgagccugcguccagguccuggacccgaaguccaaguggcgaagcaaaauccuccuggggcucaacuucuaugguauggacuacgcgaccuccaaggaugcccgugagccuguugucggggccaggugagccaagggcucucccugccgugcugaaggugucacugggcgcggguggguguggguguaaggagacagagugauggggagggucucgguccccuggggcuucugccccacagagucagagauaggggcugggccaggagccgguccugcuuggugcccaccccaccgcagcccccacuguggucaccacccauaacacggccacacaucugcgugaggcuguccccacaucugcgugaggcugggacugaggcuucccccacccgucagccuugccccacagcauacaggccgggccggggccuccuggguugaaugcuccuccuccucuccucugcccgggaguaauuuccugcuuuguguguucuugguaugcucugcgagugugguuucuuguuggcauuacuuuacuuuauuucuggaggacaucuuuccuggcuguagaauucuggcugucgguuuuuucacuggcaccuuaagcauguggccgcccucucauucggacagcguuucaccgccaccucuuucuccugccuguguugcuguccucccugcucguaggaauaucuuguauuuauggcugguuuugaacaauuuuauugacgugucuucauuuuccuuuugcacaguguucauggagccucuugagucugcauucguacucuuagcaaacuuggaaaauuugaggccaaauucuucaaauauuuuuucuguuucuucucuucugucuucucguuuggagaccacaaacacuagauccauugaauuugucccacagcucacgaauacaccuuuuaccuuuuggaauucuuuuuuuguugagacggagucucgcucugucgcccaggcuggagugcaguggcgcaaucuuggcucacugcaagcucugccucccggguucacgccauucuccugccucagccucccaaguagcugggacuacaggcgucugccaccgcgcccugcuaauuuuuguaucuuuaguagagaugggauuucaccgcauuagccaggauggucucgaucuccugaccucaugauccgcccaccuuggccucccaaagugcugggauuacaggggugagccaccacaccgggcugggauucuuuuuucucuguuuucuuuuuuuuuuuuuuuuuugagacagggucucacccugucguccaggcugcagugcacuggugugaucauagcucacugcagccucaaccuccugggcugaagccauccucccaccucagccucgcaaauagcugggaccacaggugcaugccaccaugccccgcuaauuuuuguauuuuuuuuguagagacaggguuuugccauguugucgaggcuggucucaaauuccuaggcucaagcgauccuccugccucagccucccaaagugcugggaugacaggugugagccccgugccuggccuggucauuucucuugcugugcccaaccugccauuaaucccauccauccugagcccgacguggucauuucucucaccacccaaccuaccgcccgacgugguccuuucccucaccacccaaccuaccgcccgacgugguccuuucccucaccacccaaccuaccgcccgacgugguccuuucccucaccacccagccuaccgcccgacgugguccuuucccucaccacccagccuaccgcccgacguccuuucccucaccacccagccuaccgcccgacgugguccuuucccucaccacccagccuaccgcccgacgugguccuuucccucaccacccagccuaccgcccgacgugguccuuucccucaccacccagccuaccguuaaucucauccagugcuuuugucaccucguguuguaauucaauuuuuuuuauuuuuuaugagaugggggucucacuaugugguccaggcuggucuugaacuccugggcucaagcgauccuccugccucagccucccaaagugcugcgaugacacgcgugagccaccaagcccagccaacauguuauaauucucuagaggcuugcuugggguccccuuuacgucuuccaugucucuacuaaacuuuugcagauugggauucaguuguaagaacugcugagugcccaugucugcugguucugauaucagggucgguuucaggaggcugcuuuuccuccuuguuugggguccuauuaugcugccuuccugugggccugguacucucggguugaugccugaggcauugcgaauuuuaccauguugcgugcuggguguuuuagcauuuuuauaaaucaucuuaaucuuuguucuggaugcaguugaguuucuuagaaacaguuuuagcugcucacuuuucuggagaaccugguccuuuuuguggaggccucggcugucgucuuuacgaguuuuugcaggucccccacaggccugcccuccgugaggggugugugcgugugucagcccaggcaggugagccgaggccaggccaucaccccugauuccuccuggucggccguggggaggggcagagguaaccugcuggauuugcggguccugaggguggcagcaguggguagaggaguauguuggggcaguguucccugcccggccuccaggggugcccuccgugagccccuccauggcagauggcaggugggccauguugcaagaccagggucguguguggugguccccuuagggaggcuuucccccgacacucuacgugcacacuccucucuguccacacggcugguccugggguccagcacaggccugggcucccgcuguucucuggcuucuggcccugggugcgcucugggucacugagcagggccugacccugcugcgggggcggacacgagggggugcuggcugaggugggccuggggucagccugggcaucaggcggggcgaagagccuggcgucuucucucccacgucucacccagugagucauagagaacucagccacacacugagacacgcggggcuccgcacaggcgagggcgaugccccagggccccuggcucguuuggguccccuguuccugcugagauggggcacaggucagucacugggugccagcucucaugucccugcaaugcagagugaggggcccggccgcccugucugcccaacugucuguucuuucaguuggggcugcucugugcuccugugugugcugcacccucccccaccauggcccuccuuugaugcugggaauccugggaaggcucuggaagcacagcucaugucccccaccuuaccacaucccugacauggugccugguucugggaccuuuggguggagccauguacagagcuugggcucccagcccaggauccccugugcaaagcaagaggccuccccaugcacccagcccugccucagcuccagcugugggcucugcucacccaggccuucagggaagccucaauucugguugggcuuuugaaagggagacagguguuggccuugagucgccaccgcacuagucuucaaggguaacaaaguaccauagauggggcagcugaaauaacagcuucgucucaguccugggggcuggaggugggagaugagaugaaggugccgucaagguggggucggcuccucccaggaccucucuccucagcugguagaucccagggccucuccucagcuuguagauaacugccuucucccuguguccucacaaggucccaugugcgccuguguccucuucuccucuucuuauaagacaccagucauguugcauuacagcccacccuugugacaucauuuuaacuuaaucacgucuugaaagacuuccucagugcaggcucaggccugugguccuagcuacucaggaggcugaggcaggaggaucacuggagcccaggaguucaaggccagccugggcaacauggugagacccuaacucuacaaaagaaaaagaauaagguggguggaucacaaagucaagaguucaagaccagccugaccaacauagugaaaccccgucucuacuaaaaauacaaaaaauuagucaggugugaccggacacuguggcucacaccuguaaucccagcacuuugggaggccgaggugggcggaucacaaggucaggagauagagaccauccuggcuaacacggugaaaccccgucuuuacuaaaaauacaaaaaauuagccgggcgugguggagggcaccuguagucccagcuauuugggaggcugaggcaggagaauagcgugaacccuggaggcagagguugcagugagcccagaucgcaccacugcacuccagccugggugacagagugagacuccgucucaaaaaaaaaaauuagccgggugugguggcgggcuacucgggaggcugagacaggagaaucacuuggacccgggaggcagacguugcagugaguggagaucgcgccauugcacuccagccugggcaacagugcgagacucugucucaaauuaaaaaaaaaagaauaaaaaagacuauuucuucaaauauagugcuacucugaggcacuggggauuaagacuuguguuaguucguuuucuguugcuuauaacagaauaccugaaacugaguacuuuauaaagaaaaggaauuuuuuuuuuuuuuagacagaauuucacucuuguugcccaggcuggagugcaauggugcgaucuuggcucaccgcauccucugccuccuggguucaagcaauucugccucagccucccgaguagcucgaauuacaggcaugugccaccacgguuuguuuuguuuuguuuuuuuugagacggaguccccaggcuggagugcaguggugugaucucagcucacugcagccuccaccuccuggguucaagcgauuguccugccucagccucccgaguagcuggaacuacaggcacgugccaccacacccagcuaauuuuuauauuuuuaguagagacaggguuuugcuaugucggccaggcuggucucaaacuccugaccucaagugauccacccggcucggcuucccaaagugcugggauuacaggcgugagccucugcacccagacaggaguuuauuucuuauagaggcugagaaguccaaggcccguggccaguucugugagagcguucuugcugguagggacuccgaagaguccggagguggugcaggguguccgugguacagggucugagcgagcugccgccuuccccuucuuagaaagccacagucccaugcccauggucacccacugguccauuaacccacuaguccaugaauggauuaauccguucaccagggcggagcccucaugacccagucaccuucuaaaggccccgccuccccacagugccgccuucuaaaggccccgccuccccacagugucgccuucuaaaggccccgccuccccacagugccgccuucuaaaggccccgccuccccacagugccgccuucuaaaggccccgccuccccacagugccacaguggguauuacauuucagugugaauuuugcagagaacauucaagacaucacacacuucacccuguggauuuuaggggaacagcucagcccauuacaccaucugagggugaugaguuagggcucacucacugcacaagagccugggucaggucacacaaggcaucaguguggcuuggcgcaacagcucacaccuguaaucccagcacuuuguggggcuaaggcaggaggauugcuugagcccagggguucgagaucuucuaugcaaaauagagagaccccaucauuacaaauaguuuaaaaacaaauuagccgguaugguggugcacaccuguggucccagccacucaggaggcugaggaaugccugagcuguggagguggagacugcacugcacuccagucugggcuccagagcaagacccugucuccaaaacaaccaaagccuucagcagcuucccgugggcaguugcacccacccaugauuguucugagaauuggcuaggggguuuggggccaaggaauucugauuacaaagguguguaugugagcguguggggguguaugcccucaggaccccccagcuuugcacaaguuggggucugugugcacccagucaggaaagaaaggcacugcuucuggguccucacucccagcugagaaguccccucaucugcccuccucgcccacccgaagugcccuuguuaaugaccucugggccugaguggcacagaggaggggugugggcaccuggcaggcuccagccuggaugcaggaccacuggaggggagcaggccauagggagaucugggucucaggggccccuagagugcccguccccacgucccauccuggguggccaguagcucuugcccugucugucccugccuagagaccuuggccagggcagcggcacagaugccagcucagcagggccaccucccgcaaggcuggaauaaauaaacggcugccaagacucgcucacacgugcauccucacagcugccgagccggccgagagagugcugacgcugcacagccauggcuccugccucaaggguacagcagggagggcacgcccacucuaguccaaggaggacacuggcaaggaucacaggcagaggcaacccugcugcugggagugugaugccugacagccaccagugucuucccuggguagguuccuggcucucaacugugccagagucccgucuacgaguggacggcacuccugccuccgccugaaugucugcacgguggaggggccguguucgcagcuccuuggaacauucuuccugacccuggcucugcccaggugguguccagccccucccugagccccgaccucccucucagcugcacuguucaucugcacccugugguccugcccuggacaggugucauccacucuggacaccaaauccagcccaagggcucacugccugcaacgugcacagggugagaugggccacccguugugggguguccuguggguccucccuaucuguucuagaagcuggggcucuucucccuggcccuuucucgaggcuuaucuguccuugcaccugugccggcuccugcugagcucuggcgacaucagcucagacgccucuccucacccucuguucucgccuuguguuggcaccagaugucugcuuuucuagcugaaaucucacuuauuagcugcgaccgcccuaaagagcagacagcccccagccucacaugcccccacacaccacgugcaccgccaagcaaugcggcgccugccacccacaccagccagucauccagucccagccuccucgcuccuccagccuauacuguguccucugcagaguggagcccaucguuccuucauccugucugucacccgccaggggacgucugggaggccggcagcagcagggauugaaucuuaggcacgugguccucaucacugccguggcgucuuuugcugccacgacucgguggaccuaggcguuuuccuccucugucuugugaaucuuuuacugugagaaucuucaagcauagaagugcauagaaugguguggcgagccccucauggccaccccaggacuugacucccucggccucauguggcgcuaagaguuucagcaaccccagccccgauccccggccucaugcucaccguguucuccuaacaccccagcgcucuccgauagccagugacgaggagccaggucuucuccacacccggggcccucagugucuacagcuugugccucugggagccuuggcugacuagcagcagcuccugagcacauccccaauggggccaggugcagggacuggcuggcauuaccugcgggcccagccacgcccgccuccccgagcgggagacggugaaccucagggccuccggucaggacauggcuggaucccacauuucagacaggacagccccgaagaaggauggccacccaccgaggagggcugucugguugaacucaagcucugagaggcaacugaaaccugugaagauaggagcaccuggccugggguuucagugucugcagggugggcuuggggagggccagccaucagcuauguccucccuucaggagggggccugggccuggcacugggggccucaccauugcucacagcagcccuggcccgagccugcaagccccuccucccaccagccagaagcagcuccacucccuuggacccguuccuuggagcuggcugcagagcccugugggggcuccugagggguccugggaagggcuucucucgacacacacuccugaggccagagccgggccucaugcacuuuucccugcaggaagcugugcaccaccaggcugugucuucugucugcugccuccaggacacggaaucguuuucuaaugguggcucagggcggcucacagcauaccaugacugcucuaccuuuggagccaggacagcccuagcagccggugggucaaguccaaggggugcugcauguggugacucacgccuguaaucauuacagccugggaggccgaguggggaggaucacgugaggccaggaguuugaaaccagcuugggucacagagcaagacccccaucucuacaaaaauguuaaaaguuagcagugugugguggugcacaccuguagucccggccacucaggaggcugaggcgggaggaucgcuugagccuuggagguccaggcugcagugcgcuaugaucacaccauugcauuccagucuucgugacagaacaagacccuaucuuuuuguuuuggagauggaguuucacucuugucgcccagucuggagugcaguggcuugauuucagcucacuguagccuccaccucccagguucaagugauucuccugccucagccucccaaguagcugggacuacaggugugugccaccaugccuggcuaauuuuuuguauuuuuaguagagaugggguuucaccacguuggccaggcuggucucgaacuccugaccucaggugauccgcccgccucagccucccaaagugcugggauuacaggcgugagccaccacgcccggcccccucuguuuuuaauccuugcguuuuagaccuuggcaaaguccccaggcuuuggagcaagccucucaucccacuuauuuugguuuucugcagcccuuucuccaaaaguuuccaagcuggucuccguggggugacgccccccacacacacacacaucaggagguccaaggacaucuuucucacacuugaucugcuuucucccuagaaacgcgucgaaccucugucccugguccuccuaaauugcucuguggcgcgucucgguguguuuuguguguauauccuguuuggcuuuccuuggcccuuuccauuugaggccuugcagcuguuuuugagguuggaugaaauucacauaccauaaaaugcaccauuucaaaguggcguuuaacacgcuuccagaauuguacagcccgcauuacugcuccccaaaaaaagaagcccugugccuuuuagcagcugugcccucuuucuccgcccuagcuugugcccaccuccagcccaccgucucuguagguuugucuguucuggauguuucugugaggccgagcuguccguguucauugaguccuuauuccuuacauccuccccguccaugugcuugucccucccuugggcuccugcagugcucccugcacccacucucggacuuucaccuuccccugcccucucuguggcccuuccuuccucccaggcaggccccucgcucgcuccccacucacuguggcuggugccugcgcccaaaagaccuguguggcccuuguuccuccugggagccugguccccuggugugcuuguccaucacaccagccaugcuccuuggggucuuacaagcccucaagggggucccaguuaccagccuggauggccacucaggccccccaaggacccagccccugugugugucugcggcccucugaggacuguccucccucugcugugggccuggacucccucugcugugccugcagcugcccguccucacucagccccgccccuauaccggguggccccaccuucccuccccaggagugacucucagacccucccugggcuuuugggagcugggcacacacccccacccagcaccugggcuccagcuucuccucguccccagggccugcuugggaguagcgauuccugggguuggggucccugacagcgcccuggucauggcugcccccacagcguggucaccacccacucgccaaaccaccaggcuggggcuccugagugggaggcacccagugcucucagggguccuggccacccccagccucaccuccuccuggaggcagcagauuuugagcagugaccacagaggccccccaggaggaggaguguguggcguggccagagcuccccacagcccgagggccaacccugcccugagguaucugcccacgacccugcacaucccauucuucucacagagccacccagcagauauugaggggggacgcugcaaauuacaccaacaacaccuugagugguguuucaguuaaggauaaugcaguaauuuuagagcugucugaugggguuguggcuaugcuggcagccuccaugacguugccuggucuggaggggcuucuggaaggaccauguuugcauguggccauugaggggccuggcccagccacaggagggcagggguccagcaguccuuuuccaggccugggauggcuggagcugccagccacugcugccaucccauuaccagagucuagagggacugggugcgguggcucacgccuguaauccuaacacuuugggaggccgaggcaggcagucacuugaggucaggaguucaagaccagcaugacuaacauggagaaacuccaucucuacuaaaaauacaaaaaccagcugggcgugguggcggguggcugugauccuagcuacuugggaggcagaggugggagaauugcuugaacccaggaggcggagguuacagugagccaagaucaugccacugcacuccagccugagugacagcgagacuuugucucaaaaaaacagaaacaggcgucuaagggaaacugucuggguuggggaggcugcccgaaugcuguuucccacccucccugccauguguuugccggggucugaugucugcagagcagccuccaugccccaaaaggccagagcuacccgauggggucuggcacuuugucgagcacugcuggggggguggcagcugcucccauucacagcucugaagugacaugugcccuagucuggaagaggcucccagugucaaggggacucugcccugcucaggacaacagcagccuuucccguuugggagccucaaacaucccacuacuccugggcaggagcagaaagguggcucgaggugcgguccuguggccauuucucacuuggauaaacccugcacuguccaucugugaccccuuaggauccugcggauguccaugccacacggcccaggucccugcgccccugcaguugccuacugccuguccuccccucccacauggcacccgggcuguaggccccacgccaggccuccucccugaggcugcagccccaggcacguggggggcacuguccucacgcagcaggcacuggucauguuccauugucagcugccuccaccugcacagacuccugucuguggagaccagaagcuucuggaaccaccugcccuggucccaaaugugcagugugagaugugcacacacucagggccccgugaccuggaagccgcagucguguccccagcaccuugggaaugagccuguccucugugugaaggagggggugguucucaaaccacugacucuuggugcucaggaggggccugcugcuguccugggcaugggguggucauuguucaagacugaggcagacucagucuuugaaagggugcagaggccaggcgcgguggcucacgccuguaauuccagcacuuugggaggccaaggcggacagaucacgaggucaggaguucgagaccagcuuggccaauacggugaaaccgcaucucuacuaaaaaauaacaaaaauuagucgggcauggugaugugugcuuguagucccagcuacucaggaggcugaggcagaagaaucaccugaaucugggaggcagagguugcagugaaccaagaucgcacgacuguacaccagccugggcgacagagugagacuccgucucaaaaaaaaaaaaaaaaaaaggugcagaaaccacugccccgggcagccauccccaguacaaggcacugcccacccaguacgaggcacugcccaucaguccagggccagcagcggggccagggcagccugaggccugucugguuagccucucaccuggggucuggacagagugaggagcccuguccagcagccgcugcgcggccugagggucacccucaggcucaggcaguuucaggccccgugucacucuccaggccacugaaaggacuuggugggguggcuucuuccgaggaagcuccuggaagauguuuuuccugagguuuccucuaauacaggguucacacggccuggggcucuggccaccccaccagguguugucccccagaccacuggggacaguggcugccccgaguggcccugccccugcugagagccacagccuuuggggguacaggguggggcugugggggagcugggugggcucccaaauccauauccuggucuccccagguacauccagacacugaaggaccacaggccccggauggugugggacagccaggccucagagcacuucuucgaguacaagaagugaguguuuugaagugcguggcccaccuuggccuugugugcagggaggggcccuggggguggagaugagggagcagcagggcccagggggucucagggucacgagcucacuugcugcucccggcccuggagcacagcuggacagcagguggccaccuggugggugggaggaguacaggccguggaccuuggcugugaggggaggaggccuggaaccagcagagcggaugggcugacagucccuuugucuugcaggagccgcagugggaggcacgucgucuucuacccaacccugaaggugcgugugcugccagccgugggaccgggggaggggugggccaugcgacagcacagcaggcacuggccugggguccaggcggugcugccccucggccuggaggacaucccuggguguuggggggacaggccccagcaggugcucacaccuccaucugugcccagucccugcaggugcggcuggagcuggcccgggagcugggcguuggggucucuaucugggagcugggccagggccuggacuacuucuacgaccugcucuaggugggcauugcggccuccgcgguggacguguucuuuucuaagccauggagugagugagcaggugugaaauacaggccuccacuccguuugcugugacgggucugcugcaguccucagucggggguccugggcaccaugugacuccccauccucccaugaggggucccugcccuggaugaguccuagcugggggacacccugagagcucgagccccucccacccgggcauccgcuggcugccuccugucagcugggcaggcggggcccacaguaccugccccaccaggacagccuggcucaggccuuucugggcugcuucucacauccugggcuggauguggguuuggaagcucuggaaccaucccggacucgcccacuccuggauucgagggcccucgcagggacagcucugcccagcaucaccccagggccuggcagugauagagcugagagcuccacccccacauaccugccacccaccuggccagccacagcacgugugucaccugcagagagccacccagacguccccaccgaguccagcacggcaagggugcaggggcugcccuagaaaugggcucagaggagccuggcccacccucuugaaacugguccuggaccuuggcucagcucugccgccucagguagcacgacccccaggccagccuggacacaucagggagcauggugaggggcaacggcaggacccgugggccauaucgggacaggcauuuccagcgagggguggggcagaggacauguggcuggcaggcuacacccacccugccaugcagcgguguccaggcucuggggaggcccuggggaauuuggaggcaucaugagccaaggccugguggcccucguuccccugccccucgucaccauccuguccuuggcuggccgugaggacuccccuccucaccacugggucccacagggcugaggugggcaguagagggcauagguggguacaugucccgggcaaggucucucggggggacagaagugaguccagggagugggugggccugggcgucccucacucagaaugccguggggugaggacggugaggacagggugggcacuggguucugguuuagagucaguaauguuagggcgcagugggcagggggucaggacaucuccagccgguggugaggaagcaugguggggucuccuccacaggacgggagcuggggaggggguccugggucggacccaaggcacccacacuugagaaagccuccgccuggacgucagggaggccugcgagcugccacagugcaggugcagccguucccaccgcccugcugcugcuugacacgggcauaggagauacaaguggugugugcggcgguucaugccuguaaucccaguacuuuggaaagccguggcgggaggaacgcugggcaacauggugaaaccccgucucuacccccuaaaaauagaaaaauuagcaagacaugguggcaugugccuguacuccuggcuacucaggaggcugagaugggaggaucgcuugaugagguugaggcugcagugagcugugaccgacugcacuccaaaaaccuugucuaaaaaaacacaagcugccacuggcuuuggggcacugaccuugucuccccagaggugcugacgcuaacauucaaguuguucucggggguccuguggcuucuguuggagugagggugggggacacgcaggucugggaggguggugugggccuggagcuaggcauugccagaucagcauuggguggaggcagggguggggaugccacacaggaugggaugucuagagcgggcugugucucccggggggaugggcagaggguggggcaggaauuagcuggaaaugagauuguggggugcaguuuggggaucagaugccccaaccugaacugaccgucaucccuguggccaggguccccacacaacccucaccccuggcugugagaauccugaggcaccuugaugcauuuuuuuucaugcccuguga

SEQ ID NO: 191819 - RNA, 35295 nt, Homo sapiens
gcaguggggcggugccgggggcggggcgcggcggcugucagcugacuguggcggcggcggccucgaggugacaacugucuccgucgcaggcuccggcgggggcgcaggaggucgcccggcgcgucacugucgggucggcgagccacgggggccgccgcagcaccauggcgaccaccgucagcacucagcgcgggccggugaggcagccgggcgagggucgggcgggggcggugaccugcgguugcgggcggggccuugggucagggcuacugcucagcugcggcuggcgggccgacuccgcggcucucccggggcacgcggggcgccuggccggccggaggggagcggcggcguccacaccucggggcggggcgggccggacggacgcgcccacgcugcaggaggcuugagcucaccgccgugccggggcagagcuuuggggaggcagccccgggggagggggccugcgcccguugugagccccagauggaggcgggccccgugccccauggugccccagagggaggcaggccccgcuccccaauggucuccagauggaggagggcccggugcccagauggaggcggccccgagcucugacucccgaauggaggagggccccgcacccuaauggucccccagguggaggcgggcccugaacccuaaugguccccuagauggaugcgggcccugcucccugauggccccccagguggaggcgggucccgcacccugauggcacccuagauggaggcgggccccgcacccugauggcccccccagguggaggcgggucccgcacccugauggccccccagguggaggcgggccugcacucuaguuggucccauagaugauggcuguuuccucuuucucauuuacacagagugagggcaguggugaccacuucuugggcccaauuguguccccgguuaguggccaccgugcaaaaccucaguuucuucauuugcaaaugagaggauaggcgccaggaacuucagagaaccuuuccugcucugaauucucuccugagaguugccuggcaguuucuucuauagcauuaauauugcaggagagcugguguagacugacucagagaugaugggcuccuggcgugaguggccuccuggcucacuguuagggccuucuugcauugcuguaaaggaauaccgagacuggguaauuuguaagaaaagagauuuaauuggcucccgguucugcaggcuguacagguagcauggugccggcaucugcuccuggggaggccucuggaagcucccagucauggcggaaggccaagugggagcuuacacgucacauggcgaaagcagcaagagaguuggggguggggaggugccacacacuguaaugaccagaucuugugagaacucacuaucaccgggacagcaccaagccacgagggaucugucccugugacccacacacccacccugccaggccccaccuccaacauuggggaucauaauucagcgugagauuuggcggggacacagauucaaaccgugucacucacugaggcugggcuggggcaggcugucgugagcgguacaguuuuuaucaacaguggcucugaacaugccguggguggaaaaaguccuuuuucacgaugcuccaaggucccugcccucgcgcagcccaguacuggacgugguggaggggucaccagggcuccccacccuuaacacuguauccacaaguccugguguuucucccgaggagauaauucuucagguagaacauuuuuucugaguuuagaaugaagccccagguuuugggcauagcugcuuuuucugaggacuuugaaggaaaccuccugacacuuaugagacucagguguggagccuacgggucggcagagguccuggacggccucugauggcagcgucucuaccucuucaucuuuacuccaccacagugaguccccgcaaguugccguggcagccaagugcuccuuucugccuaacaggagacucagagcaacaagggaaccagcacccugcuguuguguccuccuggagagcaggggggcaugguggccaggcaggauggccccuuccuugcuguguggucugggagacauccucugccuccugggaacuuguuccucaucuggaaccccacugggguguaggacugauuuugaaugcaucaggugcugagcaggcagggagcagugggaggcaggcccuuccuguucugaggggcaccggcgugcagcgcuguuacacccgcgaugaggaagugggagcggcaggagauguucucacacgcagggccugugcuggcaagugcugaggugucguuagaaucuccucuugcccagugccuccugggcuguuuccaucauguagacgagcagguauuucaggggcacccccguugaccgguaaacgcauaguaacaugaggucuggcucggagcugccagggucucuuaagaagguguugucagcgacgggggucucagguguugcuuggaguacaugugacuuaaucaaccagcgcuaccaacuguggcguucaggauggccaugaugcaggggacaaccaggugguuccugccacuggggucuuccagggcagcacgguagacauggcagcacauaaggacagcugagcuguguggugacggcccggugggucugugaucuuaagcgucaggugcugggagaguuuguaaaugggccucaccagggcuggguguuggggugaggacgugacaucucucggaggaggaaugggaguagggguugggcugggagggcagggcacggaaagagagguguggggucuggagguggagaggagggagccccaggggccgaggauggagggaggcaggagcuggaggccgccggaggguccugggcacaggaggacuggacuugcccuggaguuuaccggcucagcgcagcacucuguaaaguguugccuggcacacgcaaggcagggcccgccuuggcaccagccugcuucgcugagcaugacccaccccagccccucugaauuaacccauagugggccuuuacccaguuacuagcaccuagaggagcccugcuuuugcaggaugucuugacacaguauuuaucauguccucuuucuguuacaccuguggugccagagaggcaggagguuaagcagggcgcucgcucagcuuuccagcagaaagagaugcuccccaggguccgggggcaggacucuggcucgggagacccugacuguggucuagccguugccucccccuagugauaaggggagacggcaagaucccaugggccgugaaggagcagaggggccgcuaaugggguccugggaggguucuuuuguccuuggguagagggagcuucaggggcccggguggguagguguggagaggacgugugaagcuagccagcccgacaucguucugagagaaucauaccguguuuagaucuucaggauaaugguucccugaauagccacuaagggaugcuucagcccugugcagugcuucccucacguuucaaaaaggccaguauuuuggaaagauaaccuuuuuucaauauagucugcauauuaucagaaagcaugggugaguaccugcaaggaguaccauguggaccccugcgagggguaccgugggggccccugcgagggguacuguguggaccccugugaggaguaucaugggggccccugcgagggguaccgugcgggcccccgcgaggaguaucgaggaguaccguguggaccccugccuucugcagugagaucucgggacguuugcgggagacuccgcugcagccaccgcggugccgucagagaggccuccuugguagaggugggugcgcugugccguguccaggcugcucugacuccuuguccugcuucuggaggugcugguuggccauggaguccagcuggaggcggccuggccccucccuuccucccugagaggccuguuccuguccagguccccucacucuucacaucguugauaauuccugccgaaucggugacuucauuagggauggcagaggguaguuucugaacuuuaucacuucuucgguguuuauuaacugggauuguuuguaaagauuagcuuuccccaucaaccggugucggcuggcuguccugaaacacaauucgugaaagaaaggcaagugagaugcuuuucccucaucuucccguaccucaaggagagaguugcuuuucuuuguagaugugugugggcuuucucuccccugaguguugugaagagcccguggauuuuccugcauccugugugucugagccaguggcacuuacccgucuccgcuggcucuggugggcugcuccugggagggcguccguuccugcugacugcaccugagccagcggggaacgcacucaccgccuccucacgaguccuuucucucuggguuccugugaaccuuugcgcuggauuuuuuaggccggguugugagucuguacagguguggaauugcugugcuugccuggaaaucacaucuuuucacuguguggggacccacgggccucuuggaagauaaaggccucuugccuuugauuauuuugucugauacuggcauggccaccccagcugucuuuuagagaguauucaccuaguacuuuuuccuucuaugauuuuacauuuuucugaaaacuuuuguuuaagacacgugcaccaucgauagcacguagcuggauuuuuaaaaagucaaaucuaagaagacuaagucuuuugaugggaaugcgcuaguuucaucuuucuaguuaagagaugccuagauggauacacagauuuacagauuuuuuacauguuuucuuuggugcuuuuauuuguccuacauuuucuuauuuuuuuucucucauugccuuuugaauuuauuaaauggaguuuuaaaaaauucaguuguuuuaucucaaguacauacacacugugcugggaaaguacaggggcuccccuggaaaugguaacaugcacuuaucagcuucugccaugagggagucucugagugaacucuggcuccggaggcugcccggcuaaagaauaaauaaagaagaaguuaaucauugucugugccaccuccggauccacgcggagaccucggccgccccguccuggcgcgggugcugcugugccuugugugggugcuaccuccccuuggggcucccgcaggaauguguuacuucucucgagucagcgcuuguuuagauuuccuucuguguuucucuuuucuuaucccuucuggugucucgggccuuccauuuggggucacuuuccuuuagcuucagguucaucuagaauuuuccuugcuggcaaacuugauuuuugcuuguacaugccuuuucucuguguccugacagcuauuuuuguguguguggaacuccaggugggcgguacuccagguggacaguacucccgguggacggucacuuguccucagugccucgaaggugggaccccgcccucuccuggcuccuggaguggcugcugagcagcccgggaguggaugucccuuccuccggcuuuccuucguuuuuggcccucuguuugcugccuucugaauacgcugcuucuggccugccucccaguucacuugaggucuuuuuuuuuuuuuuuuuuuuuacauggaggcucgcucuguagcccaggcuggagugcaguggcacaaucucaacucacugcaaccucuuccucccagguucaagcgauuuuccugccucagacucccgaguagcugggauuacaggcguccaccaccacgcccagcuaauuuuuguauuuuuaguagagaugggguuucaccauguuggccaggcuguucucgaacuccuggucucaagugauccgcccaccucagccucccaaaguuuugggauuacaggcgugagccacugcacccggcccuaaccucuguucaucugggccucuaacacugucccuugaccugcccgacaggccccugguuaggccugcugugcaaguguuuccugucccugagucacugucuccagauccugcgggcccugcccuggcaccgugcuggugaggccugccuugcugcccugugggaagugcagcgugccccugccacccggccuugcccuguuucuuugcacagcgccuccugccguuagcauacagcauaacucaugaugcuucccguuugucuucuuccacucacguguaagcaucccaggagcaggggugccccagcaccucaccauggaagccucaggcacacagugacacgcagaggcugccgcagcgcgcgcccugugcccggcgcccagggccugccacgucacaugccgucccucucuggaucucuguccgcccuuggccugcugcuugacuggcuuuuguuucaucugaaugagaagggguuuuccgccucugccuugcuugaccgucccagcacuuaggaugcaaggcugccugcaguggaguuccuggcagagaccccauuuaaagucgcuuguucuguagucagcuuuuauaaucuaugcuuauucucauucuguccuguacucuucccuuucaccgcucuucagcuuacacggguucguuucaauacugucaucucccagcuucccuuacacaaauucuaguguuugcuuugagacuuuagcagagccagggaaccucccggcauguuggcuuugaagcgccuguuguguuuuguauaauuaaaggaagaggggagggggugauaggaagagggaaggaaagcccugucugaggaaggccccggaaggggagacaaggcacggcgaaugagugcucagcgagggcuccugggagggggcugcugagcggccgugggaggaggaugugggaacuggggacaaagucaccacugcccguccacacuggcgugggagcugccuugccaagagcaguugcaugaaaugccacuuauuugcucaaggguuguuuauugaacaugccagugccaggagacuggcguggagcaugaggccgaggcuggcuggaguggguuuuggggagugucaggaggcugguguggagcgugaggccgaggcuggcuggagugccaggggcugcagggucagguacugguccagcuuuuggaugcuggugcugugaaggguggugggugagggagccagcagcugagugggcauggggaauugcaguuuuccuucuagccuuauuuuggaaaaugcuaaacuuacagggcaauggcaguggccaccagugagugucggugaguccuucaccuccacggggcuccccucuuggccgugagugugcaggccuggggcaugugcaggcuggcacuucagucucugaaacccugcgcacugaggggucagucagcugggcagagggaccgccagggccacccagggucuguccugacugcccacggcccugugucucagcccuggugcgcguucccgcccucuugcacgcccggaucuggaugugaaucacacaggugugcgggcaucggguggaugggccauuucuccugggccagacugagcucugaccugggugugaaccuagcagcagacauccccuguaggacaguggccuggagcaggccccuugcagggccuucaaggcagggccagccccucagacacagcagggaggcuggugaugaccugggcuccagguucucagcuucaucuggaccaacugugcuguucuaugugaguccuggggcccugaccgagucuggggcucccuuccuagcagacacucagaccucgcccaagaggcuuugagacugacuuccgcccauaucccuagauguuccuacuacgggggauuuauuucucucuguuucauuagcuuccucugucccuuuagccacgagcccagcccaggucuuccugcugugggucccagcucugaaagucacguugaaucauggccauguuaggaacuggagaaaccuagggcucaggguacagaguuucacuaguugggcuucuguguuggggccuccgugggcuggcuuuguggcuucaggaguccuugacgcuuguucucaaugugggggugauauugacccugagagggcacaagggguucuugggggaggaaacuucugggguuuggcggccgugugugccuccccagcacagcuccuggauuucuugcuccuuaguauuucauugucccuggguuuucugggugucccagcacauggauacggaguucucggaagcccgcgacacaugugcgaucucagaccugcugugagguggguggggagggugggcaggcgccugcggaugccguuugugugggauccucagugcuggugugagacucuggcuuggagaauugaaugagaaucgucgacauuuugugauuuaauuccacagaacguauuuagcccaucgcuaaugaugucaguuugcugaaagaauaccagccagccaguuaaaagguacuuucucacaucaagcaaaagcuucaguucacuaaggauauuuuuuauuguguuuauauaaguuguuuauuucuacgugugauuugauacauuacaauuuauguaaauaaauuacacucagcgcugcucagcgcauagucaugaagugcuagaagcauuuuaguuuuuaauugaacuucguucgacuuaguuaugcuaaccuggcguuagcgcugagacucguugagccuugcuugcaguguuuacaugccaagugcaggugcaugcguggcacacagacacaaacagcaccuccacagccucgcagcgucauggggugggaacggugagaagguuuaaaaaggcuccgcagggggccagucauggaaguggccaggaaacccuggucuccugccgccugcguguggccagccgugcuucaggggcgacuguggugcggcuccuuggggugaugucuccuggcaggcgugaggccaggacugcauguguucaggacuccacguccugggcugagcugggcucuuccggggcucugucaaggcagaaaguguggcccaaggaagcagcggcacucucagucggaaacguauuccuaacaggugucgggcagaaaguguggcccaaggaagcagcggcucucuccguuggagacgugucaccaacaggaauauucacaguggguguuuaauuugugugcuuaaaaagaaaaauuagcuuuggauugacuacacacauugcaugacaaaaaagaagaauuaagacuuuauuucugugccaaaacuaaaacuuagacuugaagagaaauuguuuuaaauagaagugaauguuggagaccucuuuucuuucguguggaaagguacgcugcagugguuuagagcucuggcgucagugagggaggaauggucgucagucacaggcuugcgucgugauccucugagagcggcacaugggggaggagaaucagcaauuccaagaaauuugaaguuacauuuuaaaacuauauuuaaaacagacuaauauuuauaaaaguagcuuuuauuuucagagaagauaaaaugcugugagcucugugggaugagagcccuacccuguccuuuuuauuuuaaaaguaauucacgaauguuuuuaaaaaguuucuaaaaauaacuagcaggauauaaaaguauaaauaaauugaaauagaaucuucccugccuguuucccucgaguuccauuccugaaugcuccuccagaguuggugucgacagaggccuccuuauggcucccugcagcaggucgugccgcaccuccgccuccgccuccgucccccgagucuccauguguucgcggcagggaccgccggcuccuggugaggccgcguggcgaugcgcuggguggaugugccuggcugguggacggggcguuuugacggcacaggugacgcagccucaggcauccugugcucacgugcccgagugagcauugacaggggacuggcuccugaaguggaauuguuggccuucacacgggcauuuagacuuguuaguguugaacucaguaugugcaucuuguacauggaagcaaaauucuagaaaaauauccauuauguaucgggaguaaucauuuuuguuuucauauuuccaagccuuugaaccaggguaaagcauauauuuuuaugugaccauugaaauaguuccuccaucaucauauggcaaaaauaaauuuuaggauuagcacugaauuuaaaaaauaaauucaaaauagacauuuacugaaggaccgagugucgucacugaaacgauaggguuuacuucagcaccuggacucucuccccugugacucgugaagcaugaacugguagcacucccuccucguuugaagggcuuugcucuaaguugagaaacgagggcauugcagcagcaggcaagccgccucucccugguaggcggggcagcagguugcguaaccaguauuuguacggggaggacugaagccuggucuccgucuccucucuugcucuuccugucuucagguuaaauggaauauuuuucugaaaaaccuugaauuuuguaguguucagucuuaugacgaauugaaaagcuggcacgaagagguccugugugucucacccauguccccuggccgacgcuccccuccccgggaacagcucucacagcuguggcgcugagcugggggcaugacuguuggcuccagguuuuauuuggcuguccugguuuuucgaugacuguccccugcugucccagcacccugccuugcguuuagccaucaugucugccaucuccaaucugggaccgucucucaggcuuuccuuguguuuuugggaccuugacgguuugaggacgacugacuggucagggauuuugucagaugucucuuaauugggguguggguuuuugggaagaaaacccagaugugaggcgugugucaucucggggagcuggacgcgcaccugccccgccacauggcgcuggcugcgguccccgggcugcguggggcugaugagcuccauccgcagggagcugcuucuccccuuuucguguucuauccacacgguuuauguuuaaaaacccucuuuuccuauuugccauuuuaugguuaaauccuuguugaaaaaugacacuugaucauuaggccuuuggauauaauuuuauuuucucccaguaaugagcagucccacugucuuuaacggacaccuaaagagugcagagcaaggagauggagcgcuggacgccuucaaauaccgggacaaccaggauccagagcagcgagggacccacagugcucccucagaggccucuggaccccacgcccacacgucccugugaccacccacacccucccccgacuggcuucuccaugcugcugucuccgggacaugagucgccugucugucccccacguguggccaggagggcaugagccaccugucuguccccuacgugugcccaggagggcacgagccgccugucugucugccaugugugcccaggagauacggugcuuuuccugccauguccucagagcugugcauguggcacacaggaagcaguugucacaaauaaacaggaauuuggccuguguauguuaguccugagaacuugguuagcacgagucuguuucugcaagauaacccguuccuggugagcagacagagcuagucauagagccugcuggcaugggcugugccagggcccugugggguuggcagggaagcacguccuguguggccaggugucccccggggagagagcucugggcugugaauccuucugggaggcaggcgaagggcccuggccuucuguaccccaguguuuccugugugccaacaggaacaggugcuuagcaucucgugccauggggccucucagcgcccuccugagccagagcuugcuguugagcuguacagcgccucgagagaggcugccugggggaggcuggccugggacuccuggcaugggcccacuccgcucaggcaccucugcacccuccucgauuguccguaagggcagggggucccuccgggcccuggccuaugccacacccuccggaggugaagccggggugcucugcuuguucucgcaguacggcuucucucacagggcaaaggucacucgugacgugucccagucaaaaacgggguaaaguguggggaaacgcacaaaguguguuuugcuuuuuagagaagagcgguugagcacacgccaugcuggcugcucagguuggggugcagccugcagagagcuucccgaacuuggggguccugaguccguaacugcucgaagcggugccuggaucguccgggucccuucuguuuacucacauugguuguggagcgcugacuggcuugugcgcuccaggccuuagauggggacacaggugaggagcuagacccucucgggguccuuugaagugccaggcgcccagagcacagcaggugcagggcuuaacucagaaccuccuggagcccugccuggcaccgugucauugggaguccauggcacaggcagguacggguuucuggugugcauggcagaggcguucuggcggccucagcacgugcacuuugccuaagcucacguccgacacaccgaggguuccagguuccacucgguauuuccugaaaacaacugcccagggcacuggcgcugaccggggccccugcagacggcugggucuccaccccacuccaccagcaaccaggccuccaccccacuccaccagcaaccaggccuccaccccacuccaccagcaaccaggccuccaccccacuccaccagcaaccaggccuccaccccacuccaccagcaaccaggccuccaccccacuccaccagcaaccaggccuccaccccacuccaccagcaaccaggccuccaccccacuccaccagcaaccaggccuccaccccacuccuccaucaaccaggccuccaccccacuccaccagcaaccaggccuccaccccacuccaccagcaaccaggccuccaccccacuccuccagcaaccaggccuccaccccacuccaccagcaaccaggccuccaccccacuccaccagcaaccaggccuccaucccacuccuccagcaaccaggccuccaccagcaaccaggccuccaccccacuccaccagcaaccaggccuccaccccacuccuccagcaaccaggccuccaccccacuccaccagcagccagacccaugcucagggccucaucagcgaccuuucaccuguggagcaugguuuaccccaggccccuucggccgcugcaggugugcgggugguuucgggauggcauuguccugccugggcccauccucucucuuccccucagaaguggcagugguggacagagggucgaggagacauaggaugcagaguggggaggucuuucgugguuguuuggaaucgauuuacuuccugcguucuucugggauacuuuugaauuucagcuguuucauguggaaacauuugaaguauaucagcagaggguuuuccaaaucacuuuagaccugaggcucagcuuuugucucauucguuugaccaagugaccugcaguucaguggcccugccuuuagcuguggacaaggagaaagaagccgugggcacacauggugcaagggagacccuuuaaaaugaccugaaaacccaccugagcaggcuuugaggacaggaacccauuuuuagcggcagaaaccugcauuuggggaucuccugagugagggcugcaccuguaccgcugggggccaggccccaggcuggacacccuugaccccuccguuuagagaugaggaaacugaggcugagcacaguccaggacuugauaaggacaugggugggggcggggccgcgggaaugccgggggcagcugcugucgggcugcuuugugcccccacccugacucacuggccucucugguccccggccccgcagguguacaucggugagcucccgcaggacuuccuccgcaucacgcccacacagcagcagcggcagguccagcuggacgcccaggcggcccagcagcugcaguacggaggcgcagugggcaccgugggccgacugaacaucacggugguacaggugggccuuggggcacccuccugccugccuggggcuggugcgcucggugggggugggauuucggauuucggcguuuauacugcauuuccuaagcgggcaaacagaacuucugauucccgcuuuuccugaaaccugugugauguugaaaacgaucugugugaaagauauuggcauugaccccggguucuaccaaacauaacucaagugaugaguaguggguguaggugggcgucugcucuguguagggccuggcucuuccaccaggcuugaguacgcccaaggacaccucccggacccccgccggcagcuggaggaggcgcggccggcacccccgccaccuggugugugcugcgugaguggcuuccuguuggccucagugccggugccugcacccucccuccccacagagcagcccucggucagccucggggccggcccgugguugcuuaguggucuuucaagugaaagccaaaaucggcagauugaacgccgauuuugaucacacgaaaaccgucuguaagacugcaggaaaaggaaacacacugugagccacgcaggcuuucguagaaaugcagggaaaggagacacacugugagccacgcaggcuuucguagaaaugcagggaaaggagacacaccgugagccacgcgggcuuucguagaaaugcagggaaaggagacacaccgugagccacgcgggcuuucguagaaaugcagggaaaggagacacaccgugagccacccgggcuuucguagaaaugcagggaaaggagacacaccgugagccacgcgggcuuucguagaaaugcaggaaaaggagacacaccgugagccacgcgggcuuucguagaaaugcaggaaaaggagacacaccgugagccacgcgggcuuucguagaaaugcagggaaaggagacacaccgugagccacgcgggcuuucguagaaaugcagggaaaggagacacaccgugagccacgcgggcuuucguagaaaugcagggaaaggagacacaccgugagccacgcgggcuuucguagaaaugcagggaaaggagacacaccgugagccacgcgggcuuucguagaaaugcagggaaaggagacacaccgugagccacgcgggcuuucguagaaaugcagggaaaggagacacacugugagccacgcgggcuuucguagaaaugcagggaaaggagacacacugugagccacgcggcuuucguagaaaugcagggaaaggagacacacugagccaugcgggcuuucguagaaaugcagggaaaggagacacaccgugagccacgcgggcuuucguagaaaugcagggaaaggagacacacugugagccacgcgggcuuucguagaaaugcagggaaaggagacacacugugagccacgcgggcuuucguagaaaugcagggaaaggagacacacugugagccacacggcuuucauagaaaugcagggaaaggagacacacugagccaugcgggcuuuuguagaaaugcagggaaaggagacacacugugagccacgcgggcuuucguagaaaugcagggaaaggagacacacugugagccacgcggcuuucauagaaaugcacaaauacagcaggcagaagaaucgccguggaccucacaaauaagacuugcuuucaggggcuucaugguguggugagcacagcuacaccgucaccccuuccucgcggcgugucucagacccuugcuugugcagcuguuacugugcugguguggccgaucccucugcccacccagugaacucccguaagcccaugcauuccugugccagcugccaccaggccagccagugccaucacccguccucagccgccaccuccuggcagggccuggugaccgcagggcacuccaccucacacaguucaagcuccagagcuggcugggccuuggagguggcccuggcguugcccacgccucuggccccccuugguccucucccgcacccuggagcccaccacaggcagccuguuuccuccacgugagcucacccagccuucuguggcgcagcuccaguggugggaaacauuccugccuccucacugggccagguagcucagccccuguuuccugcuucucuuggcuucugggcggccacacaggugguucccugcuugcguccccucgcugcuuccccuuguugucuccuggggccccagugggaugccaaggggucugguccucagcccuccuccccucucugcccacacaucccggugacuucugcaucccugugggucuaaacacccaugugcuggccccagccugagccgaccacucagcuccaccccagaucccuagguacggaccauggccacauggccuccccagguguuccgugggcacuccggacuccgugugcccaagguggagcucucgggccacccucccggcuucucccccguguccgcagguggcugccccacacucuggaagcugaggcccaaagcccucgugcugcuggugcuccagguucauguccaccucuugcccuucaggccugacccucagcacaggcgccaccuucagcccguccaggccuggagccccccgcacccacccacugcccccgcucagccccugcagcguggccagaguagguccguucccgcgugggccuuucucgugggcacuguccugccgagccugcuccagcugggcccauguuuuccucacccuagucacuccugaccuuccucuucccuggccguucuccucccgcuuccugcagcucuuccuccagauccugcagcccgcauacccgguccuccuagcuggucacucccugcagugguaacgccgucugcugcgcugugugucugccgcgcaucucuugcccauuguggggaaagcagcggugcccguguguccccacggugucugcugucugacgugcgucucuugcccguugugggggaggcagcggugcccguguguccccacgguguccacagugucuccugcaccagaacagcaugugguugugugcagucauagugaaugggcagaugcuuccauaaacaucgaggaggucacuucagcagagcaguugaugucacaggacgcucauccuagaguuuucuagccacagugcagagggcagugggaggagaugggaaugagaggaugacgcugaguguggcagaagcaggcaggauccaaugugagcaggcaucggugacaggcacgggcaugcuggcaggggagucccaugugccacccagaaagcuggcuuugcucaaagccuuuaaaguuauuaauaaaaauaagucauagcagcuaggcagagacagcacaguuaccugaaagcuuuggaaaaucaugcuggucucagacuuuccugcuacauacucuccagaaaauagggcaguugcuaaggaguuuacaggggcagaguuuggaguguaagagcugaucuagcagaugugugggugugcagcagaagggaauuggaagcugcuagaggcugagcaugccugucgcccaggagcuuccggaaaacugucacuccauagcauuccggaguacgcuguggccacccaagaaacacgcuaaaauuaaggacccaagaauggggcaguuuugaccuaaaaggaccggccacagcuuugauuagaagugaaaggagggaacuuguauguggacaagaauagaaaacagaggaccuggcaguccagagaugugggcacaggaggggagaguucagcugugcggcgaggguuggcguggacgggacagccgugcccucgggggucggugaggacggggcggccgugcccucagaggugggucggugaggacggggcggccgugcccucagaggugggucggugaggacggggcggccgugcccucagaggugggucggugaggacggggcggccgugcccucagaggggggucagcgaggacggggcggccgugcccucagcggggggucagcgaggacggggcggccgugcccucagaggggugcggugagaacagggcggcggugcccucagagaggguucagugaggacaggguggccgugcccucagaggggcgucagugaggaugggguggccgugccuucgggggguggguggugaggacaggguggcaguacucucagagggggguugguguggacagguuggccguucccucagagggggucggggggcagugucuggacucuguuccacugggaaggaggaacuggcgggcuccaugugggugggagggccgggauggcucccggggucucuaucaccagcuccugggggugagccggguuggcugcaggagagcggguggcagugguacagggaggccgucugcauuccaggcaggacgcuuuacaggcagccggagcugcagggcugaacccaacccagcuuacgagggcuuuucuccugguuuuuucuuguaaagguuuuacaguuuuagguuuuauauuugaaccugccauccauguugaguuuguuugcugaacaaucaucuuacuugccacggucuucugucuuauucugaacacacguucacucccaccccgaggaccucaaaugucccugcccagcugagcaccuggccugaagucgaaucucauggucuacaugugauguggcuccuugugauugggagacacaagaaagacaaguuccaguccccaaaaccccacguacuccgauagcacaggcagggcugcugccuucacgagggaggaaagcagccacguggcgucugaauuaugugcagcagguguccucacucucaccuagagcgaggaugcaccucucccgggucaucaugcuccgggggcagguucacacuccaugucaugcucuggcucucagcucugucccgggaccuccuccucuuucccuccucagccacuucugaggagggcauuagagagugcgcccuucauggugggugaguggcggccucagcugugucugugagcgucguagguuucugcugucaaggacgagccacgugcuuugucucagaacugcacgauccaucuguggcucacucuucuugcuccuggccuccugggaagcaggucacagccguguucaggcgacucugaguggcuguagucuauguguuaggaaaaggccucguggaaggguucagggaggcagacggccuagagaacccacccucuccugaugguuggcaccuccuuuuccugacauuggcuucauuccaggcaaaguuggccaagaauuacggcaugacccgcauggaccccuacugccgacugcgccugggcuacgcgguguacgagacgcccacggcacacaauggcgccaagaauccccgcuggaauaaggucauccacugcacggugcccccaggcguggacucuuucuaucucgagaucuucgaugaggugagagggacgugccagcuauuauggaggcugcacguggcugagcguggcugccguggggacacaccugccaacacagccacguuccuggcuggcuucgaggcguggcuccccaccugguguuucauugggugcaugacaggguccugcucuccccaaggaaugugaaaaagggauuguuuccagcuccuugaacauacuuacauuuggaaacauccccagugacaagcaugacccagggauacagcgugcacguguccccuccgcugggcgcacagggucuggccgcucaccagcaggugggauuuccagggacagagcgugcacguguccccuccgcugggcacugaucuggccgcucaccagcaggugggauuuccagggacagagcaugcaugugucccccgccacugggcacucgucuggccgcucaccagcaggugggauuuccagggacagagcaugcauguguccgccccgcugggcgcacagggucuugccgcacaccagcaggugggauuuccagggacagagugugcacguguccacugggcacucgucuggccgcucaccagcaggugggauuuccagggacagagcgugcauguguccgccccgcugggcgcacaggguccggccgcucaccagcaggugggauuuccagagagugcggcugccuacugggugggaaagcuguucuugguggugcgaauggucgugacccuugaggguccugagucccguccguggcugcaccugcagcgcuucugaggcagagucagaaggucagaggggauguggcgaggcugcugcucagugugguccuggcaccucgcaccuguggcauugugaggcuagagacugggugggggccggggagcaguguggggcagccaggccagcagacggccagcccucccugccugggcccugccuuuuccucccggcuuuucucuccccgucccuaccugcuuuccccucccuggcccucagaagaguagagagcgcaugggaagugcagagucagcugugggaggcagaccccguguccuuuccagucugcaccccggcugcucuggggcuugacagguggcagccgguggagcaaggauggggccccgagggcuggggaggagcagccagugucccugaaguggaacugaaggaggacagcagcccagggcccucgcuuuccccagccccagaccuggcccuggcccuggcccuggcccauccugguggagagagggaagaaguccccuacggaggcugauauacgaucgugaagccugcgcugcccgaggggucucaucgaugggguguuggugcaggugggagcccuguuccacagauaagacggggacucgaggcgggcccacgauggugcggcugcaggggcaggguggccccuucccugaugccuggggccucucccucuugucucccgcagagagccuucuccauggacgaccgcauugccuggacccacaucaccaucccggagucccugaggcagggcaagguggaggacaagugguacagccugagcgggaggcagggggacgacaaggagggcaugaucaaccucgucauguccuacgcggugagcugcacgccugggcgggguggggcgcauugggguauguuggagcacgucggggcuaugccgccccacagacacccuugucucuuuccuggaggcacugagcccauaaaacagcagggcucacguucugaggacagagggcaggggcccugggugguuugguggcagagaggggcugcccugcccacugcuccugcccauguucucugucuggggaaacagcauagggguuguuuguguuccuaagaugagccaacccuuugugguggucuccacugcaggccccuguguccucggaggacccccacagcccuuccaagcucugcccuuaggguccagcugagcagcccuccagggucugagauacagcccugggcccugcaggacaccaggcuccuccccacagggcaggcauuggccgugguguggcagggcaucucuggagaugucggggaagccugggggcugcugugcucagggucaggaagucgaggccuggcuguggggccagcacgucagcgcccuggcucccagccaucuccauucucagggcaccugcagcuccugggggcaucaggagggccaguuagaggcuccaagacgcagagcuccugccgucucgucuguaucaucaaccagaggauuuucaggcuguuacugaaaaauggugcugugggaaaugccaggcagaugugacagcagagagggugcagcagagagggugcagcagggagggugcagcagggaggcugcagcagagagggugcggcagggaggcugcggcggggagggugcggcggggaggcugcggcggggaggcugcggcagggagggugcggcggggaggcugcggcggggagggugcggcggggaggcugcggcggggaggcugcggcagagagggugcagcggggaggcugcggcggggaggcugcggcggggagggugcggcggggaggcugcggcggggagggugcggcggggaggcugcggcggggaggcugcggcggggagggugcggcggggaggcugcggcggggagggugcggcggggaggcugcggcggggaggcugcggcggugaggcugcggcggggaggcugcggcggggaggcugcggcggggagggugcggcggggagggugcggcggggaggcugcggcggggagggugcggcggggaggcugcggcggggagggugcggcggggaggcugcggcggggaggcagcagcagggagcugcuuuucugggccaucuuggcuccucccacccccuuuuuguuaaagcugggauauuuuaaaucaugucccggccgugagugacgauguguaaaugucucaugacacgucuuuaacagacgcuuucauacaaacacagaaccaucaugacgcuccagugauuuuaccugcaguugacaguuucgaacucagagacgacaguggugcagugacuuauccgcaguugacaguuucgaacucagaagacagcggugcagugacuuauccacagcugacaguuuugaacucagagacggcagcggugcagugacuuauccgcagcugacaguuuugaacucagaggcgacaguggugcagugacuuauccgcagcugacaguuucgaacucagagacaaccgcggugcagugacuuauccacaguugacaguuuugaacucagagacaacagcagugcagugacuuauccgcaguggacaguuuugaacucaggagacagcagugcagugacuuaucugcaguggacaguuuugaacuaaacucagagacgacagcagugcagugacuuauccacgguugacaguuuugaacucagagacaacagcagugcaaugacuuauccgcaguggacaguuuugaacucaggagacagcagugcagugacuuauccacaguggacaguuuugaacuaaacuuagagaugacagcggugcagugacuuauccacaguugacaguuuugaacucaggagacagcagugcagugacuuauccgcaguggacaguuuugaacuaaacucagagacgacagcggugcagugacuuauccgcaguugacaguuuugaacucagaggugacaguggugcagugacuuauccacaguggacaguuuugaacucagaguugacagcagugcagugacuuaugugaaguugacacuuucaaacucagacaccacagcagugcagugugguuccccccaggccgacucgacaccuacacugggaugucccuccugucaccauccucucucagucacaucccaguuagaagggggucuguaagcccgagccaugucaccuccuggauuugaggagguggugcaggggugggagcagggcccagcguccccugugcacucagggcucguguagcgagggugauucugggcuggcauggggagggcgauucugggcuggcguggggagggcaauuguggggagggcgauucccgagguucugauggguggauguuccuccuugaccccgggaccaucuccgcuguguuucagcugcuuccagcugccauggugaugccaccccagcccgugguccugaugccaacaguguaccagcagggcguuggcuaugugcccaucacaggugcgugugcucccucccugggugccucuccccugguagaaaccccagggccuagggcaggugcgggaggagggaacggggcuuagagcgccgggguggggacgucauccauucuagaauccuguagacgugcugaccgcacacagauccuuucaggccaggaagccaaggcuuacguuugaauuuuguuugcauaucuagaaaauagaauuguuuuuuuuuuuuuuuucuaauuguuggcagaaaugaggugaguugaaauuuucagagauguggaaauguggcuuugaaaccccguugugcccagcucugugcaggagaaccucacgccccugucaggugacacgugcucugcacugugccgucguguccgaaccucacgcccauugggugacgcgugcccugcgcugcgccguugugucugaaccucacgcuccuguugggugaugcgugcucucuacugcgcuguugcgucuguugucgugugucacuguuaggagugagcagccuguggcugcagcaacaccaagcugggaugucgcuuuucaugcuguugcauuuucgguccagcugugacugugguagcugcuggugcaagaccggcccccaccauggaugggcccagccgucuuuagcaggcggggagaccgcagccccugagaggaggugcuaggggggagccuguggucacccugguucuccugcugagguggccucucucguucuggggagcugguguccaggcagagcacuggucccucugcacggaggguggaggccagaggcccaggccauggaaguggccaaguugcgggcagggcgcuagggaugcguggugguguugggggaggugguguuaggggagggucucggggcugcaugaggccccggcugcuugugcucaggggcugcuuugggguuggggcgggacagagcugcuggcaggcgagagugcugugaggccagugcugguguccagcccagcuggaguggagaggccuggucagcaccccaguccugccagcauccugcacagaugcagaaaggccaccuugggagucgggaccucgcccuagacccaccugauguggccugaaacccagcccugacgaugggaaggaggagacggcacugggagacucugggcuguccacugguguucaggacauucucggacaaaacugccugugagaacagcauggccucgcccucacuugcucacauuauagacucuguuuccaugugaagccgcccgcgcaggugccagggcugccuuucuccagaggaaagagcagagcgugugucugagagggccucugugguguccagugucuuagaaaaccaccagccugggggugggugugggggcucaugccucuaaucccggcaccuugggaggccaaggcgggcagaucgugaggucaggagaucaagaccauccuggccaacacggugaaaccccgucucuacuaaaaauacaaacaaauuagccgggcgcgguggugggcgccuguagucccagcugcucgggaggcugaggcaggagaauggugugaacccaggagguggagcuugcagugagccgagauugcgccacugcacuccagccugggugacagagcaagacuccaucucaaaaaaaaaaagaaaaccaccagcccagcagagguagcaccugcaccccgucaccgaggaaagaaugcuuccuaggaggugaccacaggugagccagaaacgcagaagcagccuugaggcguucagaguuagaggagggugggcaucuggguaaguggaagagccagcaccuuggcagagaaacgggggcgagcaugggagccccacagcuguuccugagccuggagccuggccaggggagcucugcugcccugggggcccugaugcgcccuggcugccccccagaguggcuccuggagguucugauuuguaacugggacagcccagagccgccgucguggggucaaagugccuucugugaugugcaguucauggggcuagugaaguucugucugguuguccugaguuggaggccaauggccaaccugaaagaacagagacccaggcccuccagcuuccugaggcuggaagucgaagccccguaggcagggccacucacucgucaaggcugugaggaggauccuccccgucuccuccaacuucugggccgggcgcucuguggcugucuuuuuggggggugcaguuccaucaacuggauacagcgccaggguguaucuggcugaaagagcauucagaugacagauaacauugauuggcuuaccucuuucugguuccuaucccuaauucucuuuguagaugccuuucaaguuugcucuaaaacguuuauuuuaggaaaggcuagacaaacuuugaaauuuucuuuugauagacauuguaaauuuuggaacagccccgcacuucauagaaaaguucccaaggagaugcaggaacaucugccagagccugugaggacucguccaccugacgccccaccggagcccccagcccccaugcccaggcaugcguuuccaauaagcaggggcgucccuggcacaguacggccaucuagaugaagcugacacugacgcguuggggcuguacccugcuuggagcccgucugaguccgcagcauccaggccggggucacuggcccuccauggccuugccucccuuggccuggagggguccccaucuugcuccuaggguauguucuggucagggaccugguggggcugcugacguggccuugcaggguagggcugaguuuccccggggcugcuggcagggcccccgcauuuuacccaggcagaugccaccaccgcagauuccacccagcgcagguuuacccagugcagggcuaguggugugacuugcucgucccucacggcgggcucugccuggcuguuccccgggaacuaaaauauguccugugugggaggcaccccaggaccacgugaagaucccgcccuugucagccccugaguuuauccgacuuccccagcaauguggauuuacaauuuccuauuuuauuuauuuauuuauuuauuuuaauuauauuuuaaguuuuaggguacaugugcacaacgugcagguuuguuacauauguauccaugugccauguuggugugcugcacccauuaacucauuuagcauuagguauaucuccuaaacaauuuccuauuuuauuuauuuauuuauuuauuuuaauuauacuuuaaguuuuaggguacaugugcacaacgugcagguuuguuacauauguauccgugugccauguuggugugcugcacccauugacucgucauuuaacauuagguauuucuccuaaacaauuuccuauuuuauuuauuuauuuaucuuaauuauauuuuaaguuuuaggguacaugugcacaacgugcagguuuguuacauauguauccgugugccauguuggugugccggacccauugacucaucauuuaacauuagguauuucuccuaaacaauuuccuauuuuauuuauuuauuuauuuuaauuauacuuuaaguuuuaggguacaugugcgcaaugugcagguuuguuacauauguauccgugugccauguuggugugcugcacccauugacucgucauuuaacauuagguauuucuccuaaacaauuuccuauuuuuuuccuugggucagaaucccuuaugaauguuauuuuuucacucaaauuauuccagauuuggccagagggagcccccucaggcgggaucuuuguucuuuggccuccucugauccuucucugggccccucccugcuuccuggcacugcaggaagccccaggcucucugcauuuccggccuuagcccuggcguuagcuguuucucccaggagcccugguucccauuaggagaacacugcuuuuaggagccuuugaaguauuuuuuaauuauccuagcaguacuguagagugugaauaaggcacccuucuucacuggaagcugaugcccuaauuuucuucugaguaccugugaucacagcccauccucccggcagccacugccagcugaagggcgaagucugcggagaccuuggagaggcuggcggcugcgugcucagggcgucucgggccgacuaggcaagcaugguggagucacaccaggguuuucuucucagaaguggaaucucaaagugcaucuuggccagagcaugugugucgcccacaguuucaaguguuuaugacucacaugguggagaagccugugccgcgugcucugccuggcuacgcggugcuggcugcguggcuucgggccugugugcacgcagggcggccuggccaagcccucuggugagacggggcugccggagugggccaggaaaggagagcccggcuucuuagggcccugcuucucgccagccccuucagccgcucguucauucagcugucgccugcugaucgcugcccagagacccccgcacagggugcaggucucgggggcucacugugcacauuaggugggcucaggccccgagagccucccguggugucugagcccagcugccaccucuauggagagugcaagcuggagacugagggcugaaugcuggcugagcccucacgaggaccguccacuuuccucagugaaaaaccagagucccccacaaagcaacucagaagccggggcgcugaggucagaccaucuccuucacaaaaauaaagugugaccgcaucagugaggaagggaggcuggaacacgaagcacagcuugauuauuaaagcuuuuacgccaugaucauggcccgaagagaacaguuuuaaguuuugauuuuuuuaaacaaaguauuauuuugauuaccaaauuagauacuuuacagauuucaaauaauucgugguaggcaucaugugguuauaggggguuuuuuagccucaauuuuaaggaaacaucuaggcgugaagcaucuggagaccgcguggccucaugaagcauguucucuuccacggagcugcagaguggacagagacucuccgccaggcuggcaacagcagccaacugcucaauuucccgugcguucuucgugcgugagagaccagcgcgggugccacugggccucagcccugccugcacugucccuucagcugucccuggcacagaggggcacucgggcugcagccacugccaggggucugcccugaggguccccacgagacugacaggcgcugagguggaagguggugccggccgcgcuguccucuggggcccuccucacuuucccuccuccuguugcuuuccaccuccuucugcuugguggugggaggagaaucggccuggaaaguggggcguccggcgccuccccagccuggcccgcauaggcagcaccagggugugcaugagcucauucugugcucaccguggcugcagcugcccguugacgcuguuuccaucuguucccucgugcaccuccauuucacacgggccuggagugcuucucucuuuucucugcugcccccacguccucaccggcgcagucccucccgucauccuggccugcgucucugugggcacaacccccacugguuucuguggagccaaccagaccaggacaugaaugcccguccacaaaguaugaaagcaaaacacgcagguggacgccgcugcugggauggacaagggggaggcccauagagaacgugcacgcgguggcaccaugcacgggagcagccggcguucgcagcgccugugaguuccagagagggccagccaagggcucacccagcggcccaggcaugcuuccccucgcacguggaauuccagcgaauagggaguuugcagcugagcagcacaugccauuuaaaauacgaaaugguuccauucaaaaugagaauuggaugcuuaaaaguuuccgagacaaacuaucacauggaacucucugcuguuguguuuauuaacccgcuaacuuggucgcuuugaaacaaagaaucacguagguuuucuucuuugugauaacgcucuguggagugagaagcagcaacaagccuugggaguuccggaacagucucugagcuggacggucguccccaccugcucuuuggaugucuuuccacuguggugcgagacgucuggagcccagggccacaugccuucagccugagcagggcugaugcuccccugcccaccggcggccgggacuuaccaugcugcguggucugagaucagggccuucucggagcaauuuuuccugaauggaaaagggacaaguuuugguuuuccuggguauccuuguguuugucaguagagaauuugauuuugccaagauaugacagcagauucacacagcgugaagaacgugagguggggccuguccugugcugcacauccguccgcgugcgugcagguggcugguggggcugagcgcggcagauggcagggacacagcaaagccgcccaucacuccucccagggccgcuacaggugggcucugggcugccccgggcucccauggcguccucucugcccacauuuuggggacuuugcucuccgccaggccccagagcuccuggucuguccuccugaaguccccaggcagccuugacacauacgcucaccguucccggagggcuugauggacacauccgugcuugguaaccaggaugggccggcucaggccaggcacauggccucugcccugcaggaaggaggggagugagccaggccacugccccucagcccacaccguggaagcacccaccucuucccccgggggugccugcuccccaagugaguguguuggggccgugcuguugggauucacuugagggccagucggcgccacauccccucauugucagcagagcagguuucucgggacaccccaggccgugacgucgcagcgucacagccaccgucaucgauuuugcagcaguuccccuccuccugucccuuccccaucagacugguaaaggcuggagagagugggagcacggugccuccguuccucauguugccacgcuguggggagacgugugggcagggacaggcgauggccgagccccauuccucuuguugccaugcuguggggagcuguaugggcagggacaggugauggccaaguuccugcccgccugccagccggggcgcccaaaaagccacggggaucccaggggucccuccaggacagacagcgcccaagccuuugucuuguuugaggaagaagaaaggguggugaggguggccacguccccaccuggccaugguucgguucguuuuccgucauugccgaaaggcugaugagcauggggaugaugcuuccccagugaggugagguguccaguggccaggacaagaggcagguguggguguggaggaaaggugggccuggcccugagagagccgagaagcagaggaggcagggguggguguggaggaagagucggccuggccuagaaggagccgggaagcgguggccuuccuugcugaggaguccuggccuuugcagcaggugcaggaggcuugguggcaagcccugucugcuccguuuacaccccugcaggucuuguugcugguguugguucaggccaggauugaaguggcuucugcugccuuuaggauccuccaaguguagaaaggaacaaaaguccuauccuaagauuggggcucuagcgcuccagugauccuagcugggagaugguucgugcuuuuaaaggugaaugaacgggugagcagugaacccuugcacugcugcagcugcugcugcaggaggagcucugugccucgcuggucgccgagccccgcgcacgcugccugugcucugugccucacuggucgcugagccccgcgcacgcugccugugcucagggcugcucgugguuuuagggagcggccaccaggcugggaggcgagucuuaaguccggccacacggugccuucaggggugugugugcugcaguggcugaaccgccgugcgucuccugcucgauagauugcaucucaguguguccucccgcaucagacauggggcgaggggccugcguagcugugggguggagaugccaggaacccuggacgguggccccagugcacugaggguccacuguacaccgcaccugcugccccacuuguuugaguuuugugagcauuuucuugguguaguuuguaugugugugugggguugucauucugggcaucggcugcagcuuugcugaggucuucagugccuguggugauuguuccccaccggcacacaguuuagugacacacuugccaagcugcaaaagcaucuucuagaaugccugauaaaggaagaggcucagaccgugcaguguuuggaucagcgggcgugacauuccguguaguccguccccagaugcagaggacucugugagcccacuggucagugaagacgagcgugugcagugcaaauucacgaguucugaagggaucaaaacaccacccccagccugcuaguuauaaaacagacucgggugagauuugaaagaucaaacuuugauuuuuauauggaaggaagaugaguuagugaaggaggcgucacagagggcccugcccaccuuccccguggcugugccugggguugcuguuuggggguuugccuuuccagggugucuugcgggacugguguuugcugagacccgagguggccccuuccucagggaggccggugggaugcguuguuuucuuccuucagcaggagcuaguguggcacuucuggaacuuuccgacguuuuuaccaaacuugaucuuugcuuccagggaugcccgcugucuguagccccggcauggugcccguggcccugcccccggccgccgugaacgcccagccccgcuguagcgaggaggaccugaaagccauccaggacauguuccccaacauggaccaggaggugauccgcuccgugcuggaagcccagcgagggaacaaggaugccgccaucaacucccugcugcagaugggggaggagccauagagccucugccucgaugccguuuugcccccgcucuuuggacacgccgacccggcgcuccccaaggaaugcugucccaacaagauucccgugaaagagcacccgugucgcccccucccguggacuucugugccgccccguccacaccuguucuugggugcauguggguuuucgguuccuggcgguccaggacggggcgggggcuccccucccaucucgugcugggaggucucagcgcgcucuccugucccugggacgugcgucucuccuucucaugccguucuggaaaaugcucuugcuguagagagcagcugcuucugccaggguguuggaggugguggagcgccuuccgauuccauucauggcauuuugugaugugauguaauuggaauagagcuguugauuuaaggcacacacaaucccucacacuguggguuuuuuuuagaacuucccagacgaaaacucacgcccuugcccuaacgcgcuuugcugugagccuggccccugcccagggcuugggucuggugagcugagcagcuuccuguggaugguguggggccggccucuggccuggcucaccuggccacuguccagccagccuugugacagacuccggccugaaggcagaaugaacccacaccuggagugaggaagggggccuggcacgguuggccaggcucugccugauugccagccagcgggcaucugaagccggguccuucgcccgccggaggcugccguccgucucuccugcugcgcucgugccagcuccguggguguccucccagggagcuucucuucucaacaggccuugcgaggcuggggugagaggugauagaggcagcacugugcaugauuccgagagggugugguggcacugccagccgacugcugacagcuugggagcugcugugcccaggacguggguucagcgugggcgaggaaagccuggcgagcguggcccuguaaaagcuuucugaggcgggaggcgcucacuuaccucugacugccugggcgcugcguguagcaucuuggccuacaggacagauuuuaggugacaccugguuaugacagucagaaauuugagaagcuucucacaagugaugcacuuuaaauaaucugcaugccauugagacaccugcaugucugguguuugugguucaagugucuugccgccggccuucggauguaaacccacugauaacggacagaaagagaaugcccacaagugggucuucuguggaagaugcagaaggaggaaguuagugcuuacauuuuagucuuuuucucccucaaaaaaauagguuaaguuucagugccagcuagaaaauacugcuuucugccaucgauugggggugguuuuugucaaauauacuguugauaaauauuuauuuuuguaaacuugaagugugugguggccgugggggagggacaugcuggcagcaggcgccuucuucagcuguggguccuaaaggccuuugauccuuugaagaagaaagacaugguauuuguucagcagacgccgaccacucagacggaggggccccugggauucccugucucagauggccuggucuuacgccuguguagauuucuucuccauugggaaugaaggugucaggcgggacuggaacguucuagaugguauguuccgugauauuaacaacucuaacccaggacagaccacaagccacacucagaggccucacugugcugggggcuucgguguccaggcgcccagguguggccaccagcaccgguuucugccuucgcguugcuggggugcagugagacugccacacgcgugcacauguggcucugugggugucuccuagagaggacguggccccugcugccagcccuugagcagcccgugugggggcccgagggacccacacagugggggccagccucgcuggagggagagcaacccuuugccgaugaccacgcuugccgccaucucuuaguuuucuuuuucacaagcgcuuuauuuuuuuaauagacaaaucacauuuugcaaggccuuuaauuaaauaagauucuucuuuccuucauuuuaugcuuuauuuccuguuugaaggcuuacuguagaaguggcuuacuguagaagcagcuugcugagccccuccgagcgguccccagaauuagcugguucacaacccccacccucccccgcccccgccugugucagguguggaugaggucgucacacucagaaggacaggcuugucugccagcucacaaggggaggcugcaguggguuugggagcuggguuuaggccccuggugucugagggcccaggccuugccagccucugcugcuccugcuccuggguuugaagaugcaggccgaucgccagcuccguggcagcggucacuaaggacagccugacugugccaucuuggagccucaggcggggcuccggagauagaagacaggucgccggaggcucccccuccucuccucuccccucugcagaugcucccugggcgcuacccugcagggugccaggcaggaguggucucagaacgugcgcuucugauuauuuuacugggguccauuguccagauuuuucuuugauuguaaaauauauuuuuacuuuuuagucuucuaauuuaauaaaugauccauauaaaaauagagaaauaaaguccuuuaagggaagguuuacca

SEQ ID NO: 191820 - RNA, 17264 nt, Homo sapiens
cuuggccagcccuugccucuggaaagggggcagcuguuugucucugccaggcgucccauuggccagggagugaggcuggagggcccggcagcaggcauuugcgagugcuggccagccggcaccccgccccgcuucuccuccccaccuucccgucgcccacucaugcugggagaccacugcagucucccugaagaccaagcccggcccggccagucccugcaaaguggacucugcugcaaaauggugcuucaggcugucagcaaagugcucagguaacaccugccagccuggcugggggagggguguguagcacaucugucugcccuguucuugcccccaggaaggaggucaggguggggaggcggcggacuguguccguggcugcccucccaguguggccggcggcugugcagcgagcugugcugggccacacgcaagcuguccagggcagaggcggcugugcagucccgggccagccuggcggguuugcucuggagcccugcccaguggggcuuuccuuagccgccugcacuuccuguugcucugugggagaggagcgggucuugguguccucgaccuucgggguugaccccaccuugccggcacaggagccugccuuguccucccgcaacccacagggugugguuccucagccgccagcaggugugccugucuuugucccagcgugcggcuguuugugcccugggcaggggcuucagccacccaggcagaggugacccggagucuguccuuguguggccuuguccagagaaguggcaugggguucccgggugccuauuuuugugcuggcugccauagggauguugccggaaaauccauuuuugacauuuuucucaccuguacuuucucugaccugcugcgggggugccucccugcccacaccacucagcucggugugugcaggggcgugugugggagugugcgcccaagugugugggagcgugcacccgugugugugggagugugcacccgugugugggcaugaggggccgggggaguggggcaggcacagccagcugcagcagugaguguguccucccgggugggguugccuggugggggugugaggcgagcguggccugcuggacgugcccuccaagggccgggggcugcggcacccgugugcaucuccgugccucugccugucccugggcacccggcuccaucuuucucuucauaggcuccuucccuaucucccgaucaccugugcauucaacagggagggcuccacaaguagacacaagagugccggccggugacccugccuaggauguccuaucuuaaggugaaacugugagguuuuggaaaugugugggcaaguuggcaguacucgugaguucaaaucaggaauggugccugacaucaguggugugaggggacuggcgugugugugugugugccugugccagugugugcuugugugucugaggccaaaugccgaaggcagcuccacaggagacacagaggcaggccuggagcccagccaggcccuaaggaagacgggcggagucccuucccuggggcucaggaagguuucaaaggaagcgaugaggaagccaccuuggcugggagcuggaugcauggaggggccgaggcgcaguggagcaugguggccacguggggcugagguucuaggacagcagcagcaccugccuguuuggacguuuggucugggaugucugcgggcguuccuugugccaucuuggcuuuuuccuucucaaugggccucugcagagggcacaguaggcugguaaaagcucgcuuugucuggggcugcugaccuguuugggggggcagacaauuaaacucagaagaaaagaagccacacuccacagcuuccagcuggcugaagccugugggcagugcaggcugugcugagagauggacaggggcuccggaggccuucccaccccucagccugaggccgugugacagaagugggaucagcacccagggagaacucggguuagaacacgguguuagaaaugcaguuuucaggcccccccucaacacccagaaggccacaucagaaauguagggguggggguggcgccaagcaccccagcauguggugcccucccugcauguuggggugacaggaggugcccguggcgugcacccugggcagcaaggugugcugagacccaggcucuguaccggguggcuacugggggcucugccuggccgggucuugggggaaggggucacugggagccuugacuuucaggcucuggguggaccaaccagcacugacauucacccgaaccaaggagcaugaggggcccggugcagauggcugagugggguccaaggaccaugcccuccucagaggcgucaccugcgggccuuucuccugcaccccacacgcugccuggucaccguauuuuccaggccugggcuuggggacuuguauuucugggccccucgugccugccccaccccuuggcguugaccuguggugggaagugccagaugagggccaccuccugcugcugcccacucaccucagggucuacaggcucgacuuccauagcaagcgugcucugggcgagugggggucucugagccuggagcaccccauuccugugggccguggggccuggccaggauuccaucccugugauaaugaaguugacacucguggcaaaggugcagggcacucgguugugcuguccucgucccucagggcggaugaggagugggcggcucccagcccacuccccagcucccccugccugugaagcagugugcaccugcugugggcagggugagacccccuguguguugacugugugguugucuaaguuuuccacgggagcccagcagcucugaugccucccugugccccuucccuugcccaccaaauuugugucuagcagggauugccucacuucccaguagggaucaguuacgugcugggugccaaggaggccgacuggcacgucauggguaccacuggcgagaauggggaggguggcauuugacaggcucuuaaaggaccaggagaaguuugcuaggccugguguaagaugggcaaguuggcagagcagcagcuggugcccacaaacagggugcagaccccuguggcaggcaggacaggucaucuagagcagggaggagggaggugaggcuggugagugugugggaggcaggaaggaggugguuccaucuggcccggcccuccuaagugcauggugccugccaggcaggacccaggcucagagcccaccuguuggaauagugugagggacuuuguuuugggggcugugcacacagcaucugcccuucugcuucuuccaaguggucacggaagcccugugggugggcugagguccaggguccacuccccagucccuucagcgccaucucuguccugccugcggccggggccugcucccacaguccucccuccacaucgaaggacuuggucuuucugugccccggggcuccuagccagcagcacagggggagcugggagcagggcgcagggccucggcacuucccugggugaggggcagcugggccacugaggcagugacugggcagaccucugggccuggacggcacagagccuguuucagagccugugagccugcggggggcgccgcagagguguuuucuccacugggcaaagccaagaaugacuaaggacgagaagagugccauggaggugucgugugcucugaggccuccucgguagcugccgcuggcuuggaccgagcaaugggcugccucagagugacugcuuccugcccaggccugggccuucgcugagagccugcccuucugggaaggagggcacuugaggucagggagacgugggugcugccaggcguucggggcuuucccauggaagucccucuguuggugcccgcacagccguuccuggagcagaggccauguccugcgcguccccuugguccuacuaccuuugggccagugcccguccaccugccccaugggaaugagugacccgguccaaagaagguaggcuugcaggaggcuugucucacagugcacuaagcuccggggcccggccagcccugggugcuggggacagggugagacugggggagcagcucggggaggcccagccuggagggccucgugcguacuuuucuucuguguucuaggagagcagguguggacgggaagaggcagggaggcugaggugccagugccggaguggcggcugcucacuaccuccugaccacagccagagccugggagagggaagccaggucuccagguucugccccugcccagcccucucugaggaccggagguggaagguagccccagccuggaaggcuggcaagggggcaggaacugccaguagggcagccucccugagugggcccuggggcacacccugagagugagcgcgcugacagcugcuccugcuggcagcccugcgugaccgaccaccagguaacugccaccuggagcuugccaguugacacagcuccuaagacacagagcagggagacggcuuguagcccgcuuggcagccugggccacugcaacccaccccuccaaaugggaaggccgagcccaggcuguagcugcccgggugggguguggugugcugugcugugagagcacagggcagggaggugcaggcccaccugccgguggucagggccaggcccagcgucauggggagagccuucccugugguggacacgcugggcauggccuggcacaggcugguguggagucugggugccucgcugugcuggggcgaggggcugcaggcuacacggaagcucacccugucugucccaccccuguacugugaggaccccaagugcccacgcugcauguggcccauccacaccugugcuuccucuuccucagaccccacgcccugugcucuggagagauggcagagugggagugccagggcccaggggcccugccccugccccucccugccccugccccugccccucccugccccugccccugccccugccccugcuccugccccugcucccugccuggcucuggcuacucccagcacugcccccagaggccugcgcuggucuccuuuuaaggcgaagaucugcugugagaagcugaaagggaaacauuucccuggcauucagggagcauuuuuccuuucucuuucucuuaaauaaaccauuagcaacuuuucaaaacaagaaagaaaaaaaauaaggacagggucagguugccacaaagaccuuuggcccccauccucaucacccuguggccuccccaggccugguggacaacagggauacuggagcugcaggccaggcugccgccugaugccaggggccccgugcucucaggcuggccaggaaggcaggugcccugcacaaggccugugguauguuuucaccggggccaccagcggcaggggcagggacaggcuggccaacucaaaagaagccaggagugagaggguuugcuucuccuuuccuuccaagagcacuggaaaacuggaaggugggcgcugggggcccuaaacccugggccccucccugguuggaggacuuggugaggggugaggaugcccuccgugcaggggcccguguggcaagugggagcgccagcccuucuucccaggaggugccacgcaaggcagcuccacuggccccucugcggagcagccucaccguuggugucccguugguguccuuugagccuggcagggaggcagugucgccccgaugggcucgggcagcucccucuacaccugcgcuggccacaacugaccccccgggcagacccugggucugaugggcguguagugaccacaccgcgucuccucucuuggcaggaaguccaaagccaagccuaauggcaagaagcccgcugcggaggagaggaaggccuaccuggagccugagcacaccaaggccaggaucaccgacuuccaguucaaggagcugguggugcugccccgcgagauugaccuuaacgaguggcuggccagcaacagugcgcgggggccugggggcgggcccccucccuccucccugcuccuccucgaagccccuccucaagggggacccccacggcuggugcucagcagcccccugccgcgaggggagaauguggcccguggacgggcagagcucacccagccgagcuccugcaccuguugcuggaagcagggguggacggggcggcucagcucuggcguuuuucacaucuggcuccuucucuucucuuccagccacgacguuuuuccaccacaucaaccugcaguauagcaccaucuccgaguucugcacaggagagacgugucagacgauggccgugugcaacacgugagugcugccuggcuacagcccacuuucucuugggagacucgguggggcucugagcccccgcugccccaggcuccuguccucucagauuccguucucaccuggagacccugagaagucuuggcacaggccuuccacaacauccaccuuccuguggaaaggccacaggcugggccaguggcccagcuacccagguccccaguggggcccagaaggugcaggagcugguggggguugaugggcuauguuucuagggacagagacguuuccagaaggaaugcccuaagauugcagagagcccuucuccgcuggcucccgugacagcucuggaugggacagugagggcugggcugggcaggccacagguccuugcucggccauucauuucaugggggcucaguuaccuucuccgugaccauccaacaugccuggugcugguagcucucuccuggaagcacugcacccugauuuccucaguaaauggguguccguuaguggcccugagcaccucacuugcguagcaugggaaggagcgccgccaggccuggguugcugaaagcagccuuggaggcugcaggcaggaggaggcugggucugcugggcuuagccugggacaugugcggcugaggagggcggaagcuuuucccugaugucccguuguugucagugcacacaggucagggacagaaugugugccugugagugcguccugaaagucauccugcccacagacauggcuuuccuggcccuggcacagggagacgugguccccagacaaagcugaguucugccuucaagaagccaaggggagcuucugcacaggcagcuggcaggcguccccuuggcuucaguccugcugggcccugcccucauggccaugaugggucacagcuugguuugguuaugggugacaccggggcagguacagacaacagcuggcuucacugucuuaauuccccaggaaaaugaggugucacagccaggcauggcccaggaagauggggacagugcuuauggcuuugaggggagcaagcucaaugugagacggcgguggccuccauggaucaggcauggagauggguccugagguggcagggcagcacccgagagcuacucgagagccuuguguccacuguggcucuggagccaccuguggccaagugcuggcucagcgccucugcuccugggcagacggggccuggcacccuucccagaggcucugcuccugcauguucugugguacuggguugguuuggaaaagggguccuuggaggaguguaggaugugguguugggcagaccuauguccccuuggagggccuaggccacccagauuugccucuugguccuucucaucuggagcuggcaucauggugguaguagaugugugugaauuaauugcauguaaugccuuuccaggaauccuuucaaaccaagggacagaaauccacucaaacuaagagaaacauggagacuucucagagggccucagggccacuugccacccaaaagaccagcaagucugccugggucgugugagggcucugggauugaggcgcgucuccucccugcuagggccuguaggacagucccaaaaaggcugaugucugacuccuagggagacgagaaagggggcggggccggaaacacauugcagcaauaauggcugagaacuucccacaaagacacaaaccugcagacuuaagaagcuaagcaaaccccaaauaaggcucacagacacgugcagaugcaugcaaccaaaugcugagaacugggggcaaagaaaaagcccuuggcagccauccucugucagcagucagacggcgguggccugguacugacaacagaugccgcagugaaugaccguggcacuuuuagaaacccaggaggccagaaggaagaaggaagccccacacaucuuccagugcugggagaaaagaaaggucaucccagaauuccacauccagucaguguccaaagucacucaaaaccaagagcccucacagccagcagaccuguuccagaggcucccugcagaguucucccaacaggagggccuccucccacugaguguuuguggagacgccagugauggugcaagaagacaagaguaguguccggcagugccugugcagugccguucccagggcggccguggggccugugcagugccauuuccagggcggccguggggccugugguggcgguggggcuguggcggcuguggggccuggcggcgguggggcugugggcaagagagcugcuaugcuccaguggaagcacaugugugggugccauggagagcaugugggguugaguugcguguuacagcccuuugagcaggccuugcagagcuuaugugaagagacgcagucagaaucagaauagguaaauuuaaaugaaauacaaaaacauuucaguggcccaagagaaagcaggaaagaagaaauaccauaaggaaugagaaacagaggcaacaaacagcaaauaguggaaaaccuaaaugcuaacagaugaacagacgggacugggcagcuuaugagaauguauuuuuaaaauaaccaacucucugguguuuacaagaagcucauuuguuguauuucauucgggaugcugucacgaaacaugauaggcuagguggcuugugaacaacagaaucuuauuucuugcgguucuggaagcugaaaguccaaggugaagauccacuguggaccaggaagggggcacugaccacgucacuggaucugauuagccagauucagugucuggugagggucccuuuccugguccacagacagcaccuucuugcuggaaggaaggcagggcgacggagccaccaguucuguucaugagcguucuacccuugcaaccucaucgccucccaaaggccccaucuccagauacccuugcgucugggguuaagcuuucaacauaggaauguggggcauaagcacccugugugucacaccacucuaggugcuguggugcaggcgggugagaaguaagaggacaagaugugcugagaaaacacccaucagaaggaagcggaaguggcuaugucagugccaaaggagacuccgaggaaggaagugaccaggaauaagaagguuaucuaauuagaaaaggagcagcucuugaagaaauccugccauaaaugugugugcgccagacaacagggcuuuccacacaaagcaaacggacggccuguguagaaaucacaugaucgccggggauugcagcccucuccucagugauggagccucauagacagucagcgagagcacggagcccgaugaccccacccguggguuggauugaaaugacacaugcacugcagccucaacagcagaacacccaucuuuucaacuucacaaagauuagccaccaagauggagcauaccugucacaaaagagcccuuaacaaauuuuaaaaaaucaaaaccauacgaaguaaguuuucugaccauggugggguuaaauuagaaaucaguaacagagaacaggaaagucuccaaacacuugcagacuaauacaauucugaguaguccauggguccgagaggaugccucaacaaaaaaacuuuaacaaacuguacacaggaaaauacagcaugucagaauuugugagacauaacucaagcagugccuagaggggauuuauaggauuaaugcuuucuuagaaaaagaagaugacuuucaguaaucuacguuuccaacuuaaacuagaaaaagagcaaaauaagucaaaaucaaggacaagaaaguaaauaagaacagaaagcacugagauugauuuuuaaaacaauaggggaaaugagugaaaucaaaaugugaugacuuugaaagguaauaaauugguaagccuuuaguagguacaaagauaagagagaagaugcaaugaucaauaaaaaggagugagugucacuaaacccuguggauguaaagaggaguaucacuguagacccaguggauguuaaaaggauaauaaggaaguauuggaaaaaaacccucugugcacaugaauucuauggcuuggguuaaauggaccaacucuuuggaaagcgcaguauaucagaacucgccuaagauaggcagugccauaagguaagaagaaagaauaaaaggcauccaaauuggaaaagaaauaaaacaauaagccccccuuaucuacaguuuccguuacccacagucaacuauggucugaaaauaguuaauggaaaauucccgaaauaaacaguuaauaaguuuucaacugcaugcuguucugagcagugugaugcggucuccaccguccugcuccaggugugccuccuccucccucggcccagcugugccucggcccccguguggauccacugccgcagugccagggugcucgugcucagguugcucuuaugugacaugaggcggcccaaagcgcaagagcgugaugcuggcaauucagauaugccaaagagaagacagaaagcacuuccuugaccuaaagaugaaaaggugaaaguuccugacuagaaagaaacagauugugugugagguugcuaagaucuaagguaagaacaaaucucuucuuuaugaaauugugaaaaagggaaaaaaagucccuuuaauuucgcuguuacaucugaaauugcaaaagugacagccacagugcguguugaguacuuggaucuguggguggaggaggugagaggaugggagcagcagcguguugccauugagccugcaggaggccagcaagggacccccugauaugcgaccccagccacucacugcaacugauuguccucaguuuaugaauuacacugggugugguggcucacaccuguaauccuggcuacucaggaggcugaggcgguggaucacuucaggaguucgagacuaacuuagcaacacagcgagacccuaucucagucaaucaaucaagucugccugucuuuauuuuaguaauguauguauaggagaaagcgcagcauauauaggguuuggugcucucuguggcuucaggcauccccugggggucuugcagugcauccccuguggaugggggggauugcuguaucccugugcacacgugugauugggaaaaccucaaggauuguagcaaauaauaauauaaauuuagugaggucaacacgcacaaaucagucauaggucuguauauuagcaaugugaaauuuaaaacugaaauuaauauuuaacaugccauuuauaauagcuccaaaaauaaugcgauccuuaguuauaaacuuaacaagacauucccaggaucugcacccuggaaacuacgaaaugcuguuacagaaaaucgaaggucuacauaaauggagagacgcacugcguuuaucaccuggaagaugacuccaaacacaaauucucccccaaacugaucuguugauuuagugcagucucaauccaaaucccagcagaguucaaguauagaccaguuaguucuaaaauuuauauggagggacaaauuaacugaaauagcuacaaugauuuugaaaaaauaagaggaaucucacacuuuugagacuuacugugaaacucuaguaauuaagacagugugcaguguugaaggaauggauacagagcuccauggaacacaguagaguccagagauagccccacacaaacguguggacggagaguccggagacagccccacacaaacguguggauggagaguccggagauagacccacacaaacguguggauggagaguccggagacagccccacacaaacguguggauggagaguccggagauagacccacacaaacggggccaucagaguuuugacaaagagcaaaauaaauucaagggagaaaggguagucuguucaaaaaugcugcugggaaaagcagucauuugugucaaaaaccaaacgcugaccuaucccucaugccucgugcaaacaucuaaaacuccaaagcuuuuggaagaaaccauaggaaauccuuaugaccugacacuaggcagcaaaauucagaacuuuugcuucaagacacuuuuaagagaaagaagacaaacuccaggcugggagagaaaacauuugcaaaucacacaucccacaaaggacugauauccagaauacauaaagaacauacacaacucagcaguaagaaaacaaaacaguccaguuaacugucagcaaaagaaaugagcagacaguuugccaaagaggguguaaggauggcagcuggggcuauccuguguuguuagcaauuagagaaaggcaagccgaaaccaugggcagacccauguccaccugcccacaugccggucgggacacuggugcuggccaggauguggccaccugggacucuguucugcuggcagggacacaggugaauagaugagcacgccauguccaucucugcaggggcagugucugggcagugaggagccguggacuuccgacacgucugccacgugacugcaucccaggggccuccgugcaagaggggcccagaucgggaggauccgcgcggugcgauuccuucccgcggcccaucccugaggagccauccccggggugcugggggcacagcagcacgggugugaggggccacguaagccgccgcguguccugauugugguuaugaaugcgugaguccacauguggauaaaaaucuuagaacuauauaccagaaacgguuuacugauaauugaagaaguacaggaaacagugguguuccaucuuucagaacagaugggacaauccacagugucccugaguuacugcuuucucuggguuugcauuguggaaaaggguuuccgucucuaaccuccacuguuuugagaccugucgcacaccuguggccaggugcaucagaugucagcuugcagugucaggguaccuggagccagugucugacuccugcagagugcugagccauccuggcuggguccucgcccuggaaacaugggccucagccuggcccuuaggggcugggccuccccuacaccaucugggaaccccaggacaguggggauacgugcguccucuacaucauucucgaggagcagaugcugaaaggacuguugucucugcauucucagagggucugacagccugguggcgaugcccacggugaggccugcagccugggaaggugggcgugaaggucaugcagagcugucccagggggaggacagcaccugagaggcaggugugggcacugcauccccguccucauggccuguccauuuuggggcugcacuuccccuucgggugggcugagucagccccgcacagggcacacaugagagcuccugguuugcauucuggaggugggugcugggaggggguuguccuagggcccugguggugcugggagguggccugauggcuguuucuguugcagagggcagggugccagcaugcagggcuugcagugucauccucuagcuucuugguaacucuggugacuccccccgggaucugcagugcacaggcugaggggcuucuuggacacagcagaggggugcccagagacgcuggaggcccugugcccagagaugcuggaggcccugugcccggagacgcuggaggcccugugcccggagacacuggaggcccugugcccagcugggaggauggcuucucuggcugcgcaggaagugggcgagccccccguggcccugucucagcccuuggggcgucuccccaggugccuuggugggcucuggaacccagggcacgaugcuuggagcuggccaagagaagaguggccuccagaguggagccuggguccauccuuuucagcacugccccacccagggccauuccaagaggaaccgugacuggaugaggagggugggagcgguucauguggagccugguacuggcagacugccuguuggucuagcuggggcaguggaggcgauggugguuguggccaugguguggagggggcguuugcucaguggccaguacugcucugugcuguguggcccauucccaccuguggugagcugggagcuggcucucagggaggaaaucccgacccauaguguuggcugugucucaggugugagcacucccaccacagcacucuccacugccuguggguggggcugcggcaucggccccagcaugcccugguucaggccugcgggggcggccgcugugggcauggccuuggaggacugagacccagcaccguggcagggggagaggggugguggcugccaggugggugcccuggguuuugguguugugcugggggaggagggguguuaggggcugggggucaccuuauauuaacaugaacuagagcacacccuugucauggcuggacccaacaguaagaggcaaacccaggguguccaugucccuaggaugcuccagccugcucuggggccacgagucucacaugaggacuggccgcccuuguguacaggggcaagagggggccaggucccuguccuggccaggcuguuagccgcagguacccacagagaccaccgcccuccucugcuuuccccggagaggggcuuggcuucuagcagucagagcagggcucucccaaaggguggggccuggccggcgagccacagcacagcuuccugggaagagaaggagccucugugugcuuucaaaauacaacagaaaaacagcagcacgcacuuguguaaacgaauacaacugaagccauguagaagcggagaaaacgaagaugaccccuucauuuaaucacacaccuguacagccauguggcuggcaggcuccccagcgugauccuggcguaguucuaagucagcgcaggcagaccccuccauagagugcagugugguccccgcagacaguguguggggacagugugcauguccagggagggagacaccugggucugccacaccuccgcugcuggcgccaccucugcccgcagaugaccugagcgggugggacccaguggcugggugggugugcagcgggcgcaugcccugaccgugucucugucuccacagacaguacuacugguaugacgagcgggggaagaaggucaagugcacggccccacaguacguugacuucgucaugagcuccgugcagaagcuggugacggaugaggacguguuccccacaaaauacgguucgucucccccagcacugggcggucauccucacaguggggcagggagcauucaggacgugucugcaagugaccaagcuccugugccgggaggggcagaggcacggagggcggcagcugcaccaccccagucccugcuuagcauggagccaccugggcuguggggugaggccggagcccuugggcaggggucagcccagccagggccaagggccaucucccuggcccucugggccaugcggcugcacugggccccucuugguuucugccgcucaugcugcucucaccguccagcuugugggcacuugggcuggguaucagccgccaagccuguguccagauuuuggugggaugugguggggcuccacgccacucccgugcugccagagggacggcaggggacaacaggagaggccugugccaccaucgccaccuccguccuggcccgggagauggccccaaguguccaucagggagacaccacgggggcccgagugcccgaucacaggccccuuccugaggagguggccaggauggcccaacgagcucccagcccucagggcaggugcagccuccggagccugagcacgcagggaggucucagcagcccagacccgggguuggcaagucccuguggugccugcugaugggcagaagcuguugcugcuggggcuuuguaggcccugaggguggcagggucaagguguggguggcagguaccagacccaccaggcugggugccaggggccuggccucuguuggggccaagggaugucugcagcuugugacacgguggccuuccccaggcagagaauuccccagcuccuuugagucccuggugaggaagaucugcagacaccuguuccacgugcuggcacacaucuacugggcccacuucaaggagacgcuggcccuggagcugcacggacacuugaacacgcucuacguccacuucauccucuuugcucgggaguucaaccugcuggaccccaaagagaccgccaucauggacgaccucaccgaggugcuaugcagcggggccggcgggguccacagugggggcaguggggauggggccggcagcgggggcccgggagcacagaaccacgugaaggagagaugagccccccgggccggacaggggcacacgugugcaaagagacggugguguguguucucuccugcaucugcgugugcacacaugugcugggcacgcguguggugaggucugagagggccccgggcugcacuggugugggcugcacaggcacagacgcagacggccccggccguguccuguggcccccugucggauggaugcgugccguuuguagagaagagccuuugggcccauucacucguucagcagacacgcaugggacugaugcuuugaguuuucuucugugggguuuuccuuucucuggucuccgugcagccccugcccucccucgggugcugcuggccucaaaggaggaacucguggggggagggugugauuugcagaccugggucucugcucugcucuggggguggggcuugcuuucacagagacccuccuucccucucaccccuccucucccggccucgccaggagucuuggcuguuggcagcucagaggugggggaggccuguggugugaggugcccugcaccugcuccugcuccugucaccccuuccugcugccuccuccaugcccaaggaacacccauggugcaguccucaggcaaggccaggacggggcugaggcccugcguggagaugcugcaccagcggaaggcugagacccgcuuaccuuaguucaucuguucacucguaauaaaaagaauucucucaggucaga

SEQ ID NO: 191821 - RNA, 47948 nt, Homo sapiens
ugcugacucaauguuucaccacuuuaauagaauauucuaacuauucuguacaaauugaaaacacuguauucaguuacaaauguguucuaagguuaggccgagcacucuccacaggccuggucagugcggacacggccauccccggcugccggagagcgccgucacccacuugaaaaccccacccaccagccgccaagcggucacaccaaacccaggaccuucagacaggaugaaugguggggccccgcaauggggcuacugagaaagcaggacuugacgcucauacgcuccacugaaacgcaggacuucccagcccagucccucaguggagaagacugccgaagcccggcuccggcagcaggguggcgccugcgucaugaggacgggcucgcaucuucagcccugguggcagggagcggcguuucuuccgcacaggccuugcgccugcuaggaaguggcacaucuuccugcucagggcaccaaggugguucagaaacguuaaggacgagccacagcgaaaagccgcaguccucacaggcaagaagggauaaauaaauaugaggugacccgcagcagcucucaccugggcuggugugucacaacccugacccaccccuaaaaaaaaaaaaaaaucaagaagcaacauccuaaggagaacagggcccuacucuacacagcccuuucugagaugaucggcauacagcaggugaugcaggcugcacacucagcagauucagcggcuggaaacagcaaguggguuucuucggaugaaagggaagaauucaguccaacugcaggaggggugggagagguuccagauccugggaaccacaucaccagaccucggcccuuuuugccaagugacccccaccccacccugauguggucuacagggcccucccacagggaaaggcccagggaaguccagagcuacaggcaccaaggcugcagagggugcuggacgaaaccuccuauuucugaaaugcauuucaguugccacuguacaaguuaagcaaaauaauaaggaaaaaggaaaagugaaagugaaaaucaugcacuugaaaacgaguuagauggaguaagcucuguccacgggauugugcugcggcaaggaccgaggccccgcccacaggccuggagucccgacagccggucugccaggcacccgccuccgcuuccuacugcugcuugcauuccgccggcuggcuggguuccuucugucaaugaaaaagacaaggcuuguagagagcaaagccagcuccauucaccaauuagcuccaaucaacaaugaaagccaagacugaaugaguucauucucauugaaaaaaaugguuacugcaaauauacuuuuaaaaauagugacaaaaacaaagcuaacucccccuaccacccugcagucaaagcaggguuuuuuuuuguuuuuaaagcuaugccuucaagcauucaaauucauggcauguucagcaggaggguuuuggggcuccuuggggugguggagcuccaggggccugcccaugaaagggcugggaagcagcuggaaccccugcccacacagagcacagugcgcucaacacgggcagcuccauccaggaaggccaccgcggaggcaaccccucuuggugccaacaguccccacuucucaagggcacaucugucuggggguaggcugggcccuuggcgcucauggaaagcacaucucuccucuagcggguuccugcucuuuguacuaccagggagcgccccggcagauccauccucuucugguggccuguacugcaccaacaaaugaugagcugccacucccaagagcuccaucugucacucacucuccuucacucuccuaacagucucaccaaggggcaaugcuauccuuccaguaacggcauccgggacacaaaauuccccucccagaggaauggauuaacuccaauauuaucuaacacagagaucuuguacccuuuaaaccacauccagcaacuccaugaauuuguguggaggccaacaauagccuaagaaauacaucacgaucuugcuaaugcuucugcgcuaguaacuuuacgaaccuguaaccuaugauuucuggcuaagauuacaaauugcccuuaauccagcgugccuauggaaccuaagaacuuguacuguauggggcaaaaagaucccuggguuaccauaaaugauaucuuccacaguauaagcugaggcuacaguucauucuuuuggaaaucacauuuaagggauggccgaaaaaauauguguaaaauaugcaaaaaacaaaaucaauaaccuugaacccuggugucuaagcucccaaucucagccaccccagaggcugcccaaagagccuggccaagacaaaacgaggcugaccaaaaacccucgccaugucaaucugacauucaaggguagacugaagguggcccaguguaguggccaagaacacugagccacuggccuuaggagugugggggaugcagggcgccccgagcaggagcagugaggggaggagugggacaagcagugugccuccaccaagggacucgccuagaaaaugggaugucaguaaaggagcugugcagggacggggaagacuggggcuggugacaaggugacagacuccaucuuuauguacauuuaaauuacgcaaauacuaugucaugucauacacaggacuuuauaauuuauccuaccacagauugagcaucccaaaucccaaaucugagauacuccaaaaucuggaacccaagacaaagaaaaugcucacgggaggauuccagauuuggaaugcucaaccagaaauaaaucuaaauuauccuaaguugcagaaaugauguaauagguauuuucaaccacgagaauguaguauucaucuguccuaaauaaaaccaauauccugggugaagacugcuagagggaauagaguccgcauagaacacucucucaagaccggugucaugacccagugccuugcuggaggggaguaggccaugcaccugacucugggaagagcugccucccccgugccuugagggcacagcccccucugggaaggaaggcagcauguggcccaccccugccaggcuuuggugcucacacagcacacuggagcuucugcaagugacugacaggaguuuuagaagugaauuuuacauaugagagacaccaauuguuuuuagcuugugacacaugccgaaaaaaaaaaaacuacaccuaaacucccaaacugaagcguccuuuaucucaugucacaaauuuuaaugaugguugagucauuaaucaaugcuaagauuaucaagggaggaggaguuggcauuuuaaaagguaccaacuaauaggaaaaaaaucucaucucucaugggaccauuuaaaaggugggguuugaacagauaacacucgaccugagaaaggcaacaaagacaugccgcugaaacacacucgaccauagcugcgcuggcgaagaagccccaagugcccagagcccuauggcugaagaggcagcagccucagugggacacuccucggggguugcugcuguugcacccugcccuucucuuccagggaggcauacugaaauacggauagguggcacgcaucgaggauucucuucaaaagagcugguggcaugggagggguggcgugggagagugggugaggguacagguggaauaagaguggcuaaguucuucagacaugcggggacaacaggaauuaauggcagcuagacauaauuuuaaacauacagccauauucugaaaccuggcccuggaaaacaaaaucguuccaagagcugcauccgcccuauguaccaucaguuucccaugaaagcagccuacaugaggaagacagggaggcgguggcgcuaagaccucaaggacgucuggucuaugggcugccaggaucaugcugauguucugugacgagacccuuaaaaacggagugccuacuuauccuggcaugcagaggcccugcuaugguugugggguuccucauggcaccucuuguccccaccucucugcuuucucccacuacaucccgagugccacgagugaacaggucucgucacgggcaagagccucugucuacuuacggccuccugucagcauuccaggacagggcagagcuacagggacugaagaaaguggagugggaaacagcuuccaggcuuacugacacucacuuucaucuacaacugguucuugcuucauucaacuagcaccaaccucacaacaguacuuuuuacugcugacaccaaaacagaugccaguucauguuucagauaaaaaaugcuggcacaguaaaagcuguuaccccucuguguaccuauuggucugcacaaaacaugaauucaaaaaguauagauauucaacagacacguguugguaaugacagugggccaauuucaacugccaguguguguucugagcacagcugggacagcccaguguguuaugcucucugcaaggacugcuugcuuaugguggcccgugugugccaccgugcagacugcugaccauccagggcccucuuacuggaaagcaguaccaucagcaaugaaaauuacacccaaguuacaucuuugcuacuugguuagcaagaaacacugggcucagaaagcagggaccaaaucuagguuugguucguugauuuuaaaaguacauguaacagacaccuaugucaaaccugugacacagugaguguaccuggacagcaacucccucuuuauucaaagucaaaacaaugcauuguauaaaguauagaucagaaguuuggaaguuagguaugaauggaauuccaccuuaccuagaaacguaugaaugauuaacagacaaaaauuacaccuaaauggggaaaaaaauugaaaggaacugucagcaugaaagaaaaugaaaugcacaaaauuauacaggaggaaacggccacaauuucucaugauacaaaagggcugcaagauacugaacucggggugaacaacuucaacacuagaucauacuuucaaaaugggcagaagcaugauuuucacuucuaucagacugcucccaauacuaaaaccucccuuccuuccuuguuuucuuuugcuugcacagacucuaacacugcccaucucucuggaaggugcaugugacagggacagcaggcuuggccuuauccuggccacacaugccgggccgucucugaacuucauucacaccauuagccggaacauguuuuuagucccuucucccccaaccaacauaaccguuuaucaaagguuucaugggguguuagcauguguaauccaccacaucauguucucuguaauggcuggugagaaugcucuuuuagaaaccugggacgugaaaggagacucaagguucuccaaggugacagagaaagcagaacaaacaacagaggggaggaaaagagaagcugaggcacagaauacagggagggggagauacaagugcaacaaggacagaggcagcugugcgcggagucugaggagguggcccugccaauugaccccaguccuugcuuuacaacugcaaccuuaaaaguguccauucagcgcccacaaggcggaaacacagcccaauaaacacacguggcccuuggguccaucagacaccccgcacagcagugaugggcagcauuuauucacccaacguuguucacuggcugacugacagcccucaccuucccuguccgcacacugugaugcacgcaaggcagacccaggccuuggucuccuacagcccucaccgcccaccaccacggugcugcgcacagguacgcuuucagcagaguccucccacaucaacaggccaaacuuuagaagaugaacauuuccaugagcagauuauucccagaguagucuuuauaagacacauucucaaaaaaguuuuaaaagcucuucucccaucccuuccuugaaggaaccacaacugugaacaugcauucauggaaacagccaguuuaaaccaacugaugacagagccagaauaucacacugacagcuuuuagugcacacuccaaaaaacaaggguaaaaacaagcaaaaaacgucuagucggacagagacacauuacaaaaacaccagguaacguuaguauucugacagcccauaauauacuuaauuuuaagaggcaagugaacuacacauuucauguuuuacaagaagaaacucuuaugaugcuguaggaugacauuuaagcacuucugauuuuaaaaugugccaaauggucaaaguaccuugauuuaaguuacucugagaccacaaauaaaaaucuaaauuugcagguaaaauuaaugggguugcccacucauuuucaacucaguuuucuuuaguaaaccuuuccaauuuauuuuaaauuaucugagacauaugagauaucuagacacaucaucugggcaugcucagcucaagugcaacugggucaaaugaugcccacaaucccauuauucuguuccuuaacaaaaagagccccaaagucccuucuuugcaccuuuuccaaacacgcacaaagaaaaguuuauuuauguugucaguuaaaucauuaccuuaccuuaaaagaaugaaacacuuggaaagucaaguugcucuacugaggagucuauguaaauaagacacagcuugagacagcuggaaaagcuucuacugaguauguacacucaacacucaaauuauagacacagugucugaauaaucauuccacuauuuuucugacacauuuuaaacuuucuaauuagggaauaaugaauauuguuaacacuacugccucaaaguggggaacauuuuuaaaagucuaagagugcagcauaauaaguaggucuggguggccccaaaguuaccaaccuugggguuaauuuccgcaucauccucgucuucucccuccucgucaccuucuaauuccuguauuuaaaaagugagaauuagcuggaaugacaagauuuaaacucuuguggcauucacaauccacaaacacaaggagcaaaacacugccuuagauggaaaucaauuacugcuacccacaagugacucaucacuuccuuuggacacuuagaauuauuucuagguaucuuuuuguucucacagagagcccugaaagaaacaaaauucugaaaaaguagauuuuguuaaaugauuauuuucuaagauacauuuucaugaaccaacugcagggucaaaaacgauggaaacugucacagcauuugcuaugcauuucugcuuaguguuuuaagaacauucuuagaaucaaagacagcgucacaaaaaauggguuuaacacagcccugugaguccauaaccuucaagcagagaaagccaaagaaacaacuucagggagguaaguggcacugcauaaaccugucucuuaccuccucuucuccuucuucaccuucuucaaacuggagaaacacagaaaaacauuuuuagguuuacaaaacaugacagcagccugcccaagacaccagucccaucaagugacucacugaccaagccuaagaggagcagaaaguccagccacgcugccugcugggccucgcuugccugaggagccauuugcuugugugcagcgcauuuuaaaagcaugccaggaaauugaaagucacgcaaaacaaggaauaggauaggaagcuggucagccaggguguacccuggacacagcugggaaccuggcaccacagcucugcccuggcuguucucacaccgaggagcaggcacacaggaaaagauuuuuguaaaccgaugaauuuguuuuccuuaaauuuucuacaaggcugaucgaaccagcagcauaauguuauuggauacaggaaucuggguaucauuuuacaucucauacaaagggaaaagaaaccuuaguagaaauauauuaaaacuuugguguuuaaucuuuaaagugaucaauaaggugcucaaaggugaaccuccaccauuagucaauugucuugaaucaguuucuccuacauccaaauacaucauuggucagacuaaaaaucaaguuucaaacaugagacuuacaccaaaagcaaaaccaccuuaucacuacugguugcauaacaaggguagugcaugaaaaugcagcuucauuuaucaacauuucccauuuuguugagcucacaccauguauuugcuuagagccaacuucgguggaacuuagaagggcccuacugugcugguguggaguucacacagugugcacagccuccuggcgccacgcagcagccaggaugagauguggccacggugcagcgcccuuccgcucuaaggacccuaacuggcaucaggcagggaaaggcuucucaauauucuuccauuucacgucagauccaacgagccuccagcaggcuccagggccuauuccaaggcucuaaggacagcauuuugcccuuaaggggcugugcacaggggcugcuccagaugcaucacccaccugggcagagcaggagcugccacgugcagagaagacaagaccaggguucccacauucaccuccuccuccaacaacuuucuaguguugggguacggucuagaaaguaacauuaguaaaacacuuuaugccaacacuuacugagucauugcucugugccaggugcuauguuaagggcuuaacaaguaaccagagucuuuaccaugagcucuacuuacagcugaggaaacugaagcucaaggaggugguggagcuacuaaagggagaauggggaugcgagucugagcagucuaaucugagcuggcacuucuagccucuaacugacacugcucaucaguaguaccugugcugaacguauugugaaugaaacgcacauguacuauaagcaaauguggcacagugcucaccagcaguacagauaccgcauauaaguaagcaaauagcacacaugcauauucaaguccuuuaaacugacggguguaugaucaaaacaguuucagauaagcuuuccaauguguagccacuagcccuuagcucacuauuuaaauuuaaacuaagguaaaugaaauguucaguucuucagucucagcagccauauuucaaguccucaaguggucaguccuacugcacuggaccaagcaggcagaggacaguuccaucaacagagaaaguucuacuggaaagugcuggucuagaauuuguaaaacuaugucuuggcagcuaccugacuguccauguucccugaccugcaaucaccucccaaccuagggaugagccagcaaguugaguuuuagaaguuaaaugaacagucuaagaccuaacagcugauaaagagcacgcuggccuauucuccccacugguggaacucaguacaaugggagaggugugaggagauguuggccuuuacugccacagggggcuaaggcccuugaacccaccuaagcucuugccgcccugucugaagccccaacagaccagaccuucuaagaaaagaaaccuaagagcuccacaagaaagagaguaucaucuagaacauacuuccaguaacagucuauaaaacaaaacuuuauuuuccacagaucaagaagacuugaagcugcuugagccuuggugaggaugggaguuucuaagcgguacuugggcugugcacccgcaaguucugacuguggaagagcuggcuucccucaagcccagaaaggaaagugacaugcaaucuuguuguuuucuucgggagcacggguuucuuuuuuuuccuuuuuaccuaauuagauagaaguucaggaauuucuauuucuuuuggguugaugaaccacaggcuagcauaaguccacugucaauaaauguuuguuguggccagaccuccauaaaagagauauucccuguguucacaaguucccugaagcuuagguuuugagagaauauuguugagucacuaggcagggcucacauaggaaacuggcaaucaccucugaaacugcuucacagacaccugcuuuuccugcucuguuccucagacuucuccucuucaagcguauuccccccacaacaaggacagcagcuuggacuacauaucuggcugaugauguaauaaaaagauuaggcauggggguuuccuaagccacaauucagggccacucugcaccaacagagauaagcacccagguggaagccccccuuccccgagccucauacauugucaucaucuucuauggccuccccagugaaguacagcacagcccgcgggacuauccgcucacggaaaaaguguccaauuucaaaaucagaggcuaaugugaauucagaaucuucauccugaggaggaaaaaccuacguguuaacucauuuuaaugggauaaaaacauucacuucaccacccucagccaaaccucagccccucacuuuugauuuacuuaacuuaaaacaccaaacuccugcacugcugggggacagccacuagacacucaaagccccuuuaaaacaacuuuaaguagcuuuaaagagcuacugaagcaaaauggcagagaaagugggaagugagggcccuacagcuccacaacuuguccaaaggucucacccagaguaggcgguaucagucucacauaugggaaacaggcaguauuaaagcacugcacauuugcuacugaaaucaacauaugaaacacauacuuuuacuuagauguguaaugauuucaaauuaaucccagaguuuuaggaaacagaaauggauuuuuuuuuuuuaagagacagggucuuauucuaucacccagguuggagggcaguggugcaaucacagcucacuccagccucaagcuccugggccccagcgacccuggaacuacacagugcaccaccauguccagcuaauuuauuauuuuaucuuuugagacggagucuugcucugucgcccaauggaauacgguggugcaaucucagcucacugcaaccuccuccucucggguucaagugauucuccugcuugagccuccugaguagcugagauuacaggcgcugccaccguguccaacuaauuuuuuuuuuuuuugguauuuuaagcagaaacgggguuucaccauguugaccagacuggucuugaacuccugaccucuggugauccacccaccuuggccucccacagugcugguauuacgggcgugaaccaccauguucggcuggcuaauuuauuugguuuuaauuuuuuguggagaugggguugugcuauguugcccaggcuggucucaaacuccuggacucgugcaguccucccaccucagccucccaaagcauuaagaucacuggcauacccaguccacacacagccaggacuggacuuuuuuuaacaaguagacaaguagacauucacucaggagagacuucaacaggaaaauaagacuauuaacaacaaaucuuaccagugauucuccauccccggaugcuagaaaaagaaaagacaaaacauauuuaaauuacagugacaacucccagaauuuuaaagcccacacaggaggaagcugugcugguagauaaaauguaacauuucucaccucgagguuuaacagaaauccccaaagccuugcaucuccucacagacaucuuugcaagcuccauccaccacuucugaagcuggccugagugccucuaugccccccucccuucuccuccuccaucaugugccaugggcuggcacucaagcuugagaagaucauuuugagagaguuaauauauuaacaggaggaauggcaaacagcccccaggcuguggccauucagugcauuugugcuuuauggggaaacuuaacucaugucccgcagaacuauacaugauggugcaggaaagagaaaguccuuaagccuuauaagcugugaguguuacuaaggcacugcaaaucagcgagacagaaacugcauuucuguuuguuuggagagugcuggaaugcccaccaggggccccuguagaguggcgcaauuccucagcgaaagcugaugcucagacgagcuaagcccaccaagacagauagggacuucuaaccacacucaaugaagcugugcaacguucaacugguagaagauccaacccccugauuuuagaaacauuuacuacaagacccugagcuucaucaggaguugaauguuuacucugcuuagucucauaccugccuuuucaaucuucacugggcucuccucucugagucucccuucccauuaagcgaccacaacccuggcagcacuugcuguuugcugcugagacaugaauguugggugcguaaacaccacccaugagugaggcagaguucccaagccucggugugccagcaucacccagggguuuuagacauggguuaggagcauggcugggugucuaaaugcuggagcagcaugcuccccagggcacucuggcccaagucaugaauaguacaaggacucugaacacucauacuucuggacuggcuuugcaguuuuaaggacaaaggagcuggacucacuagcuaaugccuccuucacuucacaccacaggaguccauuuugucuguuccuucacuaccccauuaccuauuccgcagccauccucaauuuuuuucaaagcacuuaccauuugguauuauguguuugauuacuuuaaaaguggcuuuacugaugggauuuacauaccauuaaaaggcauacacucuaaauguacaacuuuaugacuuucaguacguuaauuuuagaguugugcaaccaucauacccuaaaaguuuuagaaucuaaaaaaaaaaacacuuaaaaauucccuugaguccauuaucaacuccauuuuuauccuaaaaauuauuuuuaaaucaguuuuaagagaacuuccuacacaaagugauuccagaaauuaaagccucccuucuucacgcugaauucacagacaaucuccaguaugcccaacccaagugucuaaaaggaaucuuccaaaaaaaggaaauguaauaucuaaauuuaugacugcucucauuccccaaaccguauguauuugcaucuucuagguucaaagucuaauugcagaaaauaggcaccacaauuaaaauaauggacugaacucugaagggcagcuugauaaauaagggugcuaagcucagagacaaaaucaaaaaaucaaucacucagacuggagaagagauccgcccuguggccccacauacaaacaaacacucacugauuaucugcagcaggggcuggcaucucuucacuucaaauuauguuuuaguucauggaaacuaaagagaauauggauauuuuaacacugacaaguugcuugaccuucacauuuucucgcgauuaggaaauuauaugaaaaaucccaagaaauuuacucuuaaaaucaauuggucaaccuuuacuagcucaaaggucucaucuuuauuuuaccacuuaggaaaauuuaaaaaauaaauaaauaaacaaaaagaagcagcuuccaagcugugauucugccgauguuuuucaaaaaugaaagucccaacuacuuguguuucuuacaauauauaaauuccaaaaaauucuaucaaauuaugcauaaaaaauuacaagaaaagggggacuaagcagaugauccaaaagcagcacaacuagaaccagcguacagcaguaacggguaccugcagagcaaacccagcagcucuccgaggcugggagugguccccggggggugcgaaccagacacaacagcggggcagaaaugccagcugguggagaagggugcuccagguguccaagugaggaagcagcccaggugcaaauacucgauucaguuuucuuaaaacagaacugcaaguuuuugccugggcuacagccaagcagaguaaagcucuucccuuuccugcagaagaugacaauccuacucuuacuguccuagcuaccucugccccccgcgauaaacuugccagcgcaccaacagaacagccugggacacagcaaugugccccuacugaccacacuugccugaaaaaagaggacuaaagucucuggguguuaggaaucuaucaggugaccaaaauuauuuuauauaagaacauaaugaauauuaacaaccaacagacuugccuuucaauggauugaagaaguugaaaaaggacucauuggguacuuguuucguaauuguucuaacagugccucgacccuuaugcuucugcuuuuucuugaugguuuugacaguaacauucuuuccuuucuuccagucaauaguacaccuaccaggacaagacagcugucaggaacacacaauccaugagaaaaauccauuacaaaugcaugcaggaagcaaaccacagcucuaugccaaaccuggaaaacgaaauaaaaccaaucugcaaaccaaauacaauggcccaugaaguucaucuggagguuggcaaaaagagaaacagccugguccucuuucaacuugggugugaccacuggaacuucagacuucuggaacaaugguauuauuuucccaagacauuucaucaggacucugaaauguauauucuguggcaaagccccgucaagucugcaugaugcacaagaacuuguccgcgguuucccaaggaaggaggaguugcugcuguucaaagcagccaacugagcacgacaagcugaaaaaaggaaagagguggccaccgggaauacugauggccagugcagaccacuccagccccagggaugcuggcgagggcugagcacagcacgcucucucuaacacacaaucaccacagacccaggcaacaccuggcagaucucaauacugcccgcuuaagaacaugcuugguaaggccaggccuuuuucucacaugauguccuggcccuggaaaaucaucuuucuaaauuacucuagcaggauuuuaauaaaguccugaauuaacaauuacuauuuacuucugguaaauaaacguaauuguuucaagucaagacuaaaaccauuucucagucaacccaaccuggagaaauuaauucuaaaccaaauucucucuuuagugauuuauaaagacugaaaucagugagucaaacaacagcuaugcugcccccaccuauuuccaaagcaaucagcugaucaauauagcccuggacucagacucauucauucaauaaguauuuauuugcugaggguaauccauggauucaauuuuaagaacuucaauucacgaugucuagagaauccacuacuuucauuaaaaugaagaaacagggcacuaucccaaaggcuugcaugugcaaccacgugacucauuucccagguucagccgccaucuccaaguucugcacuaugagcauucccaaacugaaagacuauugaaauauacaucuaccaggcuuuuaggcuuuuaagcagacucaagacuguacuuuauuccuuacuucuaucuuacccaucaaguuacaaaauuaucuuuugauuuuguuucagaaaaacaagguagaaugacauuuucuuacccgucacaguccacaaucucaggaccuucaaaggaaaagggaucagccuuaucugguucugauuucaucuuguagguuuuugucaggacugaguugguaaaguagucguuggguucaaaguggaacucuaacacaaaagacuaaaaguagaaauucagaguaagcaccaguuaaaauagaaaaauaacgaggacagauugcuuggaguacacaacacuuacuagaagcuauuuugggaaagcucaacagauagggccaugaacaagaaaaacuucuccaccgcaaaaaagacuagcgugagguuaaaaaaaccaacgauggacuggcgggaaauaucuguucaguucaugaguaaggggcauguucccccuccaaugccuccucaccaauaggcgucaagcucuccuaagaaauccuagcuucucuuagcugcucccagcccuugcuuccuggaaggagggaaggugacuaggggaaaguaaggggaccagcaguccauccuccuccuguccuuuuccgcucagccuaagccccagcccccacccugcugggggaagccagggucucuacucugugcugugcagugaaagcagugacccacagcuuuucucccgggaggugggugggagaaaaggacaaaucucuacaaggacagaaagcucaucccucacuuacaaagcacgcuacagaccuggaagagacgugagcacaccgggaaaaaggaugcaaacaugaacgcaggcauagaacaaccaacagcagcaacaaggcauucaugcucacgaguaacaaaacacaugaacaccaaaaugagaugccuuucuuuggggcaaaauguacaaaaauauguagacccggccaggauuuugggguacugagcacacucauguacugucgacagauuuuaugaaggacaauuuggcaauaucaaaaaaaauuaaauuaaaaggcauauucccugacucaguaauucuauuuugaggaauuuguucuauuugagaaaaauaccuggauggaugcaucgauaugugcaaagacauugaccucaucccuauuuauagaagaaaaacauggaagaugcgcuugguugaguaauuuauagacaguuuacaagaccaguucuacgcucagacagccuggauucaaaucccaucucugccuacacugcuaggcaacucgcggaagcuacucaaugucuccgugcuuuaguuuccucaucucuacacuggaaauaacucucucccucucuaggagcugccuuggugguuaaucuguaucacuuagagccgcguuuauaggcaaggcuggcuaaaugucagcuguuuccauuuucauuguaaugguaaaaccaucaacgggggggaaauuaagaggacuaaaaaaaauauacagcaaaaaaaguuuauacauucaaacaaaccacuugcacaaaggagaagugaaaaaacaacuuucaaagaaagguggaggaggaggcggggcaugagggcuuaggaagucaggaucagggagacagucuagucgguuucuagaagggaugacagcaggaucuggcuaggagcucuccacuggccuuggcaagagcaaaggaagcggguagggcacugcagaugaaccacacaaacgaaaggccagucaccugccuggcaaaaaucacaaggaaaggaagaggcagcuacagggaaucagcaucaaauaaaaugccuauuucucucccaacccuccacggcuuaaaaaaaaaaaaaaaaccaacauaaagagggaagacaaguagccaaccaauggagagacugcuaugauuccagaacuguuuaaggcugugaccacaguguggacaaccaacccagggcaugggguggccccaauaaaacaaauaguacuauuagacuugugguccuucaccauguccuacucauuuuuuccccuccuuuuuacuuucucuuuuaaagaccaguucucccuauguugcccaggcuggucuugaacuccuggggucaagcaauccucccaccuuggccuccuaaagugcugggauuacaggcaugagcuaccacacccagccuacuuuucuauagauagauucauguuucuuccuauuuuccuuuuuucucuccccucugccuuuguucagucaagaguaacccaaagacaacugaagaugauucaagaaacuguuuagcugcccaaaugaaaaguggcuugaaaauaagacugcuucauucacacacgcacuacagccagguaagccauaaauaugcuaaccaugcucaaucuuacaagcaacuaaagaaaugcaaaauuaggcagggccugaguggcucaugucuguaaucccaacugaacgaccuuugggccuucuaaagcuucaucuucuuugacugguaaguacacugaaaggaaccuaaacuaaggaaaccaucaaacauuuaauuuaacacaaauuuggguucaaguaugcugaucauaaugcaacaauuuacaaugggggagguggggcauguaggggaauguuaaacuguuuuauagccaauggcugcaguaacaacuauucccccagccaagccugugugauguggcagcagggugacacugugcacacaccaugugguguggcaggagccguguggcacacgugugcacuguguauccagguaggcaagcgcucaagggaagggaaugaggcaugcugcaaaaacaccagucaagacucauuuugaaguuucauuuaucuuuauaacuuaaaaugcauuagacgcuucauaauaauuuuacaaaggaaaaagaguauggggaaauucacuaagcugcugagauuuacuuuuagaagacagauuuguauaguguucuuuacacuugccuguauuuucuacauaugacuuuuauaauagggaaguaaaaagaaaaaaaaaaauuacugguccacagucuaccauaaccagagcucuagucuaugagucacaaugagauggagaaaaauaagaugacaggcuaagaaagaaagaaaauugaccuaggaaaucaucaaacagguguccaauaagaaaaaaagaggccgggugugguggcucaugccuguaaucccagcacuuuggaaggcugaggcggguggaucacgaggucaagagauugagaccauccuggccaacauggugaaaccacgucucuacuaaaaauacaaaaauuagcugggcgugguggugcgugccuguagucccagcuacucgggaggcugaggcaggagaaucgcuugaauccaggaggcagagguugcagugagccgagaucauaucacugcacuccagccuggugacacagugagacucggucucaaaaaaaaaaaaaaaaagaaaaaagaaaaaaaaggaagaaaagaaaaggagaaaaaagaaaggaaaaaaaaaggaacugacccaaaagggaaaaaaaguuaauugcgucuggaugaaucacagguaagaaagaaguacaaagaaaaaacgcacagaaacuuaaagcaccgcacgcucacaccauggggaagagaaugcacaccaacgagggcaaacuaggcagacgugcccaggcggcuccugggggcccugugauaaagucuaaacagaagugaugcaagcccaggaagaaggaccugcuauaacccacauggggcaaggaagaugggguauccccucuggagggcagcccccagcuggugagcaggcaucacucccagcucccagggccccaccuagagagggacaccugaaugucaccuuccauaguggaaaacagacaggaaaaaguagaagagacagauacagguacauccacugcccaccccugcugcugccccaggcauuacuugcagcacuugcagugaagaaaucccacuccuaguggcccucauccauuagcccaggccccagugcugagauggggaggaaggaagauacuggugacuggccccaggccccuaccaccaucacccacacccaagaucccuaacccacagcccgucaugcagcauuugucuccaagaccugaaacugaaagccaccagucagucagucaugugucgcuggaaaugcuauugcaccggaauggaacccauuagcuacagccaggcuaacggguuacgaacagugcucccugggagaaccaggcugggaugagacagucuggcaaggccauuugaagaugagcauaugguuccucagauaaaaguaagggcugaccuagucaagcuuaucuuaccaacugguaggcugauccaugccacuaacauuacuaaugcaaugauaugccauggcaagcauauuguaaagacguguuucaggacaaaucaaagagcaggaaaacauuuuucagucuuauuugcgcuuuuuuuuuuaggguaaaaccuaguagguucagauuucugaauaagugcugaucauuauguguacauagcucccaucuuuuuaaacguuaaacauauacauuagaugcaugcaaacuucagagacacuugggaaaagaaugguaucaucuccacccaacagaguaaacaaacaaacuacaagaccaaggccuggcacaguggacagcaccacuacagcccaggaguugcagccugacuccugcauuggugcccaccuggcugcagggucuggggcaucacauggucugcaucacugucaaaucauccagcacagacucacgacuacagugccaagcaugacacagaaaggcaaugggauccccaucgaacucagggagcaaacacacaaugcgguacucagucuaacucuuggagagcagucucgcccagggcugcccagcagaugaguggcuggguguggguuuuguggguuucuugccccuggcuccaaguucuuccaucuuuguggacugacccugucugaugccaaccagaaggucaagucaguacucaccauaggcuguccagggucagaaaauuucacuuuaauauccugcagguguuucaagauugguucaucauauuccuaaucaaaaagagaaaaaaaauuccaacaggcuuuuaaaaaaacaacacaucucucccgaagagucaugguugcagaggcucccagauguugcauaacuagcccuauuggaauucuguccuugucaaaguaauaacuaccaggaagaaacccagacuuauucaccaacucccugucauagagaagcagcaccaagguguccccuuucccuaguguggagcaacgguggcugccacugccagcaaagggcagugccacugacacccgccugccugcaauacuggggcaagggccuucacugcuuuccugccaccagcugccacugcacacagagaucagaaaugcuaccaaccaagacuguugguccucagccucucugaggagaaagagcagaagccuggaagucagaagagaaggcuagaucggcuacggccuuggcagccagcuuccccaccuguggcaauaaaguugugcauggcuuaacaaugggggcaccuccugagaaacacauuguuaggcaauucggcguguguucaucagagcauauuuacacaaaccucgauagugcagccuacuauccacuauugcuccuacgcugcaaaccugaacagcaugggacuguacugaauacuggaagcagcuggugaugguacuuauuuguguaucuaaacacagagaagguacaguaagaauaugguaucauaaucuuacaggaccgccauccuauaugcagucuguugugaccaaaauguguuauguggcucaugacuguauccaaaacucacaauacacacagucacuucuuuauuuuuuuugagacggagucuggcucuguugcccagacuggagugcaauggugugaucuuggucacugcaagcuccgccucccggauucagccucccgagcagcugggacuacaggcacccgccaaccaugcccggcuaauuuuuuguauuuuuaguagagacgggguuucaccguguuagccaggauggucucgaucuccugaccuugugauccacccaccucggccucccaaagugcugggauuacaggcgugagccaccgcgcccggccacacacgguuacuucuuuaagaacacuuacacagagcgugucugagauccaacuugcgggcaccauggaagagugggcaucauggaagagcguacaauucuuaucugugucuguaucauuuuacaagugauauuucuuuaaacucauuuugccaauaccugucagcuuagaaagucccagugaggaaagucagaagaggagugggaagaccugaauccucagaaacacgcacuggcagcaggcacuucauuuguaacauggcagucacuucuuuacccccaaagucugggcacugaaucucaaaaugucuugaaguugcauuaaguuuuucuuaaaucauuuuuucucuuuuuuaguuguauguaauaauuguacuauuuaugggacacagugacauuuugaugcacguacacaauguguaauaaaucaggaccaucaccucaaacauuuauuuuugaacauucaaaacccguccucuagcuuucugaaaacacgcacuaaauuaucguuagccacauucacccuacagugcuacaacacaccagaacuuacuccuccaaucuagcagucacucuguaucugauaacagaccucucccuauuuauccuccccucucucucccucuuagccuuuaucaacaauucucugcuucggugagcuguuuuuguagcucccacaugagugugaacgugagguauuuccccccuuucugugccugauuuuccguugaguccuaauuuucaacucuucugacauaaaacaaaacaaaaacagcaacaaaaagauaccugcaaguaucuagacaaaaaguaacccaaaggcaguugugaaaugggccacaccugcaugcgauguucagucuccaaugcugcgcgugccacccacagaagcaugcgcuggcucuagaucaccaagaugagcacuuccaccagcaugcuuuccagagauggcacugggacuucaaacucaucccacucaaagacgcagugcccacucauguuuucccaaacuucauaaaauaaccauuauguucuaauuuccucaagcagccauguacccugugggucaaaacuuuaaauguccagggcaaauauuaagguaaugccccacacuggcagacgcucagacucaggaagcaaaggcacaacacuggaggcaucgcacucagaucguaaagccaccaucucaaauuuuccacucuccuugcagaaauauauuucaacuauccccaaauuuagaacaaagggacucagaguuaauccgccuuuggaauuuaauauuugaccaaaaugagcugggcauaguggcgcauaucuacagucccagcuacucgagaggaccccuugaggccaggagacugagacagcaguguccugacugugccuaugaaaagccacugaccucuaggcugggcaucauagcaagaccaugucccuuaaaaaugaaagggcuucucucagaaauggcagacuucaaaaccagacauuaaaaaacaacuguuggccgggcacgguggcucacgccuguaaucccagcacuuugggaggccaaggcaggcggaugaugaggucagcagaucgagaccauccuggcuaacacagugaaaccccgucucuacuaaaaauaaaaaaauuagccaggcgugguggcggaugccuguagucccagcuacucgggaggcugaggcaggagaauggcgugaacccaggagguggagcuuacagugagccaagaucacgccacugcacuccagccugggcgacagagcgagacuccguuaaaaaaaaaaaaaaaagaaaauauuguuaaaaaaaaaaaucaaaauagaauaugcuaccauuaccugcuaugagguuacaaacaguacaaauaacauuuccucauucucugcauauuaaaugaguacucuaucaaccccugcauaucuuuuuaaagcuguuaaaacaaaaagcaacaaaagacacuucauggcugaaaugcugaagcacugacacuacuacagaggugcugggagaaugagaagggacaccccauuuaaaauguggccaaaugccucacugugcucucaaaacccaaggcagcacuauccauggccagugaccccaaugccauaaccagguggccacacgcacagaaggggacaccaaaacucacucaagucaccuaacucuagcucccaaacccuguuaucacugcacccccaaucccacgugaagaugcuccaacccugcagugcaagaaucaccccagggcccaugagccagacagccccacagaaccagaauccgcacugccauggccacuccccaugccccccgaagucugagaagaacgaacuaagagcuagucuuuccaccugcucccugccauggagauuuucaacucucagggugcacauuagaguuccuaaaaccaacucaaaacucucagugccauggugacagaugaggcauuuaguuuuugcuauuuaguuuucaaagcugcucaggugauuguaauacacagggugagacuacggcucugguagacauuacuuaauuuuuccaaugaaauucuggugcauggcauucuuuuaaaaguauggucuagucuucuuaaauuccaccuuuucauaugaaaaggaagcucagaucaggaaaaaccaaggcuguucuauuuuagaugcuuucuggucuggaaggagaauaagaaauacaucauucuuuccaucuuuucucaaguuuuggcuuaggacacaggacaagcauuaaacaagggagguagcagaggcagcaaugugauacauuugugaaaaccauuaaaaaccguagcuguaaaauccugugcaaauuacaauguagcaguuugcaacgcacagugccuaugcucugugaugggagaagcacucugcccacacaagcagagccugcagcuguccugagcaagucugaaugcagacgugcuguuucuggggacgcuggagcaauaaaaacugacggcaagucagucagugagacuuaaggcaagauuuguuucucuguucuagaaacuucuauuauaacucauuucagggaaaaccaaauuuguuaccuuuuaauuuguucaccauuucacuacagaaagugaaaugucaaggcaagacaaaaucagaaauggugguuggguuuuguuguuguguuguuuuuuuuuuuuuuuuuuuuuggagacagggucucgucacccaccaggauggagugcagcaccgugaucacagcucaccacagccucaaccuccucggcucaggugauccuccugccucagccucccaaguaccugggaccacaggcgcacaccacaacgcccagcuaacuuuucuauuuuuuguagagaugggauuucgcgaugcugcccaggcuggucucaaacgaucugccuaccuugaccucccaaagugcugggacuacagacaugagccaccaugccuggccucuuuuuuuaaaaaaaauagacacuuuuucaagagaaaugaucagaaaauauuagcaacuuguucaaaaauucacugagauguguguguacacacacacacacaaacaaacacacagcucaucccuucaaaauucauucugcucuggucuccugcccucacccuuuccugcacacucacaccacaggaagacagagaugggcucuggaaucuauucauaggcuuucccacaggcaagacaacagagcuuuacaagagguaaaaggaacugauuugaaaguuuuggaucaggcugaagcgcccagcuuuccaccaagaacugcaaaagacagcauggaagccccacugugaauaaaccauucacugugagaucaggacugcucaucugagguccuggucagagaaagugcccuuccgcccacuaugaacaaucuuucaaugcccaguguagugcuuaaaaaaugccauagauaaguaauguuagaagacuagcacauaaucucucuacaagacagaagugugcuuaccuggacuaauucacucagcauguccacauuucugaagaugguaaaccagaacucuggaauuccuuugggaucuggcucuucagccguugccgcugcuuuuucugugacgacuacuuuacuuuucaugucucccuaaaaaaaagaugcaacauagguaacgaaaauaaaaguuuacaaacaaugcagcggcuucacguagaauaucguugccgaauccucuacuaucucccaucaaacaccuugcuuucuaagucugcaccuccaaaccacucacugggccacgcgacacuuuucagaugcuucugaggaaaaagcauucaagucauuacauccacacggaauuccguaccauuucacaucaaaggcgaagaaacuaaagagaugacaaagugccaccgacgcugggaaaggccauccagugcuagcucugugaggugccauccugagacaaucaucaucacaaaugcagaugcaaagacuguacaucaaccuuaaggagaugcaaugcaaauaugcagaacaucuagcacugggcaaaaaaaguccagugcaaggauaaagaaguucacuuggacuaauaaucugaccucuuguuaaaauuuguggggugcuaaguugaaauaaaaaaaaaaaaaauugccgcagcaguaucugcagcaagaaagugcucagcaacuuauccagcuuguaaggaaguggcuauaaaugccagcucagacaccacgcaagcaucagaaagugaccagaaaggccacauggcaaaaggaaggggagucaggccccagggaaaagguagaccaagggaggugaaacgcaacaccagaugcaacuaugggaaauucugaaugccuugccaaacgggauuguuaugaugaaaugaucuugaaaugaaaggccuuuuaaaucagcaaaggcagauuucccuugagcuguuagaaacugauucacaacuguauuaauccacagccauggcuucaauuaggccagguucuauauauuuuuaaagcaucaaaaacacauauggcuaccaaaaucaucauauaccaccccccccccaaaaaaaaaacugcaaaaaguuaguuauaggauaaaaguuacuugucucccaaacauaaaaucaggcugacaaaguuaauccaugguacacugggaguuuucacagcacuggaaugggaccagucacuagaaaaaggcugugagcaggugacugauggccacaccacaaccaccaucugcaaccaauccacuggcggagcaccucucagggggcaagcuaguccaugccacugagcaggaaggcacuccccucacaacucccccaaucuuccagugacugagaacacaggggcaucucuucuucaucuuugcuuucucugauguuuuaaucuuuguuggucugaucccuuauuucaauaugcuccuguccacagauaacugagguggcacuacaucuuacuccuauuaacugacaguacugugucagaugcuagauccauaucagaaaggaaucuaaacccaaccuaaugaugcagcagcaccuacuguuagaagcacauaaguuuacuagucauuaaaaaucauuaaaaaaugcuuauuuuuaacaguauuaaaacagaacaugagucacauguuucuaaagacuuacagccaauuucucuuccucuucauuuucacugugccauuccgauuccgcaucuguugguucaacaucgccggugauaaauucucuucucuacauaaaaaugagaccuuauuagaauuauguuauuagcuuacuuaggaacucaagaguuaaauuuauaaauaaugucuacuaaaagacuuugaaaacuggauauuuuuauaacuuauuuuaagauucuaaauuuuaggguucaaagaaaaauauuaaaugauucccuggguaaaccuggauguuucaccuaaagauguaaaauaaagacaguccccgauuuccaaugguucagcuaaagauuuucaacuuccugauggugcagaagccaucacacuuugggcaccaauacagccacacuguguuccucucucuguguaggguucaauacauuacgcgagauacucagcacuuuauuauaaaauaggcuuuguggaagaugauuuugccugacugcaggcuaauguuagcguucugagcuuguuuaagguagucuagacuaagcuauguuuggcagguuagaugcguucuuacccuagauguugucaacuuauaauggguuuaucggaaccuaacaccuucguaagcugaaaacuaucuguauauuaaauuaacagagcucccuaccuugucaaagagaggcugguauagcgcugcauacuuucuuuccaagucauguaccucuucauagaacuuggcuucuaugugagcacaucucaccugaaguuguuucaaugcauuaauucuucuuuuuacugcuuuagguaaacuaaaaaagggaguaagaaauacaacauccucaugccugcaaaauaaagcagcaugcuuuucaauuuuauuaaaauaaauuuagguuaacauggaaucaacauccuuacuaugaacaagaccucuuaaaaauuaagaaaaggacaauaccccaacaggaaaaaaaggauacaggaggaagcagaaaaaauaauucacaaaagaaaaaacacaaauugucaaacaugaagaaagauucaauuucauaaaauauccaaaagaaugcaaacauuuaagaacacucagcuuuuccuuaccaaauuggcaauuaaaaaccaaaacaaaacacccagguuuuacgaggcuaagggccaagaagcccucuaacugacucaucuuucugaagggcagaaauauugaaaauguucuuuggacccaguaauucuauuucuaagaauuuauccuuaaggcugggcgcaguggcucaugccuguaaucccaccacucugggaggccaagguaggauugcuugagggcaggacuccaagaccagccugagcaauacagcaagaccucucucuacaaaaaaauuuuaaaaaauuagcaaggcaugauggugugcgccuguagucccagcuacucaggaggcugaggugggaggaucacuugagucugugaggucaaggcagcagggagcuaugauugcgcuacugcacuccagccugggaaacagagcaagacccuaucuuaccaaaaggaaaaaaaaaaauuuauccuaaucaaguauuuaugcuggaguguccgucgauagaucuguacaagugaaaaacuggacaaugcaagugcaacagcauucaaauauggccuauucauaaucacacuguccaggaauauuuagugccacgugggaauccacacuuguuaacacacuggaggaaaaaaucugagaaacacagaccacaggcaacacaacuuuguccuggagagucaggucaacuaugaguuugccuuucaauucuguucuauguuuuaaaaaauaguuguuauguauaacuuuuauaaaucagaagaaaaauccuuguuuaacccaucaaaacuauuuguucaaaacgaagccccuggucacaaucauguggacugaacagcagauuccuggccucaucauagacccaaauaaucuaccuggggcagggcccuggguccugcaucuugaauacucauucacacaaucagagucuucaagucuaagcacuugacuuacccuccaacaacagacagcacagagcaguaggcaagucacacacacauaucacuggucugggagguauuagaacaacugccuugcaucccaaaggaccacucuccugggugaaauacaaccacagcuaccucaagcuaaagguccuuaguuuaagcaaagacucucaaauaaugcuuaacauucuagaacuacugcuaguaguagaugaaaaaaagggaaaagcagaaagaauuuaacaaaaugguagacucccacugccauuuuuaccccuuuucugcacuggucauucauucauucauuuauugugacaggaucucacucuguugcccaggcugcagugcacuggugcgaucucggcucacuguagccucaacuuucugggcucaaaugauacucccaccucagcauccugaauaguuggacuacaggggcacaucaccaugcccagcuaauuuuuuugcauccuguagaguagggguuugaccauguugcccaggcuggucucgaacuccugagcucaagcaaucugccugccucggccucccaaagugcuaggauuacaggugugagcuaccaugccuggcuaauuauacaauuuuaaauuaguuuaauuuuugaagcuuuccaacugaaguaaaaugacaaaggauuuuuuuuuuuaauuauacuuuaaguuuuaggguacaaaugcacaacgugcagguuuguuacauacguaugcaugugccauguuggugugcugcacccauuaacucgucauuuagacaaaggauguuaaacaaacuggacccuagugugcccccaacaguccuucaaucauucacaccaacuacacccagcccucugccggcacuuuuccugcaauauggcuaauauggaaccacuucuagucccacauaaaccugaucccacucaagcaguuccucucacagaaugccaccccaccaacccaguuucuaaagcgagaaaacuagaaaccauuacucauucucauucuugccacucccacucaguaucaccccaucccaucaaucuagucugcaaaaaaaauaacaucaaaacaccuugcccacuaaguaaucucugagaagcuucuaaaugggcaaagcaaacucugaaugucaccuucuaggccaggcgcaguggcucaugccuauaaucccagcacuuugggaggccaaggugggcagaucaccugaggucaggagcuggagaucagccuggccaacauggcaaaucccugucucuacuaaaaauacaaaaacaaaacaaaacaaaacaaacaaaaaaacacgugcagcaaaucaccauggcacauguauaccuauguaacaaaccugaacacucagcacaucuacuccagaacguacagugaaauaaauaaaacuacaaaaaacuagcugggagugguggcgugcaccugcaauuccagcuacucaggaggcugaggcaggagaaucacuugaacccgggaggcggaaguugcacuccagccuggaugacagagcaagagucugucucaaaaaauaaaaauaaaaaauaaauguccccuucuugucguaauagcccuggcaguccugacuggggaaaccagcuggaagguggggccuccugggagaccaagcccugacccaauuauagauggaagcccaguaacagcucaucccuuuaaaaaaaaaaaaaaaaauugccaugcaugguggugcaugccuauaguuccaacuacucuggaggcugagguagaaggauuacuugagcucaggaguucaagguuacaaugaacuauuacaugccacugcacuccagccugaacaacagugagacuccaacucaaaaaccaaaaauuccuuccagaaguaagagagguccugacaagagccauccuaggauucuaggaucaccacccuuaucauuuucauagugcaauacaucuagcacauaggccucucuuaagaaagcaaaggugucagccaggcacgguagcucacccguuaucccagcauuuugagaggcugaggcgggagaaccaauugaggccaugaguucaaaaccagccuaggaaauacagugagaccccaucuuuuuuuuuuucuuaaagacagucucacugucacccaggcuggaggguagugaaaacucauaggcaugcggcacuaugcccaguuuuuuuuuuuuaagguguuggugucacaggcucauguggguaagucaggaaggagugguucucuuaguuuaacuuaggagccaccagcuguccucuccaacucagaugaucugugaaguccucuagcccuccacaggauggcacugugcacuuccuaucagaacugacaggucacgcuacuccauccaccaggcaaacucucagccuaggcaccggguagggucacuccucucauaucccagugccugucucucauagacaaugucuuggaacgaaaaaaacauuuaauccuguucuggggaacugaaaagugguuuuuccuuuauuuuccuuuuguuucuccaaauugcaugagacccuauucacagcacacuuacguuucgauguagcuggaaggggugugagggacauugucaagucgcuccuguaaagcugccagaacucgaggauucugcaucaccugaucugugagcuuuucuaugaagaguuaagaccaaacauauuuaaaauaugcccaccacacacaauagccaagagucaaaaauuaguaacauaucuacuuagcuuugccuagauuuacaucuacuaauuucuaaauacauacaccagugacuucuuaaacauguuuugaaaauaauuaaaauuuauuuuaagagcauuuaacacucuggguuaaucaccugauggguaguuacaaauuuacugaauaaacaccuagagaguccuggcucucaccaggacuguggcuguuuaagcaccagacuuaaacaacugaggacaucauuaauguaaguucacauggucuacccccaagucccauggugguguccagaagccacgaacagagaugagaucaguuccucaaaguaaaagagcauccacuagcucccuugcucacuguggugccauagacuucacaguccaggagagcccaaggcucacuagcucucugccagcacuguucccuaaguuuucuuugcaugugcuacucgccucugccuugaauguccuucugcccaaacccaccucccuccaggaagcacuucugaccauuccaccccacuuagggcuaaccuacauguguagugagcucacaauaccaagcuguuuguauuuauaagcccauuucccaauaaaccaaugaaugagauccugacaagguagugacuguccuuuuacccaguugugacuaugaaguggcagacaucuggcucaugacacagacucuuaacaaucucccucuuaaugacacaauacagaaauccaaacccagcgcccuucccuugcuuagagccaguacauacccgaguauucucccaucccgaguauucucccaucccgaguauucucccaugauguggguaagucaaacacaccaagcaggcacucaauuuuaaacauucauaauagaacugcaaacacaaccacuaacaugaagcacaugaaguguauuuaagguacguaauuuguauauauaaaacuguguacacauguguaguauauaaauacuacaugcauauacaaacacauaugaaugggugcuaaaaccuccgugugaaaguuugcugaagaggaagaggauaucuacacgugccugacagauugcuuccaaggugaaaggaccuugguaacagagaagucuggcaggcacugucuuaaucaucaaucucaguguccuugggcaggugccgagccaacacccugugccuccggaaccaacgaccacugcaucauguuaccugugugcccuucuugccaaaauguuuacccugaaucucaucaggaagaaacgacugggcaaauccagacugugagcauucuauaagacaacaguggcccagagcgcugauauguugauguauuaauaaaagaugcaaaagguagggagaugacucuagaacaaaacaaaacgcaugauccuugaauaggugcuagauucgggcgugggguaaaaauugcugagaaaaccagggaaacaggagcaugacugucuauuagagaaugguauugcuccaguguuaaguuucuugguaaugacauuguagaauuguuuuaggaaaauagauauccaccacuugcuuucaaacaguuuggagggaguggggaguacagauauaguuuuuuuuaaugguggaaaaauaucacaucugugaauuuaugaacaaaaugacauucuuaggauuugcuuuccaaaggaaggaaaguaaaggguauagacuuaaaaaaaaaaaaaaaaaauggccaggagcaguggucugugccuguagccccaacuaccugggaggcugcggcaggaaacugcuugagcccaggaguccaagaccagccuggguaacacagcaaggcuccaucucaaaaauaagaaaaaagacuggucauuuguuaaucaauacuaaagcucacugaugguagcuacaagaagguagacuguacuauuacucucuuuacuacuguagagucugaauuccuauaauaaauacaucuuuuguuaaugagauacugauuuuucauuuuaauuacucuagcuuuccuaaaaccacugcaguacaggaauccuuuacuugcauuaauaaauguuuccagagagaggaacguuccccauacuggaugcaaacucuccaugugcaguggacugaccuguguuacuugcauuuuuagcagcuuccacggaaucugaaggaaccccaucugaaaaacuaaaacaacaguauguuuaaaaaguauuacuguaaagaaaguuccaaagacauagcacaaauggacauguuucuuauucaauauauuaagagguaucuguacagugacgucagauuugggcagaagaaaacuaccaaugugcauguuaucucagaggcuguccucucugcuauaaaaauauucuacuacguaacauccccucuccucucccaaacauaaagcccuacaaaguucuuauuuccaaccuuagccaaagcuucuuagcucucauuucuacagcuucuuuccucaaaaaaucugcucccagcccucaaaccaaacccaucaaccaacgaacauguuacuguuuggucagcugcucaugugaucagagcaaggcagucuuaccaaguuaagacagugcccaaaguggcuuuguaaaauuagccacaacaaguguaaaaugagccaugaaacaguuuuuaaagaugccuggacacaccucccucacaaaaaauaaacaucaaauaauauacacaacuaaaaguaacccucaauccacaaaacaaaaucuuccacuugaucacugacaacuacagacuguuaggagagugucaaaauuaccuaacuucaccccagggguguuaaagcauggagagcaaaacgauugcuuuccauaaaagaucuguagugucaaugucugaggcacuguucaugucggaaguaauuucuuuacgugcucaaauacauacacaagaaaugagccaucagcuagacgcugaaaugcauuuaacuuugauucuaauuauuuauugaaaaauggcuuggcuguugcucaccaacugaauuuuaaacuccaauaaacaaaguccacuuuggcuuaccugugaucugccaucugaauguuuuuauccccuauaaauuaaaaagaguuguaauaauuauauucauaagcaaaaauguuuguucaauauacuuuuuaaacaacgguuaucugugggauggaguccacuagaagggacaggagggaacuuucuagagugaugaaaauguucuagaucuugacugagguuaccugaguauauacacuuguuaaagcuuauuaaacuauacacuucagaucugugcauuucaucacacacaaacuuuacucauaaaaaaauuucucggccuggcgcggugguucacgccuguaauccaagcacuuugggaggccgaggugggugggucacuugagcucaggaguucgagaccggccugaccaacauggugaaaccccaucucuacuaaaaauacaaaauuagcugagcgugguggugcacgccuguaauccccgcuacucaggaggcugaggcagaagaaucacuugaacccaggaggcggagguugcagcgagcggagaucaugccacugcacuccagccugggcaacaagagugaaacuccaucuaaaaaaaaaaauaaaauaaaauaaaauuaucuuauuggcacuaaaauaaccagacuucagaauaacauuaauucuaauuugccuuauuuuuuauaauacauucggcaacacaaacauacauuaaugauagcccaaccauuuuagaguaagucaaagcauuuacugguguuuacacuuucaaauuaacuuaugggauuauuuucuaauugcauuuguuuauuccguaucuuccauuacuucuacacugaggauguauugcuuguguaaaaaccuuguguaauauacucaguauuauuccacuuuuaaagaugauuauuucuauauugguagaauuagaugacauuguaacugaauauuaaggguguguucuagggcauuuacuucuuaaauagaagaacuugauauuaauaaaacuaaaaaaaaguuaucauuuuuuuugagacaggaucucagucaccaaggcugcaguguagugaugcaauccuggcucacugcagccucaacuuacugggcucaagcaauccucccaucucagccuccugaguagcugggacaacaggcgcaggccaccaugcccagcuaauuuuauuuuuuguagagauagggucuggcuaaguugcccaggcugagucccaaacuccuggccucaagagauccucccaccucagccuaccaaaguguugggauuacaggugugagucaacacgccuggccuauacaauuucaaaaucuaaucuaaaugcauuuaaaguaacagcuaaaugcacagcuuaaaaagguccuuaaauguaaaauaauacaggugugguuacgaaguuccuuaaacucagaugugggaaauacaccugagggccucgcuaaacgguuguuccagcugaaaacuggccaauguucauucuucaguaccugagcaaagcccaaaccacugaaucacauagcuuuaggguaaaaccaacaacaaaaaaaccccucuauauuuaacaaaaacaguucuaauuaugaucuaugacuguccuguauuuaacucaacuacuuuuuuaaaauuuuuauuguuuagaaauaaaacgugcuauuuuuaagauucaaaauacaacaaauauuacacauugucuuuuucaaaaaaaauaaauuauguuuuaaugaagaagaugaaaaccaaaaagaaaaaaaaaaugcagcaggcacagugguucaugccuauaaucccagcacuuugggaggccaaagugggcagauuaguugaagcucaggaguuucagaccagccugggcaacauggggaaaccucgucucuacaaaaacaaacaaacaaacaaaauuagccaggcgugcuggugugaaccuguagucccagcuacucaggaggcugaggcaggagaaucgcucgagcacaggaggcagagguugcaguaagcugaaauaacaccacugcacucccgccuggaagacacagucagacugucucaaaacaaaaagaaaaaaaaaaaaaugaggcuggacacagcggcugauaccucuggucgcagcuacuugagaggcugagacagaagcaacacucgagcccaggaguuggaggccuggcggcugcagugaccuaugacugcgccacugaacuccagccuggacaacagagcaaguacccugucucaaaaaaaaaaaaaaaaaaaaaaaaaaaggcaauaaacccuacaauggcuggcuaugcucaccaccaugaccacagcagcaacccaaacccagcccuagucagugaagauuuaaaaacccuuuaacggaggccaggugugguagcucacaccuguaaucccagcacuuucggaggcugaggugggcggaucaccugaaguggggaguucgagaccagccugaccaacauggagaaacccgucucuacuaaaaauacaaaauuagccgggcaugguggcacacgccuguaaucccagcuacucgggaggcugaggcaggagaaucgcuugaauacaggaggcagagguugccgugagccaagaucaagccacugcacuccagccugggcaacaagagcaaaacuccgucucaaaaacaaacaaaacacccuucaauggucccccgucaccuucugcagaauacacauuccuacugauucaggcccugucuaccuccccacacucauucccacucacgcuccuccaccauguuugcugcaaucacaguauuccugagguuaguucccuucucacauauucuaaaugcaaggugugagacagucagacuucauaacaauuguuuaaggacaacauucuaagagcuaaaacaccacuuaccagcuguuaaagaaugagguguuuuuuucuguuauauaccuuugauaaugucucuaugaacaucuuggcuuauauggcuucccacucccaguuauccuuaauugauauggcaauagcaggaccgcuacaguagcauuucugggucaaagagcaugaauggauucugauacauacugccaaaacaguuacacaauaacaucaacuguaauuuggcuacuuaauugaagcucucuauugccuaagaaauguaucucauagcaccuuccuuaccccacacauacacacuaauugcugaaagaagccuacuaaccuggaaacaucuaacacugucaguuuaauggacagauucuuguugucaucacccuaucaguaacaccucguaaagacacauacuucauuuccagcaccuccuauacuagcaagggaccuacaugucaggcacuucauacauuuaauaccaagagaaacuccacuagggagggacuauccucaguuuacacgaaaagaagcugaggcuuggaaaggugaggugccaaauugaaagucacacggcuaguaaaacaugcauucguguuucaaaucugacuccuucuaaccuuucccuaguaccaacaccacuucacuucuggcuguuucuacuugcucauuaaagauucuguugcugcuaggcugggccugggggcuaacaccuguaaucccagcacuuugggaggccaaggcgggcagaucacgacgugaggaguucaagaccagccuggccaacaugguaaaaccccgucucuacuaaaaauacaaaaauuagcugggcaugguggcacucgccuguaaucccagcaacugggaggcugaagcaggagaacugcuugaacccaggaggcggaguuugcagugagcaaagauugcaccacugcacuccagccugggcaacacagcaagacuccaucucaaaaaaaaacaaaaaacaaaaaaccuguugcugcuauuggaacaagugacaagcaacagcuuagucaggguugaaauccuacuguucagcagcaucuccaagaaauccauuuugucuacaaauggagugugacaauacucccuuuugaugcuguucacuaugcagccccagagccccuaacaguuccuggcauaauaaauaucuguugaaagcauaaaccaccuguguuaggacaugagccaaagagguucaccuucccauggaaugguaccuguuccaacuuaacagaguccauugauaaaaugauucacucaauuuucauuuaagugaaggcugugcuuuuuuaaagagacacacagucucacucuguuacccaggcuagagugcaguggcaggaucauagcucacugcagucucaaacuccuagccucaagugauccucccaccuuagccucucaaagugcugggauuauaggacagaggcaccaugcccagcccggcaugugcuguuuaauacaauuuuuguuaacaagaugacaaggcaguuaaguuaaacccaacacgguauucuggaaaaaaaaaaaagugcuaaaucaaggauagaaaaaaaauaaugaauuuacacaauaaaaaagaaaauaauuuugacuaaagaaccaaccaacccagaacucaaugccuagaacaagacagacacacacugaacagccugguuucaaauccuaccccuaucacagaucaccugaagcucaggaguuucagaccagccugggcaacauggggaaaccucgucucuacaaaaacaacaaaaaaaacaaaauuagccaggcaugguggugugaaccuguagucccaauucaggaggcugaggcaggagaaucgcuugagcacaggaggcagagguugcaguaagcugaaauaacaccacugcacucccgccugggagacagagugagacugucucaaaacaaaaagaaaaaaaaaaaaaaugaggcuggacacagugguugaugccucuggucccagcuacuugaguggcugagacagaagcaacacucaagcccaggaguuggaggccuggcggcugcagugagcuaucacugcgccacugaacuccagccuggacaacagagcaagacccugccucaaaaaaaaaaaaaaaaaaaaaaaggcaacaaacccuacaauggcuggcuaugcucaccaccacgaccacagcagcaacccaaacccagcccuagucagugaagauuuaaaaacccuuuaacaaaggccaggugugguggcucccaccuguaaucccaguacuuugggaggccgaggcgagcggaucaucugaggucaggaguucgagaccagccugaccaacacggagaaacccgucucuacuaagaauacaaaauuagccgggcaugguggcgcaugccuguaaucucagcuacucaggaggcugaggcaggagaaucucuugaacccaggaggcggaaguugcagugagccgagaucucgccauugcacuccagccugggcaacaagagcgaaacucugucucaaaaaacaaacaaacaaaaaacuaacaaacacacuucaauggucccccgucaccuucugcagaauacacauuccuaccaauucaggcccugucuacuuccccauacucauucccacucaugcucuucugcauaaccuuccucuggaccucaguuucaucauccacaaacuagaagacaguggcuaccugagaaacuguuaauggagacaaauuuccuaguacauaacagcaggccaggucucuuuucacuuuuguaacugccaugcauauagacuacaucuauuccuugauaugaaaccaacaaaucaaguuacuuuaaacacugcacccuuuauacagguugaguaucucuuaucugaaaugcuugggaccagaaguguuucagauuuuagaauauuuguauaaacaugaucagguaucuuggggaugggacccaaaucuaaacaugaaauucauucacguuucccacacaucuuauucacauagacugaagguaauuuuauacaauauuuuaaauaauuuugugcaugaaacaaaguuuuaacugugauccaucacgugaagucaggugugaaauuuuccacuuguaacauuaaugucaacacuaacggaguuucagaauuuggagcauuuggauuuuugauuuugggaucaggagugcucaaccugaauaaggaaagacaauguagagaggugguauuauaaacaagcuagaguucagucaaguuucagcaccacaaauuauuuuuguuuaucaaucccuaucacccuuaaaacagaaaguuauaaggaacuaucaaauauacagguuugaggaaaauaaauaucuguuuguuuuaaauguuauguucaguuuaauacuagucuuauaaaaccacagcccgaagacucauccagaagguucucucacuuuuaaaaggcaaucaagggaucuauacaaccuggugacuauaguuaacaacaauguaucacauaauugaaaaauugcugagaguagauguuaaguguucuugucagaaucaguauaccaccuaaugugaauuaacuugacuuagccauuccacaauguauaguacuucaaaacaucgcauuauacaucauaaauauaauuuuguguuaauaaauaauaacuaaaaauaaauaaaagacaaucaaguuaaauuaugaaagggauaccaggcaaaagaauguuguaaguuuucuaaaguucagguucccucccaaggucaaaaacuuuaacugugucuacaauucuaaaucugaacuggcaagcaaauuuucacccaguuaauugggucgaggaaaaauaaaauaaaauaauucccaugauuacacaaauguucuuuuauuuauauuagucacuguaacaauccuauuuauggauuaauuucuuuguaccccaaacaacuguuuucuuaugaaauuuuuaaagauuuuuguaacaaaauauaaccuuaaauuccuaauuuugaacugaaaacaucuacuccauagcuagaguaacuauaaaauugggccauggccaggcacgguggcucacgccuguaaucccagcacuuugggagaccaaggcgggcggaucacaugaggucgggaguucgaggucagccuggccaacguggugaaauuccaucuccauuaaaaauacaaaaaucagcugggcaugguggcacacgccugaggucccagcuacucaggaggcugaggcaggagaacugcuugaaccuggggggcggagguuguagugagccaagauugccccacuagacuccagucugggcgacagagccagacccugucucaaaaaaaaaaaaaagaaaaagaaaggaaaaaaaaauugggccacguuugagagacaaagcuagagaguguagucguacuccccaaaacuuuuauauauuuacucugucuuaauaaacucaaagguccucaaugucuuuaugggagauaacugaaggauuaaaauuaauucaaauguaauuaauguuuucacaagacuccuuauaauuuccuuacaaauccuauauauccuacaaaauuagggaugguaguaaauuuuuuuuuuuuuuuuugagauagaguuucgcacuuguugcccaggcuggcgugcaguggcgcgaucucggcucacugcaaccuccaccucccaguuucuccugccucagccucccaaguagcuggaguuacaggugcccaccaccaugcccagcuaauuuuuuuuuuuuuuuguauuuuuaguagagacaggguuucaccauguuggccagacuuggucucgaacucccaaccucaggugauccaccugccucaaccucccaaagugcugggauuacagguaugagccaccgcacucuaagauaaauuucuaaagcacaauugcuuggcccacauucagucugaggaauggcaauccaacauucucaauccaagagagucugaccagccauugggcacaaguucaaauccuccaggaguacuggauguuuuagauuaggacaucagaaaggacaaagaaaugaucuguucucagaaggaaucaagauaccccuguaggacaccccaacauccccacccacaaaagcuggugauuauacgaagcccugagacaguccagauuucauuucuauugcccaggccaguagacuccugauccagucuaucauuaccacucuccaggaucagaaguuaaucauguuguuaaacuuuccaugauaauguucuggguuuuuuguuguuguuguuguuuuuugagguggagucucgcucugucacccaaggcgggagagggucucaaacuccugacccucaggugaucugcccaccucagcuucccccaaagugcugugauuacaggcgugagccaccaugccaggcccaugauaauguuuaaaagcaaugaauaggcugggcacgguggcucacgccuguaaucccagcacuuugagaggcccaggugggcagaccaccugaggucaggaguucgagaccagccugaccaauauggugaaacccgucucuacuaaaaagauacaaaaauuacccaggcgugguggugagcaccuguaaucccagcuacuugggaggcugagacaggagaauugcuugaaccugggaggcagaggcugcagugagccgagaucgcgccacugcacuccagccugggcaucagagcgagacuccaccucaaaaaaaaaaaaaaaaaaaaagcaaugaauaauacauguuugcccacuaaagaacaaguuccacgagggcagggacccugucuacuugcucaauacagaagucccaaggcccagcaacagacucgggaugagacugguugccaagaaaucuuugcuuaacucacugcuaccaaaugacaacuugucucuguguuaccaguacccagcacgcauggugcccgggacugcaugcacacaucucaagcaguuucugaagacacagaggagaaacacugccuuagucauucauguuugguuacaagaucuacugaaauaccugccuccaaacagcagcagacugucucuucagagacuucugcggugccaagcccugggguuucaagaagaaagcaaaaaaugauuuccuuuccuuaaccaaaacacuacauuuuacuuggggcgcagcagucuuuacugcugcacucccaucuccuccacccuucuuuucugggcaguucauuagcauacgacucaaugaggcuaacuucuuaauccaguacauauuaaaagaucuugucaucuugucaauaaggcacuucccucucuaccuauuucauauugcaaccaccaaagucccuacuccucugcacuguuuuucaaaagcaccugccaccauugaacuuguucgucugucucccauagcagaaacaaggacaaagacuucuguuuuauucugcgggaggccccaguaccuagaacugugcccaguacauagaagaugcucaugaauaaguaaacagaugcaaaucacugaaagcuacuuuucgguaacugaguaaacaaguacuauuuuaauuauuauacuuaaaaccuuugcacauaaaagugcacagucauucuuucuaccacaaauuaaacagaaauuaucucaucuuguuuuugaacaggcuuuuccagauaaugcacagcgcauuuuuaaaagucccaaggacaugaaaugaacauacauuucguuuuuaacaguuaacaggggauacuuguaagaaacuuaagguuacacaggaaguggucaaaaucaaaaaguaaagaucacaaagugaucuuucguuguuuucauacuauaaaaacacaaugccucuguuacuaaaugcaaaauguaaagcucuggcaaacaaaguaaagcaacccuguucucucuuaagagggcaggguggaaaaccaaugacugccagaugaaaacuaauuuauaucaccacaaacuauuucuuaaaaauuucauuagcagccaaauacaaaauuauuuacuaucuaccuacugauaaggguuuuccauuacuauaugcucaaagacaaaccuuacaacuauaguuucgggaggcauaaauuugcuuaccucaggaggucccacaaaaauucagcugaggccagguaacagcaguuuccugcagagaucagcuacuuccuaucaccauaguggucgaagaaucaaacgaaguaauaucagauuucuacucuggaagccuaaaacacuuuucccuuuaagcaaaaaagcaagcauuccuuagcuagcaaucucaggccaaacucccaacaagcucaucucugcugucuuauucaaauauaaaccaucaugguuucaagcaguaacagcacucgccuauuucacacagcugacgccucuuaggccgucaggaauuuaaaucaccuucuugcccacaaaguauuuuucuuccaaaacaaacugaaaaauauaggcucuuuggcaacauuuuuggaaguacaacauaaacuuaucacaauaauuuuuaaacugcagacaacuaaagggaaggaagaaaagcacuacuauauauacauacauauuugaggucaccuccuccugaugcuagagacuaucaacugcucaaaagaaggaaaacaaaauaaagauuucaguccccacacuuagcugcgaauagcuaacaaagggaauuaacaugcggucaauaacaagaggcuacuaaaaacucugacagguuaggaaguuuucauuucaguuucaaauucaaauucauacuguaaaguggugaugaacacaucccauccgcagguacuuaaccuccauacaaauaagaacuaccucucauaugggcaaaaagaucaaaauucuacagaagaaucugauggcuaaauggcuaauuugcaaaacacaaugcccuguacauuuugaggacauccuaaaacauguguaaacuuuucagaauucaguuuaccaaaguuaucaaacuuaaaaaugauuaaaauuuauuugcuacugcaaagaauucaaccaauuucuccaaugacuacuccauauucauuuugaaaaacaguaccggauuuaaagcuuacacaacaaaauucacaaaaguguuauaugugccuauaugacauauaggcacaaauaacugcagacauucugaagcuaacacugcucaaccaggaaaaaaaaaagacugcaauuggauauguaauaacagcuauuuaagacggcaguaacguguuaaaaugguucauaaaaaucacaucauaaggcccugaaauucuaguaaaaauaucucuaaguaaacuugugaacuacuacuaaauaacuaauuuucucucucucuguagucacucauuuuaucuuuggauuacuuucccauucuaucaccacguugcuuucucugaacuucauuuuacauuugcauauuauuuauuccauuagcaauugcucaucccagucugaaucucaaaauucuacuauaggaggcauuuggcauucuguggaauaagagaauuuugagauggaaaugaucaaccagcucaaaaccucguaagcuagaguucaguuaagcuuagcacaaugaugaaaacaauuucucauuaaaacuucuuucauucccucuacagaagcaguaacccuggguacaguuaaaacugccugggucuuuaagcuuugucaccucggacaagucauuauaccuaaccucccagggccucagcuuccagaguaguuaaauggaaaaacaauagcaucuaucucagguuauuagauuaugaaaugaguuaacacacgcaaacaggcugaaagagucccuggugcgcagugcagguauuagucauuuagagguauaguuacuauuacaggaagguaguaacuuagaaagacuuaccuuuaagguccaacaaccuaaucuacauauuuguauauuucuaagguaagagaauuuuuaaaagucuauuuucaccccguaaaccuaaugcaggaggauaaggcacggguuacuacaggaaaaaguaaugcagacugggggaugcgaaccaaagcacagacgaaugugccccgacgauuccuccgagaacauaaugaaauggcggaccuuccugccagaggagcgcacagucacccaggcaggugaugugacacacacguuagggucuaaaggucccaaggcuggaguccccuuuacuggacccuaaacaugucugccuccugccccgcaaucagacuuagagaacuguggacgguggaaagucuuaucaugaccaggccauccuucgcuggggugaacggaaagcauucagaaggggaaaauugaaaacaacaaagacucuggucaggucaaaaaauacaaaugugaccucuuccaccaucucugaacugaaagaaaagcauggcacuuucccauccauaacauguacaauuuuuuuuuuuggagauuuugcuuuucccuugugaaagacgguuuuaaauaguaaacagacuugcugcccaccuuggcugggaaaccaagucccgugaguaacuagucuaaggccacucaggccaguccucggggagcgcacgccgcccagcucgcucccaccgcacagcucccaacagcuaagaagcaacgccaaggacuuucuuccccgucagacaugcccucggccacaccaaacugacaucaaaaccccaguuagcccagccugaccccacagaggcucacgaugacaaccgcccuacggaaaaacucaaauuccuaaacaucuaauaaagaaguccuggacgucuccaccuuaaaaacgggaagccugaacgcuccggcgcgcccggccguguaaccgccacagcccccgcacgcggggcgggcugggcuagcgggagauuugagcggccgccgccucucgccgucuucgccuccuccaaggggccgccgcccaggaggccgcccgcggcgcagaacaaagcgccuugaccuucagugaggcgggcagccgggcgaggcgcgccgggaguugggaggggccucccgccagcgccccaggcccgggcuccaggccccaagccccaggccccgccgcggccgccgcugccugccccgaccagaacgcggccccgccccugccccaccgccccgaggcuuccagagauggccgccgccgcgcccgcgccggacccgcggccccacccgcccguccgggcccggccgcccuccccagcgcgccguuaccggcccagcacccgugucuccgcaccucacgccuccugcggcaguggcggcgacccuagcuucgcucgcuuuggggcugcgccgccguggccuccaacaacgccggcucccauuggccgaggcuccuagcuccucucuccgcgagcaag

SEQ ID NO: 191822 - RNA, 14021 nt, Homo sapiens
aaucgcugacaucauccgggggcgggcgccccugcccugcgggugacuccgaccccuggcuagaggguaggcggcguggagcagcgcgcgcaagcgaggccaggggaaggugggcgcaggugaggggccgaggugugcgcaggugaguggccaaggugugcgcaggugaggccaggggaaggugugcgcaguggggggcgcuugcccaggugagcaggugcccacucacagggcgaggguggggucagggguagggggcgugcgcgcagguggggagaggguccagcucacaggcgaggggccgcuggggcuccggggaggcggggcggaggcguggauagucccccucccccacgagccggcgucugagggaugcucuguccccgcgcugucuggagcuuccccgggcgaaggcugccuggcuccggggucggcuccuggccccaugccgcgcuccgcggcggcucuuucuccugccccaccuguuguucgccucccucuuugucagugcugagccaggcacagcagcuuugcgaugggacuggcuuguccgccguccucccugacaugcggcuguugaagcccugagcacuggaccuucugccucuugcuugacuccuacugugggccuugagcuucugcccucuccugaaaugucagcugccugcggucuuauucauuuuuguguuccuugcaggacuuuagccgguugagaaggaucaagcaggcauuuggagcacaggugucuagaaacuuuuaaggggccgguucaagaaggaaaaguucccuucugcugugaaacuauuuggcaagaggcuggagguaaguguaucucagugcccuggaucgugggcgcaggcuauggcuucacagcguugaaaguacagacagacugguccaccagcucucgagugccaacgacugucugugccucuuaugaguaaaauacaacauaccagggcaccuccccuuugucuguucccagccgucuauugggaaggauguuacuuagauguuuauugcacaacucaaugcuuguggcuaaagagcugacuccugggugaaugaacucuguaauaagcuaaaaguacuucuuuggucuuguuuuaaucccuuuugacaacauucucccaguggcuuuuucacacuuuaguucugagguuacacauccccugacccuuuugcaauuucccaguguuuuacauaauugauaauguugguaccaggcauuguccccuuguagcuuauccauggcuuggggcaagacgaaugccaccccauucuacuuagccuuccuguaaggcaagugugcauguggguggucuggauuaacaccagucagugugggaacuagggaucggagggagugggggcacugagcugguaaguuuuggcugggaagaaacuaagcuuguaucuuaccuugaugagagccugggggagaggaacugucuaaagcaagccagcuuguccagguggcugugaucuugagaucagacucacuagcgugucagcuuuucucagaaguaguuuucuuucauccacuuugauuuuacagauauaaggagagugacuggcacucgccaggcucuguauucaguauuuggggccggagagagacacggucucuuccuaucaagaacucuucgucuuguuuugugcaucauaggaacugcauaaacuaacuuguguaaauugaaugaagugcggguacugaaguucucacacugcauaaggaaaaugucuuucaucguugaaauuuuuuaaaugugugugaauuuuuauuaaaguaauucaugcacacauuuuuuuaaaaaucaguguuaaaaggcuucagaagaaauacucucuaccacaucccacauccgacagucuugcuugccagcagcaaacacuuuucauucuuucagcuacuuuuguguuguuguuuguaccuacuuguuucuaaguaauuuccuuuuaguaccccuaacuuugcaaauucccuucugugcauacaauagucaauaaauagucagaguauacauuguuaugacaaaauuaccauuauucacuguugagccaaguaagguccuauaauaauggcuugguuucuuuuuuuccuuccuuauaugacuuuuuauuuuuccuggaguuaacaguugccuuccuuuuuuuuuuuuuuuuuuuuucauuugguaagguuucuaugcaucucucauucauuuuuuucuggaugcucuaaccgagcugucacauauaucaauaauuuuccuacacauucagaugcaacaaaauucaucauuuucauuuccucucuuuccuagccauucaucuuguaccaauguggacugguuucugguuaguccugcugcauagcuguccucuugggacuugccccugcccuuuuguggacauggcuucagcagcucucuugggucuccaguuuccuggauccuauguuguuguccuugaguaauaguucacauaggaguagaauucuagguugcaaaaaguuuuccucaaaauuuugaaguuuuucaucauugucuucuagaauccagcuugcuguugagaaaucuaagccuacugugauuuuuacuccuguuuuuucucuaaaagcuuucaagagcaucuuuuaaaaaaucucagauauuuuaaagcuucacaguuaugaacuuguucuggaaguggggaugucacugcuucccccaaauuauaaccauguagagcagcuguggguaccuagagacauucuguguucucuuccccuuuuuuuugaagggugauuauugaugguccuacaugggccacuguucuaggcccugguaguagaacaaugaagaggacacacaauuccugcccuugggaagcuuacauucuagugaggggagacagacaauacacacacacaaaugaauacuucuaggcgauggggagaguuacuaagaaaauaaaguacccaguggagggccuuggcagggaagcuggggagcagcugcuucagauuggcugagagggaagaucuccccaggaggggacauuuuacaugagcccugaacaaggacaccugcaaacgugcucuaagcagaggaagucagugccacagacaauuuaaacuguguucaaggaugagugaagaccccuguguuccuggagccaaaggagaauaggggagagugguguguaggagggaggcaggagccagcuugugcuguaagagggggggcauucugccauguuuggagaaugaacugagacuagcaagagcagccauagcaaggucacgugggaggugauugcaggguccaaggaagagagucuaagacaagaugaucucuucccugccuggaaucugcugucaggaacaagguaccgggaagaugugcacaggaggccagcccugccaggcccaggagcagugguggaugcaacagggaaagguggugucuguuauuugagggauaauguaagcaagguucucuuucuugcagggcccaauggcugcaaaaucgcaacccaacauucccaaagccaagagucuagauggcgucaccaaugacagaaccgcaucucaagggcaguggggccgugccugguaaggaucuugccuguucucccagcuagaaaguaaaguguggucucagagcuuuccagccuuuggaauuguauggacccaaaggaaugaaggaccuuuuuaaaaaagauuuuuuuuuuuuugucaagacuaaugaaagguaaacaguuuuccacuuuauaaaguaaggaauuauaaaaagaaacuagaaaucauggucagucaacaacuuagaaaaaaagauaaaggcuuaaagggcagcuggggccuucccaccaucuggggguaugaccuauugucacagcucccauuucgccauagaaccauggggacuucgugcagggugaguauccucuccgaccuggaacuggggaaaccacuggccuuggugguugugaaagaccuaccuccgcucauauucugagcucugggccuuccaugggggccacagauagugccaccaguuaaucaacuacaguagagcaggcauguugaguggcuucccuggccgcaaggagggcccgugcuaggagcuaaugccuucugucaugggguacugguggguuugagcaacaguucucccacacagagccucuuaggguccugguggggcccagggcagaugggccccagugugacugccugcauccguccucgcagggagguggacugguuuucacuggcgagcgucaucuuccuacugcuguucgcccccuucaucgucuacuacuucaucauggcuugugaccaguacagcugcgcccugacuggcccugugguggacaucgucaccggacaugcucggcucucggacaucugggccaagacuccaccuauaacgaggaaagccgcccagcucuauaccuugugggucaccuuccaggucagcagccccugcccugggguugggacacagcagguggggagcgugcccuccugcugggguaguccuuccauuugucugggacauggauccuggcucagguugacaucuggguucccgggacccagcagggcauucccuggacucugacauguucagauucauccucagcuguaaggcaggaggcaccugucacaucagcguuugauacaccuucacggcaugccugcaugcaguugcugggcacgcccagcucugcagggacaagcugaggauaggagcaaaaccccgugggagggcagugcuguccugaggaagccccauugucagcaggagucacgccuugcaccaggucuggaaaggagcaucucaguccccaaagggacucucucagucaugagaugccacucagagaagcgagggccauguuuccccacaggcagucgaggcagguccaggacguccucagcuccaugguguccccacuggccucccaguccagagggaguuccaggaagggguuguuguaaaccuggugcacacauggguggugcugauugccugaacccaggaaaagguuuccagggaaacggugcuagaaagagacaggccuggguuuuccuuccugggcgggaggaaggcucagaucaugauuagcuguuucuccccaggguccaagcuucugggcuccagaauacuucucaguucagaucucuuggucccuuugagugaaaaaugacaggggcagugugaaucacaaauagccacaaagcaggaacccccaccuguccaucaguagaugaauggacccacagaacagaacacugugcccacugugggacacuauuuggcagcggaagggaaugaagcucugaugccaguaggcggaugacccuugaagacacugcugagcgagagaagccagucacagaggcugcauacugugugguucccuuuauaugcaauacccaguacaggcaaauccacagaggcagaaagcucaguggcagccaggggcggcagggacagggaauucagagugaccggagauuggaacaacauuuucuucuguggugaugaaaaguucuggaauuagcagugauagguguacaaccaaccauguaaaugcgcuaaaugccgcugaauugugcacuuuaaaagggugaauuuuagccgggugugguggugcacaccuguaaucccagcuacuugggaggcugagguggaaggaucacuugagcucaggaggacaacgcugcggugagcuaugauugcaccacuacacuccagccugggugguagaacaagaccucaucucaaagauagauuuauauauauauauaaaaaguugaauuuuaugggauucuccauuuuaaaaaggugacugggagggaccugugcgcucuccugaggggcgaauggagcccugggggagaacgccuuggcaccuucccugguugaugaguuuauugucucagaacccccuucaaaacccacagcccagcaguuugagcuuccaggagccauaagugcuucaggaagaaaaagacuaugauugugauucucauguuccugcuaugcgucccccuuugcaggugcccuccaggcggggggugaucaggcugcuuguguguuucaggugcuucuguacacgucucucccugacuucugccauaaguuucuacccggcuacguaggaggcauccaggagggggccgugacuccugcagguagccuccucccuuccacccuccccaggcucccguucucaucccuuucucucaggggccaguccuccccagcgcugcuuugucccuaagacuugucacaggauagaaauccauuuugcuuggauuuuucacagcaccaggccucaaaaccauugagggcagcuggggccaucccacacccagguuagaaaucacuuuccuggguaaggagggaauggauggcccagcuccuucccagccccauagcaggggaugcacucggcccaugaagcuuccugcagagaccaccaugcagagaccaccauuccucggggcuguccgugggagaccuugucuguucauuccuugccaucauugagaacccacgaggagccuggcuuugugccucucacgugggugcagacuggaaccgcaucccaacucugcccccagaagcucccuguuuugagggguggaugggcugaggugcuccccaacaauuacagagggggccaggcauaccacaggggcauccucacuugcuucugccccucagcccugaccucccuaucagacugcacaccugucacucagccuauggccaguuaacgagaugcagaaccaaaggauggacucagccuccccucccucuuccuaggagcagguaguuccuuggccaaggguauaggggccucagagaugguuccuggggccccagaugaggguccgcagcagcagaggcccagaaagugaccagggcccccgccaggcaugcuucagcccagccaagcuccucacugcggguugggaaagcgccuucauuucugaauccuucaucugcagggguugugaacaaguaucagaucaauggccugcaagccuggcuccucacgcaccugcucugguuugcaaacgcucaucuccuguccugguucucgcccaccaucaucuucgacaacuggaucccacugcuguggugcgccaacauccuuggcuaugccgucuccaccuucgccauggucaagggcuacuucuuccccaccagcgccagagacugguauguucuuagcagcggguccagccugauguagaaagugcaaacuucaccccuggccuuucuugcugccuggggcaggugguuguaaagcccugagcacugagaauccguggaagaggaggagggggauggaacuugcuucacccuggggaacauccuuucugaauguuugguggcuucuccagccuuggcaagaaugcagcugaagauggccaggucagcugugguggccaagucauugccuuuagggcuggcguggggguaaggaagccaggaaaaacuucuggcuuggggcacaggcagcccauugccucuuucuuuggauaagcuggugaggcccaaaacaaccuuagugaagagucuuauugucccuguggcuuuaauuaacagcuucccaggagagcccugcuggcuuguacccauucccauggcuggacaguggugagccacucaucucuguccacucauccauucaccugcccaucuccccacccacccauccaccccccuacccauucaucuaccuacucacccaucauccaccuacccauugccccaucccauucacccacccaccaaugcaucauccauccaccuauccaucacccacauccacccacccaucauccauccaucuacccucccaucacccauucauccaucugcccauccaccuacccacccaccuacacaucuagccacacacccauccaccugcccaucuccccauccuuccaccuacccacccacccauccaucauccaucucauccaccugcccauccacccuccaccccgucugucuacccacccgucaucuauuuguccauccaccuauccaccuacccacccaccuacacaucuagccacccacccauccaccugcccgucauccauccauuuacccauccauccacucuaucagggccuguaauggcaugugccgaggggaaggaaugcaucaucucauccaggucaaccuccugccugagcaauguccgcagcuccugaccggccucccuuacccucucaggcccuccuagccugcucccucuggcuuccugggugacacuucugaacacaccugaucccugccacccugcaccccagcucaacccugccuaucauauauccauccaccugcuccucuccccaucccauucauccauccuuccacccacucacccuguuaucuauccauccauccaucauaaaccaauguuugggggguucucuuguggacaguuguaggcagugggacuuacaguucaguuugggggauccaaaaaaccccagugugguuuacaccuaggcucuugggaaauguuucuggaggaugacacuuuguagcuuguguguuaucagauaacgaggcuggccuucaauggcuccuggaaaucauccucgcuaccuuauaaucauguagacuuuguguguuuugcuucuuucuacuuacccuaccugagggaacuggacaugaaaauaggauuuucuaguuaacacagaaauuguuguguguccucagccagcuagaccuagucagggucuccacagggguuaucucggcugaugcucuggcccuccggggauugggggauucagguaacuggucaaagaacuuguccugcacaugcuggaagccgggcccagggugcguuugucauucucuacguuggcgugauuuauaaugucacucacccaugagggcccacgugcccugcgucggcuucaaaccgugugcuugggccccagaacguaaucucagugcaaucaagccaguucuucagcucaccugugccaugcgucaagggcaucuggagaaggguagagagaaacccagguaccagcccagggccggucucccacccuucccgggugcagagcaggugccccugggcuucugccuaaggaagucucugcugagcagcagcugaaugcaaagcaaagugaaugagggcgccaggaaccagccgacaagcauuccagccgugggggucccagcggcucauggccagcuucugccugcgccgucucacguuacccuuuaggacccugggccagugcugggcucucgcuaaguaagguggcuucaucuugugagauaugcucauccacuaaauguaucuuuuauuuauauuuuuaagcaaauucacaggcaauuucuuuuacaacuacaugaugggcaucgaguuuaacccucggaucgggaagugguuugacuucaagcuguucuucaaugggcgccccgggaucgucgccuggacccucaucaaccuguccuucgcagcgaagcagcgggagcuccacagccaugugaccaaugccaugguccuggucaacguccugcaggugccugucauggcuggagagggugaaacgccgaugccggcaggcucugggggaacccgcaagccagagcguauucccaugaccuuaaucuacugcuuguaaaagagagucagcugcccuccccaggugucaccaggaagcagccggcgagcacuuggugaaggaagccauccuugggugccugucucugccagcccugggaggggaggaggcagguucuacgcagccaggcgugguccaggaaggucucccuuggggauuacaccuggguagaaucugggggugugugggaguuaaccugguagaguggaggcaagagugcaugcuccaggaacccccuguagggagagaggguggcaagucugggacacucagaaacaucccgcauccugaccagagagcguucaggagcucagagccaggugaggcuggaggccucauggaagucuuccucuuuaucuuaaaagcagcaagacccagaaagugugugcugagcuggggugcaggguggcagcgaucaggugcauucggaagcgucacccagggagccagcgggagcuggcuaggagaacccgagagggugagggaggccugucaggagcuguggacguugcucgggcaggagguugaccuggaugggaugaauguaucccuuccccuuggcacgcgccauugcaagcccugagaaccugggcugggagagaugccagggccaugggcucggggugguucugaggacaaggaagcccuuagcccugcccaugacccaggcaggaacagccccagccgcagggaaggaacagccccagcauugaggaaguugcugagcagcucccgagcacccccugcugcaucugcguggagugugauuuccccgagguccaugggggccccaggagggccggggguggucagcggcugcuucugucuugcaggccaucuacgugauugacuucuucuggaacgaaaccugguaccugaagaccauugacaucugccaugaccacuucgggugguaccugggcuggggcgacugugucuggcugccuuaucuuuacacgcugcaggugaggaggugggcagagcuggcccagcggggcauuuggcagacacaugcuaagcuuucuccuugcagaagcgucuguccuugggggcaccaaagcugcccccuguuucuaggaagaagggaaggccucguguauuagccagcucagccagcuugggccagcagccagggagguggccuugaguaugucccuaacaucugcaaaguagggcagaugccggcucagggcuggauggggcaguggagguggaggugggucagugcgggcacuggcaggagggguccucuucauuccugccuccuaggaugugcugggcacuggggcagggcugcccugggaguuccaggacaguaggggauagcaaguggccuugucauuggcaucaagccccccacuccccucccagcucaacgagagcagcccugcucugauuuggggagagugcugggcucccagguaagguggcugcuugaccagaugccaccugcccauuucaagagcaacgagcccccuggggacagaaauaacucaccccagggcacuugcuuagcagaacggugggguggccugccccaagaggcugugcccaaguggagagaaccaacguggagaggcugucaccuauucaggaugugacaggcccggcaucaccugugacagccaguccugugggauggaggugcggguguccuggaaaaccaggauucccacagcagagggggccaguaccagguggagggugcagagccccagcuggccccaugcucacaccagguccuuggagccccccgcauggcccacccggccccauuucuccaccuggcuggcugcaggucugcugguucccugguuuuauaaacuccauuuuccaaggaugugaaaacguagcaauaggucccacuauauaauagcucuuacuugcuuuagccucugugugugucucgagauguacauuuuuuauacuauauauuagguuucucccaagaagcagaaucaauagagggguggaggguauacguguaagaaagagauguauuuuucaacucaugugauugaagagugacaaguccaagaucuucagggcagccuggagccccagggaagaguugaugcugugcuuaaauagaaggucacuuuuuuuuuuuuuuugagacggagucucgcucugucacacaggcuagagugcaguggugugaucuuggcucacugcaaccuccaccuccuggguucaagugauucuccugccucagccucccgaguagcugggauuacaggugcaugccaccacgcccagcuaauuuuuguacuuuuaguagagaugggguuucaccauguuagucaggcuggucucaaacuccugaucucgugauccgcccgccuuggccucccaaagugcugggauuacaggugugagccacugugcauggccagaaggccacuuuuuagcagauucccucuucuuuggggaaggugggucuucugucucuuaaagcugucaacugauuggaugaggcccacccccauugugaagggucauccacucugccugguugacugauuaacauaugaaccucaucugaaaaaugccuuuacaacuaguguuugaccaaauaucugggaacaauggccuggccaaguggacacguuaaauugaccaucacaauauuaaauucagauuauauuuuuaauacuguuacauauuugauguuuaugcuauaugucauauauauaggggguauauauacacacacacauacacacacagacagguagaaggcagguagaguuacucauuuaaugaccacaacagcccucaagguuggugcuuuuauucacagaagagaacacggaggcaaggcgugugucagaggcagagcugggguuugaccccaggccgcugggcccccgagcccacacuccuguccucucccugggcaaagcaccgcuugaccccuucccccucgccccccagggucuguacuugguguaccaccccgugcagcuguccaccccgcacgccgugggcguccugcugcugggccuggugggcuacuacaucuuccggguggccaaccaccagaaggaccuguuccgccgcacggaugggcgcugccucaucuggggcaggaagcccaaggucaucgagugcuccuacacauccgccgaugggcagaggcaccacagcaagcugcuggugucgggcuucuggggcguggcccgccacuucaacuacgucggcgaccugaugggcagccuggccuacugccuggccuguggcggcggccaccugcugcccuacuucuacaucaucuacauggccauccugcugacccaccgcugccuccgggacgagcaccgcugcgccagcaaguacggccgggacugggagcgcuacaccgccgcagugccuuaccgccugcugccuggaaucuucuaagggcacgcccuagggagaagcccuguggggcugucaagagcguguucugccagguccaugggggcuggcaucccagcuccaacucgaggagccucaguuuccucaucuguaaacuggagagagcccagcacuuggcagguguccaguaccuaaucacgcucuguuccuugcuuuugccuucaagggaauuccgaguguccagcacugccguauugccagcacagacggauuuucucuaaucagugucccuggggcaggaggaugacccagucaccuuuacuaguccuuuggagacaauuuaccuguauuaggagcccaggccacgcuacacucugcccacacuggugagcaggaggucuucccacgcccugucauuaggcugcauuuacucuugcuaaauaaaagugggaguggggcgugcgcguuauccauguauugccuuucagcucuagaucccccuccccugccugcucugcagucguggguggggcccgugcgccguuucuccuugguagcgugcacgguguugaacugggacacuggggagaaaggggcuuucaugucguuuccuuccugcuccugcugcacagcugccaggagugcucugccuggagucugcagaccucagagaggucccagcaccggcuguggccuuucagguguaggcaggugggcucugcuucccgauucccugugagcgcccacccucucgaaagaauuuucugcuugcccuaugacugugcagacucuggcucgagcaacccggggaacuucacccucaggggccucccacaccuucuccagcgaggaggucucagucccagccucgggagggcaccuccuuuucugugcuuucuucccugaggcauucuuccucaucccuaggguguuguguagaacucuuuuuaaacucuaugcuccgaguagaguucaucuuuauauuaaacuuccccuguucaaauaa

SEQ ID NO: 191823 - RNA, 38079 nt, Homo sapiens
gaugcggccccgcccccgcccucggaaccggaaguagagccuggugccugggagcggcuggcgcggcggaauccagggccgacccgggccggaccgaccccaggcggcggugagcgagcgcggcguccgcccggggugcaggccgggcucugcuucuucccuccuguggcgucgccuggccgcgaaaggggaaggaagcggcggccgcagcggucucaccgcucuuccgcuugcgguuucgggggccggggcagaguggcgaggcuuucccggccuggggcggggcagggcgagggccggggguccgcgagggccacgaggacgggucugggcccaaggaggccgggcagggggcaagggggcacggagggcuuggggcugggguccgcggaggaagguuagaaaggggccaaauugggguaucagcucugaggggagggucccugggcgccggggggcuccagggcaggagaggggccaggcugggaggggucuuggguccgagggaauaggagagggggaugggcuccgagggggaggguauuagggcccgagggagaggggcugggccugugggguucgggggucugagcggagggggccgggguucgaggggccaaggaagguggguguggggggucucaaggaaagggcgaggggucugagagggaggugucugggugcagagggaaagggaugagguccgaggggaggagauuggggucugacgggaagggguccaggcgcagagcuacugggaugggguccgagggaagggaauugggguucgaggggaaggggucggggcucggaggaaagguauaggguccgaggggaggggauuggggcuccaggggaagggauccaggcgcagggaaaagggaugggguccgcggggucaaggcgguuggggugcgcgacuuugaggggcucgcugugggacguggcggagcagcuggggauccgcccggccugcaccugagcggagguuuugcaaucaggucaguggaggcagcgaggcgcggcugcagcuagucgugaggcucuaaauuuggaaccgucccuccuucgggguguguuuaaaaucaccagaacggugcuuuggggcuuucuguuacguuuccaucaccuggauagucuaagggaugccugaucccugaagcuggaaggccuugggugagaagggacagggcuuccucccgcuggaaucuguggacguuuggggccccuuggggaggaauucauuuucugcugaaggaagcuccggaggcauccggugagcgcucccuggaaucccaugcgcucccuuugggcucaguguugacuuggcugcgcaggcucugucggggggacuucacccacuagguccuucaggcaugauccagcccucaagcccggccgggcccaaggccguggcgcaggaggggcuggccgccugccccugucuccauucacguguuugaccgugugggugagucacuggcuccagagcacugagucaguccuguuucuccucugguuagagaaguauucgccagauacucaaggaacaaggaagagucuuuuaagugggacucaauaaaaaguuggggaggcaggguuguuuugauauuagguccccuagaacuagaagcuaaccuucugcuauaucuuacugaaaagaaauuucuuuugaccuggggcaggggugcgguggcucacaccuguaaucccugcacuuugggaggucaaggugagaggaucguuugaggccaggaguuccagacuagccugggcaacacagggagaccuugugucuacaaaaaaagaaauucgcugggcauguuggcuugcaccuguuguccuagcuacuuggggcgcugaggcagaggaucucaagcccaggaguuggaggcugcauugagcucgaucgcaccacuguacuccagccugggugacagagcgagacccugucacccaggcuggagugcagaggcucuucacaggugccaucuagcacacugcaaccuugaacugcuggccuuaagcgauccucccaccucagccucccaaguagcugggacugcaggcccagcuaaagcugacuuuuaauuguagcauuuugauggacuuguuuuuaaaacacuuuuaaaaugacagcacacauaaucggcaauucagaucuucagucugugccacgcaguaggugcucagaaaagguguccugagagugugaauugcugugagcgcugguugcugccuuguguugcaguauucccauggccugggccagccaagagcaggggacugugcuccaggagcaggcuuggcuuucacuguggcccaggcccaccccaucugcucacgcacugcuuugaguaaacggaguaaauguugggggcgggguuucccuugaguaagugugguguagggagugugccugugauggugauuuuggcuacgcaagugucuguuuccuuucuccuccugcucugccauagaugcugaggcuaauggaaagcugaugguggacggaugguucuguccugucauuuaaaacauucuucugccaggcucgguggcucacaccuguaaucucagcacuuugggaggcuaagggcagguggauugcuugagcccaggaguuucgagaucagccuaggcaacauggggaaaccccaucucuguuaaaaauagaaaaauuggccggguaugguggcucacaccuguaaucccagcacuuugggaggcugaggugggcagaucacgaggucaggagauugacaccauccuggcuaacacagugaaacaccgucucuacuaaaaaaaaaaauacaaaaaauuagccgggcguggugguauaugccuguagucccagccacucaggaggcugaggcaccagaaucgcuugaaccugcgaaguggagguugcagugagccgagaucacacuauugcacuccagccugggcaaaagacugagacuccaucucaaaagaaaaaagaaaaagaaaaauuagcuggguguagugacaggugccuguagucccagcuacucaggagggugaggcaggagaaucgcuugaacccaggaggcagagguugcggugagcugagaucacaccauugcacuccagccugggcaacagagugagacuucgucucaaacaaaaaaaaacaaaaaaaaaaagagagagaaaaaucagcuuggugugguggugcauuccuguaguccuagcuacucgggaggcugaggugggaggaucaccugaaccugggacacagagguugcagugagcugagauugugccucugcacucuagccugggccacagugcaagacccugucucagaaaaaaaaaagaaaaaaaaggcugguggggggcuuuuaggcgcggugguucgugccuguaaucccagcacuuugagaggcugaggcuggcaaaucacuugaggccaggaguuggagaucagccuggaccaacauaaugaaaccccaucucuacuaaaaauacaaaaaauuagcugggugugauggcgcaugccuguaaucccagcuacucgggaagcugaggcaggaaaaucacuugaaccugggagacagagguugcagugagccgagaucgcgcuguugcacuccaaccuaggcaacagagcaagacugucugaaaaagaaaaaaaaaguuauuguguagaggaauuuuucacucugucuagacagcaagauuacuucacguuugugcaaucuugauuuguacacugacguuugcaaggaagguuuaauguugaggauggacagagucauuaucuucuuuugaaccguauuguaacagcuuuaucgagauauaauucacauaccauacaauacgccuguguaguguguacucuccacugguuuuuaguaucuucaugcaguuguacaacugucaccacagucaauuucagaauaauuuuaucaccucaaaaagaagcccuuguaccuuuuagccaugaccucccuauccucaccaccaccauccgcccagcccugggcaaccagcaauguaucuuuugucucuguagauuugugaacuccagacauuuccuagaaauugaaucguauaauauguggucuuuugugcgugguuuuccuuugcgcaauggauuugaggucccuccacgcuguagcaggugucacugcuggauccucuuuguggcagaauaaaaugccuuuguguuagguagaccacauguuauguaucuaucaguugauggacauuuggaguguuucuguuuuuuggcugcuaugaauagugcuguucugaacacucacgcacaaguuuuugugugcuuauacuuuauuucucuugggcauagaccuaggaguggaguugcugagucauacaguaccugaguuuaaccuucugaggaacugccagaccuuuuccauuuaacaucccugucagcagucuaugaggcuuccaguuuuucaacacuguugcugagauuugucauuggcuguuuuauuuuagucauccuaguggguaugagguggguucucauugcaguuuugauuugcauuuccuuggugguuaaugacauugaacaaacuuuuccugagcuuguuggccauuuguauaucuccucugaagaaaugucucuucagauccuucaaucauuuuuaaaugggguuauucguccuuuuuauugaauuauaagaguuccuuuuuuuuuuuuuuuuuuuuugagauggagucucacucugucgccaggcugcaguauaguggcgcaaucucggcucacuacagccucugucucccggguucaagcaguucuccugcuucagccucccaaguagcugggacuacaggcaugcgucaccacgcccuguuaauuuuuguauuuuucguagagacgggguuucaccauguuggccaggauggucucgaucucuugaccuaguaauccgcccgccucggccuccgaaagugcugggauuacaggcgugagccaccucaccuggccaagaguucuuuauauauucuggaucuacaguucaaaauacuuuucucucaggaucgucuugucaccuucuugaugaagcacaaaauuuuuaauuuuguacaauuuauuuuuuuccucuaguguuuuggugucauaucuaagaaacuauugccaaauucaaagucacaaaaauuuacacccuuuuaggauuuuaguucauuuuugaguuaauuuuucuguaugguuuugagguagggcucuagaggcuuuuuaucuuuggauccacaaaacaaucaaacuuauuuccuauugguuauuuuugugauuguuuuuuaaauuuccaauauugagaguauaaaauuguggaucugagccuauccuuagcugcucaugaguagauuuuuauuauuuacuuuaugauugauuuauguaugagacagggucucucucugucucccaggcuggggugcaguggugugaucauggcucacugcaaccuugagcuccugggcucaagcaguucccccaccucagccuccugaguagcugggacuacagguauacacgaccaugccuggcuaaauuuuuaggcagaguuguauagaugcuugccgauuacacuaauaacugcaguaaccagaauguagcaagcaaucuguagaaguuaggauugccgaagggaacuggggagagagauggagcaaacaguugggucagaaaccagauaggaaauuaauuaauuaccaggagggccagccaggcaccauccccuaguuccuaaugcgugagaaaccacucugccugugaccggcuuguuccuagggacaaggggauuucauucguccauguguguugucuagcaguaugguguccaguugaggcugaugugugguccuagggaaggggucgugugcuuggccacccucuggggagcuggagucuugcucccugcgcgguaaccguguacguucauuaggaaugcagcccgccuccuccucggcucuccagcugccagucucaugucuugauagacagucaccauacugguuuuuccucccggccauaucaugauccucucaaggaguguuuuucuuauauuauuguuuuaaaaagcucacaguaacaauuuuauuuuauaaugucauuaauuagaaugaauaaaaagugaaaaucucuaagaauuauggcaaacaguaaaugcauacuagcaauuaaggcaauaauuucuguuugcauucauaagaaacaucauguaggccgggcgccaugccucacaccuguaaucccagcacuuugggaggccaaggcaggcggaucaccugaggucgggaguuugagaccagccugaccaacauggagaaaacccgucuguacuaaaaauagaaaauuagcugggcgugguggcgccugccuguaaucccagcuacuugggaggcugaggcaggagaaucacuugaacccgggagguggaguuugcgguaagccgcgauugugccauugcacuccagccugugcaacaagagugaaacuccaucucaaaaaaaacaaaacaaaaaagacaaaaagucaucauguaguuagaaaucuuuuaaaacuuauuucuuuaguuucucucuguugaacuuuuuuauuaguaaaaugcaagucuucccauccuccucucagauuucauuacaaaaccuuguuacguuugggaagauuucugaaguuuucuaaaaagaucuccacacagaaggguuugcccagggagcugcucaacauacauccuucucagcuuuuuacccuuaaucuuuuuacagacggaaucaguccccaaugccuggaaauuccucauuggauuacuguguuuuaaacagaauuucgugaacagccuuuuaucuccaagcggaaagaaagguacuugugcauugugaacauccuaacauucuuuuccuguggaugguaagggcaaaaaucccuuuaacaggaaacgggggagguugcuguuucuguggauuuacugggagagagaugauaauauucuggaaggaaauuucauuguuuaaaaaauaaagucagguuucuguugcauaugacuuagaggagacaauugcagaaaacucuggaauugaggaagagaaccauuccuguccucccugaggggaaaucuggccccuuccccaccccaugaacauggguggggcccccaggcacaggauugugaagcucgcaagugcccaccccgcucgcuggugaagcuguguccgggaagaugagcagagacugugcucugcuaaucucuccccgaugagccugaaaaaguaccaggcaaagacaccugccgccuuucuccuuugccuugggggugaagguggccucgccagcccugcagggacucccauccuuucuugcagccaccuucucaguggugggaaccaugggcagcugaaguccugcaggcgggcagcccccucgccagggcagcauggugccauggggcggccggagaccaagcaucccguuucucuuuccugcagccguugcuucauuuauaaaugggcgcguugggacaagauggacugguugugccuuuccguucugagauucuaguucaucuguuuucuaaaauccuggcaaaagcagaucacucuggaaauucuugccaugcuuugggcauugacagaagguuccaggggcacuguuaguccugcuacaccccuuggcagacgguucuuccccaagagacaaagucgcaccuagaaauuugagagcacgcugcccugauuggucccucacugucacauuggauuuggacuugagacccagccaggcuggagggagaggagccagaugggacauucucaagcugcgaagggguuuuguccaguccugauucagggcgcuagagucccaacauggcaccugagaaaaagugaauuggguguccucaguucagaccccugggcacagcuuaugguuguuugauuuaaaauaaucucucaguugcucuguggccuauguguaauuguauuacuauuucuguggaaaaggaaucacuucuuuuuauacauaguuugaaaaaaaaaaaaaaaccuuaaaauuuuauauuuuaccacugcaguuacaagaauugucuuguuaggguuuacagaugugccauuguucuguauaacagagaaaaccuuccagucuucaagggcugagggagaagguggcugcccacuugcagagcugccugauagaggaaaagguggcauuuuauauuccuguuuucuuccaaguagagaguaaagcaauucuccaauaaacuacuugaaacauuuauuaaauuguaagucugaauuaggaaaauuauuguuaugguuucaguaagcacuugaaaucaaaaugggugcacuuuuuaaaaaugugugauaaaauacacauaccaugagauuuaccauuaguaacauuuaguauauuuauaauacauaauccaaaauggugcuuuuauuuuugguuggaaacuaucaucauaugauugaacagaacaggaauauguucuuaaugaauaaauaagugcacacacgacuuuuuuauuuuccagaaaauuuucucacucaaggugaagccaaauaguauuuccaguauauuucugacgucaggugacggcaguguuagaaccccgaggugaaauuucuuuuacuccugugguugucagucaggcuuauggaucaugaaggauuggcugguccugcagccucguccuccuggguugccuagaaucucgguaguuuuggccaaagggcucaucugcuggccucuguggauggcgcccugaggccuccguaacccuccccggcugcucuuucagauguggaaagcuucagcaggccacgcuguguccaucgcccaggaugacgcgggggccgaugacugggagaccgacccugauuuugugguaggagccgccagccuuugcuuuccucuuucaugaaguggaaguggcucuccuggguuuuucuuugaugggguggugguuugucugugucacaauccaggcugugagauuuacuggucgcuuuucuuuucagaaugaugugagugagaaggagcaaagauggggugccaagacggugcagggcuccgggcaccaggagcauaucaaguaagaggcgucgccaccacccucccgagggccccucugcggauggagccccaggugcaacagggcccauggucaucuguggagggacagcccguguggaaacugcauuuaucuucuugaccugauacccaugcaguaaaugaauauaagacacacacauauauguguauuuguguaauguguguguuuauauguguauauuuagauacuucugugcucaguaauuuuuaaauucccauugcaaacaauuuccguauuuauaauuuuagaguguccgcuucucaguauuguggcuuuuaucagggaacauuugucccuaagcucuaccuuacaagcgagagguuucuaaaguaugagaugucugaauaacugagaccuuaaaugcccugucccuuuuuuuauuaucuggaaaugauuauguguuaauagugagguacugugagcuuuguguucuuaucgaaagcccagaguugggcacugagugaacccugucauuguuucucacuuggcacuaucuaaaaugccagcucuuggggcaguuuuuuuuuucgucagaaaguguagauaaaaggaacuuuuaaaauaugcucagacuuuuauuuuaggccacgcuggguucagaguggauccuccuuucccuggcugugaaggcagcaccacugacccggugaccgccucaguaucccgggaagacugucccgcuugaccacggucccuucagcugagaaagauuuaguccuuccuccagaaaagaaggcacagccugcacaauggcuuuuuauuuuguuguuaaagauuuauuuauuuauuuauuuauuuauuuugagacagggucucacucugucacccaggcuggagugcaguggugcaaucauagcucacugcagcuuugacuuccuggguucaagcgauccucucaccucagcuuccugaguagcuggaaccaugggcgcacaccacaauggcuagcuaagugcuuuuauuucuuguaaagaugaggucuugcuuuuguugcucaggcuggucuugaacuccugggcucaggugauucuccugccucagccucccaaagugcugggaucacaggugugugccgccgcaccuggcccccaguggcuuuuuauacacaaguuuuagucccucucuggcuugcucagcacacucccuuccacagaagcagcuucggaacuccgguggccgugcggcugcccaggacaagagacuggaauggggcugacuugggaguccacuguagccuuggguauuugcuauggcguuaagcagacuccugaauucguugagucaucauaccucuucucaucucuucuguucccuguggcuucaaaacaugucucggaggguggcuuggagaaaaaacaacucuccaguacaaaacccuugggcugguuaggauucagagaggaacacauggggaauaagcccauucuucaugcucuggggccuucccagguuuuaggaguggugucuuucuuucuccugcucauaaggguauugggcgguuuccaagccugguuuguauuucaucuucaauucuaggauugucguccagaugucaaagguggcguccuggugucuccugggcagaaaguccgaaugccaaaguggccuucuuaucacucuggggucucucaaugacagcugugucuggccuaccagauuugagcaaaccuugucaucuguuucauuaucugcuguauuaaaauuuuuuaauggcauuuagauguuaaauucugaaacgcuuuccucucaucuuugaauguauaaaaaagcuggaguacuucaaguacagacgaaucaucugaauguucagcaccacuggacuucugccaguggccgaggaagggaccauagccucguguuucccccucuaccucuggaugauuacagacuagcuuuccuauuuucugcgugugaaauaaaggucaggcuucaguagagccaucuuuagcggggauuugggaugaucccagugucugccuucagauucguguucugucucccacagagcaugcgucugauacugcagacugccgaaguggguguaccagccggcagaauagucaggaaggcacagugcagggagagaaucggugaacaucagauaagcagauuuacaaauuuacaaagauaaugucaccuguucuuauuuaucauaccaggaggcaaagcugcacgucuguuuuauugaucuguuccuauuuucaucucuuccaucaagcauacacaagcugagggagaaugucuuucaagagcaucagacccuuaaggagaaggaacuugaaacaggaccaaaagcuucccauggcuauggagggaaauuugguguggaacaagaccgaauggauaagguaaguggcccgcggcugccuaugccaggcuccuggugugcuuggaccacuagacuggguggcagagucgucccucagucuuuccuuagaucagcaguuuugaguccaucugcugagguugcgauuugcccggaguagaccccuguugauuggacuuacucaugaaguacucuagcuuucuucaaagcucuuuaggaauccucagaggugcuggagcacggguguuaguggggaggcccagagagggagauuggcccucagaggcagccuugugauaggacagaaguccagaagcauccuggcucuaggugucaucacugucaaugccugugguuccagucuguagccuaagucaugccaguccgaagaccaaagucaaaucuguagguccccaugguucacagcacacacggaauccagccaaaggccuggcuaacauccuucaugcguucagugaccaucagagcagucucccucguguaaauucggcgcguaccaggcuggggacagugcucacucuauucgagaggucugggcaagccucccagcagcugucauugaugggaugcagacugccacgcagacguugauugaggacguuggccaaaugcauccggcugcacccgugcuuuagguccucucuaccuuaagaaagggagccacguuagcucaggagggcuaccuuuuccuuccuggagagaagauggaagagaucgcaguguguuugcauguuucuucaguaaaacagacauccuggaggugaacuuuugagucugagcaacauaagcuuguucugaccugacagaugcuugccuuuacucuguggaaagaaguguguuagccagugucggauuccagccgguaauuccauaccccucucccaccucaugcaccagccagaugaacauuugagcugggcacgggaugauguugccgugucacagugagcugcaccuugcucugucccccgcagaguagaugauguggugggccggcagggcaccccaaaccacgaccauaaauagccugggggaggaguggggugagggaccuucugcaggaaagagacauggauguugcugcgucacuaccacagagaugcccugacaccgagaagagcaaugugugcagaaucaucaucuuuggagucuaaaaaaagucugguagcuuuuaggaguguaaacaggcagacggaccccugaguucagugcagcgagcgaagcaagugcacacggacagacggaauccauguguucagugcagcgagcgaagcgugugcacacggacagacggaauccauguguucagugcagcgagcgaagcgugugcacacggacagacggaauccauguguucagugcagcgagcgaagcgugugcacacggacagacggaauccauguguucagugcagcgagcgaagcgugugcacacggacagacggaauccguguucagugcagcgagcgaagcgugugcacacggacagacggaauccauguguucagugcagugaacgaagcaaguagauaggagccuuucccacugcagacugaggcgagcccugugcuuagggggcuuguggggaguuagcgcagagagacauuuauucuaaaaauggggcucccugcuguggguugggaaaauuacauauuggggaaaagaaaggcaacgugucaggagagccugguagggaagcugcuguggcuucucugcugcugcucggccugcaccuuuuuucagcgcgaaucucgcucacccuagaaccugcagcucaggccuucccgagugccaggagcucccuggaagagcccucacuucccucucuccugugcggucuccacagcagccucugcuucccucaugagcuguccuugccucauccugcuguccuucccagggagacuccccuccgggcugggcuuuucaagggucgggacuugucauccucaccuugugccuggcucagugccacgugccccccccuuaggccagugcucucauggaaccaaggaggcuuauggagccuugcucucaccucucagccggcaaguuggagagcuguccuagcagggcgaguccagcaagggaugcugcugcugcucagucccagcuggcaucggggccagguuagcgcucagcucaggucagcaccaugggacagauacguugucaaaaauaacucagggccagguacgggacuggcaccuguaaucccagcauuuuggaaggccgaggcaggaugaucuuaucagcccaggaguuugagaccagccugggcaacauagcaagacccuaucucuacaaaaacauaauuaacugggcaugguggugcacaccuguagucccagcugcuugggaggcuaagcugggaggaucaccugaaccugggagguggagacugcaguguccugugaucgcaccauuacaguccagccugggcgacagagagagacgcugucucaggaaauaaauagauuaaacucagauuccaaaccgaaggggaaacggcuuaaguuauuuguaacuugcccacuccagaaacuaaaaaaaaaauaaaaaauugaaaucucugcguuaagacuugaggaauaugugcuagagacuuccagaacaaaagaagacauugaggacaagcacacgcgagaggagccuggacgggcugucaggauucuguuuaugcuggggccugagcacacugcaccuuucccuugcggccagcgguggcugcauccaucacgcggggcaggcuuccuucuugaucccuugucuccuugcaucccguagcccugagucuacauauucaggcuucaagauacaaucuccccagcgugauuguuuaauaacagauuuugucaaugugaaaucgaaggcaauuuuggagaugaaucccuuucaaucaaaaagcuggaaacuuugccuaguugucauucugggcaugucuuuagaucaguuuuccuguaacuuccuucugaugaaaacucaugcuggggaaucccuuuggcacgucugccucugccacuccuucaucucuguuuucugggugagaccccggaggacacggaugggcagucucugccacagaggguuuggaggugauggcucauguggaaagagagucagcugccaaccucaaaacaaacgugggaagaagagggcgcagcacaggcccaaggcuuagggcaagaccugcuuuuucaauaggggaaauaguggacacucucugaguugccugcugcgucagcaccggugugggaugcugcuuggguuagcagguuagcaugaguggcuccacaugcuagagggagugagaagaggggucccgaugugccguggacuuucuccacgcccucugcugggccaugugcccgcacugucugugaaggaguccuugacccggcucugcugugaggagggagccucagaacccuggggccucggugucaggacuggagcagggccagugcuuugagguaggagaucuuuuccacuuuguggaccagagggucucucaauagaacugccgaacggaguugcugaaucacacaagcagcuguggacagcacaccugugaauggcuguggcugugucccagaggcguuauuuacagaagagcugggugccgggucuggaaagcccaggggaaccuugggcuuuaccugcuggcuuuggcgaacagaagguccccaaaccugugugcgcugaugggggcugacgacauuaaugaugcugaaaugagcuggcaugggagccggcagcuggcuccugccugaacagggugcugcucagcggaaauccagugugagccugugucuugcagacuauuuuuguuuauagucuauuagaacaaaauaguuugcuggcagacuauuuuuugugccgauucuuuggucaugugauucacagaggucccacuucaguagaugccagcagucuccacaccagcgggucucacggauccugccacaggcugccagcucuguguaccuucuucaugcccggucgugucagaaauccccacugguggccccgaccuguguccaggguucgugugcagcuuccaggagcccaagggcuggggugggccgugaaagccugcaccaagggcugggcgcggugucucacgccuguaaucccagcacuuugggaggccgaggcggguggaucacaaggucaggagauggagaccauccuggcuaacacggugaaaccccgucucuacuaaaaauacaaaaaauuagccaggcaugguggcgggugccuauagucccagcuacucgggaggcugaggcaggagaauggcgugaaccugggaggcggagcuugcagugagccgagaccccgccacugcacuccagccugggcaacagagcaagacucugucucaaaaaaaaaaaagccugcaccaaggacccgggccucccaggagucgugucgccuuccuuggcuccccagauggguguguuaauguaagguuucccugcacugaccaggauguggccucccccagcccugcucugggaggaagugaagcgccgcaguguuguuggugucuaaugcuuuguguuugaacccuguuccagucagcugucggccacgaauaucagucgaaacuuuccaagcacugcucgcagguggacucgguccguggcuucggaggcaaguuugguguccagauggacagaguugaucaggugagugauguggcacugggacuggggcagguuggggcaaggggggcguuccccguagaucugagcccuguugggccacuuguaguagcaggcaggugcccuccagcucugggggacugcagagaggggcaucugccucccaggaugcucugagagccugggcucucagagagaggaagcaggaugcggcgggcuugcuguagcagucccugcggucgcucuucacuacgugccucaguacuggauggcccugugucugucccaaugugccagcagggaccguuuccacccguguuucucacauguguguuacugugacagagugacaucagagccuauaccgggggggcaggaugcgcucguguccaggacccaggcuuugcguccagguguuguugcagucauccuaggcccgagccucuuugauucucuucggcucgggucuguuggcucuuuuguuuaauagaggagcgaucaggagccuggagggagcagggagcugaugcuggucgcagauuguggcuuugugacauauuagccacgguucugaauuuaugugucugugaaaggaggaugaucauaccuaucucacggguguuugcucagaugcccaucgcagugccuggcuggugggagugcaccccugguggccacugcuauucucauuacuaauacuaauguucucagcaugacuuauuugagaagcgaguuuuugugaagcccguggaaugaaucagcugagcauucccugcugccgcaugcuggggagggcaggucaccagggauauggcuuggccugcgccgcccacugggccuugcagugggccuguccguuuaggaugccagagcucuugcgucacugccaccugcaccuggcuuaggaacccagaggucacagcaucauguguuucauauuuuuuuaaaugucaugucaugaauucagagagauuguuucagggacauuggaaaguauuucuccccacuuuuucauguguuuuuggucgucacagucugcuguaggcuuugaauaccaggggaagacugagaagcaugccucccagaaagguaagacgcgaaaggugcagaaagagcccgcuccgggggccccgauggggagagucacagccaccugaagccguuuccccgcgcuccgggggcccugauggggagagucacagccaccugaagccguuuccugagcgguggcuguugccacaaggaggacucugcccuccucuucauguuucuggaucaucuggauaccacaugauggauguauuccccguuacacaucccccucggagcccuggcaucugcugucauuguggggcuucucccccuuguagcggaagccgccuucccuucaucugggcagcgcuccuccuggaaaagagagcucacagauugaucggcagaaagcuaacuuccccccaaggcuagaaaccagaguuguuaaauucuuguuuuccuuauacacauacggucuuaacugcuggugauuaaucuugauuacaucaugcagucucuuuuuugaaagaccaaagcauaucgccaccuuaaaguucucaguuuauuuuuugcaagcuuauuuaguucuuccuccuuugugucauugcaucauccgcggaacaagcucucaguccuuacgcagucucggugcagucuagguggagguagcuguggugugggcaggcggaggaucagggucuugucucccauguucagcugcauggcuuucuucauaugaggcuuucucuuuccauuuuuuucauuuuguuuuguuuguuuguuuguuuugagacagagucucgcucuguugcccaggcuggagugcaguggcacgaucucggcucacugcaaccugcgccuccuggguucaaacgauucuccugccucagccucccaaguagcugggauuacaggugugugccacuaccccuggcuaguuuuucuauuuuuuaguaaagaugggguuuugccacguuggccaggcuggucucaaacuccuggccucaagugauccgcccaccucagccuccaaagugcugguucuuuguaugaagcuuuccagcuuuuaccugagcaguugauuuucaaagugggcaugcagcgucauuucugacuacacaaaggaacugcccuguaacagcugacagggcccagaacccccccaugcaccuguugugaaacaggguccagcgucaccuguauggagcaguggguggcuuguuguacauuuuaaaaugugcgcuugauguguuugugaguuguaaccccuacacacuuuugcuuaguuuaacaaaaggaacaguguaguucguccucaggcccccgugcuaauugcugcccugucucuccagacuacuccagugguuuuggcggcaaguauggcgugcaggccgaccgaguagacaagagcgcggugggcuucgacuaccagggcaagacggagaagcacgagucacagagagguggggcggaccccacggucuguaaucacgcguuugcuccagaaacacccacgagggcauuuucucucugcacacgugauuguuguagauuuuuuaacugaaaauguuugguguucuuuucguaccaguguaugugggcuuuuccuaauucgaauggcugcacaguuccccaucguaugaggauuccauaguccauguaaccauuccuuuuuugaauguggaauuuagguuauuuauuuauuuauuuauuuauuuuugguagagaugaggucuugccguguugcccggacuggucuugaucuccguggucucaagcaauccucccccaccuugguuuccuuaagugcugggauuacaggugugaccuguaaauuuuuuuuuuuuuucuuuuagacggagucucgcuccguugcccaggcuggaguguaguggcgugaucucugcucacugcaaccuccaccucccugguucaagcaauucucgugcuucagccucccggcuagccgggauuacaagcacacgccaccacgcccagcuaauuuuuguauuuuuaguagagacggaguucugccauguugcccaggcuggucuugaauuccugaccucaggugaucgcccugccuuggccucccaaagugcugggauuacaggugugagccacugcgcccagcugaaacuugacugcagggaacauucuuguaccuguguuuuguucacaagugauuauucaaaagaaucaacuccuagacauggaauugcugggucgaaggcuauugaauguaaaauuuccauagauacugccaaguuguccuuggaggcugugcugaguucuuccuuccccacugcauagccuguacaccaucacucagagcguuucccagggcugcagaggcuguggccugccuguuucccugugccucuuguuuggccugcacauuuaaauuuuuaaaaauauuugccaacauuugaaaagugagagcuugacuauuuaaaaacucaaaaaaaaaaaaaauuaccccaaagcaagaaacaccacuggaagauccgaccaugcuggcuuggcauuucccugaggaaagugccgguggccuggagggcagcuuggcuuguaguuugucgcggccuggccuggccuugccuuccugccggucaggccuugccugccgcacagagcugcuugccucugcucucugccucuuuccugggaacaguccauuccuccucuucccgacaccacacaguugugagcagcgcaugcuccgcgaagcugcaugagugugugacuccagggagccagggagcacaggccgagcaccugggcagacgcaaggcuccuuggaugcuucaggccuucucucccaggccuugauccucugccuugugcuguuaguggguccaugagagagucauguuuuggugucacagugacaugcuaaauggcuucauucugaguagaacugaaguuucuggaggaugcuguguguguccuauuuccuggcaucccccugcgugcuucaguuugugaagaguggccuuugaaagccuugcccuucugcugccuccugagcuuagagccuuaucauaaacucucaucuccugcuagcuucuggaugcaauggaugauguuacaggaauucaucugcuguacuuuauuucuuuuuuuuuuuuuuuugagacggagucucucucucucgccaggcuggagugcaguggugcgaucucagcucagugcaaccuccuccuuccggguucaaacaauucuccugccucagucuccugaguagccgggauuacaggcaugcaccaccaagcccagcuaauuuuuguauuuuuaguagaggcgggguuucaccauguugcccaggauggucuugaucucuugaccucaugauccgcccaccuuggccucccaaagugcugggauuacaggugugagccacuguguccagccucugcuguacuuuaaaaaaaaaaacuuuuuuucuuaauucuuuuuuuuuuuuugagauggaguuucacucuuguugcucaggcuggagugcaguggcgcaaucucggcucacugcaaccuucaccuccuggguuccagugauucuucugccucagccucccgaguagcugggauuacaggugugggccaccacgcccagcuaauuuuguauuuuuaguagagaugggguuucauaauguuggucaggcuggacuuaaaccccugaccucaggugauccacccaccucgaccucccaaagugcugugauuacaggcgugagcccccucccccagccuguuuuuugaauuuuuaaaauauuagcuaaugauuuaacuuagagauggggucuugcuauguugcucaggcuggacuccgccuccugggcucaagugauccucccuucucagccuccugaguagcugggcugcaggcacacacccccaccucugguuaccacuguuuguguuucuguuauuacacauaaauagcaccuuuaaauacugucuguauuauucagugguccuacaguggaccugaaagauuuuuguuuuuuuaaucaaaggauaaaauacuugcauguucacugauuucguugcuccuuuuaaaguaguccuuuuuuguuuguuuuuagauuacuccaaagguuucggcggcaaauacgguaucgacaaggacaaaguggauaagagcgccguuggcuuugaguaucaaggcaaaacggagaagcacgagucccagaaaggugucuuccguuuuaucuuacccuccagccagcagcuaguaaugugacaggugguagccacaccggaaaaggaaaaacaaagcguuauugauagcccuuaacguagaugucucuuuuucaugaaaugcccaacuugaaaacggcacauccagaaacacagcugcuaaauaggaacucgcagcuugaguguuauggcgcuccagccccagcggcguugcuuaucgugguggccacaccccgcacgucuguguugcccgugugagccugugcugucucauggugcggguggaagccgcaugcgugggagcuuccaugggguccugucuggcuuagucacgaugcugaggucauagacuagguuauuuccugccacucuccaaggagggccucuucauggauguuaucuaaaguauuaccaaagauccggaagggaagaguagauugagugaaucauaugcguuuaacuguauugaaaacauacuuuccaccugugaccugcacuaccuguuaaugauggguucuggccuuucauugugcauguagacuaugugaaaggguuuggaggaaaauuuggugugcagacagacagacaagacaaaugugcccuuggcugggaucaccaggagaaauugcagcugcaugaaucccaaaaagguacauucacucugccuguaugcgagaugguuuuagaaguuuguuuuuguuccuugcggggucaguugguauguguugugucugcgugugccugcugcacauuguuuugucuucacuguuugaaguuguccugugugcccccccaaucccccaguucccuccagcuaguguagucacaaacccucccugcugacacggggugguaccccagagagcuggguuuaccuggaaguggguugcacgggccaagccugcagcagggggcuggguuuacccaggaguggggacaugggucaagccugcagcggggggcuggguuuacccgggagugggggcaugugucaggccugcagcggggggcuggguuuacccgggaguggggacaugggccaagccugcagugcuccucauccaggcuucuugucuauaaagugggccacgguuuuuggcaggagauacuuacuuuugaaccgaaaguguuuucuuguuggaaugggugccccuucccuggaaaaaggagccugagggggcugaaagccucucagugugacccagcccugagagaagcaggagcggggcuaauggggcugcagcgcccuccgaaucugcagggucucuccucccguguacacagauacgcacacucgucugcagugugcguaggacgcuaagaaugaacugcacagccgggagugccuuuacugaauuauuugaaguacaguucuuaggcuguuccagaucuucgcugaauguucagauuuuaaguucauucuuuaacguugaccucuggagccaccuucuggcgcugagccugggaguaggaucucaaaggcccuaagcucaggagagcccuugcuuucuggaaacuguguuugauuuuugcgcaugcucaugcaauucuaacccaacuguguuuccucuuuugguuguuuuccccaccguugcuuguggauuuucagauuauaagacugguuuuggaggcaaauucgguguucagucggagaggcaggacuccgcugcugugggguuugauuacaaggagaagcuggccaagcacgagucccagcaaggcacaguugccaccagccuccuacccuccccccgacccuccugugcggccacuucuagcacagacuucagggcucaccgucagcaccugcaacacaguccuccugugucaccacuugucagcugucaggcuguucggcacuuuaaacccauuucuaguagagcgacacugauuuugagugguucacuuucuucccugugaacuugugaucuguguauggcaggaugcgccaguuagugugugggugccaucuuucuaacccggugacccauccagucucuggacuggggcaucuccggucuccagcagcauucugcccgaggcuguucugcuguuauuggugacugccgugagccacugagucaggccuuccagaugaggagagagguguugguucaaccaaaccacuggccauuugaccaggggcuucguagcagcaagggccaggagacaggcguguucugugugguuucuguguuucauuuguggugguguuuuuggccgggguugggagguuuuuuguuuguucuguuugaugacaccauauguguguaacaucuccacacagagccacacaguauguacgugaagccagcucugcauccuuccuuagagcaguuauguuguuaccuucaaaauuuggacuugguuauuagaaccugaacacauaauuggaaaaacaguaauucccuaaccuugcagggaagacucuaggcuuuccaccugcagcguuagaaacacacagcaguguucaggugugggcagguagacacaccugggguggucccgcagacugcauggagauggcaguggcucuccguggcaucacugcugcaugacagugugacuuucauguggaucuguguugcugcaacggaagucuuuggcugguagaauuuccacauggauuuuuuuuuucucuuaaaaagcaagagaacaaacugcgauugagccucuuuuuagcgcucaguagagcaggcgcacaggaagcagaugagaauaagcccgugcuggugcggaagacugugcuauugaaguggcgcguugcaaaggccuguccgugcccucuuuccucgcuuagcuccugccugcugcccgccgccccuccugccccuccugccccucagggaaugcugaagccucugccccuggccugugcucugcuucucacugccugugucucacgaccauggguggaagcaaaacuugccuugcaagugaagccucgcuuggccauucucguuucuucccgcuguggugcaccuucuugggcuguuucuggaucugucugcaugcacccacggccacccccaugcucgccuccaccucagaguaaguguuguguuuugccacguuucagacuacuccaaaggauucggcgggaaguauggggugcagaaggaucggauggauaagguaaauauuccagccccggagcuuagugucuucugccugcaggggcucuuggugggcguggcucaccgugcuggccaacauccacgcgcugggguggggcacaagugauuuccgucgugguggugguggugguggcgaugacugacucggacagucuugugcuccucauggccgugcugugggauaggcgcuggcaccggcccaccuccuaacugggggccccaggccaggcaggcucagcaccuggcugcagccauaggaacccagauguuuaacaugagaggugagagccucgagggcucauguccauuugaacuuaaauucuuaauaguaaaucagauuggaaccugaguguguuagacugcguguggggcuaccucgcuggcagccagcgcugcgugugcggugaugagccaugucucccgucuucagccucguagagacgcgggcuccacacugccugcuccugcgcguggccuguggucagggguggcagggucaguccuugccucgcagcugaccacacagcaccauccaggggcguaggcaggcagagcagguguucgggcugggcuccccagggagcaguagccugggcucauuucugagggcaggcgcgaguucaccaggagagaaggcucaggagaccacggaggggcgaggugugggccugggugggacaggagucacugcagguucucaaggagccuagcugcagagggaggguggggagcggggauagagcuggcccuggagagccccacacaccacagagcauucugcaugucgugacaugcgucacacaccacagagcaucugacgugcguggccccagaaagguuagcaggcaaggaacacugggggggucuacuuugagaagcccccggccucagcguggagucuggguuguggggguuggccugggcagaggggugugguccugaagagagcuggaggggcucgggugguggagaagcagggcaugguguuuggcgccaagggacgcaggggagggagcagucggguggaugugggguggacguggggccaacuguggagccgaagaacugggaggagcagaugugggugucagcgagagagagcugggguagggccggggccggguccggguggcgugcagaguugggaggggaguaggcacgcggucagaggacacugggcagggggacccagugagguagcaggggccuugcaaggcacugggacagacggagggaaggagcuccccugugggugagucagagguuguggcuuugaggccggaaccugagggacugccuguguugugggugucuguggucagcauugcugguguuggcggugaccgcugagcuugugagcacgugaggaggcaguguguggguguggccuuucgugucauugucuuucauccaggaggggguggagcuucucucucuguuugcugugugauggaggaguccaaggcuuagagagggugacguaacugcccggguccccauacauuguggggauagggcuacaacccaggcugggaggugaaguugcccccucagggcaaggugaugucugcagagggcccagugggugaugggacccaguaaggcugauggccuugccuuugaacaggugcaagcagcucaagggacauggaguagacgcuggagcugacugaugggaggagggagcgggguccgaggaaggacaggcgggccaggaagggggcaagcaggaggugcugggcagaaaggggccaugguaugggggcucugguggcuucugagccucagguguucucaucagagguagugaaacccacagugaaacuggguacggccacuggucuccaugagcccugacagucuccaccugagucagcacguaagagucaucgccgucgcuuggucagaccauaguugaguccccugcaaugcagaaaggugugauugcaccacuggguaguguguaggacgggccacuggaggcuugcauguguccccagcgucuucgcuuccuguaaaugcucacaccucuggguggcgacggaggguggggaaggcuugaggcugaucccagaauugguuugugguagagcagauggagauacaugcauuucuuaugcuaaugcugacccacgauugccugcaaaugugguugguaauaguuuucaugccucaguuaguuugcaaaaccgagaggccaugaagagugcucugggcuguguggcugggccuuugggaagaucuggggaaggcauuugcaucuggcaggagcuaccacagggcauggagaaaagagaaaagugcucuccugacgcccauguccugucucugcagaaugcgucaaccuuugaggaugucacccagguguccucugccuaccagaagacaguaccugucgaagcuggugagucccggcugauaccaggagcaccgugugguuucccaggaaaacacugaggggaaggacaguugugaaacagccaggagcagaugcaccacuaguugaaagcgugguuguugcugcguauuuuugggaaagaaaaugaucguucugaugaagaucuuguuucuccugcagagguuuagagucaccuuuuagacgcagcauggugcagccguuucaguggggcccguuucaaggggcucuucccagagcaaaggggcuaagugcacauucacaagggccuccacacugccagugaccagcuucugggagcagcuggggccugcccaacucccugagccgcucggucgcagcugugacaggaggaagacaucaugacgucgaugugcaggcgacagcagacauucucucugcugcucguucuugggcccuugacagggagcucgaaaccuguccuuuucugugcuggacacacgauggagucagaugugggcccugccccggagagucaaguaguuggggaaaauguuauacauacaugagagcaagugcuaaauuuaacacaggaugcagagagccaccacugacuuccuucaggggcuauggacccacaguucucagagauugagggcccaggacgcuuugacacuuugaccacucgugagaacccccaagauguugauguauuugaugacauugacuauauuagaaauuagaggaauguggcccggcacaguggcucaugccuguaaucccagcacuuugggaggccaagacgggcggaucacgaggucaggagaucgagaccauccuggcuaacacgaugaaaccccgucucuacuaaaaauacaaaaacaaaauuagccaggcaugguggcgggcgccuguagucccagcuacucgggaggcugagacaggagaauggcgugaacccaggaggcggagcuugcagugagcggaguuugcgccacugcacuccagccuggaugacagagcgagacuccgucucaaaaaaaaaaaaaaaagagagagaggaaugguuuauuuauuuauuuauuuugagaccgggucuugcugugucauccaggcaggacugcugccucagucuccugggcucaagcaguccucuugccucagccucuggaguagcuggaacuauaagcgcaugcccccugcccaguuaaauuuuuuuuuuuuuugagacagaguaucacuuugucgcccaggcuggagugcaguggcgcggacucggcucacugcaagcuccgccucccaucccggguucacggcauucuccugccucaagccuccggaguagcugggacuacaggcgccugccaccacgcccggcuaauuuuuuuguuguuguugcuauuuuuuaguagagacgggguuucaccguguuagccaggauggucucgaucuccugaccucaugaucugcccgccucggccucccaaagugcugggauuacaggcaugagccacugugcccggccaaauuuuuuuaucuuuaguagagaugaggucucacuguguugcccaggcuggucuugaauuccugagcucaagugauccaccugccucggccucucaaagugcugggauuacaggcaugagcgacauuggaaaguuauuaauugguucacuuaaaaagaauaaaccuuggccgggugugguggcucauaccuguaaucccagcacucugggaggccgagguggguggaucaccugaggucaggaguuugagaccagacuggccaacauggugaaacccugucucuacuaaagauacaaaaaguagcugggcauggugguccacgccuguaaucccagcuacucagaagacugagguacgagaauugcuugaaccuggaggcagaggucgcagugagccuugauugcgccacugcacuccagccugggcgacaacagcuaaacuccaucucaaaaaauaaaaauaauaauauaacuggccaugcacaguggcucauuccuguaaucccagcacuuagugagaagaccggcauuguuuuguuuuguaaaucucuuuaauagaagauggcugcacucucacaucugccucugcagucuaucgauguuacguuguuuaggaagaacauguggaaucaccuagguaggcgauugggaaagggaggaguguuuguaaccuugagggcagcguggguguccuucugcgacgccgcccaagcgugccaggcaguggugguccugcaggccggcuccucuggcccugugagggacucgcuacccacugugcuugggcagcacuguguguuggucauuuggaaaaugcugggucucugaguugugcucgucuuccaguuguggacacuucucauuccacaauaccaaaaaaaaucacauuugcugucaucaucuauuucaucugcagaagcugaguggaaaucagcauguucauguggcagccucacauuuuucaaaauucugucuuuuacuugaaagcuggaauuuucccguuggcaacaaauacuccaguaauuuuucuugacacaauaggcuuaguucauucacuugggagaaaacuguugccagauacccagcuuugcauaaccauaguuggacugucaguuguuauuucagggaaaaacgcuauuccaugagaaaacagucaacuugcagcucucaugguucuauucaugguccuugagacacagacagccaccgccacagucccggacacagcagggaaggcucaugugucuucccacuuuuuuuuuuuuuuuuuuuuuuuuuuuuuuugagacagagucucgcucugucgcgagacuggagugcaguggcacaaucucggcucacugcaaccccugccucccagguucaagcgauucuccugccucagccucccgaguagcugggauuacaggugccugccaccaagcccagcuaauuuuucuauuuuuaguagagacaggguuucaccauguuggccaggauggucuugaucucuugaccucgugauccgcccaccuuagccucccaaagugcuggaauuacaggugugagccaccaugcccggccauauuccccacuuuugacuuaaauuuuuaucauuuuuucuuaauagacacggggucucacugucuuucccaggcuggucucaaacuccugaucucagucuucccgucucaaccucccaaagugcugggauuacaggcaugagccacugcccucuuuuccauuuuugucacacacaauauaaaaaaauguauacucugguugagauuuacuauacucaguauacgucaauuacaguauacaucaguaccuuaacugcuuuaucaaggacagaugucuuuaagggaaauuggcuguuuuuauuuaaaaaggugagugugguggugaagauaccgucuuauuuagagaucuuccugaugccaggcuuagggggauugccagucccaccagguacgcagugcccugcggcaggugcccagugcuggcuccggaccagugggcugagcuggcagcugcaagaaccuuucccuccuuggggguuagggggaugaccgguuccuggggaggucacucuguguggguggggcuguuguccaggagcaguguuuuugcugugcucaaggcacacguccucccuccuuccucuauagugaccagcaaaacaaguaacaucagagcuaacuuugaaaaccucgcuaaggagaaagagcaggaggacaggcggaaggcggaggcggagagagcccagcggauggccaaggagcggcaggagcaggaagaggccaggaggaagcuggaggugaguggcaaggagugggccgcagcgcacccucccugggaccugugccgaggggauugggagcucuggggccugggcggggcuuauucucuccuggccagguuuuccuuggaaggcauguuuaacucuccuuuaaggcucuccauuaaggcacuugucacuugcagccacacauaggcugagucucuggccacaaugcuccaggcagccggcuagcgcuauccuggucuugccgguccagccccaggacccgccaaccugcccugcccucugucccugagcugacggcagagucuugucggcuuccaccuccacggggcuccuguccaaaugucagccugagucucuucucaccccucccccucuggaagccccuccuuucccagguggaaguuugggguuuggaggggacucugugcagaggcagccugcucucggggccugcuucugcuuggccagcccagccccgcucacccaagccccugggcuguggagaagcgcucccagagaaagaugccagaagugcaccccuggcaggggcggagcacgagccugugucugggugcuuugggucuagccuggguggcuugccacugacaaggacuuuccuugugcucagcuggaucagggggguugugaauagagccugaggccuacagaugugugugugugaaguuaccaggugugguucugcagcuggggcaucugcaguguggggcaggcccagccugucuggaagccugggcuucuccuauccaccccaggcccugccccugcagggccacacaggacgugcuacuuuggguguuuaaccuguggauggcaucaggugacgugggaauuuacaacuguccuguuggggucaagcaaggccauagaugccaggaaccgugcuagggucucaagaccaggggugguuuucucuucaaaaagacaagacagcacuaccauuguucccguuagagcaaggccgccugcagagggagaggagggaagggguuuggaguggacaccugggguucagauccugccugggcagcucccuggccagugugccugugccugccaccucacccucagacucagcgucuggcacuggagcccacaggcugucagugaguuuccuguugcugccguagucaccaccacacacagcacacagcuagugucuuauagcucuggaggucagagguccucaaagaugucagcagggcuguguuccuccugguggccccucggcccugucuucccaucuccagccucugcuuuuguugucaccgccccuccucugucccucacacuccugccucccuccucucaggaccuugugauuacauuggguccacccaggcaguccagaguucuccccaucacagaacccuuaguuucaucacauacacagucccuccccauggggucuggggacugcgaugucagcagcuuugaggggcuauuauccuaccccaguucauccuuuggccccuaaagcuucauguccaucccaugugcaaacauacucagcccauuuuaagguccccaaagucucaacccauugcagcaucaacucagacucccaaaucugugccuaaacuaucuaaucgugugugggcgagaaugagcuguggcccagucccggcacugucgcgucacuggcugugugaucucggccucagagcacaccugccccucgaauccugccuaggugcuggugggaucugaggcuuggugcuccagcuccccugccccucggauccugccugggugcuggugggaucugagacuuggugcuccagcuccccugccccucggauccugcuggggugcuggugggaucugaggcuuggugcuccagcucagccuugguguggguguuuuccacuccuuuccccagagcaugccuagagcuugcacacgaucuucugaaacacggcaggcgugacagugcagagugucauggcagcauucugauugcuguuuguuuucaaucacaggagcaagccagagccaaaacgcaaacgcccccugugucgcccgcaccucagccaaccgaggagaggcugcccucgagccccgucuaugagguuggugucuuugguguuugaaugagcgugagugacuuacugccagagcccagguccuguuuguggaguggaggaagcccuugcaggcaggcaguguggcguggguguagagggcaucgcugcauuccacgcccggagaggggugggccaggagcgccuggggggugggugacaugccucagugcugucaggggauagcugugcaggcccacaugccauccuuucaccccucugcagccuguuguagucuggccacugucacugcagucccugcuguagucaccugcuaucagauaaucagaugggggugucuucaccccacuugcucucugcugugcaggacgccgccucacucccuaauggcagugcugcccuccuucaucacugagccccugccucccgcacaaucugccuucuaugccugccccauucagcucuccagccuugcagccccucaugaguguggcugcagacaugcuguccggccccucccugugcugcugacccccucucaugggucccccaguguuccguccccaucccugaguuacggagccgccugccgaugccccgcccaucccugacuuugggucuccugcuccccgccagcaccucugcgcuaaccacacccucuaccuguaaccaccucuccuguccccagcccuugcccuuucuccaucccauggccaucauccuggucuaugcauucaucucugcucgcccaggagccagucaguuacaggggucacacuccagaccaugguaguucaggagcccagagagagcccuggagacaggccgggucugggaucugggccucgauggccguggccuugucaccacccgacugucccuccuuggcuacgcugcugccugcugccuuuacccugccgggcccuggggggaugugguaagugaggccuugcagcuugucaggaaccggccucccccucuagucccuccccuuggcagccagcgccaucugccucaaggaagcuccgacccugccccucccgugcaguucagcccuugugugguuccuggugccugugcugaggguggagucgcucucccugcccgauuacucucccuggcuagcagcucuccaccacuggcucuucccagaucuccugggugcgcgguucugagcugucggcauugcuuucuuucagucacugccggugacaucagguggacccuggucagaaacauugauuaaagccacugucggugauaagcaguucagaauuuucgcuggggcuccgaagcggcagugguuauagauagagagguguuccacugcgcaccuuuguaguugaaugugauucuuuggcgaugcccugucuguaggcucagcugcucuggagccacguggugaagccgcugucaggcagggccagggucgagcagcacaggcaggaggguggccgcucggcccaagggugccuuguguggccuuggagaugaggccuaaaaaaagaaaucagccaaauuaacccaacaaagacaggcucuacccccaggcaacagugugggcaggggcgugucuccuaaccugcugugugggcgugguuauugcaggacuggagugucgguggugaggaccgggucaucaucgggaaggaaauggcaugugggcacucaccaccauggugaacacaccggcaggccuggccuuccuauaccgcgucuguuuucucaguccuggcugggacugagaauuagauggcccguggguuucugcuggcuguggcaguacagcuacugcucucuagaagccagcaugggccccgugccaugugcgugugacccuuccccaggaugcggcuuccuucaaggcagagcugagcuacagaggcccugugagugggacggagccggagcccguguacagcauggaggccgcugacuaccgagaggccagcagccagcagggccuggccuaugccacagaggcugucuaugaaagcgcagaggccccgggccacuaucccgcagguacuggggccccacgcugcagcgcccugcccagggcagggagcucccgggacauccugcucgaccuguggcgucguugcgaggagcguggguuucccacugacacgccuuugcuugcuugcuauagggucuucuugucccuggagggaagugcucuaggcacauuuggggcaucggcuccugugcugggucccaggaagauccccauugugcuggggacgggugggcaggggcagaggaagggaggguuucagcugccgcccuguguccuugagacaaaaucuuaggaagugucgucuaaaacuugagaaggcugggaaccugugugggacuuuguauuguucagcucugucauggcuuucuuuuagaggacagcaccuacgaugaguacgagaacgaucuggggaucacagccgucgcccuguacgacuaccaggcuggugagcggccugcaaaagcacuuggaggggagacccaggcagcugcgccugccucugcuuguuuucugagaauucacuucucuagcguuguuaguuuuagaaguaauuuauguugagauaauuucagagauauagaaaaguugcagguauagugccaagaacucccauguucccuacccggauuccaucucugcacacacacgcacacacccccuguuaucuuuaguauucucugaacccuuggagagcugcaggggugcugccacccccaaagacuccagcguguuucccaagaucaaagaugcugucccacagggacaccccacccuccaggugagggggccgcacagaugccuugauguucgagaccccauuccugccuguccugccccggccgccagcucccguguggccugcacguuccccugaguucccuuugcggccuuggcaguuuaagagcagccucagcuccugggcuggccucagccgcccgccccguguucccucagggccaggcugagcugugcucugguggcggugaggucuuggagaccaugcgguggggcucucugcugggccgcauagcauccacuugucccucugucucagccaccaccugguccacaaagucaccaccaccccucugcaguugacaagcaucuuacggguggcgugggauuccccucagaacccccggccucugccucuugagugcuucccguuugcaacuuuccaucagcgcggaagcuggcauucuaccauaagugagcgcuggccguccccguucagugccuuuugcacacgugcauuugcguacacgcaugugggugugucuguggcaucucggcaccugugcguggauucucaucaccguggcuuuugcccuccauucccauuucagccaucaccucgggcuucucuccggguguccccuggcuguccuuccacugcggccuccgcagcccaucuccccacccccuccacagacacgucugccagagagaggggaagggagggcaggcggggcuggaguuaugugguggaaaccugcuccugaggaagggguccgggugggguuggugcuugugugaagggcucugugccucuuuguacucucucgguucauguucacaaauccuggccuugguggcaugggagaggcagcaggagccuccgcggugguccgcaucucugcagggggcaucucugagcaggcugccugggagcuugcucuggguugugcuuuuuuucuggcagaccaggaaacgcuugcacuucagcaucuuucucuguguucucuuccccagcgggcgaugaugagaucucauuugacccugaugacaucaucaccaacaucgagaugauugacgacggcugguggcgcggggugugcaagggccgguacgggcucuucccagccaacuauguggagcugcggcaguagggcccccagcccccccccggagcugcgcccuggauccucacacuacagaucaggccuucuuugguucuugggugguuuuggguuuuuucuguuuuuuuuuuuuuuuuuuuuuuuuugaagguggggaggggaauauacacauugcuuuuauauuuaauacuuuugcugaugcuuuugaaaauguuuaugccacagaauuugcuaauauauuguaaucacauuccuuaggaggacuuugguaauugguuuuaugcauugaugguuuuuuuuuucuuuuuugccaaauugacugucacgcggcagcuucagggagcucgcauucucuuguguucguguugcccucgugcccaucaagugcagucgggaccucccaggacaagcacgaggccucaggucggcccuguggcggguaggcaggaaggacugucccagacgaggggcuuccucuagagucucacugcuggggaggagaggacugggccugauggaaguuaacccggagcuaagucacccagagcacaggagcugccaugucagaugggaaaucugccuaugucauaccgugacagcccgcaggaucaggugacuucuagcagagacccugguuuuuuuccugugcccacuccggcuuguccucaucucuacccauccccugaugcccaggucaccgggagggcugcugggagccucuccuguccccgccgggcagugucacugaguccuugaaauccuccccugccccgcgggucucuggauugggacgcacagugcaguugaggucugcgucgggcuuggcuuuucacaaaggcugaugucuuaacugucacccauauggucccugggccaccgggcagccuggggcggugugugugccaugucacagcauggccucucggccuugggaaggaaggcagugccugcucugcugugagccgccaggaacccuccuccugucaauggggguguaguauuuuugccaaaauaucauguucaauuucaguaguuugaucaguugaaggcuagaagugugaagugcagaugaguguguguucuuccccaagguccccccacagcuccaggacaccgcuguccuggcauuuguggccacucacuuuguaggaaacucaucuccuuccugaggagccgggaggcuggaccagucccgucgugcagucaggugggcggugugucuuuccagaaggucacguggaaaugucucgggacuugggucccggagugcccgugaagcguguuuuugcuccugaggugcauuuucucaucauccuugcuuuaccacaaugagcaaugaggucggguuuuauaugcaacuuauuguaucugaauuccuguagcacaccucauagguaugauuuuuuuaaauuaaagaauucagaauaaacauuuuuugauccacuugcguga

SEQ ID NO: 191824 - RNA, 4240 nt, Homo sapiens
gacgauacgccgggcgcaggcgcagaagccgcgcccguccgcggcgccgccagccagggcggaaacggcugcggcuucgcuagggacgcaugcgcgggucccuuaguuuucgcgagauaacggucgaaaacgcgcucuugucgauuuccuguagugaaucaggcaccggagugcagguucggggguggaauccuugggccgcugggcaagcggcgagaccuggccagggccagcgagccgaggacagagggcgcacggagggccgggccgcagccccggccgcuugcagaccccgccauggacccguuccuggugcugcugcacucggugucguccagccugucgagcagcgagcugaccgagcucaaguuccuaugccucgggcgcgugggcaagcgcaagcuggagcgcgugcagagcggccuagaccucuucuccaugcugcuggagcagaacgaccuggagcccgggcacaccgagcuccugcgcgagcugcucgccucccugcggcgccacgaccugcugcggcgcgucgacgacuucgaggcgggggcggcggccggggccgcgccuggggaagaaggugggcgcggggccgggccgggggagccagggccuggucgcccggcuguaggugcugcgaggcuccuccgguuggccuccaggcgccuccccuuugccggguuugauuugcguggguuuucuccguacagcccugguuuugcagaugggagagccagaaacgcagaaaaguuaacuuauucgagguugcagggcguggacacgcacaguccuuuuuccuccacccacuucugcccggguaaauuagaaaacucacugaagaaaagaugagucagagaaggugugggggaggggcagagguugggugagccugccucgcaucauuuccuuucugucucggaauaugcuuuucacggcugucugagaguaauacuagcauucaguaacuccuacccaggggcuuacagugugccgcuuacccuuguaacugccaaauacaauuuucgcaguagcccuguggcuuagauacuguuagcuaucacuguucccauuuuacagaggacaggacuguggcucacagguuaaguggcuuugucgaaaugcgcagccgauaacugacggagcuaggcuugagccaagcaguccggccuccggauggguaguguuagccacuacacugccucucuggucaaguucauuguggaguggcuuccuguccugcucucggucacucccucuccacccucgccuguggauugcagcagcuuccaggauaaaaaagaaacccugaguacagcagaguuucucagcccuaccccccuuguucucagagucgggagaggcuugggagugcucuggggacgccucucagaggcuucaagcuguagcuuggaaucagccauucagucaccaaucagauagggccuaaaugugucaccauggguuucacucuguaaagacuggugccuguuggggacaggauggacagaacagcucucugccugagagcagucaaguccagauuuuaaaaaaaaucaguacugaacaaacaaaacaggacguagaaaaaucggguuuuauggauauuuaaugucuggaaaaacacugauaaauugcauuuuaaaggcggucuacgaaacauagcugacauuugagauguaugugugcuugguuuuauuuauaucgucauguaguuacugugugcugggaaaaguacaccagaaggugagcgguggguauggacagguugguagcgggcgacucugccuuccuccccagaaguucagcauagcgguuaagggucgacucuggcaccacacucuuaggguuucagaacauggcucugccaucgucuagcuacacgaucucaggaauguccauuagcuucccugugccucaauuuccucaucuguacagucaugguaacacagugcccagcccacagggcugucagagcugcgggagcugguacaccugccaacggugucucagaauugccaguaguccaagcagcacccuguccugccucuccuuuccucucuucacauuccagaagcggccuuuuauggucuugugaccagcucccugaucucaguggugacgucagcagaugaggaguaugguagccagggacugaagacugguggucacucggggcagcuuucuaaauaacaauuggagugccuacuaguuuccugugauugccauaacaaaugaucacaaaucugguggccugaagcaauagaaaucuacccccucaaucuggaggccagaaaucugaauaagcagggugccacagaccggcacacccucggaaugcuguuggggaggcuccuuccgggucucguccgcuuugugguggcuccaggcauucuuugacuuguggccgcuucacuccaggcucacacggccuucccugugugucuccugcaaggauaccuaucauuggugcauccaggucauccaggaugaucuccucucaagacccucagcuuaccuuugcaaagaugcuuuuuccaaagaacauucaugguuucagcaauuucacgugaacauaccuuggggugacaucguucagccugcuguagggcaggaugugggaucaacccuauuuucuucccucccacaacuccccagccccucccucagugucuccugcucuaaguagguagcuccacuacaacuuccuuuggcacuugagucuucagugggccacgccuccuaggacaguauuagagagcaggggguuuggcugagguggaaucaggccacucuugggcauuuggugcagccccuuugcugccaggcgacucuagccucuacagaggaccucguguaggcaccucuguccacucagcacuuggcgucugugcugaaaagcccuagggaggauuguggggucgcuugucuccaaaccuaugguaaaccguucuguucuuuccuucccagaccugugugcagcauuuaacgucauaugugauaauguggggaaagauuggagaaggcuggcucgucagcucaaagucucagacaccaagaucgacagcaucgaggacagauacccccgcaaccugacagagcgugugcgggagucacugagaaucuggaagaacacagagaaggagaacgcaacaguggcccaccuggugggggcucucagguccugccagaugaaccugguggcugaccugguacaagagguucagcaggcccgugaccuccagaacaggaguggggccauguccccgaugucauggaacucagacgcaucuaccuccgaagcguccugaugggccgcugcuuugcgcugguggaccacaggcaucuacacagccuggacuuugguucucuccaggaagguagcccagcacugugaagacccagcaggaagccaggcugagugagccacagaccaccugcuucugaacucaagcugcguuuauuaaugccucucccgcaccaggccgggcuugggcccugcacagauauuuccauuucuuccucacuaugacacugagcaagaucuugucuccacuaaaugagcuccugcgggaguaguuggaaaguuggaaccguguccagcacagaaggaaucugugcagaugagcagucacacuguuacuccacagcggaggagaccagcucagaggcccaggaaucggagcgaagcagagagguggagaacugggauuugaacccccgccauccuucaccagagcccaugcucaaccacuguggcguucugcugccccugcaguuggcagaaaggauguuuugucccauuuccuuggaggccaccgggacagaccuggacacuagggucaggcggggugcugugguggggagaggcauggcugggguggggguggggagaccugguuggccgugguccagcucuuggccccugugugaguugagucuccucucugagacugcuaaguaggggcagugaugguugccaggacgaauugagauaauaucugugaggugcugaugagugauugacacacagcacucucuaaaucuuccuugugaggauuauggguccugcaauucuacaguuucuuacuguuuuguaucaaaaucacuaucuuucugauaacagaauugccaaggcagcgggaucucguaucuuuaaaaagcaguccucuuauuccuaagguaauccuauuaaaacacagcuuuacaacuuccauacuacaaaaaauuuucuauuccu

SEQ ID NO: 191825 - RNA, 181746 nt, Homo sapiens
gagaaggacgcgcggcccccagcgccucuuggguggccgccucggagcaugacccccgcgggccagcgccgcgcgcucugauccgaggagaccccgcgcucccgcagccauggccaccgggggccggcggggggcggcggccgcgccgcugcugguggcgguggccgcgcugcuacugggcgccgcgggccaccuguaccccggagagggugagucugggggcgcgggcgugggcggggagcgccgcgauggggagaggaccccacccaagccaaaaucgagcccccgcuuguggacugagaacccuccccaggggcggggggcgguggccaggacgguagcuccugcaucgcguagggggagcgggaagccucugaccuuggccuuugcccgcccgggcucgcgccuccgcgcccugcgugcccgaccugagcccgaggaaccuugccccggugcccgccccgccgcgggcuccucucuggagcgcgccuccgacccgugccccggccccuccgagcccaagucgcuccggagacacgacacgcgucaucuuugggucgcggccgggaaguggggucacugggucuggacagccccgaacagccaagucccccgagcgcauaugguguagguagagccaagcgcccugagugccucaccggugggugacgcugccuggggucagggacugcagagccccccucuacccaacuaccuuggaucuaggcccguggccaccccggacucuagguccauguuuacccuuuuggguucuguuuccagauguccggaggcaaauucuaaagccuuagcaacagcagcaauuguagcagaaguaguggcgguuuuuuacccuauuuauuguaauugguaucaccgcacgccacagccuagucuaucuuaucucucuggacugucacaguggcccccggaggcagauacaguuaugcacccauuucacagaggaguaaacugaggcucauguaggacgcauaacucccuugcccuaaagucagugccagagccaggacuugagccucugugugucccguucugcccaagaaucuggacuacugucccuugucugcugucuccuugaccccuccucuccccucagcccugcgcuucaugaaggagccuuugaccuugagugagccuuucguucccccugaccccaugggccccucucccacgugugggcagcaucuuccuugggcuugacaauaggcaccuuugggguuguaagaugaagauggcgcaaucauuuaaggaauauagccuggguuucccacuguggggucugaggcccugcuuuaaaaauaucuguuggguuacuguuucagauuucuccauaaaaggaaaucagucgugaugaggaaggggucagggagggaaggaauugaagcucuuaaauguauugauggggaaacgggugcauguaaaaucaggugcuagaguggaccaaccggguuugcugagucgacucugucaaucacauaaugucuaaaagccccgggcccacccccccccagccccgcccccaggugccugggagacaguaggugcucaaugaaggguggcgguuaguuggaguucuuguuaagaaaaucuggccagcugcgguggcucaagccuguaaucucagcauuuugggaggcugaggcgggcggaucacgaggucaggagauggagaccauccuggccaacauggugaaacucccuucucugcucaaaauacaaaaauuaccuggguuugguggcguucgccuguagucccagcuacuugggaggcugaggcgggacaauugcuugaacccgggaggaggagguugcugugagcucagauggcaccacugcacuccagccuggccaaagagcgagacuuugucucaaaaaaauaaaaaaaaaggcggggcgugguggcucacgcuuguaaucccagcacuuugggaggccgaggcggguggaucaccaguucaggagaucacgaccauccuggcuaacacgguaaaacccugucucuacugaaaaauagaaaaaauuagccgggcgugguggcgggcgccuguagucccagcuauuccggaggcugaggcaggagaauggcguaaacccgggaggcggagcuugcagugagccaagaucgugccacugggcgacagagcgagacucugucucaaaaauaaauaaauaaauaaaaagaaaauccaagaugagugguuucgaacuaugccagauucuaugugugcgugugugugguucccuguucuucuguuccuuguagcuuugguaauuaauuguggaucugugccugggcuuucagggucaguaaauggauuuaccauuucuuugcacauuuauggcuuccauaugggcagggguuuaugguuuguuguuguucaccguugcauuucuagagcccagaacgaugccuggcacauaguagguguucaguaaauauuuguucugcaguggggcacaagugguggaguuccuggguguacugggcuccuuuaucaucuuaaggaguuccuuauucucugcauaauaccuuccuaagaauuagaagagcaagcucucagcaggugcuguucuaugcgcuuugcauauauaaucucaguuaauccucacggcaaaaccccacgaggugcgguuuaaucuucccuuuucacaagugagaaaacuucgcuugaggccagcaggcagcagggcugggauugcaaucuagcuaguguggcugcagagcaaugguuucuuaacaaaucuuuguucuuuugaguccgagccuccguaccccccacgauuggggugauggugaacaaaauccugucaaauaaaugggcugugaugccucuugaaggcuuggggaggggcaaagaacuuuucagaucauuaaucucuaaugucaaccaauauggcuuuuuuuuuuuugagacggagucuugcucugucacccaggcuggagugcaguggcacgaucucagcucacugcaaccuccaccucccagguucaagggauucuccugccucagccuccccaguagcugggauuacaggcguguuccacaacaccggcuuauuuuuuguauuuuuaguagagacagggcuuugcuguguuagccaggauggucucgaccuccugaucuugugauccacccgccucggccucccaaaguguugggauuacaggagugagccaccguaccuggccuuuuuuuuuuucuuuuuuuuuuuugagacagggugucacucugucacccgggcuggagugcagugacacgaucuuugcgaccuccgccuuucagguucaagugcaucuccugccucagccuccugaguagcugggauuacagucguguaucaccacccuuggcuaauuuuuguauuuuuaguagagaugggauuucgccauauugguuaggcuggucucaaacuucugaccucaagugaucugccugccucggccuuccaaagaccugggauuauaggugugagccaucacuccgggcccaauauggcauuuugauugggaugaaggguggaggaaaaucagugugauuuuuguaucuaucucucuagcuaucuauuauuuuuugagaugaggucuugcucuguugcuuaggcuggagugcaguugggcaaugauggcucacugcagccucgaccuccuggacgcaagccauccuccuauuuuagccuccguaguagcugggaccacaggcacacgccacccugccuggcuaauuuuuacuuuaauguguagagcugaagucuugcuauuuuguccaggcuggucucaaacuccuggccucaagcgaucugccugccuuggccucccgaagugcugggaucacaggcaugagccacggugucuggccucugcaguuauucuuauucuuugcuucucuccuggagaccugcuucuugcccuuccccauucaugcauagagaccacagggugugggcugaguccccagggcuccccaccucaccccacucuacccuugacuuccauuccucuuugguuuaagcagaacucucaaucuuggcacugcugacauuuggggcuggaucauuccugguggugggggcuguccuguauguagaguguugagcuggaaccauggucuccacccaugugguccugggaggauccccuuccccccaggcaugacaaccacuaaugucuccagacauugccaggcacgucucugcaggaguuaaccuuuucccugucugagacauuuacccaucugggcucuugcucuuucuccucucuuuguucaauaauccucggccgggugcaguggcucacgccuguaaucccaacaccuugggaggcugaggugggcggauccccugaggucaggaguuugagaccacccuggccaacauggugaaaccccaucucuacuaaaaaugcaaaaauuagccaggugugguggcggguccuuguaauccuagcuacuugggaggcugaggcaggagaaucgcuugaaccugggaggcagagcuugcagugagccgagaucacaccauugcauucuagccugggcaacagagagagacucugucucaaaaaaaaaaaaaaaaaagaaaagaaaaaagaaucuucauuuacccacgugcuuuuucagccucuaaacacccaguaccccccaauccccauuaccuaccacugaccuccagccuccacccuguccagcuuccccaggccaguccucccugcccuuuccaucucacucuuuucucacuguucugcccccagcaucuggcuugcaucuccgcugcuuuaccgauggcucucgaaguuaaucucucaucucccaguugcgucuccugcagccucaccucacuugaccccucuggguuugacauugccaguccccccuccuggaaggcugugucucccgucucaccugugccuaaguucuucuguuuuacuguucucuucuccuucuaccugggcuaagauguuggcucucucuucccagagggucaguguuuccuuuaaucuucucucagcucacuuuuuuuuuuuuuuuuuuuucacuucuucacccgggcuggugugcaauggcaugaucuuggcucacuacaaccuccgucuccuggguucaagcaaugguccugccucagccucuccaguagcuggaauuacaggcaugugccaccccgccuggcuaguuuuuguacuuuuaguagagacagaguuucaccccauuggccaggcuggucccaaacuccugaccucaagagauccaccuaccucagccucccagagugcugggauuacgggcaugagccaccguguccggcccuuuuuuuuuuuuuuuuuuuuuccaauuuuuauuucuuuuuagagacaggauuuugcucugucacccaggcuggagugcagagguuuaguccuagcuuacugcagccuccaagucauggccuggagcaguccucccaccuagguuccccaaguagcuggaaucacaggcaggugccaccaugcccagcuaauugaaaaauuuguuuguagagacagagucucacuauguugcccaggcuggucuugauuuccuggccucaagugagccuccugccuuggccuucugagaaacuaggaucacaggcaggcaccaccaugacuagcuaauuuuuaaaauuuauuuguagagacagagucuagcuauguugcccaugcuggucuugaauuccuggccucaagcaaccugcuugccuccgccuccuggguaccugggcucacagacagucaccaccaugccuggcuaauuaaaacuuuuuuuuuuuuuuuguagaaacagggucuugcuauguugccuaggcuggucuugaacuccuaguucaagcagucuucccuccugggccucccaagugcugggauuauaggcaugaggaaccauugcgcccagcuaagaaauuuacauagauuccgacuucuucaucugaacaggggucagcaaacuauggcccucaggccaaaucccacgguuuuuguaaaugcaguuuuauuggcaugcaaccacacucauuugucuacucaucaucuaugacugcgcaaaaaugccccgacacggcagguugaguaguuaaaacaggaauuccauggccaaaauauuuacacuuuggcccuuuacagaacagcguuugcugaccucugaucuggaacagacgccuugagguuucauucaugauagcaugccuaauagcuugugcagucccugguacaacucgaaugaagugagugaaaugaaacgcuaugucuuucucuuuacaccgcaagagauguuaaagaaacgugugucauuugcugcacugaauauacggauuccaaggaugagaaaaaucaccgugauguugccuacuuagccauguguauuuauuuaaacagcuauauuggcauugaaugaggauuucaugcucucaacccuguaucuagaacccaaaauauaacugguguauauaaugagauuuuuuuuuuuucucucaggccucucuuguguuaauuucuguuaagaauacuucugggccaggugugguggcucacgccuguaaucccaagcacuuugggaggccgagguggguggaucacuugaggucaggaguucgagaccagccugaccaacauggugaaaccccaucuuuacugaaaaaauacaaaauuagccaggcgugguggcgcaugccuguaaucccagcuaguugggaggcugaggcaggagaaucgcuugaaccugggagguggagguugcagugagccgagauugcgccacugcacucuagccugggugacagagcgaaacuccaucucaaaaaaaaaaaaaaaaaagaauauuuuuggccaggugcaguggcucaugccugcaaucccagcacucugggaggcugaggugggaggauuacauguguccaggaguuucagaucagccuggacaacacagcaagacccugucuccacuaacaauaaaacaaaaauuagcugggcaugguggcaugugucuguagucccagcuacuugggaggcugagaugggaggaccucuugaggcuggaagggcaaggcugcagugagcugugauuguaccacugcacuccagccugggcaacagugagauccucucucugucucaaacaaaaaaagaauacuucuugggguggccugguugauauuuugcagcugcaugguauuuacaguuuuuaauuaaauagugacggguaaugcauucucauugcaaaaagaaaaauuacaaaaguguagaaaggaaaaaaaaaacacagaaguccuucugcaaaaucuugugguggggugcaguggcucacaccuguaaucccuggacuuuuuaggaagcugaggugggaggaacacuugaagccagcaguuugagaccagccugggcaacauaaugagacauuaucucuagaaaaaguuuaaaaauuagcugagcauggugguguguaccgguagucccagcuacucaggaggcugaggugggaggaucgcuugagcccagaagguugaggcuacaguaagccauauucaugccacugcacuccaaccugggugauagagcccgacccugucucaaaaagaaaagaaauaauaaaaaaaaaucuugucccccuguccccaaaagcauuccauucauguccagggagguaacugugccauugguuuauguaucuuuuugauguuuaguaauuuuuuaggcuaggugucauggggccacuccuguaaucccagcacuuugggaggccgaagcagguggaucucuugagcccaggaguucaagaccagccuggguaacauagcaagaccccgucucuacaaaacccuacaaaaaaauuauccagauacaguggugagcaccuguggucccagcuacuagggaggcugaggugggaggaucaccugagccugggaagucgaggcgccagugagcugugauugcaccacugcauccagccugggugacauagugagacuguguaacaacaacaacaacaaaauauuuuaaacauuaucauacaguaaaauuggcuuuuuaaagguguaccauuuuaugauuuuuaagccauguguagaguuguauggcuauugccacaauuaggauagagaacagucucguuguuguccaaacucccucaauucaccccuuuaucacuaaaccaccuccaccccuaaccacagaucuguucuccaucccuauaguuuucucuagacuuuaaaagauuuuaucuuauaauuggauuaauauuccuaaaguugaaauuuuaaauuugagucugguugauccucaucauucccagaucccauauuuucuuuuuaaaauuuaaaauuuaaauuuuuauuuugagaggcagguucuugcucugauacccaggcuggagugcaguggugugguccuaauucccugcagccuccaacucuugagcaucaacgauccuccugccucagccuccugaguagcugggacuacaggcacacaccaccaugcucagcuaguuuuuauuguuauuuauuuauuuauuuauuuuugagacggagucucacuaacucuguugcccaggccagacugcaguggugugaucuggguucacugcaaccucugcuuccugggcucaagcaacucuccugccucagccuuucuaguagcugggguuacaggcacgccaccaugcccggcuaguuuuuuuuauuuuuaguagagaugggguuuuaccauguuggucaggcuggucucaaacuccuggcuucaagugauccgcccacuucagccucccaaagugcugggauuacaggcgcgagccacugugcccggccuaauuuuuaacuuuucagcagggauaagggcucgcuauguugcccaggcuggucucgaacuccuggccucaagugauccucccaucuugacuuccuaaaguacugggauuacaggcaugagccacugcaccuggccccagacccuguauuuuugaauucaccuacucacucaaauguauuuguaacccucaaaccagcaugcucagugccuuucuggucauuuuaggacacucauaaguacgagucucaaaugugaggucaaguaagagggcauuccaccuucuugcuucagcccuuaugcgucagauucauacaaucugcacacugaggauuaaaacuaguccuuuuugagcaggcgcaguggcucaugcccagcgcuuugggaguccgaggcgaguggaucacgaggucaggagaucgagaccauccuggcuaacauggugaaacccugucucuacuaaaaauacaaaaaauuagccaggugugguggcgggcgccuguaguccgagcuacuccggaggcugaggcaggagaaucacuuggacccaggagguggagguugcagugagccgagauugugccucugcacuccagccugggugacagggugagacucaaaacaaaaaacaacaacaaaaaaaccugaguccuuuuugugguuauuuggugccacauuuuuagcauuuuugugcuuucaguuggugauggggcuguuucaaaugccccccagggugcugaagcccugcucucuacucuuccuuggcuaaggagggcugucaccacccuuguggagaaaaggcagcguggcggggcacgguggcucacaucugcaaucccagcacuuugggagguugaggcagguggaucacuugaggccagaguuugagaccagccugggcaacauggugaaaccccaucucuacuaaaaauacaaaaauuagcugggcgugauggcgcacaccuguaaucucagcuaccugggaggcuaaggcacaagaauugcucgagccuaggaggugaagguugcagugagccaaggcggugccacugcacuccagccugggcaacagagugagacccugucucaaaaaaaacccaaaaaaacaaaaaaacuccaaaaccaacacacacacacaaaggcauguguuacauaaacuuuguucaggcaugaguucuauuacuguuggccgugaguucgguguuaaugaaucaacaauauagauucaauagugucuuucaacagaaacacacauaaaacaaggcuagguauugauccauggauaaauguguuguggccagaaguucgcagguacuuacccucgcauuuuccuaggaacaaugguucaguauucacuaguucaacauucaggggaauuucacagagccaaacuaccaccaauaacaagaaucggcugcaagugguuuaaaacuggugaaucuguggcucauacccguaaucccagcacuuugggaggccgaggcagguggaucaccugagguggugaguucgagaccagccuggccaaaauggugaaaccccgucucuacuaaaaauacaaaaauuagccgagcacgguggcucaugccuguagucccagcuacucaggaggcugaggcgggagaauugcuggaacccgggaggcagagguugcagugagccgagacugcaccacugcauuccagccagggcaacagagcaagaccccaucuaaaaaaaccaaaccaaaccaaacaaaacuguggguuugucauuuuccguuuagaauccuuugaaugcaaaugcccuuuuuguuguauuuucaucugcguggaaaccgcuggguugauaccuuuuggaaaguucaugagauguccaaaaaccccuggcccauguuucagggaggggaaucccugcccucugccaacacugguggcagggagaggcagcaguggcucucgggauuuuauuuauuucauuuauucauuuacauuuuuuugagaaagggucuugcacuguugcucaggcuggagugcaguggcgcaaucacagcucacugcagccucgaccuccugggcucaagugguccucccaccucagccuccugaguagcuggcacuacaggcgugugcuaccacgacuagcuaauuuuuguauuuuaguagagauggggucucaccauguugccuauuauuauuauuauuauuauuacuuuuuuugaggcggagucucacucugucgcccaggcuggagugcaguggcgugaucucagcuuacugcaagcuucgccuuccggguucaugccauucuccugccucagccuccugaguagcagggacuacaggcgcccgccacugcccccggcuaauuuuuuguauuuuuaguagagacgggguuucaccguggucucgaucuccugaccucgugaucccccaccucggccucccaaagugcugggauuacaggcgugagccacugcgccuggccauguugccuauuauuauuauuauuuugagcagucuuacuccguugcccaggcuggaaugcagugucacgaucucagcucacugcaaccuccgccuccaggguuuaagcaauucuccugccucagccuccugaguagcugggacuacaggcaugugccaccacgcccagcuaauuuuugcauuuuaguagagaugggguuuccccauguugcccaggugggucucaaacuccugaccucaagccacccaccugccucagccucucaaagggcugggauuacuggugugagccaccuuguccagcuggcuugaaggauuauuauuauuauuacuauuauuuugagauggagucgcacucuguugcccaggcuggaguguaguggcacgaucucggcucacugcaaccucugccuccuggguucaagcaauucuccugccucagccucccgaguagcugggauuacaggcguacaccaccacgcccagcuaauuuuuguauuuuuaguagagacaggguuucaccauguuggccaggcuggucuugaaccccugaccucaaaugauccacccaccucggccucccaaagugcugggauuacuggugugagccaccgugccccgccggcucgcgggguuuuagaaacauauuuuguuuccagcagaacaagcuuugcuauccugcggugccacguacagacuggcucuaagcuccuguuggaguucaaagcggacuugugggaaugaauguuuaauuucacaucuggcauuuucuuccaguuccuuagaaguaggauaucucaucagguuuauauaaaagccccugauguauguucaggaaaggcaggaugcuaucaugagauucuuauuuccuuugccuuugugggaauguggaaaccauagguacugucuaaaaauuacccuuuuuaucaaugcaggcaaaaguagucagacaggaagggacucgagaguagggaugcaacugcuuuuuuaaauugauuuuaaaaucucauuuauucuuaucauuagagacagggucuugcucugucaucccggcuggagugcgguggugugauuauggcucauugcagcccugaacuccugggcucaaaugauucucgcgcuuccuccucccaaguagcugggacuacaggcaugcaccaccaugccuggcuaguuuuuuuauuuuuauuuuuugcagagacagggucuggcuguguugcccaggcuggccucgaacucaagaccuuaagugaucgucccgccucagccucccaaagcacugggauugcagaugugagccacugugccuggugggauacaacuguuuucugacugccuguguaugugucuguguguguguguguguguuuguuuguuguugucauucuacucucaaggauguaucuuguuguuuccuugcagaagaucagaaaagggaggaccucauauguucccuccuaauuauacccaguuacacggucuccauaccaccuguuacaaagugacuuucuggucuggcaggacuucucuuguuuuuccuccugucuucuguguccugucugcucuugucuguauaaauuucaggacuccugaaauagcacggaagcccccuucuaauccugugguuugauguuugauauuguuaggauuacaaaacuaugucauagacuagaggagucagacauuccagaguucacagaagguguugguguccggguggcugugggacacaggugcccuuccuagucccuggccuuucauacugugcccccuggagccccucuuucuuucuuuuuucuuuuuuuuuggagaucgagucucgcucugucacccaggcuggagugcagugcaguggcacgaucuuggcugauugcaaccucugccuuccagguucaagcgauucuccugccucagccuccugaguagcugggauuauaagugugcaccacaauaccugacuaauuuuuggguuuuuuguuuuuuuuuuugagauggaguuucgcucuuguugcccaggcuggagugcaauggcaugauaucggcucaucacaaccuccgccucccggguucaggcgauucuccugccucagccucccaaguagcugggacuacaggcauacgccaccaugcccagcuaauuuuguauucuuaguagagaugggguuucuccauguugguuaggcuggucucgaacuccugaucucaggugauccacccgccucggcugcccaaagugcugggauuacaggugugagcuaccaugcccggccuggcuaauuuuuuauauuuuugguagagacgggucucaaacuuuggccaggcugggcucgaacuccugaccucaagugauccaccugccuuggccucccaaagugcuggaauuacaggcgugagcaaccgcacccagccuuuguuuuguuuuguuuuuuuguuuuuuguuaugagacggagucucgcucuguugcccaggcuggagugcaguggcgcagucucgacucacugcaagcuccgccucccggguucacgccauucuccugccucagccucccgaguagcugggacuacaggcgccugccaccacgcccggcuaauuuuuguauuuuuaguagagacggaguuucaccuuguuagccaggauggucucaaucucuugaccucgugauccgcccgccucggccucccaaagugcugggauuacaggugugagccaccgugccuggccuuguuuuguuuuugagacagggucuccucgcacugucgccuaggcuggaguguaguggugugaugucaggccuccgcaaucuccaccucccaggcucgagcaauccucaaccucccgaguagcugggacuacaggugcacaccaccacacccauccaauuuuuuuuuuuuugguagagaugggguuuugcuauguuacccaggccaaucucaaacuccugggcucaagcaguccacccaccucagccucacaaagugcugggauuccaggcgugagccucucuuucuaucauuuucuucucucaguugucuccgugcuaccuuuccugcaauaucaccuguugucacugcguccaccagcauccguaccuguucccccaucuucccaaugcccacgggacccacaucccugaguaucccaaagcccucacagacucaauaugcugccaacucagccuguuguucuugccacucuaaacuguuccuaucucgaaugcuucaggcucauugacgaucccuccucacucucuucucccucuucucuuccauuucuccuggguaugaaguccuguucacacaaacugccccugguuucuguggugcuaugcaugcugucuucaguaccuucuucauucugcugccagaaggcuguuucucucuuucuuuuuuauuuuuuaauuuuauuuuuauagacauggggucuuacuguguugcccagauuggucucagacuucuggacuuaagugauccuccugcgucagccuccccaagggcugggauuauagaugugagccacugugcccugucuagagggauauuuauuuuauuuuauuuuauuuuauuucuuuucuuuuuuugagauggagugucacucugucacccaggcuagagugcaguggcgugaucucagcucacucaaccucucccuccuggguuuaagagauuguccugcuucagcuuccugaguagcugggauuacaggugugcaccaccaucccuggcuaauuuuuguauuuuuaguagagaugagguuuccccauguuggccaggcuggucuugaacuccugaccucaggugauccucccaccucaggcucccaaagugcugcgauuacaggcauacgccaccauaccggacucauuuuuguauuuuuaguagacaugggguuucacuuuguuggccaggcuggucucaaacuccugaccucaggugauccucccaccucagccucccaaagugcugggauuacaggcacacgccaccacaccaggcuaauuuucauauuuuuaguagacaugggguuucaccauguuggccaggcuggucucaaacuccugaccucaggugauccaccccccuugaccucccaaagugcugggauuacaggcgugagccacugugcccagccuguguggcucucuuuugguuacccugugguauccuguuuucucaagcucauccucccugguggguccaugaucccuggaaauuguuggucuucuccggccuuuugaaauugcugccuuaugaauguccagaguuggguaucugccuuucucucccaaggaggaagaauccugagggggcaucuuugcuuuuaggucccagggcuuucacugacuuccuccuugcuggcuucuugguuuguuccaaagauguccucgguacaucuucugagacuaaugacaugauaaguuucuggaaggacuaugaucuggaugaugaggguuucaucacaguccucuuucaguucuguccuacagauuacacuuguuuucuuccuucauccuuugucuucacugguucacuguuuccaucugcauucuucuguucucauuucuuuuuguuguuguuuuauuuuuuauuuuuuaauuuauuuuuuaauuuuuuugagaccgagucucacucugucacccaggcuggaguguaguggcacagucuuggcucaaugcaaccucugccucccagguucaaguguuucuccugccucagccuccugaguagcugggauuacaggcgagcgcuaccgugcccggcuaauuuuuuuguauuuuuaguagagacgggguuucaccauguuggccuggcuggucucgaacuccugaccucaagugaucugcccgccugggccuccugaagugcugggauuacaggcgugagccaccguguccggccuugguuuuuuuuagaaauagugucucacucugucacccaggcuggagugcaguggugcagucauagcucacugcagccucaaccucuugggcucaagcaauucuccugccuaagccuccugaguagccgggagcacagacgcgccucaccacgccuggcuauguuuuguauuuuuaguagagguaggguuuugccaguugcccaggcuggucuugaacucccggacucaagcaguccacccgccuaugccucccaauauguugggauuacaggcaugaccacugcacccggccaacaucucugcaguucuuuguuuuaguacuuuguccuuuagcucuggugguagcuuaucacaguuauuuaggugcgucuuuccuuuacuugcuguaagagugcaaccuuauuugucuugagagucccccugggccuggcacaaugucuggcccaccgagaugcccagcaaacguuugcugagugaauacaggaaugauuuccauguagcugacuugccggguccagaaccugcauuugauccagacgccuccauuccuucucgcagagguagauuugaaagcuauucuugcaggcagguggagaaucuuaaggaucucugacaccccaguguguccaagcucuaauuucuggagguaauaaaucugggaauggauuccaucuggcucagaugggagacagaacagguauacacagccagagaccccaguucucaucucuucuuuguagguuucauuaugcuguugucaucauuuaaaggaaacugaggccaggcacgguggcucacaccuguaaucccagcacuuugggaggucuagacggguggaucaccugaggucacgaguuugagacuagccuggccaacuuggcaaaacccugucucuacuaaaaauacaaaaauuagcugugcgugguggcgggcgccuguaaucucagcuacucaaaaggcugaggcaggagaaucgcuugaacccgggagauggagguugcagugauucgagaucacgcuacugcacuccagccugggagacagagugagacuccgucucaaaaauaaaaauaaauaaaugaauaaauaaauaaaaaggaaacuaaggcgugcagagggguugaagauguuguccaggaucacacaguugacaggugacagagcuggguugggaagccagauucguuagauuucuagugugccccaaaacugguauaggugguggccugacaccagaacccaagacuuguugaggcaggaccuccugaauuuaagaggaagcaguuugaggacuggaaagaauguggaaagggacgugugggccccagaauaggucagcagggagcauuuuaagaaugcuguuacuggccgggcuugauggcucacacccauacucccagcacacugggaggccgacgcaggacugcuugagcccaggauauugagaccagccugggcaacauggugaaaccccaucucuacaaaaaauacaaaaauuagccaggcauggugguacgcagcuguagucccagcuacuugggaggcugaggcaggaggaucacuugagcccaggaauuugaggcugcagugagcuaugauugcaccacugcacuccagccugggcaacauagcaagacucugucucaaaaaaaaaauccuguaacugaagaacaaggaccuuuaugauugaaaacaggaaguagaaaacucuuagcauuguaaaggauuucagaaucuucuagaaaguucuuucucugcccugcucccaacccaucuccccugcuguuuucaugauggagagaaaaucagggaagaaaggaacacuuccuaagauggcucucauguccgccuucucuccuucuggaaaauucucagauucaggaccagcacgguccaauacagcucugcuuugauggaaauacucuguaucugcucuguccaauauggcagccaccauccacggguggcucuugagcccuggaaguuguggcugguaagacugaauucuuuuuuuuuuuuuuugagauggagucucgcucugucauccaggcuggaguguaauggcacaaucucggcucacugcaaccucugccucccagguucaagcgauucuccugccucagccucccuaguagcugggauuacaggcaugcgccacucccccgaccccgcuaaguuuuguauuuuuaguagagacgggguuucaccauguuauccaggcugaucucaaacuccugaccuugggucauccacccgccuuggccucccaaagugcugggauuacaggcgugagccaccgcaccuggcugaaacugaauuuuauuuucacuuuaauucauugaaaugucaauguaaacuuuuauuuaauucauggaaauguaaaaaaaauuaguacucaguucuguuacuggaaaacucucccauauauuuggaacaacuugguuaugugaacuugagguaguaggcgggacucgucuccagaggcggggauccagcccuggaccaaauggaggacuagccacaaggacagggcuggccgggcgcaguggcucacgccuguaaucccagcacuuugggaggccaaggcagguggaucaccugaggucaggaguucgagaccagccuggccaacauggugaaaccuugucucuacuaaaaauacaaaauuaucuggaugugguagugcaugccuguaauaccaacuacucgggaggcugaggcaggagaaucacuugaacccaggcggcagagguugcagugagccgagaucaugucauugcauuccagccugggcaacagagugaaacucccucucugaccaaaaaaaaaaaaagugcugucuaacaccaccagcucacccucgaauucuuuccugggugaagccaaaaacccucccgggguaaggcucaauuuuggggcuugccucuucuacaucaaaccuacauuuucgaugauacucuuuauaaaaucuacauagacaaaucaauuuuuuuuuuuuuuuuuugagacacagucucacucuguugcccaggcuggagugcaguggccugaucuuggcucacugcaagcuccgccuccuggguucacgccauucuccugccucagccucccgaguguagcugggacuacaggcaccugccaccaugcccagcuauuuuuuuuuuguauuuuuaguagagacgggguuucacaugguuagccaggauggucuugaucuccugaccucgugauccacccgacucggccucccaaagugcugggauuacaggcgugagccaccacgccugggcgacaaaucaauuauuuuuaaagaaaaaugagccuccguuucgagaugggcugccaggguaaagcacacaccacaucucguaggcgucaugggaaaaaaauccugcagaccagggauccccaacccuuaggccacagaccaguagcaguccauguccuguuaggagcugggcugcacaguagaggugagcagagggcaggugagcauugccgccugagcuccgccucgugucagaacaauggcagcauuagauucugauaggagcucgaauccugucgugaacugugcauacaagggaucuagguugccugcuccuuaugagaaucuaacugaugccugaggaucugagguggaacaguuucauucuaaaaccaucaccacccaucccguguucguggaaaaauugucuucuaccauuggucccuggugccaaaaagguuggggaccacugcuguggacuaucucauuaaucauuuuuuuuuuaggauugauuauaugugggaauuauuuauuuauuuauuuauuuugagauggagucuugcuuuguuacuuaggcuggagugcgacgggaugaucucaguucacugcaacuuccaucuccuggguucaagcgauucuccugccucagccuccugaguagcugggauuacaggugugagccaugguaccuggcccauucggcauauuuuaguacggagaugguggucaggcacgguggcucacgccuguaaucccagcacuuugggaggccgaggugggcggaucaccugaggucagaguucgagaccagccuggccaacaugaugaaaucccaucucuacuaaaaauacaaaauuagccaggugugguggcacacgccuguaaucccagcuacucgggaggcugaggcaggagaauugcuugaaccccagaaguggaguuugcagcaagccaagaucaugccacugcacuccagccugggcaacagaguaagacucaagucucaauuaaagaaaaaaaaaaaaagaaaaaagaaaauauuagcugucacuuagcacccucuuccucauugccuuuuucuaccuguacaaagaguggccauuaaccagguacccauuaugaagaacuugaagcauccuucacgcccacucagagauguuaaaagccagcagaaguccucgugucuauuucugccuucauuucuaacauccucuggguauuuucugucccagugguaaacugcucuauugucuuucacuaauagggacacauacggcuuuaaugaauuaagaguuagauucauaggauauuuaaaaagaaaagcaauucuugauuguucccuacaauuauagcuguuuaaucuuuacucauaacaacuuuagugagacagaauucacaugacauacaauucacccauuuuaagugugcaguuaggugguuuugaggacauuuacaguugugcaacugugaccacagucaguuuuagaauauuugcaucaucuucaaagaaacccuguacccucuagcuacuacuuuccaucccccauuucccuagcucuuggcagccacgaaucuauuuucugucucuauggauuugccucuuucggauuuuuuuguaugaauggagucagacaacauguggccuucucuguuugacuucuuuuauggagaagguucauaccuguaaucccagcacuuugggaggccaagacuggaggauugcuugaguucaggaguuugagagcauccugggcaacauagagagaccacuaucucuacaaaacaaauuuaaauuagcugggcaugguggugcaugucugugguuccagcuauacuggaggcauaauuuuguuuuguuuuuguuuguuuguuuguuuuuguuuuuguuucgugggguuuuuuugguuuuguuuuuuguuuuuugagauggaguuuugcucugucacccaggcuggagugcaaaggcacgaucucagcucacugcaacguccgccuccuagguucaagccauucuccugccucagccuccguagcagcugggauuacaggcaugcgccaccccgcccagcuaauuuuuguauuuuuaguagagacagguuuucaccacguuggccaagcuggucuccaacucccgaccucaggugauccaccugccucagccucccaaagcgcugggauuaaaggagugagccacuguggcuggccuuuuauuuacauuuauuuauuuauuuauuuagagacggagucucacucuuucaucaggcuggagugcaguggugcaaucuuggcucacugaaaccuccaacucucugguucaagugacucuucugccuuagcuucccaaguagcugggacuacaggcacucgccaccaugcccagcuaauuuuuuuuguauguuuaguagagaugggguuucaccauguuggccaggauggucucaaucuccugaccucgugauccgcccaccucggccucccgcagugcugggauuacaggcgugagccacugcggccagccuguauuuacuuuugagacaagauauugcucuguugcccaggcuggagugcagggguacaaacacagaucacugcaguccugaccuccuaggcucaagcgauccuccugccucagucucccguguagcugggaccagagacacacaccagcauuccuagcuaauguuuuaaauuuuuauagagauggagacucgcuauguugcccagguuggucuugaacucuuggguuuaagcaauccuuccgucucuaccucccaaagugcugggauuacaggcgugagccacugcacucagccucagcuauuaugaauaaugcugcuauagacauuuguguacacgucuuuguguggacguauaguaucauuucucuuagguaguuaccuaggaguggaauugccaggucauauggcaauucuugguuuaauauuuugaggaacuaccagaguguuuuccacaguggcugcacuguuuuacauccccaucaggaaugcaaaaggauaccaguuucucuacauuuuauuuuuucuuugagauggagucucgcucugucgcccaggcuggagugcagugaucuuggcucacugcaaccuccaccucccagguucaagugauucuccugccucagacucccaagugucuggaacuacaugcgccugccaccacgcccagcuaguuguuuuuuguauuuuuaguagagacgggguuucuccguguuggccaggcuggucuugaacuccugaccucaggugaucugccuaucuuggcuucccaaagaacugggauuacaagugugagccacggugcccggcccauuucuuuacauucuuugcacuuguaauugucacucuuuuugguuuuagcuauccuaguggggauaaagugguaucucacugugguuugaauuuguauuucucuaauguccaacagccaguuaaucuuuccuuuuuuucuguuuuuuuuuugagacagagucuugcuccaucgcccaggcuggagugcaguggugugaucucggcucacugcaagcuccgccucccggguucaugccauucuccugccucggccucccaaauaguugccacuacgggugcccgccaccacgccuggcuaauuuuuuuguauuuuuuaguagagacggaguuucaccguguuaaccaggaugguuuugaucuccugaccucgugaucagcccaucuuggccucccaaagugcugggauuacagccaugagcuggccaccacgcccagccguuguguuuuuuuaaucgagacgaggucucacucuguugcccaagcuggagugcaguggugugaucacagcucacuguaaccuccuauuccuggacccaagugauccuccugucucagccucccaaguagcuggaauuacaaccacaugccaccaugccuggauauuuaauuauuauuauuauuuuuuagaguuggggucuugcuauguugcccaggcugacuuuaaacuccuggcuucaaucgauccucucacuguggccucccaaacugcugggauuacaggcaugagccacugugcccagcccuaguuaaccuuugaaugcauauucaugucugauuuugguucugccauagccuggggaggauggcggccaaguguucuuucuaccugcagugugugugugugugugugugugugugugugugugugugugagagagagagagagagagagagaaaugaaauauagugugggacucaggguugagaagcccagggcuauggccaaaucuaagauuaggaugccagccaggcauggugguuuaugcccguaaucccagcaauuugggaggcugaggcggguggaucacgaggucaggagaucaggaucauccuggucaacauggugaaaucccgucucuacuaaaaauacaaaaauuagcugggcgugguguuggacacuucuugggaggcugaagcaggaaaaucacuugaacccaggagguggagguugcagugagccaagaucacggcacugcacuucagccugggcaacagaacgagacuccacaucaaaacaacaacaacaaaaaccccacaagaauuucauagaaacaaugaguaauuuuuuuuaggguaaguuaugucccaaacauuacaugggauauacuuauccucaaaaagguauuauugcuuaucugaaauucaaauucaacuaggcauucugcauuuuucuuugcuaagucuggcaacccugccagucacuggugaguuguguguccuugagugauggucuuugccucuuggagcuucaguuuucucaucuaugggauggggacagaacuugcugggaggcaccaauggcacgcgggguucuuugacaucucuggauguggaagcuguugaugugacugacugggagccucagacugggguugggucccugacuaggaggggugggggggcugggacuggcauccuuguccucuugaagcugccucccagccugagcuuggucccugcaggguuccugcuugguucagaccccaggcagccaguguugaggggaggguggagauuaauccauaguuguguacuggggcuuuccuccaacuuccuagcaagcaaguguguguguguguguguguguguguguguguguguguguguguguguguuuucucgacuuagccuaauccauuugcugcauggaaugugauccaggaucacugcuacuuuuuuuuucccauuuguuugcuuuugcuguguuuugucguuguuauuguuuuuucuaauuugugcuucuuuuguggguaauucucaggguggauuuuuuuuuuuuuuagaggauuuacuauucuucuuuagaacaaucuguuuuccucaaagauauugguggaagguuuaguguuuuggaacaaaauaagcagggguuguauacugagccuuauauucuaggugcugaggacugugguguguguguuggggaggcgguguguguguguguguguguguggguguguggguguguuggcagagagaagccaucuaaagacuucaauuuugaaaaacguuaacucagguguaagggacacaaggaggagaaacacgcaaauaggugugccaaggaaaggaaaucagggacggcugccuggaggaggaggcagcauuugaacuggauaucuugaagcaugaugggcuggauuuagaaauagggagcuaagguacaaagcacuucgccagccaaaagauagacuagccuagagaugacuguuauauguuugggggaauaaacaacagcaagaagaacaacaacaacaaacaacaaaauagcugacauuagugcagcacuuacuaugucucaggcacuguuugagugcuugcccugaguuguuucacuucuucuuccauauaagccauguuacagaggaggauaggagucuuggaguugugcaagaguugugggcaggccuguuuaguggugugcaggggauguaggggcagaaucuugagggaagugcaggaugauggggagccauggugggcguuggggccugggagggaccgccuucaggagaaugagaacucagggcauuugggcaauggagaucgggcucccugggaagcccucaccacacccagguaaaagguaauuaggucuugauugcaggucaggagagcaguccgggaaggaaagucagccagcgaggugggaggauugacaaaacaaauacauuuagcuuuccuugccccauuucugaccgcgggcaccuuuauccccguaaauuaucuccugaagaucuucuauguugacgcacuggagacaguuccccuuucuccuucugcaccugccgcguuacucaauccccuguaaucccauugucccgacugcaucauuucagagguggugauuuuaaggauuuuaacagggcuugccaaaagaauuauuuucuuggcguuuugaaaguaauuacuuaggcauggguacuuuacagagaaagcuacucaucccggcuggcugcagaguuuacagggcccgggaugaaaacacagggcccagguuuccuguccaugaagccggcucugccccugauccuucugaugcauccaccgugcgucugcucaccugucuugcuuucuguucauuuucucuuguagugugucccggcauggauauccggaacaaccucacuagguugcaugagcuggagaauugcucugucaucgaaggacacuugcagauacucuugauguucaaaacgaggcccgaagauuuccgagaccucaguuuccccaaacucaucaugaucacugauuacuugcugcucuuccgggucuaugggcucgagagccugaaggaccuguuccccaaccucacggucauccggggaucacgacuguucuuuaacuacgcgcuggucaucuucgagaugguucaccucaaggaacucggccucuacaaccugaugaacaucacccgggguucuguccgcaucgagaagaacaaugagcucuguuacuuggccacuaucgacuggucccguauccuggauuccguggaggauaauuacaucguguugaacaaagaugacaacgaggaguguggagacaucuguccggguaccgcgaagggcaagaccaacugccccgccaccgucaucaacgggcaguuugucgaacgauguuggacucauagucacugccagaaagguacgccggggauacaggguucuaagcagugucucgugccuuguucuagaaagcuuaaaauguuuuauggcuuaaaaauguuaaauggucauuagguaggggccggggaauagugggugguggcauucacuagcccagggaguggcagacauuuucuguaaagacucagauaguagauacuucagauuuugcaggccauauggucucugaugcaacgacucaauucugccacuguauuggacaagcagccacaggcaugcauaaauguaugacuguggcuguguuucaauaaaacuuuauuuacaaaaacaagucgugggccggauuuugcucgagggcagcaguuugccaccgccugugcuagucagugaauguucuucuugcuugggagaggaaaaggaguggaaaacuguagauucgguuuuuuuaaaaaaauaguuuaguucuuaucugauuauagaagugauauugcuuauaauagacauuuggaaaaagacacuuguaaacgaaaaaaaagcaaaacauucaucuuauuccacaacgcaugucgccgagaguaguuuauuggggguuguuccuucuagugaucuucaggaaucugucgugucuacugaagguuuccuuaaccauuccuguuauugggcauuaagaugauuuccaggccgggcacgguggcucaggccuguaaucccagcacuuggggaggcugaggcggguggaccacuugaggucaggaguucgagaccaaccugaccaacacggugaaaccccaucucuacuaaaaauacaaaauuagccgggcguggcggugcacgccuguagucccagcuacuugggaggcugaggcaggagaaucacuugaacccgggaggcggagguugcagugagccgagauugugccauugcacuccacccugggcaaccagagggaaacuccuucucaaaaaaaaaaaaaaaaaaagauaauuucuaguuuucacaaagagagugaugaacauuuuagagucaaagcuuuaucuagcaguuguuucuuuaggcuugcuuuccagaagugcaauuucugggucagaggcucuuggugcagauugacaaaugguguuccggaaauguugugccaacggccacuccuccuagcuuuggaggagagggaacaccuuggccagcuuugaguguuauuugaaaaaucuuucauaauuuacugcgggagggaggagcugacguguugucauuguuucuauuugcauuucuuugauugcuaucgggguugaaccuuuuaaaacauguuuauuuaucauuugaguuuucucuuccuguucauauccuuugcccauuugucuuuuaguaccucaguagcuuuugcaaaauuaaucuguaugugguuuucaucagugaaggcuacuaacccuuugccaauugcauuuuguuguuuuuguuguucagugguuuaaaugcucugggaaguguuuugcuggagaagcuuaaaauguuuauggaguucagagcuggauuucagugugccacuucuguacuuuacacuuagaaagucuucuucuacccaugaaagguuuuuuuucucuacauuuuauauuuuaauuuuuuuuuuuuuuuugagauggaguuucacucuuguuguuaagacuggagugcgauggugcaaucucggcucacugcaaccucugccucccggguucaagcgguucuccugccccagccucccaaguagcugggauuacaggcacccaccaccaagcccagcuaauuuuuguauuguuaguagagacgagauuucacuacguugaccaggcuggucucgaacucucaggugauccacccaccucggccucccaaaguguugggauuacaggcgugagccaccgcgcccagccuauauuuuaauuauuauuaucuaaaaaaauucauccucacuacuugagaucuguuugugugugugacucaacgggcguuucguuucucucccaaauagcuaacugggggccucagacagcuguugauuauagaaaucuaccucuuugccauugcuuuggggucuguuucugguguguccauagaucugccucuccaugccacagagcggugacuguucugaucaugguagugacuguucugaucaugguaguuuuaucauguuuucaugcucaaggaggcaauuccacauucacacauuacuuguuuguuguuucauggacuucuuuucacauuucccugggaagaacuagggaacaugcgauggaggugggaagaaguuaaguggguggcuugaggguuguaucacaaaagauagaagggaggggagaaaggaggaucuucuuaucugagcccaacgcucuggggaagccacccagagugagugaguccuuaaauagaccuaaauagaauccuuggaauugucugugaggacucccuuggagcccccagcaugaguccuuccaugggacauguuggaugguuggaaaucgggagugggauaguugaaaaaggaagauggguuagugaaggguggugggagaggggaccguuauuauugcacuguggaaaaauccugagaauauuguaggucaggggcaaggagaagcuaaacuaugaccagagagguuacuuaacuugcccagagccacacagcuaauaaaagacagaacugggguuugugccaaauuuaugcaagacauacaccagaauaaaagcuaugauuuuuuggaggagugggaaggauguccucucuguuuagaaacaagugagcugcuucuagcugggacaccaggggaaacagugaacauucuuuuauucuauuacugaguuuuccaaauguagugcuuguuugaaaagcucuaggccuaccuaucuugagauauaauuuaagacauuccucuaugaauuuauuuuuguaucuguuuuagacaaaauauccagaaugguguuaucugcaauugagucuccugcucccugcuggguguucaguuguuguugcuguuguuuguuuguuuguuuguuuuugagacagagucucguucugucacccaggcuggaguacaguggcacaaucucggcucacugcaaccuccaccuccuagguucaagcaauuuuccugccucagccucccaaguagcugggauuacaggugucaccacauccggcuacuuuuuuuuuuuuuuuuuugagauggaguuucgcuuuuguugcccaggcuggagugcaauggcaugaucuuggcucaccgcaauuucugccuccuggcuucaagcgauucuccugccucagccucccgaguagcuaggauuacaggcaugcgccaccacacccagcuaauuuuguauuuuuaguagagaugggauuucuccauguuggccaggcuggucucgaacucccgaccucaggugaucugcccgccuuggccucccaaagugcugggauuacaggggugagccaccgugccuggccaacaccuagcuaaguuuuguguauguuguagagacaggguuuggccauguuggucaggcuggucucaaauuucugagcucaagcaccucggcuucccaaagugcugggauuacaugcaucggccacugugccuggcugugccuggcugugccugauguuuugagugaauuaaaaauugcuuugcuauuaagaaccaggcuuuuguguccaggaggucgaagcugcacugagcccuguucaugccacugagcuccagccugggugacaaacugagacucuaucucaaaaacaaaagaaaacaaaaacaaaaaugaacacaaaacaaaacaauaaaaagaaccgggcuuguuuuuccaguacuggggguuuuguuacccggagaaggugcgacuaacacuucccgggguaccggguuccuggcaugugguauauaucucagccauccauuaguagcaguauccccagggggccaaaaaaugauuguuuuuugaacuguugccccugucuuugagagcaacucagcuucagcuuucuuuccccucuucaauuucuuguauugugauaaaauacacauagaauaaauuuuucaucuuaacuuuuuuuuuuuuugagauggagucuugcucugccaccuaggcuggggggcaguggugugaucucagcucacugcaaccuccgccuccuggauucaaaugauucuccugccucagccuuccgagugacugggacuuauaggcaccagccaccaugcccggcuaaguuuuguauuuucaggacagagggggcuuugccauguuggccaggauggucucaaaccccuggccucgagcaauacacccaccucagccucgcaaagugcugggauuacaggugagugccaccgcgccuggccccaucuuaaccauuuuaaguccacaguuuucaguggcauuaagcacguucacgugguuuugcaaccaucaccaccaccaucucccaaacuuucucauccucccaaacugaaacucuguccccaugaaacacucacuccaccaucucccucucccagcccccuggcaccuaccauccuauuuucugucucuaugaaugugaugacuguagggaccuccugugaguggaaucagacgggauuuauccuuuugugccuggcuuauuucacugagcauguuguccucaagguucauccacgugguagccugugucggaaauucuuuccuuuuuaaggcugaaucauguuccauuguauggagggagcacauuuugccuguguauucauccaucuacgggcacuuggucgcuuucacauuucugccauugugaaucagggccacugcuguugacgcaucuagcuuuucaaugccugcauuaaccuuguugcugaggcuuuaggaaacuuauuuauuuauuuauuuuuugagacggaguuuugcucucgucgcccaggcuggauugcaauggugcgaucucagcucacugcaaccucugccucccggguucaagcgauucuccugccucagccucccgcguggcucggauuacgggcaccugccaccacgcccaguuaauguuuuggauuuuuaguagagaugggguuucaccauguuggccaggcuggucuugaacuccugaccucagauaauccacuggccucggccucccaaagugcugggauuacaggcgugagcuaccgcgcccagccuuaggaggcuuauuugaugucugaugggauuuuugaauacagaauagauugagccuucagaggauacuccccugucuuaggugacagaaaugggcuggagaaaacuauccaucaaccccucuuuucccccagagucuuuucagauacuucugugaacauccguaguugcuauuuuugucuuccacacuuggcagcuucuggaagcaucaggggaaugcaucaacauuuaggaugaaggugcugguuuguccuuuggaccuaguuuaagcaauuccgagcaacauccaccccuucuucuaccugucccuuaagcacuuuuuacagggagaccaaaaaaaggcuuucaaugguuaagggggccggguguggaggccccacaccuguaaucccagcacuuugggaggccgagguagguggaucgcuugaggucaggaguucgagaccagccuggcuaacauagcaaaacgcugucucuacuaaaaauaugaaaauuagccaggcgugguggugggcgccuguaaucccagcuacuuaggaggcugaggcaggagaaucacucgaacccgagaggcagagguugcagugagcugagaucgugccauugcaccccagccuggccgacagagugaaacuccauuuuuuaaaaaaagaaaaaaaaaugguuaggggaauuaaaagaaaaacaaaaaaacauggcaugugcuaaugauccauagccuggacacccucucuccauuauccugcaauggauuuggggcaaagauaccaggagagguccaaugcacgaagccuuacaugggaagaguggagacggggucuaugcaguucguuuauugacugccuacuaggugucauguucuggggcgcucagggcauaggaagggagccagccuuugccuccucagagcggccagucuaguggcaaaugcagauguucacgaucaaaccaaguacacucagaagagggggagaguuagagggagaucuacauuaguucagccagcuggacgcgguggcucaugcuuguaaugccagcacuuugggaggccgaggagggcagacugcuugagcucaggaguucgagaccagccugggcaacauggagaaaccccgucucgacaaaaaauacaaaaauuagccaggcaugguggcaggugccuguaaccccagcuacuuggaaggcugaggugggaggaucgcaugggccccgggggcggaggucgcagugagcugagaucacaccacugcacuccagccugggcgacagagugagacucggugagacucugucuuuaaaaaaaaaaaaaagaaguucuuugaggcaagcagcaccggcuuccagucucguuuuaccauugacuggucacaagcugguucaagccucaguuucuccaucugaaaaaugggggucauuaugggaccugcuucuuaggguggugguguggggguugaaugagauggugcagggggaggcacuuaaccuagccucaggugcuccgugaguguccuggaagcuuccaguaaguaagcaccaugggcccacccuaucugggcagacuagcuuccaggugaauaucuaccagggcucagccucauuucugacuuugguuuugaggcaggcagaggaacauguaucuugcgaccugcugaugagggaugggugccacaccuccagccccagagggaagaccacccugauuuuugggugccaacagcaugggaugcucuggaaauucucagcucugggcauuuugaggggaccagaagccacagggcuugccugaccagcugcuuuagccaaacccacuggcauuuucuuucugggaggucaccccagcugcucacugccggccagaggggugggugaggccgggacaugcugggugccaggggaaaccaacccgagaugccacauauggacgucggcaccaaagcaggagggggaggcugaaagcagcaaaucccuccucccugggucugagauuacagcuccgagucaaagucucucaaagugugguauugugccuaccacauuaaauaucacguauuuaaaugcacgaguuuaaaugcaugcucuuggaggguuugauuuuuggcagaauuuuuagcugccuauggaaacucucugcuucuuuuucuucuuccauuuaaaaaguuugccuugauauuuuauuuuuuuacauuuuuauuuaguuuuuaauauuuuuuuaaauugagaugggagucuugcuauguggcucaggucggucucaaacuccuggacucuaaggaauccccccaccucagccucucaaagugcugagauuucacaugugagccaccacgcuggacuugacuugauuuuguuuucuuuuucuuuuuuuuuuuuuugagacagagucucgcucuguuguccaggcuggagugcaguggcaugaucugagcucacugcaaccuccgccuccuggguucaagcgauucuucugccucaaccuccugaguagcugggauuacaggcacgugccaccaugccuggcuaauguuuguauuuuuaguagagaugggguuucgccauguugccuaggcuggucuugaacuccuggccucaagugauccgccugccuuggccuaccaaagugcugggauuacaggugugaaccacuacucugggcuugccuugguauuuuaacaaucggaauugucuuuguggcaaaugcugauuucaugccagccgugguucugggugcuuugauuaggauauugcaucccaucuucccaacaaucuuauuuauuguugagaccacuaaggcuucgagagguuaagcaacuucuacuuccaacacugccccgcccaccccuuccgccgcgcaccccacacacauggguaguaaguaguggagaugggauuugaagcuggggauucuggcucagaauccaagcucuuuaccuuugugucuuauagaugucauugcgggaaguuggugaaaugcaggaaacuguaaaaagaaaggaaggaaggagggaaggaaggaaggagggaagaaagaaaagaaaaggaaggaaaaaaggaaggagggaagaaauaaaaggaaagaaaggaaggaaggaaggagggaaggcgggaaggaaagaaggagggaaggagaaaggaaggaagaaagaaaggaaggaaggagggaaggaaaggagggaaggagaaaugaaagaaggagugaaggaaggaaggaggaaagaaaaaaaggaaggagggaaggaaggaaggaagaaggaaaggaaggagggaaggaaggaaggaaagaaggaaaagaaacuggagaggaaaucuagaauuugccccugccaacauguguguugccucuucuuaucagccuucucauucugucuugacuuagggccucuccuaucagacuaagcucuccugaaggcagggacuuuguuguaucucaagcaccugucauaguaccuggcucacaguugacaaugacauccuuaacacucaucaauagcuaguguuuacugagcacuuacuaugugcuaagcaaugccuuaggggaucccaucacagccuaugaggguuuguuauccucauuuuacagaagagggaacugaggcauggcuaggaauuaugagacuugcucuaggagaccuagcuggggaaugguuugacuucagacuugucugacguaaggccuuugcccagugaucagcaaacuacgaccugugggccaaauccaguccgccagcugcuauuuuuguaugaccuaugagcuaagaauuuuuuauuuuauuuuuauuuuuagagauggggucucacucugucgccugggcuggagugcaguggggugaucauaggccacugccaccucagucagccuccucaguagcuggaaccacaggcaggcaccaccacgcccagcuaauuucuuuuuauuuuuuuaguagagauggggucuugcuauguugcccaggcuggucucaaacaauuggguucaagcaauccuccuuucuuggccucccaaagugcugggacuauaggcgugagccacugugcuugccuggcuuaagaaugcuuuuucacauuuuuggccgggcaugguggcucaugccuguaaucccagcaccuugggaggccgaagcgggcagaucacucgaggccaggaguucaagaccacccuggccaacauggagaaaccccaucucuacuaaaaaauguacaaacauuagcugagcgugguggcgggcaccuguaaucccagcuacucaggaggcugaggcaggagaaucacuugaaccugggaggcggaaguugcaaugaguggagauugcgccacugcacuccagccugggugacagggugagacucugucuauauaugagcuggacauucagcauucagggauagaggcuguuucagugggacuugggagcaccacggccugaggccauacagcccagcugcccuuugcugguacuuccuuccuuccuucccucuuuccuuccuuucuuuccuuuucuuucuucccuccuuccuuucuuccuuccuuccuuacuuuuugagacucugucucaaaaaagaaaaaaagaaaaaaaaaugugggguagagcacuguacugaaaaaaauuccacaguaguuguaauucauuuuucacucagaugauuagcauuuuuuuuuuuuuuuuuuggagcucucuguuuggguggaggagggcaguauauguacaaggcaaggcccccacuccacccuccucccuccucccaccccgccuuuccccuucgagugagucaucgaacccgugcuucuagacguguuuggagcagagcaccuggaaaucaugauguucucuagauaacagggaauauugauaaauucccuuguggcgaugucacugucguccauacagaagacaggaaaguguaacgccugcacacggggauccaacaaaaagaaaaagauaaggugggggaggccgggcacgguggcucaggccuguaaucccagcacuuugggaagccaagguggguggaucaacugaggucaggaguucgagaccacccugggccaacauagugaaaccccgucucuacuaaaaauacaaaaauuagcuggguaugguggugggcaccuguaaucccagcugcuugggagacugagacaggagaaucgcuugaacccaggaggcggagguugcagugagccgagauugugccacugcacuccagccugggugucacagcgagacuccaucucaaaaaaagaaaaaaaaaaaaaaaaaaaaagguaggguagagcauguaacgugaaugauggcccacuugaaucucucauucgucuuucuucccuuuuauguugucaaagaucuuuaaaaaaaaaaucuaggagagaaacaaacaaaaaaaacuguacugaaaaaaauuccacaguaguuguaauucauuuuucacucagaugauuggcauuuuuuuuucuuguuuuuucuuuuugagacaagggucucaacucuguuguccaggcuggggugcaguggcgcaaucuuggcuuacuuccgccuccugaguagcuggaauuccaggcacgcaccaccaugcuggcuaauuuuuguauuuuuuguagacaugggguuucaccacguuacccaggcuggucuugaacugcugggcccaagcaauccaccugcuucaaccucccaaacuguugcauuauauuauaggugugagccacugugccagccaggauuggaauuauuuauuuauuuauuuagugagauggagucuugcucuguugcccaggcugaagugcaguggcgcaaucucggcucacugcaaccccugccucccggguucaagugauucuccugccucagccucccaaguagcugggacuacaggcgcccaccaccacacccggcuaauuguuguguuuuuuuuguauuuuuaguagagacaggguuucacuauguuggccaggguggucucgaacuccugaccucaggugauccucccacuuuggccucccaaagcgcugggauuacaggcgugagccgccaugcccagcccuuauuuauucauuuuuauuuuauuuuaaaauaaaauaaauuuuaaaaauuugauugaaauuuuuuaaacaaacuuuucacuuuggagaugauuggauuuuguagagcaggaaagaacaaguacccuagagaguauguuucugggcucccggcuccucuuccggggguugaagaugaauugccguuggccuuuguaaaagaggagagauuguuccagauuggaguggcagagaugugcuuugguuuggguggcaaggaucacaaagaaagaagaugagguuggguguggugggucauaccuguaaacccagcacuuugggaggccgaggcaggaggaucacuugaaccuagaauucgagcucagccugggcaacauagcaagaccccaucucuacaaaaaauuuuaaaaaauuagccaagcauggugcugugugccuauagucccagcuacucaggagucugaggugggaggaucgcuugagccugggacuuugaggcugcaaugagcuaugauuacaccacuguaccccagccuggguaacagagugagacccugucucaaaaacaaacaaacaaaaacagaaggaaggaaggaaggaaagaaagaaagaaagaaagagaaaagacaagacaagaaaaaaaaaaaaaaagaaaagacagggugagagggaaggguauucggguggaugaaauggcaaagagaaggccaagaggcguuuugugggcaagagugaagagggugccucaugccgggaagggaggcuuggaccagugcaggguccuuaugggcuccaaugccgucaugaaggucacacaggggcuguguuuaggaggggcuguuuccaccaauacugaguggacagccuugcugagccaggcuuuuuguugcguccccgaaguccuugcugagucagggaggaagucaaaguaacuaucagguuagauaagcugaugggugggcagaaaguguuuugguggguucaaggcugcgcugaaagaugguagaccaguugaccguguggucacuuggcugccccagagaugaugcugucuaaaucuugaguggugaagauaacgaauuuacaauucccaccauugccuggcuuccuggagcgggugggugcggggaccggggaggggggccgggggaggcugagggcuaucaguugaaacugaccuuuuggcccaauccuuuugggaagaaggcggguagaguuaaaauccaucguaauggaaaggcggcuuucccuuuggcugucugcuaacuuggugacuggccugacaaguuuuucuuuuccuuccuccuaccugauacucacugaccgguuacuucccaugucacccgacccuuugucagaauuaaaaucuguucuuugugacugaacaccugaaaugccccggggaggacccaaggaagucagcgagcgccugugcgucaggcuggcagcccagguccuucagugaucuguuucucucaaugcgccugugucagauagaaccgugcauuucccaguaaaaggaggugaugugugugcuggaguuucaagauuguaccccuuauccuaucuccccuuuccucugucuucccucucuacuuuuuuauuuuguuguuuguuuguuuguuuuugagauggggucuugcucugucacccaggcugcagugcaguggugcgaucauagcucacugcagccucagccuuuugggcucaagcaauccuccagccucagccuggccaguagcuggaacuaugggugcaugccaccacgcccagcuaauuuuauuuacuuauuuacuuauuuauuaaagagauggagucuugcuauguuucccaggcagcucacaaauuccuguccucaagugacccucucgcuucagccucccccauuagcuaagacuacaggugcgcaccaccaucccuggcuaauuuauuuuuuaaauuuuucuuuuuguagagauggggauuuugcuauguugcccaggcuggucuugaacucuuagacucaagcaauccucccacuuugggaagcccaaaguguuaggauuacaggugucagccaccaggccgaccuguuugcucauuuuuccuuuuccuuuuuucuuuucuuuucuuuuuucuuuuuuuuuuugagauggaguuucgcucugucacccaggcuggagcacagugacacaaucucggcucacugcaaccucugccucccagguucaagcgauucuccuaccucagccuccugagugcugggauuacaggggcaugccaccacgcccggcugauuuuuguauuuuuuagugaagacgggguuucaccagguuggccaggcuagucucaaacuccuggccucaaaugauccaccagccucagccucccaaaguguugggaugacaggcgugagccaccacacucggcccguuugcucauuuuuaaacauaaaugaugucaagagugggaagcaaacaagaaaguguugaaagcauugcucuccucugcucccugguuaccuaucauccuggggcccgaggaguggcugcagauugggccaccuuccuccaaucacagguuugggaaguggaccaaagucuuucaacacacuggacuuagcaugaucaucaaauuugcacuggaggggccaggcacacgccuguaaucccagcacucggggaggcugaggcgggcagaucacuugaggucaggaguucgagaccagccuggccaacguggugaaaccccgucucuacuaaaaauacaaaaauaagccgggcuggugguuggaaccuguaaucccagcuacucggggggcugaggcaggaggauugcuugaacccgggagguggagguugcagugagucgagaucacgucacugcacuccagccugggugacaaaagcaaaaccucguaucaaauaauuaaauaaauaaauaaacaaauaaauaaauaaaaaauuacacuguagggcaugugguaggugaagcccaccauugucaaguaccuaccuagaggguuugggguagaggguccuguggcuucuucuauuuuuuuuuuuuggcggagucucacucugucaccaggcuggagugcuguggcacgaucuuggcucgcugcaaccuccgccucccggguucaagggauucccccgccucagccuccugaguagcugggacuacaggcgcccgccaccacgcccggcuaauuuuuuuguauuuuaguagagacaggguuucaccauguuggccaggauggucucaaucucuugaccuugugaucugcccgccuuggccucccagggugcugggauuacaggcgugagccaccgcgccuggcuguggcuucuuuauccuagaaguuucuuugccucucguuuugucccaggcgaggagggucuuggaucuuuaaugacuccauggcuuauugaguguagcccagaaagaaugguuguuuaauaggcuuuauuaccgaguguuuccaagggcuuaccuggggaaggaaaacauuuuuacucggaggucugauaaggaugggcuuuaaagcgcuggcagcuagucauguccacacgcggugugcgaagcacggcguuguuuacugaccaccugcaaagcccgucggcuggugaacaaggcucuugucccaggcugccucauugguggugaugauguuaagaguuuccucauuugcaaauaaauugacuaaccuagcagacggguuugauccaaaguggucaagauuccuuuucuuuaaauuuguuuuuuuuuugagauggagucuugcucugucacccaggcuggagugcaguggcgugaucucagcucacugcaaccuccuggauucaagcgauucuccugccucagccuccugaguaacugggauuauaggugaacaccaccacgccuggcuacuuuuuuuguauuuuuaguagagaugggguuucgucauguuggccagaauggucuugaacuccugaccucaagugauccacccaccucgaccucccaaagugcugggauuacaggcgugcgccacuacgcacuggcaaauuuuuguauuuucaguagagacaggguuucgccauguuggccaggcuggucuugaacuccggaccucaggugauccacccaccucagccacccaaagugcuacaauuacaggcgugagccaccgcaccugggcuauuuucacuucuuucgaaguuauaccuaggaguggaaucgcugggucaguugguaauucuauauuuaauuaauggaaucaagauuucuuuuucuuuucuuuuuuugguuuuacuuuaaaaaauucuaucuuauuacauaaaaaaaccacagguucagaaaagccacaccaaacaaaugaauagccuaaugguucacucuaacgucaacacucauauaaucccuaacucugguugagaaauaguacuuugccagaacacccccuccaaaagccaugccacggaccacauccuagucacaggccucuucccccagaguagucacuguccugucuuuuguagacaucacuuccuucuuucuguauaguuuuaucacccaagugugaaucuguagacaaauauuuagcuuugcccauuaaaaaaaaaaauugauggccgggcaugguggcucaugccuguaaucucagcacuuugggaggcugaggcgggaggaucacuugaagccaagaguuggagaccagccuggacaacauagugagaccccaucucuacuaaaaauaaaauaaaaaauuagccgagcaugguggugcaugccuguagucccagcuacucgggaggcugaggugggaggaucgcuugagcacagaagguugaggcuguaaugagccgagauugcauauugcacuccagccugcgugacagagcaagacccuggcucaaaaauuaacacaauaaaauaaauugauguguuuguuugggucucuagcagugguuuugaacugagggugauuuuuuuugucucccaggggacauuuggcaaugucuggagauauuuuuugguugucacaacuccagggaauguguguguacugcuuucauugagcagauggaggccagggaugccguucaacguccugcaaugcagagacagcccagccacaaagaaugauccagccccaaaugucaauagugcugaggggcagaaagccugguccacagguucucccuccaucccuuuccuuuuaccuucucucuguugaagagcugggcuuucuggcuuggggugcaguccccagucugaguguugcugaucguacguuccugggacaguucugcuugccccucugagcuccagacucagagcuagggucacacucagguucuaccucuuggacugacuuuauuuaacaaguaccauuucagcacucucugcagucagcuguuuucaaaggcgaccaugcuugaugcuguucguuugcacauggcucugaguggugguguguucuuugauuuuuuuucuuuuucuuuuguuuuaaagaaaaacacaccguuuuuuaaacacgguugcccgaacucucaucuucuuccucccugcccucccucccucccuccucuccuuccuuccuucccucccuccuuccuuccuuuuucuuuauuuccucccuuccuuccuucucucccucccucucccuuccucccuuuauccuucucucuuuccuuccuuccuucucuuucuuuucuuucuuucuuuucuuccuuuucuuucuucuuucuuuucuucuuucuuccuugcuuucuuuuuauuucuuaccucccuuccuucucucccuuccucucucccuccuccuuccucuuucccuuucucccuccucuuucuuuuucucucucuuccuuucauuuuucuccccuccccuccccuucuucuccuccccuccuuccccucuccuccuucccauccccucucuucccuuuucuuccuuuccuucuuuucccucccucucucuuucuuuucuccuuuccuuuccuuucccucucuuuucuuucuuucuuuucuuucgacagggucuugcucugucacccaggcuggagugcaguagcaugaucauagcuaacagcagucuggaacuccuggucucaagccauccucccaccucagccuccagaguaguugggacuacaggccccugucaccaugcccaguuauuuuauuuuauuuuuuuuugagacagagucuggcucuguugcccagguuggagugcaguggugcgaucucagcugucuguaaccuccaccucuugggcucaagugauucuccugccucagccuccugaguagcugggacuacaggcaccugccaccacgcccggcuaauuuuuuguauuuuuaguagagacgggguuucacccuguuagccaggauggucucgaucuccugaccucgugauccacccuccuuggccucccaaagugcugggauuacaggcgugagccaccgcgcccagccgcuaauuuuuuuuuaauuuauuuuuuguacagauggagucucacuauauugcccaggcuggucuugaacuccagggcucaagcaguucuggcacacuagccucccccaauucaaugggauuacagguguacccauuuuuuaaaaaugggccagacuaaauauuugucuagagauccauacuugagugauaaagcuauaugagguuccaucugggaauucgguucugcgguaaaacggugccgacgggccucccuuuuuuuagugucugacaaacagggcacagaccgaacuucauaacaaaacuuuguguucuugacgaaggcaaguuuugcuaagaaaauuauuuuuauaagcgagaaagguaugaagguuauuugcaaaggaauuuuacuggggugagaaaaaaagcaagagguuuaccuuaggauuccuggugguaaagaagauggaaugggcagaagacgucaucacagaugucacggggagagcgauagcugaaccucugaaaggaaagagguucccagggaaggaugaauuugaugcaggaaaaaaguuagaggauggucuuaaauuugucaauguaguucagaggaaaguguaauucuucacagacuuuuaguuuugaaaggauggcuucaaaagauacugggggacaugggcgcaguaacucacgccuguaaucccagcauuuugggaggccgaggugggcggaucaucugagguggggaguucgagaccagccugaucaacauggagaaacccugucucuacuaaaaauacuuaauuagcugggcgugguggcgcaugccuguagucccagcuacgugggaggcugaggcaggagaccaucgcuugaaccugggaggcagaguuugcagugagccaagaucacgccacugcacuccagccugggcaacagagugagacuccgucucaaaaaaaaaaaaaaaaaaaaauucuggccaaccgggaauaguccaggauaauccauucuucagaacuuguucuugcuaacucaguuaagugucgaauggcguggguugucuacuguauuuuagaggacauuagaauauuuaugaagggcuuucccagguuuacucauaacuucauuuuccucaugcuauuugucccuuaaagucuuucugaaaucuuucaguugccacuucuucuggguggguggguauguauguugagggucaugcuuuuuuuuuuuuuuuuuuuuuuugagauggggucucccucugucgcccaggcuggagugcagugauguaaucacaccucacugaagccucaaccucucaggcuuaagugauccucccaccucagccucccaaguagcuggcacuacaggcaugaaccaccgugccugacuaauuuuuaaaaaauauuuuugcaaaauuagccaggcgcgguggugcacgccuguagucccagcuaccugggggacugaggugggaggauugcuugagccugggagguugaggcugcagugagccaagaucaugccacugcacuccagccugggugacagagcgagacccugucuccaaaaauaaaaaaauaaaaaauaaaaaauaaaagauggagucuugcuguguugcccagguuggucuugaacuccugggcucaagugauccuccugccuuggcuucccaaaguucuggaauuauaggcaugagccacugcaccugucuggguccugcuuuugguagugauauagaaccaacuuagugaaauucuagaaugacgcuguccacuaagguagcucugccagccacagccacauguggcaauuuaaguagaaauucauuaaaauuagauauuugucccucaguuguacucaccauauuuagacaaugcagacagacaauguugcuaucacugcaaaaacuuguauuggguaccucugccuuagaacuuuucauuccaugaugaaagauuguucuggagucagacaggccugcauuugaagccuauaucuguuuugugaccuugggcaaauugucuagcuuuucugaaugucuguuuuuucuucuaucaugaggacaugauaagggaaccagucuccaagguuuuccucagcuuugaacugguauauccccucuuucgauaaaaauaaaaauccaguuccucuucccuacuuggaguuuguucuuuuuuccucuaaauauaaaauauaccguugaauguuuuuucaaccucuccaccccuugagagucccuggaauagagaggaaggaguggcuugggaaaguugaucacaacaaagaggcuauuauagguacaucuaaucgagaagaggaacaaggaaggaguagguguguugaccggggcucagagugucuugucugugggucaccaagaaugaggaaugugucagcuccuuccuggcuucuccucucugggaacagagaacagugcauugcagcuuaaguggaguaaaauggguguggguuuggaggaaguggauuaaggauggggaaggggccgugggagagaaccccagccugaguuugucuuccuggcucagcacugagugucucagucaacacaugaaugccaguaaugggaaucuauuuggauucacuuaagccaugaggugggggcaguguguuaacuggggcaacacagggcucucagcuugaaucagcuagcuuuugcuguguagcaaaccacucugaaacacagaccuuggaauuuauauucaaguuuaaucauggagcuuguaucagcuagcuuuuccuguguagcaaaccacucugaaacauagaacuaggaacuuguauccaaguucauucauggagcuuguaucagcuagcuuuugcuguguaacaaaccacccugaaacauacaacuuggaacuuguuguauccaaguucagucauggaguuuguaucagcuaauuuuugcuguguaacaaaccacccugaaacauagaacuuagaacuuguuguauccaaguucaaucauggagcuuguaucagcuaguuuugcuguguaacaaaccacccugaaacauaaaacugggaacuuguuguauccacguucaaucauggaacuuuuaucagcuaacuuuugcuguguaacaaacuacucugaaacguaauggcuuaaucaacaaucauguacuuagcucaugauucuuugggucgcugggcaaguuuucuuguuuagacccaccagcugaccacaaacacaggcucuuuucucucucaugucugggaucaaccaguggguugucugguagcuggauggucuagcauggccucacucacaugucuggugguuggugcuggcugucagcugggaggccuugguuuucuucccuguagcugcucauccuccaguuggcuaguuugggcuuagauuacaugauagucucagcguuccaagaguggcaagagaucaauuuccaguacaaaagugccuuuugaguuucuguuugcaucuugugugcuaacaucccauuggcuaaggugagcugggagggaaagggagaauauagucuuuaccuguugauggaagaggaagaauuuguggcccuguuugccaucugccaaagaacccuggagugggaaacaguggggcucauaaaacauuuuuuuaaaaaccucuuauuuuagguucaugaguacaauaacauuuuaaucagaauuuggagcucaauuggacaucaggacuguguauggugugacugaggacauuaaaugauuuuuuuuugaguaggaauuuaacuuuaugaauuccacuuguugaauaaccaauuccuuccccaguaauucuugauguuuucuucaucagguauuaaauucaaccaaaaccaugaauuugcuuuugggauaucaauucuauuucaaguccucugugucuuaaucuuaucccaguaccauacuguuuauagauuuagaauauguguuuuuuuaguuuuguuuuuguugucguuuuguuuuuaaagaaguggggcucggcugggcgugguggcucaugccugcaaucccagcauuuugggaggccgagguggcuggaucacuugaagucaggaguucgagaccagccuggccaacacagugaaaccccgcuacuauaaauacaaaaauuagccgggcaugguggcacaugccuguagucccagcuacuugggaaccugagacaggagaguugcuugaacuugggagguggagguucaaugagccgagauugugccacugcacuugagucugggugacagagcgagauucugucuucaaaaaaagaaugggggcucacuguguugccuaggcuggacucaaacuccugggugcaagugauccuccuuagccuccaaguugcugggacuacaagcucaugccugguaagaacaugcuuuauaaaguggcaaaucuaguuuuuucccuauuacaccuuuuagaagaguguuuccuuuucugguugaacuaaauauuucccuccucucacucucauauaaaacccauugagggcugggcgcgguggcucacgccuguaaucccagcacuuggggaggccgaggcagguggaucacgaggucaggagaucgagaccauccuggcuaacacgguaaaacccugucucuacuaaaaauacaaaaaaauuagccgggcaugguggugggcaccuguagucccagcuacucgggaggcugaggcaggagaauggcgugaacuugggaggcggagcuugcagugagccgagaucaugccacugcacuccagccugggcgacagagcgagacuccaucuugaaaaaaaaaaaaaaaaaaaaagcaaaaacaaaaacaaaaaaacccauugagauauugauuuaaaaauuuaauuaaaaacauaacccauuucccagaggaaaaaaagugcagcucgcugccagcacuccuuuaauuuuacauaaacauguucuuugaggcugaagcaaaucugacugauuuucaauaugagaaaauauaaaacgguucuuggaguuauuucuaaacagaacuugucucuaaucuuaauguaacagaaaugucuauaauguuacauuaggauuagagaauagauuauucuugggacaaauggaaaaauggguuaaaauccauaaauuaagaaaucaauacuuucguauuuuuccuuuccgggcagguaugggaucuccuuuuccauuugcucaaaucuuuuuuuuucuuuuugagacagagucucgcccugucacccaggcuggagaguaguggcacgaucucggcucacugcaaccucugccucccaaguucaaacaauucuugugccucagccuccugaguagcugggauuauaggcacacaccaccaugcccggcuaauuuuuguauuuuuaguagagacgggguuucaccauguuggccaggcuggucucgaauuccuggccucaagucaucugcccacuucggccucccaaagugcugggaugacaggcaugagccacugcgcccagccaauuuguucaaaucuuuuauauuguccuuucuucaucuuuauccuguauuauuuuugugacgaugguuccugauuucuguaucacagaguuuuguuguguuaguuauggcuacuaugaauagcauauuuacccugaauccagauacuuuagugaaauugauugguagguuuuuaaauuguuuuauucauugugugcaauuucguccucuacaaauuauggucauuuaaaaaaauuaugucugcucaguucuggaagcaugaaaaaaauuaugucuaaaaucauaccucuuguuucgguuuuaaaucuuauucuauugaccagggcuucuagacuaacauuaaauauuuaacaaugguauuauccgacaucuauguuuaauagauuuccuaauauaaaaucauccuugcuuuccugugguaaaaccuacuugguugugaugaauuauucuuucagcauaauguugaauucgauuugcuagguuugcuuuguuucguuuucugaauucuugccaucuguguucaugagugaaauugggcuauguuuuugguugguuuuauuuugcaaugucuucaucaguuuggauuauuuauuguguucuagccacauaaaaugaaauagcagguaacugaguauucauugacaaauuuuauggugccauaacuuuuggggggaagcaauucuuugauaacuuaagaaaaaauuuaggccaggugcgguggcucaugccuguaaucccagcacuuugggaggcugaggcagguagaucacuggaggucagggguucgagaccagccuggccaacauggugaaaccccgucucuacuaaaaauacaaaaauuagccaggugugguggcgcacgccuguaaucccagcuacucgggaagcugaggcaggagaaucacuugaacccaggaagcggagguugcagugagccgagaucgcaccacugcacuccagccugggcaguagagcuagacugcaucucaaaaaaaaaaaaaaaaaaaaaaaaaaaaaccaaaacagugugugacuggcugugacguaaggcagucagaccucuccuucgaaaugggccgugauucaucuuuauuuuuguagggcugugucacguuagaaccacuacagcaaaaguuuucauuggaaaucuaauaauguuuuuuuagucugccaucuggagucugugcuccuuguaugucuuuauuguucaagacuaagaguggugugugugucuguguuggggggaugggguuugguaauuuugcuaacauggcucuaagaaucugucccgcuucccaaaaccucauuuuucucugcuuuagcaguagcccaacacugaaaacagaguacugcuuuuuuagaggaguucugauuuggauuccuuuucuuucuuuuuuuuuaggccaaaauuuucauuuauaaauagcuucugugguacacaacaugcaaauauuuuugguuucaugauauuacaccagaguugcagaguuguagcuguuuuuuuuuuuuuuuuuuuugaggcagucucgcugugucacccaggcuggagagcaguggugcgaucuuggcucacuguaaccuccaccucccggguucaagcaauucucuugucucagccuccugaguagcugggauuacaggcgcccacaccacaccuggcuaauuuuuguguuuuuaguagagacgggguuucaccauguuggccaggcuggucucgaacuccugaccucaagugaucugcccuccuccucagccuuucaaaugcugggaauacaggcaugagccaccacacccggcugaacuuuuauuauuuuaaaaacauuuuuauuuauaguaaaagucacacauaaaaugaaauuugcuguuuuuagaaagaauguuuaaaaagauguguaccauguugcccaguacaguggcuauucagaaacagccauaguacaccacagccucaaacuccugggcuaaagggauccucaagcuucagccucccaaguagcuggggcuacaggaacacaccaccacaucuggcuugccuccuucuccuucucuuucuccuuuuccuucuccuucuccuccuccuucuucuuuuuuuuuuuuugagacaagagucucacucugucacccaggcuagagugcaguggcaugaucuuggcucacugcaauuucugccuccugaguucaaagcaauucuccugccucagccuccuaagcagcugggauuacaggugcauaccaccauaccuggcuaauuuuuguacuuuuaguagagacgggguuucaccauguuggccagucccgaacuccugacguccagugauccuccuacugcggccuuccagagugcacaggcaugagccacugugccuggcuuguuuucuucuuuuuuuaaauuuaaugaguuuaggcaggguuucucagccucaacaguguuagcauucugggcugaaccccucuccgugguggggacugcccuguacauuacaggaagcuuaguagcaucccuggccuccacucaauaccaguagcaaccccaagucaugacaaccaaaaaugucuccggauacugccaagugcugggaucacaggcaugugccaccaugcccagcugauuuauuuuuauuuuauuauuuuugagacagucucgcucugucgcccaggcuggagugcacuggcacgaucucagcucacugcaaccucugccucccggguucaagugauucuccugccucagccucccaaguagcugggauuauaggugcacgccacuaugccuggcaaaguuuuguauuuuuguagagacgggguuucaccauguuggcaggcuggucucgaacuccugaccuccagugauccacccgccugggcaauauagcaagaccccaucucuaccaaaaauuuaaaaaaauuuagccggggguggcggcauguucuuguaguucuggcuacucacgaggcuaaagugggaggaucauuugagcccaggaguuggaggcugcagugagcuacgaucacaccacugcacuccagccuggacaacagggcaaggccucaucucuuaaaaaaaaaaaaaaaaacaaaauaaaauaaaaagugaauaagugaaaguaauaaaauguaagauacaguuggaguucucuuugucaucuucccuugcuauauucuccucccuucuucccagagguaacaacucucuuagguuugguacauaaacuuccagcccugcauguauuuugacacauaaccuuguacacacgucaaugccagauacagguucaguaucccuuauucaaaaugcuugggaccagaaguguuucccacuugggauuuuagaauaugugcguauauguaaugagauacuguggggcugagaacgaggucuaaacguuaaauucauuuauguuucauguacaucuuauacacauagccuggagguaauuguauacaauauuuucaguaauauugugcgggaaacaagguuuucaccgcccugacugugaccugucacaagaggucaggaauggaauuuucuuccacugcuaucaugucggcgcucaaaaaguugaauuuuggagcauuuaggauuuuggauuuucgggccaggaaauuuuggagcauuuaagauuuuggauuuuggguuaucuucaguuguucuuuaaaucuauuuauuuauuuauuuguauuugacaacgaguuucacucuugucacccuggcuggagugcaauggcgcaaucuuggcuuacugcaaccuccgccuugccucaagcaauucugcucucuaguggcucagauuacaggugugcaccaccacgccuggcuaauuuauguauuuuuguagagaugggguuucaccauguuggccuggcuggucucaaacucccgacuucagguaauccaccugccucagccucccaaagugcugggauuacaggcaugagccaccacgccuggcauaaaucuuucuuuaaaucuuucgcugcuguaauaaaauauacaucauaaaauuugccaucuuauuuauuuuucaguauacaguucacugguguuaaacacugccauuuauauuguaauacacuuuugaguauucuaaauaucugcauauauugggaagcuaaguaguacuaucccuuaggaagccauuguguauuuugcacguaaagcacauuucaguucugacuggccacacguggcugguccugcuguaauggaucuagucuuuaaaaauacuccgcgagagcuugcagugagcugagauggcgccacugcacuccagccugggcgacagagugagacuccgucucaaaaaaaaccaaaaaacaaaaaacucugcgaucuuccucaccaugcacacauaugauauuuuugugauugugauuccaauugcuacaccugcugcaugaguucuuaagccaaaugcuuuuuuuuuuccucucagccacuauguucuuuaaguuuaugccucuugauucaguauugcuaguucauucuuuuaagugcuacauaguaucuuguaugaauaagccacaugcuacucaccagcuccccuagugggaggcauugagauuguuuccgguuuguuucuuuuauaaacaaugcugcaaugaacaucuugguguccaucuccuccuacccauuugugaaugguuuucuaggauugauguucagaauugaagucacagggaauggaguaugugcauuuuuagaucuaguauauacuccccgaauggucuccaagguggcugugacaguuucaccagugaugcauuaagguauaugucaaaugugggcaaggcugcaggaaaauuauguuaauuccagugcauggaaauugguauccuaugguauucuuuugcaucucccugauuccugguaagacugggaaucucucuguaugcuucuuagccaugucuuccuaccucuuccuccucuuucccugggagcuguuuuggggugggggggcugggccuuuuucuucagggacucugcauuggcaacgucacaaagaggugcacaagggauugaagugucggaaaugcuuugcugcugucauugcauuucuuuacccagcauuucaauugugcuuugcuuugcuuuucucacuugaaauuguggccagauagaaacccaguuagacuaauaagcauccaucuuuuuaaaucucuuugagaugcugauguuuggauaucuucaguugcucuucuuuaaaucuguaauuuuuuuuuuguaguaauaauaggacaugcaucauaaaauugaccaucuuaaccuuuuuuuuuuuuuuuuuuuuuuuugagaauucaucuguugauggacauuuggguuguuuccgccuucuggccauuguaacuaacgcugggaaaaacacgggucuacaaauaucuguuuguggcugcccaaguuuuggggacacauaguggaagcccaccccuuccugauugaagcauggggcccauugagagacuuagcccauaggagccucuuuccagugaggaauauggagggaauggagggcaguacaaaaguucuccggccuggacccuugugauucuuugaaggcugagacgagagaugagacucauggcuggguucacuuuuugguucacuuucccuuuccuuuuuuuuuuuuuuuuuuuuuugagauggagcacucuguugcccaggcuggagugcaauggcgugaucucagcucauugcaaccucuaccuccuggguucaagugauucuccugccucagccucucggguagcuggaauuacaggugcaugccaccacgcccggcuaauuuuuguauuuuuuaguagagaugggguuucaccauguuggccaggcuggucuugaacucaugaccucaagugaucuacgcaccucagccucucaaaguacugggauuacaggcgugagccacugagccuggccucuuuuuccauuuucuguugcaucaauggaaaguccaucuccugcccguggacguuuucuauguugauguggaauguggcauuuguccaggaacuuggugcuuuuuuuuucccucuauuauuucauuugcuuuuggauuuugagagauggagaacuuccuuagugugggagggaaacaguuauggauuuacuuuaugauucuacauucaauccuggucucuucaaaugauuucagggcuuguuuggccaggucaagucuguucuaggaggauuuucuuuccauccuuccucugggaaaugaaugaguauaaaaacaugcccaagauggagggaaaccuccccuucccuuuuuugccuuuuucuuccugguuuuguacauaacugaacauuuugauuuugggaugagaggauauuaguucauucucacauugcuauaaagaacuaucugagacuggguauuuuuuaaauuuuuaaaaauuuaauuuaauuuaauuuaauuuaauuuuauuuauuuauuuuuuugagauggagucucgcucugucacccaggcuggaguccaguggcgccaucuucgcucacuguaagcuccaccucccggguuuacgccauucuccugccucagccucccgaguugcugggacuacaggcacccgccaccaugccuggcuaauuuuuuguauuuuuaaauagagacgggauuucaccaugcuagccaggauggucucgaucuccugaccucaugauccacccgccucggccuuccaaagugcugggauuacaggcgugagccaccacgcccagccuauuuauuuauuuuuuugagacagagucucccuguguugcccagguuggagugcaguggcauggucucugcucacugcaaccuccaccuccccgguucaagcgauucuucugccucagccuccugaguagcugggauuacaggugccugccaccacgcccggcuaauuuuuauaguuuuaguagagacgggguuucaccauauuggccaggcuggucuggaacuccugaccucgugauccaccugccuuggccuccuaaugugcugggauuacaggcgugagccaccgcgucuggccuguuuuuuuguuuauuuccauagguuuugggggaacaggugguauuugguuauaugaguaaauuauuucguggugauuuguaaguuuugguggauccaucacccgagcaguauacacugaacccaauuuguagucuuuuaucccucacucacuuccuauccuuucccccugaguccccaaagucuauuguaucuuuuuuuuuuuuuuuuugagacagagucucacgcugucacccaggcuggagugcaguggcgcgaucucggcucacugcaagcucugucuccuggguucaugccauucuccuuccucagccucccgaguagcugggacuacaggcgccugccaccaugccuggcuaauuuuuuuguauuuuuaguagagacaggguuucaccguguuagccaggauggucucgaucuccugaccucaugauccgcccgccucggccucccaaaguguugagauuacaggcaugagccaccgugccgggccuuguaucauucuuaagacuuugcauccucauagguuagcucccacuuaugagugaaaacauagauguuugguuuuccauuccugauuuacuucacuuaggauaagagugagacuaaguaauuuauaaagcgcugggauuagaggcgugagccauggugccuggccaaugucuggcaucuuuucuuugguguaauguuuugagauucauccaugguuuugcauuuaucaauagcguauuucuuuuguguuguucaguagcauuccauuguguggagagacgacauuuaguuucaccauuuuagcuguugagagacauuuggguuguuuucaacuuuuggcuauuauucauaaaccugcaugaaccuguuauacacaauuguguaggagucuuuuauguggaccaaugccuucauaucucuugagguuauauccuggagcagaauggaugaguuguguaguagaaguguguauaaggagugggcaggccaggugcgguggcucaugcuuguaauccuagcacuuugggaggcugaggcggguggaucacuugaggucagcaguucaagaccagccuggccaacguggugaaaccccgucucuacucaaaauacaaaaauuagccgggugugguggugggcaccuauaauccaagcuauggugggagaauugcuugaauccagcagguggagguugcagugagcugagaucgcaccacugcacuccagccuggguaacaaagcaagacucugucuuuaaaaaaaaaaaaaaaaaaaggaaaggccagauuguuuuccuaagugguuggagucuguuauauuuccaccagcaauguaugagaguucuaauugcuccacauccuuagcagcacuuaauauuuauugucaaucuuuauuauuauuauuguuauuauuauuuuuagagauaggaucuuacucuguugcccaggcuggaguucacugcagcccugaacuccugggcucaaguaauccucccaccucggccuccugaguagcuuggauuacaagcacacaucacuacacccagcuaauuuuauuuuuguaaagaugaggucucacuaccuugcccaggcuggucuugaaccccugggaucucaagcaaucucccuccucauccuuccaaaguguuggauuacaggcgagagcugcagcgccuggccccuuucacuuucuuaacaguaucuuugaaaagcagcugauuuuucacaggguguuguaauuaauuuaauuagcuccacacuguggcuuugaaaaucuuccguaagcucuagcgccagacacauggauauuugcagaaucuuauuuucuagaguccuggaaauuuucuuuccugugagagaguugagagcgauaauuuuagggugguuauucaucuucagacacaaggaguaagaauguagggaguucgugacuguguuuggagaggggagagcauagcaguggucuaaugaucuucucaggguucucaaaggguggacgagcugcagguugaaacuugccuugcuuuuagacuguugacugaguuuguaguuaagcagauaagugccaaaggagaagucagggcugacugauugcaagugaugauugaauacuggcccucacaaccaucugugaaaagucuauuuccagaaauuuuuuuuauuuuguuauuauuauuauuauuauuuuuugagacggagucuuucucugucgcccagucuggagugcagugaugcaauuucagcucacugcaagcuccgccucccggguucacgccauucuccugccucagccucccaaguagcugggacuacaggugcccuccaccacaccuggcuaauuuuuuguauuuuucguagagaugggguuucaucauguuagucaggauggugucgaucuccugaccucguguccacccgccucggccucccaaaguguugggauuacaggcaugagccacugcgccgggcccagaaauauuuuuaagaagagauuuuugaaaaacccuuguuuucaugaugggaggauaugaaaagcaguguuuugaaaucuccuccuuagauccugauacucggaacugucgauucucccauuuucauuuucuccuggauagauuguacacuugugccuugguaucuucaaugauuccaaaaccccccuggggauccagucccugacauaaaauggcguaguguuuguacauaaccuacauacauccuccuguauacuuuaaaucaucuuggucuggcaguguggcucacacuuguaaucccagcacauugggaagcagaggugggaggauuacuugagcccaggacuucaagaccagccugggcaacauggcgagacccccaucucuacaaaaaauuuaaaaauuaauuggguguaguggcaugugccuguagucccagcuacucaggaggcugagacgggaagauugcuugagccagggaguuccaggcugcagugaguuaugaucgcaccacuacacuccagccugggcaacaaagaaagaccccauuuccauuuaaaauaauaggggccagaugcagugacugaugccuguaaucccagcccuuugggagccugaggugggcggaucaucacuugaggucaggaguuugagaccagccugcccaacauagugaaaccccaucucuacuaaaaauaaaaaaaauuagcuggacaccauagcgcgccuguggucccagcuacuagggaggcugaggcaggagaaucacuugaaccugggagguggagguugcagugagccgagauugcgccacugcaccacuccagccugugugacagaaugugacagaaugcgggcacaucacgagaucaggagaucgagaccauccuggcgaacauggugaaacccugucucuacuaaaaauacaaaaaaauuagccgggugugguggcgggcgccuguagucccagcugcucaggaggcugaggcaggagaauggcgugaacccagggggcggagcuugcagugagcggagaucgugccacugcacuccagccugggcaacacagcgagacugcgucucaaaaaaaaaaaaaaaaaaaaaaaaagacagaaaaagaaaaaacaaaagacguuuagcuuuccugggugacccaguguugcagggauuggccauccuugguauaaggcauaggaugugcaggguagcaggacagcagagugggcagugugugggguuucuuucauugauagggugguucccagcacucggggucagggcuugcuuguagaaguuucugaaaaguugcagucauguuucauuucuuucucccccuaccuagcacaugccaggccacacagcauaguacgaugguuuggaaccaggcuuaaccuguuaguagccguggggcucugggcaaguccacuggaguucuccgggaucuguuuccucuuuuguaaaaugggaaccaaaagguaucacaggcugggcaugguggcucacgccuguaaucccagcacuuugggaggcugagguggguggaucaccugaggucaggaguccaagaccagccuggccaacauggugaaaccccgucucuauuaaaaauacaaaaauuagccaggugugguggcuggugccuguaaucccagcuacucaggaggcugaggcaggagaaucacuugaacccaggaagcggagguugcagugagccgagauggcgagguggcgccacugcacuuuagccugggugacagagggagacugucucaaaaaaucaacaccaaaaccaaacccaacauguaucacaagcucguugugaggaucagagaagaggauacgggaaugauaaacaugguaguuacauuguugcuagcauuguaguuauauugcagcuguacauugugaccuauuguagcuacuguuauuucuuugauuaaguuuagcaacugaaauuuuuuuuuuuugagacggagucuugcacuguugcccaggcuggagugcaguggcgggaucucggcucacugcaagcuccgccucccggguucacgccauucuccugccucagccucccaaguagcugggacuacaggcgccugccaccacgccuggcugauuuuuuguaguuuaaguagagacaggguuucaucuuguuagccaggauggucucgaucuccugaccucgugauccacccucagccucccaaagugcugagauuacaggugcgagccacugggcccggccaacaacugaaauauuuaacauacaauaaaaugcacauggccggggugcaguggcucacgccugucaucccaacacuuugacaggcugaggcaggcagaucacuugaggucgggaauuugaaaccagccuggccaacuacuaaaaauacaaaaauuagccagacgugauggugcguuccuguaaucccagcuacucaggaggcugaggcaggagaaucgcuuaaacccaggaggcggagguugcagugagccaagaucaggccauuguacuccagccggggugacagaaggagacucugucucaaaauaaauaaaauaaaauaaaaugcacagaucugaagcauugaguucaaugaauuuugacaaaaaauauaugcaccuguguaaccaccacugaaaacaaaauggaggacauugccucaucccagcccuuuccagugaauucccaguacccccgggaaugagguguuacaaugauuacuaucaccauuguugauuauuauuguuuaguuugguuuuauugaagaagcggguagagaaagaaauaguuagccucaugcaaaaaguagggcauaugagagccugagauauggcuuaagaagaguauuguuugagaaguuuggcugagugugguggcuuaugccuguaaucccagcacuucgggaggcugaggugggagaauugcuugagcucaggaguucaagaauagccugggcaacauagugagacucugucucuauaauuaaaaaaaaaaaaagagacagaaaaguuuaagguauguuggcagguaguccuagaugggguuuacugccaggagcaguuaggauucaaagagcaaaaauuugaggguaaaaggauguauggcagguuguuggugguggauauauagccccaacauccagucacuuuaaacucuuaucaagacaacacagggccgggugccguggcucaugucuguaaucccagcacaaugggaggccaaggugggcagauaacugguggucagcaguucgagaccagccugaccaacauggugaaacccugucucuacuaaaaauacaaaaauuagcagggcgugguguuggggaccuguaaucccagcuacucaggaggcugaggcaggacaaucacuugaaccugggagauggagguugcagagagcagagaucacaccaccgcacuagagccugggcgaaagagagagacuccaucucaaaaaaaaaaaaaaaaaaaaaaacaaaaaacaccaccaaaaacaagacaacacaaagcguuugaacgaaaacagcauuugcagaugcaaauucaggauccgaaauuaauucuuccccccucuuugcugagcugccagaauguuccaaggagaucccuccuuuccaguuuccuccguggcgcacaggcugugccgaguaagugggcaauugugaguuucuggaaaucagcgagcugguguggcuccuggcuccuggcucuggccaagggaguuggcuucccuguguccaugccaggaggggaggcuggaggcuucuaaaggccgcagcuccgcuguagacacgcgccuccuuggcacuggcuuuguugaaaucugucccuagauagucucucuucugcacagaccucugagguuuuuccauacugcaaagggccuugcugcaggaggaacagucugaccuaaucucuccuagaggaggccuugagcuaauauuuuuuauuuuuuuuuuauuuuugagauggagucucacugucacccaggcuggagugcaguggugcaaucucaguccacugcaaucuccgccucucggauucaagcgauucucccugccucagccucccaaguagcugggauugcagaugcccgccaccacacccggcuaauuuuuguauuuuuagucgagaugggguuucaccauguuggccaggcuggucucgaacuccugaccucaggugauccaccugccuuggccucccaaagugcugggaugacaggcaugaagcaccucacccagccaagguaauauuucugaaagguggaguaccaugcuaugagcuagacacuuggugugguuuauccugucaucgccucagugaccucaccagguggacacuguuaggauuccuaauuugcagagggagaaguugaggcugacagaaaggucagcacugugcucaaagugauccagcugcuaccaagaugaacugcaggcuuugcucugagcucacagccugaccucagucuagagcugggaaucuuucucucccucauugcuacaccugaucaauuacugagucccaucccuuuaacugcuuacauggccuucaaauccaucuucccuaccuaagcugcccauucauugaccugugccuucuguccaucugcugagagccaggugcugugcgagccucugagaauguggccgagaacaauauggauaaaaguucugagccggguacgcugacucaugucuguaaacccaguguuuugggagguugaggcagaagacuuccuugaagccaggaguuugaggccggccuggacaacacagcaagaccccaucuuuacaaaaacaaaaacaaacaaacaaaaaaaagaaaaagaaaaauuagcugagcaugguggcacugacuuguggucucagcuacuugggaggcugaggugggagcaucacuugacuccaggaguucgaggcugcagugagccaugacugugccacugcacuccagccugggcaauagagcaagacccugucucaaaaaaaaaaaaaaaaaaaaaaagacuguaaauguauccuccagaguaauucuucuuuuucauuuuucaaaagcauccuugcuuuguuuaugcuuccaaaaguuuaaaaacuguagcuaaguuccaagaaagaaaaagggaagcaaaggaaaaggaaaacacagacccagaggcccuuuaugggguugauuguaugugaaguccauaaauugauggagagaaggagcaccuuggcaguauuuacuuguacucuccuaugucauggauuuccucuccauuuucccaaggguucuuuccuguucuuagaaauguuuugugauuuugcuucagacacaguuugucuacuucuuguaagcauuguucuuagauugcuggcuuuauaucuaucacucccuugcucaucugcccauccaucuauccauccauccauccauccauccauccauccaucuauccauccauccauccauccauccauccaucaucccuccauccacuugcucaucugcccauccauccauccaucuauccauucauccaguccauucaccacccaccaucuauuauccauccauccauccauccauucauccacucacccauucauccaucauccauccacucacccauccauucauucagucacccuucauccauucacucacccauccauccauccacucauccaaucacccauccauccauacauccacucauccauucauccauccauacauccacucauccauucauccauccauccacccacccagacguccauccauccauccauccauccauccuucugucuacucugccaacaauccacacaccugucccuccaucccuuccaaccacucacccagcaaucuucucauccaucuauccacccaugcauacauccacuuauucauucauccaucccuccacccacccauucauccacccauccauguguccauucaucucuccaucuauccgugugucuaucaucuaauauaagggagauguuuugaaguauuaaaagugauuauuuuguagcauaggggacagggauuguguuuucuuuacuuacugcuaccuuauuaaaugcuuacuaguucuaaaagcccugcaauugauucccuucaauuuuccaacucuauaauugcagcaucugcagauaaugaugacuucuugccuuuugccaauaauuagaccaguuauugcuguuaaccuuguuauggcaggaacuuccagaacaguguucagugacgcagcugaauauggucagcccagucucauuucugauuugaguggaaugccucaauuguuuuacugcagaggauaauuauauaauuguuaauacucuugaccuuccugucuuuagccucacugaguaaauggggugugaucaugaaaucuugauugucucauagaugcaagagacauaaacgacauuugucuguguauaaugacagcagauuuauuuugcuaagcuguuaagcuguuaaaauaagccuuuaagcccccgccucaauuuuccagcagaguggaauguuauuuuguugcuucuggccaagugucgauauucauuuuagggcaggucuucauggaaagucugcuggacuauaggucuggauacuugccggacccugugucaucacuaaaguuagggugcguuucagaaccacccuguaccacagugaagagggacaaauggccuuagggagcaggacccaugggggcccucuggggcuguuucuugugcccugagagaggcccuagauuugggacagucugauuuaccuccccucccuuuuuuuuuucugggugaugcuacccugguuucuguguugaaauaugacccuagugugaaggucgcggucucagaccaucuuguuucugguauguuaagaaacagaaaaacaccuuuuaggacacaauguuaaccauugaggauacauaucaguguucuggaaaaacaaaaacaaaaacaaaacaaucuguaccgcgacugugguuuucaucagggugggcugccuuuccgauccauaacccuguguggcuugauggagaacauguuuuguaacuugcaagggcaucugcaauagccggguccucuuggugaaaggggaggacccacauuaggucuaagcuggcuggagucgaugcaaaacucucacaugcuuuggaaaaagcacgugaucuuucgacgagaaugcaaauguugaccgggugcaguggcucaugccuguauuugcagcauuuggggagacugaggcaagcggaucgcuugaguccagaaguuugagaccagccugggcaacuuggugaaaccccaucucuacaaaaaauacaaaaauuaaccaggugugguagugcaugccuguagucccagcuacuugagaggcugaguugagaggauugcuugagcucaggagguugaggcugcggugagcugugaucacgccacugcacuccagccugggcaacagagccagacccugucuuuaaaaaaaaaaaaagaaugcaaauguuugcuugauuauucagcugguauuugacacacaguucuuuguuccagagggacuguccagcaacaaauagugaauucguuaauuuuucacaccaaaccuauugaaaauaaccagaaaagguauaugcuggaaaacucaguguucuagaaacauucauguuugccaucccaagagcaaaagucauggaaugccugaugcuuaguguuaagaggaaggaauuccacacagccuguggcuagcuuuucuuauuucauugguguccaagacaagauuugaacuguuuacuaaaggaaauuagcaucauaagucuccucuggcauauauuuccagcauccaaguggagcugcugagaucuugcucaagaguagcaaaauuggcaggaggaggagggcauuaguuuuuacaucagcuuaaagaauuuuuuuuaucagccauuuuugcaauuuggaaaccuguuuggaguagggguauauggagaugaaauugggcuguuucuaggauucaccuccuccuucaggcauuuuuuuuuuuuuuuuggaaacagggucuggcucuguugcccaggcuggugugcaguggcgugaucauggcuuacuguagccuugaccucuugggcucaagcaauccucccacuucagcuucccgaguagcugggaccacagguguacaccaucgcaccuggcuaauuuuuauauauuuuuuguagagauggggucucacuauguugccagggauggucuugaccucucaggcucaagcaacucuccugccucggccucccaaauugcugggauuacaggcaggagccacugcaguugguacuuagaguuguuuuuuuuuuuuuuuuuuuucccuugagacggagucucacucuguugccaggcuggagugcaguggugcgaucuuggcucacugcaaccuccaccuccuagguucaaaccauucuccugccucagccuccugaguagcugggacuacaggcacacgccaccaugcccagcuaauuuuuuuuuguauuuuuaguagagaugugguuucaccauguuggccaggauggucucgaucucuugaccucgugauccucccaccucggccucccaaagugcugggauuacaggcgugaggcaccacacuaggccgauccucagacauuuuuaauuuuccuuuuuuaguguuacagccagccauuugaaaaaugagacuucccccuaaccuugugucaaacucagagacguugucaucuuggcuuugaugugguggaggagaggggcuucucauuccgggacgggguuucuccaccuggggccugcggauacuggggcuggauuguucucugggguggggccguccugggcacugagggugcuagcagcaucccuggcuuccacccauuccaugccuggagcgccgcccccgaggcauggcaaacacaaaugucuccagacacugccaggugucuccuggugggcagaaucgccuccauuugaggaccccuggaccagggugcuggaaugggggugaggggcacucugcaauuauucucugcucuuuuuuugaggggggggaaauggaaaccaagagcccaucaucagccucguggcucugugguuugacacugccaugcuaccgacaaaaaccacgucccuagacuugggggaccaaggaaucuggaggaauaugaugauagucauuuaaugaagguggguuuauguauuacucaagugcugggcuggggagucaggacauagccacagggaagaaaacagaaagguccuucccucuuggaagccccucuugaaacaccuaauuggugacaugguacacuggagaaucagagagugucacucaagcauuuuggcuuggugguggggcggggguggcgggucaggcacucaagcaccccuaagcugaucuggagaaagugucggggaaggggaacauuagcguuucucccugaggaaucaucuuacaccuauaacggcaacuggcccacaguaacauugauggagcaagugucuucuuguggcucggccgcucaauagcugugugaccaugggcagguuacugaaccucucugugccucagucuucuccucuguaaaaugggaacaucuaggauuguugggggaaauaaaugguuaauaauuggaauagugcugggugcauaggaaacucuaaguguuacacagcauguggccacaaccuccccucuccccuccucucuccucuuugcugcugcccugcugccuuaaugggauacuccccucucugucucugucugucugucugucugucugucucucucucauccccuuuucuuuccucuguucccccacccccaccucugaugcaguuuggaccaaguuuucuucagccagcuaauuuagagacaagaaccuggauauuuauugggcguuugggggacuuccuuacagcccuaggucucugugaaaagggcccuggauuaucucugcaaaagcccaccugcuauugguuagccaggacugucuccacuuucagacaccagcuucauccaaacacucuuugcuguauuuauaaccacggugcauuuccucgggacgcacaucuuacggcuucuuggccccuucgcccagggugcacugccuggaccaucgcccuccggcagagacagugucuuucuuuguauguucuccuuccucuggucgagauguggcuuggucaccuggaguggggccgucggcaagucgccugggcuucguggaggcucgcugcccccauggcggaaagcucggccacacacccugaugucucgacaccuuugaguugcccaugaauggguuuucagagcuucccguguuuacuucgcugcacgccucuguuugugcucuggggaaauucuuggcagaggaaaagccaauuggaaaacagcccugcuuggugucagggcuugagguugagggagaaagacugaaacggagauuugcaugagcugguuugagcaugucacaagacuuugucuuuaaaaaaaaaaaaaaaaaaauuggccuggugugguagcucacuccuguaaucccagcacuuugggaggcugaggcaggcggaucacgaggucaagagaucgagaccauccuggccaacguggugaaaccccgucucuacuaaaaauacaaaaauuagcuggguguggugguguacgccuguagucccagcuacuggaggcugaggugggagaacggcuugaacccaagagggagagguugcagugagccgagaucaugccacugcacuccagccuggguggcagagcgagacuggucucaaaaaaaaaaaaaauuuuuuuuuguuccagucuauucugguggcuuagaggagggaagaugggaaauuuuggguuuaauagaguaauauccaucagguugagggcuuugaagcaccugggaauauccauaagucacuacugagcaccagcuguauagaguuauugagcauguauugucucccaggcacaugguccucacaacaaucuuuucacagagcuaggauuugaacccacagucucucuggcuucagaacccuagcuuuucuugcuauacucugccuuacagaggaagggaacuuuuguacuggguuuugaagggugaauaggaguucaaugaagaagcagcacauucugugcuaaauuuggcuuccugauccuccuagaauuggccagaagccaauaucuggaggccaaaauugggucacuagggugaccaacucaucacagggcccuggauuaucucugcaaaagcccaccugcuacugguuagccaggaccaucacagugugcccagguaacccugcguuucaccccaaagcagaauuuuacaccagagccuggacaccaguugaauuuucuuuaacucauuucugucaaugguuaccuccaaaaaugcucccuugugucuuuaugcugggcuucuuucucuagauacuuccauuucuugguuugggugaaaaucaaaugagguaauuaaugcuugugacauguaaaguguagugaguggcacaugguaaccucuuuaguuuuagccaguugguuuuuuuuguuuguuugucuuugagacagagucucacucugucacccacgcuggagugcaguggcgcagucucagcucacugcaaccucugccucccagguucaagcaauucuccugccucagccucccgaguagcugggauuacaggugcacgccaccacacugggcuaauuuuuguauuguuaguagagaugguguuuugccaugcuggccaggcuggucucaaacuccugaccucaggugauccgcccuccuuagucucccaaagugcuggcauuacaggcaugagccacagugcccagacaguuuuagccaguuuuucacuggccucccucuuugccuuuuuugcaagggagcuggccucccugucccuggaguaagcaaacuuccuuauaccuauagcuuccucuaaggaagcguaguuaccuacagccuggcccuccccaaggacacagcuguuuccuccaccaagagcaaggaguggacauaaucacugccaaauagggaagccaggcuggacaccguggcucaugccuguaaucccagcacuuugggaggccgaggugggaggaucacuugaggccagggauucaagaccaaccugggcaauguagcaagacccugucucuaaacaaauaaaaaaauuagccagcugugguggcccauggcuguagucccagcuacuccagaggcugaagcaggaggauugcuugaccgcaggaguuugaugcugcagugagcuacggucacaccacugaacaccagccaggacaacagagcaagacccugucucuuaaaaaaacaaaaaaauaaggaagccagaugggugcuggguguacgggacacaugucaaaagucagaccucuaucugaguaaggaaacagguucagagucaggauuaaagaccaagacagcuugaggucaucagaggccaggaauuuccauacaggcugcgguccaaagugccaagcugggcuagauagauguuggggaagagucucugucgcccucuuuccuuccccguuaaugcuaucagcugagcaugggucacuccugauuuuuuuuuuuuuuuuuuuuaccgaggacauaggcucagagugucuucuagcuuucaacccaccccagacucugacuuagccuuucccaaauggugcugugcagaaaaaugaaaaaauugcuaggaggaucaugugccugguggauaguacaugcuugauagcuguaaacaguuggugcucaauauaucguggcuuguggaucuucccagcugcuucagaaccccaagccugcuguauaauuguacuugaucccgacaacagcccugccagauggguguuacucugauuccuguguccugguaaguggacggggggccuggaguagcugaauugccuagagaaggggacauagcuagaaaggaaaaguugaaacccagugugaugccagaguccaugcaaacuuuauccugaaaggagggaucucuuuuuuuuuuuuucugagauggaaucucacucuguagcccaggcuggagugcaguggugugaucucggcucacugcaaccuccgccucucagguucaagcgauucuccugccucagcgucccaaguagcugggauuacagacgugugccaccacaaccggcucauuuuuguguuuuuaguagggacgggguuucgccgugcuggccaggcuggucucgaacuccugaccucaggugauccgcccgccucggccucccaaagugcugggauuacaggcguggccacugcgcccagccuucuucuucuucuucuucuuuccuccuccuccuccuccuccuccuccuuuuuuuugacagagucucacucuauugcccaggcucgagugcaguggcacaaucucagcucacugcaaccucugccuccuggguucaagagauucucccacuucagccucccgaguagcugggauuacaggugcgcaacaccacagccgguuaauuuuuguguuuuugguagaaacggggucucgccacguuggccagguuagucucaaacuccucaccucaagugauccgcccgccucagccucccaaagugcugggauuacaggcgugagccacugcgcucggccuggugaagaccuucuugccgguggggacucugcagaguccugacagggagcagggcaucacauggcgagggagcugagagugucagcucaggucucucuuccucuucuuauaaaaccaccagucccacuccuaugauaaaccauuaauccaugaauggauuaauccacuuaugaggacacagcccuuuuaaucaccucugaaaggccccaccucucaaugcugccacaugaggaauuacauuucaacaugaguuuuggaggggacaaauauucaaaucauacuauuauguuaccaguaaaauuuaaaauauaggaauaauaauugccgauguguggcagacuuaccaaauacuagacccugugcuaaguguuuuauaucuauuauuuuauuuaauuuucuuggucacugcauaacauaugcucuguuagucccaguuuuucgaaugggcauaacaagaccgaaccuaccuagaguuggcacaaguuguaaaaauaggauccguggccgggcacaguggcucacacuuguaauuccagcacuuuaggaggccaaggcgggaggaucaccugaggucaggaguucgagaccagccuggccaacauggcgaaaccccgucucuacuuaaaauacaaaaauuagccaggcgugguggcgcgccuguagccccagcuccucgggaaacugaggcaggagacucguuugaacccgggaggcggagguugcagugagccaagaucgcaccacugcacuccaggcugggcgacagagcgagacuccaucucaaaaauaaaauaaaacaaaaaaauaggauucacuuuugccaccaacuugaaaaggaggcaaacacaagauuacucaucucuggagaggaggcauucagauuugccuacucagcauuccuggagauagaaccagauuuugcauggguuagaaucauauuuugcuugggaagccacucagaccucauuguguggacucuauucccagagccagcuuccuuuauuccuucagacucuuaugauuggcucaggggaaggcacaugacucagacugggccaaucagcuuucuuaauuccuccagccuccaugauugguucaggggugggcaugugaccccagaagguuccauaagauucaguucugggacuuuagugggagugauagagagauuuuuccuugcuaaaucuuccuugcugugaagcuauaauccaggugccaccauguagagaccacgugucucagacuucugacaccauagaaggaagcaggacugcgaaaaggaaagggagagagaugggguccccaugacaucauuugacaccuggaucuagcuguaccugaaaguguccuuguccuaugacuuguuaguuaaaugagccagcaaucguucuuuucuuuuuuuucauuuucuuucuuucccuuccuucccuccuucccuccuuccuuuccuuucuuuuccuuucccucccuccuucccucccucccuuccuuccuucucucucucuucccucccuuccuuccuuccuucucucucccccuucccucccucccucccuuccuuccuuccuucuuuccuucguucccucccucccuccuuccuuccuucccucccucccuuuucucucucucucucucuucuuucucucuguauaacugagcuuucuauucucacaaacugaaagaggucuugcuaauccaaggcaugacaaucagagcaacaugugaagcccaaagagcugcagagcuccccuccauggcuuccagccccggggguggucagugaaaguaacuggagcccggagcuucagaggccaguguggagguuggaaagguuguggucaggagagaguaauauaucuggucccugcaacagacaccccugcaguuuuauccugaauccuggguaauuuccccagguccugggaagccuaauaaagccccuacucagauguuggauugcaaguccuuuuuguuuguuuguuuuuuaaauccacuuuaaauaugucugaaaaccacacacagagugacugcugcacagaagagcgaaugguucaugccuucuucuuugcugccaccaacaagucaguuaccuacuucucugacaugggacccuuggcuggagcucacuggcugccuuccugccaccuguaagccucggcacuugcuguucccucuaccuacaugcuuuucccugugauacuuccucauacgauuuccucagauuaucuuugcucaaacaacaggcaagggcugggccuuaaucucacaccuguaaucucagcacuuugggaggccaaggcagguggaucaccuggggucaggaguuggagaccagccuggccaacauggcgaaaccccaucuguacaaaaaauauacaaaaaauuaaccagauguggcagcgggugccucugaucccagggacuuggguggcugaggcaggagaaucacuuaaacccaggaggcagagguugcagugagccgagaucaugccacugcacuccagccugggcaacagagcgagacuucguuucauaaaaacaaagaaacaaacaaacagaaaaaaacaacaaaacaaacaaacagaaaaaaccaacaaaacaaaaaacaagaggcaagaaguucagugugcagaaucucugagaaaaacccaugguuguuaaccccaggucugccccuuuugagcagggugacauuaggcaacugauuugauuucucuuagaugaaauuuccucacucccugccuauucaaccacaguacugaggacauuuggagcuggauuaucucucugguggcagcuguccugggcauuuuaggguguuuacuagcaucccuggccuccccccacuagauaccaguagcacucccaccccacacugguugcaacaaccagaaaugucuccaagacacuuccacgugacccccggggggucagaauuucuccccuucccccuguguuuuccuauggagguggaacguguuuauuucuuugcucaccguuuugcaaucucucuucccccgccacaaggcagggacucuucuaucuccgucaccaucccauccucccacaguggagacagcucuggggacucuccugagcagcagauucuugggugccacauucuguuccauuccuggggaauuuaucucuuuacugagugauggguacaugagaacuuucugugucacccuugcaucuuuucuguuuuguuuuuacaaaagaaaaaaaagaaggccgggugcgguggcuuacgccuguaaucccagcacuuugggaggccaaggcggguggaucacgaggucaggagaucgagaccauccuggcuaacacggugaaaccccgucucuacuaaaaauacaaaaaauuagccaggugugguggcgggcuccuguagucccaccuacuugggaggcugaggcaggagaauggcaugaaccugggaggcggagcuugcggugagccaagaucgugcccacugcacuccagccuggcagacagagcgagacuccgucucaaaaaagaaaaaaagaaaaaagauaucacucgaugacugcuaccgaaacauucuguggcugggagaggaaaauaccagaaagggugaauguggucgguugaaugaugccucucccuucccccagagaugcccacaucguaaucccugucaccugugaauuugguaccucacuuggcacaaggcucuuugcagaugugauuaaguugaggaucuugagacggggggaugauccuagauuaucuggugcaccaaaugccaucgcagggauccuuuucaaggaaagagggaggcaagagauugaaaugcuacggccaagaaaaaggagcugccuuaaaagcuggauucucucuggagccuccagaaggaaccaaccuuuguaacaucuugauuuuagcccuguaagacucauuuugggcuuuucaccaccaaaacuguaagaaaauaggcaggccaugaugguucaugccuguaaugccaguacuuugggaggccaaggugggacgauuucuugaggcuaggaguuugagaccagugugggcaacauagcaagaccccaucucuacaaaaaaaaaaaaaagaagaagaagaagaagaaaaauuagcugggcuugguggcacacaucuauauucccagcuacuugggagguugaggugggaggauugcuugagcccaggaguucgaggcugcagugagccaugauugcaccauugcacuccagccuaggcaacagaguaagaucccgaugcaggagaaaauaauaaauguaugucguuuuacauuugugggcguuugugacagcagcaaugggaaauggauacggugagaaacccagcaccugggccuggaaacccccucugggcgggucucuagccaggggccaacaggagucagagcagggccuuggugagagguggauacggggccccagcauccugauggccuugcuguggcuucuggggacaccugcaguggcuccauuacaccguggcaauuuguuccuucccagacccccuggauacaaggggccugcauuuucgaacccagagcccggggacaucccccgugguucccuguuacccucuggaugucuguccugcuacuaugcaccucuccccaacuccugguacacagugggaguucaggggccgucucauuuguaccgcauaacaucacggagguccaagacgccauguaauauucuguuuaggauuucagaggcacagucaguuacauccaucuucuuuuugucuuugagacagagucuugcucucuugcccaggcuggagugcaauggcacgaucucagcucacugcaaccucugccuccuggguuuaagcaauucucuugacucagccucccaaguagcugggauuacaggugcacgccaccacaccuggcuaauuuuuuguacuuuuaguagagacgggguuucaccauguuggucaggcugaucuagaacuccugaccucaggugguccacucaccuuggccucccaaagugcugggauuauaggcgugagccaccgugcccagccugcuuccaucuucuuagccacuuuucccucaggugagaccaugagauuaggaaccuguuucaauucccgucggaauuucccaacagagcuggggcuuugugauucgaauauguucagagaaggaagcagaaggaagcagaaaugaaggauguuaucagaaaaggagacucaggguugggugugguggcucacgccuguaaucccagcacuuugggaggccaaggugaguggaucaccugaggucaggaguuugagaccagccaggccaacaugguaaaacccugucucuacuaaaaauuacaaaaauuagccaggcgugguggcaugcgccuguaauucaagcuacucgggagacugaggcaggagaaucacuugaacccgggaggcgaagguugcagugagccaagaucaugccacugcacuccagccugggugacagagcaagacuccaucucaaaaaaauaaauaaauaaauaaauaaauacaggaaaaggaagcucgguaguuuucaggggcugcuggcguuuccaagcuuuaggcauuuugcuuugagucuuuuucugucuuucgagucauccugaaguggaaccgagagaggacugaguggguggaggggguggugguggggacggcugucugcucugcuggaauugagagucugggagaucauugugguguuuuuggagugauucuuaaccccagauauagacagugacacaaggggcauaaauacgaggaacagugaccuucccugguguccuuguuugaagcauuugaccaucugggcaaggccugggagugucugaacuggcuggugcuuccaugaacaagcacagacucagagcccaugguccuggguucgaauccuaguucuuccacuucuuugcuguaugaccuuugucuacaaaaaauaaaaauuuagccaggcacaguggcgugugccuguagccccagcuacucgggaggcugaggcaggaagauccauugagcccaggggucgaggcuguagugagcuaugauugcaccacugcacuccagccugggcaacagaagcagacccugaagaaagaaagaagcugggaagacagggaagaaggaaggaagaaaggagggagggagaggggaaggaaggaaggaaaaaaaagggagggaacaaggaaggaaggaaggagguggggacggagggaagaaggaaggaaggagggagggaaggaaggaaagggagggaggggagggaggagggagggagggaagaaaaaaagggaagggaaggaacuuuggaacuacugaacaucucuguuuccucaucuauaaaaagagggauaagucaucaucauaucuuccucuauggucauugaguggaugaaauaagacagcauuugcaaauccccuaaugcauaccuggccccugauuuuguuccuugggcugcagcgaugauagagguuuaaaaccuccaaacgcuguguugaaaucucucacguggacaaccagcccaccagcagagaaugucauuuuuccauccuggguaaacaggguagagaagaaugaggaccucaggccagguuagagagaccucgcuuggugaccuugggaaggcuuuuaacuuuuaacuuuaaugcuaacaucugguucccuccaguuaggcagucggcggccuagccgucuugucuugaaguuucucuugccuuccaucauggguuuauuuguucagcaaauguuuauggagggccagcacaggggggaauaagaacuagaguucugggaggacgugugaagaaacaaguuccgagccccagggaggaaagaggucauugccucccucuggggaaaaugucucuucucauaccugguucacuucuuaaauggaauuucccccuucagaugaguaaggcguuuaaucacaaagagaaaacaccuucaucacauagccauccuuaaaaggcauuuauugugaagcugguucauagacuucucgcccagguugcuaacagccaaccugucuggguuuugggaaguuaaagugucuguaucccauuuccuuuuuuuuuuugagacaaagucuugcccugucaccuagccuggagugcaauggcacaaucucugcucacugaaaccucugccucccggguucaagcgauucuccugccucagcccucccgcguagcugagauugcaggcgugcaccaccacgccuggcuaauuuuuuguaucuuuacuagagaugggguuucaccauguuggucaggcuggucucgaacuccugacuucgugacucaccagccucagccucccaaagggcugggaugacaggcgugagccacugugcccagccaguucugacuuuuuaacuugugauuugacuuuuccugucugaagucuuucucugcuggacgugaguuguugaagguguugcuuuucuuuguagacaauuagaggcgcucaugcacugggcuauggacaauaauacuuugaagaugugcaaaugauuugcaaccuuuguugcauaaauuaucccucugagaugcuguuuggcuugauaaauaaaggaccugcaagagagaauuuaucuugagcauuccuugggggagagaagcaaaggggaagugaaugcugcauaauaauucuuugcauacuuuauggaggguggguuccugcagugcccuguaggguuuuuuguuuguuuuuuuuuuuuuuuuuugagauggagucgcucuguagcccaggcuggagugcaauggugcgaucuuggcucacugcaaccuccgccucccggguucaagcgauucuccugccucagccugccaaguagcugggacuacagacgugcuccaccacgcccagcuaauuuuuguauuuuuaguagagacaggguuucaccguguuagccaggauggucucgaucuccugaccucgugauccgcccacuucggccucccaaagugcugggauuacaggcgugagccaccgcgcccggcccccuguagugguuuaaagcaucuucacuguuauucuaagccucacauuuuaaacagagcugaaaaaggacucuaauugcuggccugggauccuugugugcuguaggaauucacugagggggcggggcuggagagggcugcuagagggugguacagaagcagauggaacuuucucucuggcuggacacaguagcucacaccuguaaucccagcacuuugggaggcugagguugguggaucaccugaggucaggaguucgagaccagccuggccaacauggugaagccccgucuuuacuaaaaauacaaaaaauuagcaggacgugggggugggugccuguagucccaacuacuugggaggcugaggcaggagaaucgcuugaacccgggagguagagcuugcagugagccgagaucaugccauugcacuccagccugggcaacaagagugaaacuccaucucaaaaaaacccaaaaauaaauuuaaagaaaaauuuucucucugauucugccugccugccugcuagacuggaagcaccaugaggucaagguccacgaugucuugucgcuauugaagcgccuccaaaacauggcagacccucagcaaaucuuggacagaugaaugggcauucgauucaacaugugucugcuaggugggagcugagcgggaaucgcagggcuugggucccggggaugauggggaauggcagugugacuguggggaagccaggggaauggggugcuggagcccccaaagcuauaaaucagggccugaugaacagacagacagauggaccaacuuaaccauuucagccccaucggcuuugaugauuucccucuggcucuggcaagagucucgcucaccaagugguucucacccuagggugggucuggauauuucuggggacaucugugguugucacacgucgggguggggggagaugcuccugacauggaguggguggaggccagggauacugcucagcacccugcaauguacaagacggccccuccccagaugaagauccgacucugaauaccaccaguccugaggcugagaaacccuacuuuaagauaacagugaugggggaauuauccaccccagagucugagucugugacuugggaaacggccccggcauuaccagguguugaauucgugagaauacaaggagaaggcguguagcccgugacccaguccugccccagacaaaccgauauucccuccaaagcucuauuuggcagaagaaguguuuucguucccucuugccugugguaucuccccugauaagcguuguggauuguuccagaccguguugacggggacagcuuccuucuccgcggcugccggcccugacccugcagcuuucagucugugggaguagagucagcuguugagcaguuuacucugucccugugucaaugggauugugcauguuuugguuccugaggggucauugauggugcacuuuucuuuuguuguuagucaauuuaauuuguuacuaauaauaaaaucuggaacuuaccugaccccaaaggcccaggucguuaagaaugcuugguggaaugcacguccuuuucaaauaccggcuccuuuggaaaacacagaggauggagugaaauccuuaccuggauuguacuggcagugggaugacagcgucaccuccugaaaauggaauguagcuuauugcuaaauaagacagcgcagugccucccucgcaccugucaucuuggugcuuagagaggccaaggugggaggaauucucgaggccaggaguucaaaaccagccugggcaauacagaaagagccuauuucuacuacaaauauaaaaauuagcugggcauggugacaugcaccuguagucgcagcuacaugggaggcugaggugggagaaucgcuuaagcccaggaagucgaggcugcagugagcugugacuugcuacugcacuccagcccaugcagcugagcgagauccucuuucaaacaaaccagccaacuaacaagcaggccccaaggggacaauuuuucuggaauuaccugauuguaucaagaacaguuugaucaacaccuguaaucccaguacuuugggaggacggaucacuugaggucaggaguuagagaccagccucgccaacauggugaaacccugucucuacuaaaaauauaauaauuagcugggcauggugguggguggcuguaaucccagcuacuugggaggcagaggcaggagaauugcuugaaaccgcgaggcagaggcugcagugagcugagacuguaccacugcacuccagccugggccacagaguaagacucugucucucucugucucucugucucugucucucucucuccauauauacauauauauuuauauauauaacuuaucuugaagacgguuuuggcacgccuuaacuuuuaugccagaggccagugccuugcuugugucacccugguuccaagaaucugcauaguuuuucccagcccauucuacagacagggaaacugaggaccaggcacacuagguuccccuccaggagucgcacagcgaggagaaaguggagccaugacuugaugccaaacacugagacuccagaacccauauuuucucagcucuuagguuuuugucaauuuccuaaauuuguguguguuuuaguggggcugaguuucuccuguuaauuuguuuauggagaggagacacucuuguuuacuuuuuuuuuuuuuuuuuugagacagagucucuguugaccaggcugcagugcaauggcucaaucucggcucacugcaaccuccaccuccuggguucaagcgauucuccugccucagcuucccgagcaacugggauuacagucacacaccaccacaccugacuaauuuuuguauuuuuaguagagaugggguuuucccauguugaucaggcuggucucaaacuccugaccucaggugauccacccgccucggccuccuaaagugcugagauuacgggugugagccacugcgccuggcucuuggcguucucccuuaguaauacuucuugggggucauuuugaaucucuguuucuucuguggucacguucauuuggaauuuacuuauucaacccacaaccaauagacauuuccagcccuuuguuaguauaaacagaacuucucuuugacuuucacagcguuuuuguucuggaggugcuauccuugauugcuaagacacccacgacauugcucuuggaauuggaguaggguggaugaaauaguauucaaagauggggguggugcaaauguucuguauuucaaccuguacauuagucaaguguuauuuuuacccucauguacaucuauuauggaauaaaauacaugacuuuggccaggcgucauggcucacaccuguaaucccagcacuuugggaggcugagacgggaggaucgcuugaauccaggaguucgagaccagccugggcagcauagcaagaccccuucucuaaaaaaaaaaaauuagcugggcaugguggugugugccuauaaucccaguuacucgagaggcugaggcaggaggaucaguuaagccugggaagucgaggcugcagagagcugugauaggcagccugggugacagagaaagacccugucucaaaacaaaaaacaaaacaaaacaugacuuuuauggaguugagcucaacguuugcauacacaugaggagcagaagcuggagguuucaaauaaauaucuggcuucugcaggcugccuggagagaggugagagcgaugcauuggucacccagccuggagugcaguggugugaucacagcucacugcagccuugaccuucugggcacaagcaauccuccugcuucagcuuccugaguagcugggaccacaggugugugccacuaugcccagcuaauuuuauuuauuuauuuagagauggaaucuugcucugucgcccaggcuggaaugcaguggcacaaucuuggcucacugcaaccucugccuccuggguucaagcaguucccaugccucagccuccugaguagcugggaucacaggcaugugccacuaugcccagcuaauuuuuuuuuuuaauggagucuugcucuguugccaggcuggaaugcaguggcgccaucuuggcucacugcaacuuccaacuccccuguucaagcgauucuccugcuucugccucucgaguagcugggauuacaggcacgcgccaccaugcccagcuaauuuuuguauuuuuaguagagaggggguuucgcauguuggccaggauggucucgauuuccugaccucgugauccgcccacuucggccucccaaagugcugggauuacaggcgugagccacugcgcccagccuaauuuuuguaccccuagccgagacaggguuuugccauguuaucuaagcuggucucgagcuccugggcucaagcgauccacccgccugggccucccaaagugcugggauuacaggugugagccacugcgcccggccacagcuguuguuuucucacuggcuugagaauuguucucuuaagcuggucaagguuaugacgguuuguguggccugugcacguguguguggucaaaucccauuuuucuaaagcaaaguuucuauuuggguaucugcuguuuaauuuuucagggauuuuuuuuuuccgguugcuaaggaaaguacauuaaauuuuaucuuuguauccuguagaacucuuugugaauaauacacggccagagggaagauaggcugaggaaacagauaggaaggaaguucaagggggggauuucuaugugagaaccaagaaacaccuuugaucuuuagauuucaaagugggaaguucaaggugaggugggcguggaauuaggaguaaacccaagaagagcgagugggcgguuccuccuggcagccacagaauaguuacguggcaugaggucaguagcaucucagaggguguuguugucuuugacuuagaugaguuccaagaagcagaaguucgugagccaaacacgaggugguuuucugggggguacaagggcuggaagaggggccagcucuuaaccacaaaucccuuuccaugcccaaggccaagcuccuuguaacucuuuucuuucuuugccucccucccucccucccucccuccuucccuuccuuccuuccuuccuuccuuccuuccuuccuuccuuuccuuccuuccuucucaaacaaggucucacucuaucacccaggcuagagugcaacggcacagucauagcucauugcagccucaaaccccugugcucaagugauccuccugccucaggcccucaaguaguuuuuaaacuuguuuguagagaugggucuugcuauauugcccaggcuugucucgaacuucuggucuuaagcgauccuccugccucagccucccaaagugcugggauuacaggugugagccacuggcccggcccauucuccuuucuuuagccaggcuagggagacauaaguggggaaacucauguuguuuuuugagaugguugcuuuauucucgugauauuuucccucuuuccaacuuccuugagcccuccccagccuccucuuagugucugugugugggugagggggcuuugguauaccuucugcuuugggucucauucauuuuaauuuuuuauuuuguuuuguuuuguuuuguuuugagauggagucucacucuguugcccaggcuggagugcaguggcaccaucuuggcucacugcaaccucugccucccggguucaagcgauucuccugccucagccucccgagcagcuggggauuacaggugcaugccaccaugccuggcuaauuuuucuauuuuuagcagagacaagguuucaccauguuggccaggcuggucucgaacucccgaccucaggugaucugcuugccucagccucccaaagugcugggguuacaggcgugaaccaccgugccuggccacgggucucauucauuuuaguuggagcccaaauucacuggugguucaaguucccaaucauucucggcauucuauaaucacaggccucagagaguaaugcucccaauggcccucaaauuaugguuuccuuaggaggcuauuaaaucuugauuucugagaggaaaauuggggauuuuguguuuucccuuuuagacuugaguguucuguuacuguggaugagcucuucuagaaacuuccaagcaguuucaaaggggauuuagaugucaucaggaagugugguugacaacgugauauuugggcuuuagaaaaacagcgugucacccguuuuauuuauuccuugaugacucuuuuuuuguuuguuuuuguuguggucguuguuguugagacagggucucacucugccacccaggcuggacugcacuggugcaaucucuguucacugaaaccuccuccuccuggguucuugcaaauagacagucccauuugguggugacgggagacagugacagaucaucaagcauuagauucucauaaagagcgugcaacccagaucccucgcaugcacaguucacaauaggguucacgcuccuaggagaaucuaaugcugcugcugaucugacaggaggcgcagcucagauggucaugcaagcaaugaggagugacuguaaauacagaugaagcuuccaucgcucgcccgccccucguccacugcugugcagccugguuccuaacuggcugguuugaaacuagacugggcaacauggccaaaccccgucugcucaaaaaauaccaaaauuagcugaguguggaucacaagugugugccuguagucccagcuacuugggaggcugaggugggaagauugagugagcccaagagguagaagcugcagugagcuaugaucacacccacugcacuccagccuggguuacagaaugagauucugucucucaacucccugaggggugggggaccccugguuuaauccauccaacccucucuucccaugaaauaaaggaaguugugagugcuauuuugugcgucauccccuccaguauucaagucagcccaagguacuucgaugguucccgucugcacauggggaaaccgaggcacagaaagcagacucaugugaccaggaaguagcugugucugcucgaaacucaggucgaccugauaccauaaguccuugcacuccacgugcuggcuauugaagcuguggcucgcaggucugaugggagagccucagacagugucucacucugucacccaggcuggagugcugucaugcagucauaacccacugcagcuuugaccuccugggcuaauugauccucccaccucagccucccgaauagcugggacuacaggugugcaccacaaugcccaccuaauuuuuguauuaucuguagagaugggcguggggggugugaggggucuugccauguugcccaggcuggucuugaacuccugaccucaggugauccuccagcuucagccucccaaaguaucgggauuacaggcaugagagagccacugcaggaagccaagagagcagauuuggacaauguagaauuucuccacgcuccuccuacuguccccaucuuaggccuggcuacugcgggacugacaggcauggcuggcuguccauccguuccuuaguuugauugcauggcagacaugaggaaggaaggugagaacugagcuagaaaguuggcauuuggugcucugguuucucaaugcaagaaaguaacacuuuggcuuuuauagaauaaccuucugaggaaauuaacaacccgggcguuucagcccccugugaacuugauuggagcauggucacaauuuguaacgaaaugugcuugcaugcccagugcuaaagauuucucucugucuacccucuaggcuguggaaaggucuguucuaaccauuagcuuguaucuggagcucagauggugccggacacuccguaggagcucagaucuguugauagaagccacuagagaaugggacaagcaacaggagguguuuugcugccuaguaaacuuuuuuugagaugaaguuucacuuuuguugcccaagcuggagugcaguggugccuucucggcucaccgcaaccucugccuccuggcuucaagcgauucuccugccucagccucccaagcagcugggaugacaggcacccgccaccaugcccggcuaauuuuuuuuguauauuuaguagaaaugagguuuugccauguuggccaggcuggucucgaguuccugaccucaagugcucugcccgccucggccucccaaagugcugggauuacaggcgugagccacugcgcccggcucuacccaucuuucuuacaugaugauguucagcagccagccugauaggggagcauuguuuguccuuuuuuuccuuauugcauuuuccccgcauaggugccagggcucaguagcauaaauccagguagaacugggaaguuccagguaucugggcuguuugcucugguggacaaagagcagcugcaaggugggucuugauuagccagugaagucugaggauccagagggaaacuuauuccuuucuuuuguugaaaucaacaugagcaggaaauggaucuuucccccaaucagagaacuucacauguuuuucuaauagaauagcagugucugagguauauacacggggaguggccccccgggaaaacgaggccaugaggcuccuggcauggagaugacacacgaagacucucguaacuuauagaggggaaaauaaagcagucauuccaggcugggcaugguggcucacgucuguaaucccagcacuuugggaggccgaggcagguggaucaccugaggucaggaguucgagaccagccuggccaacauggugaaaccccaacucuacuaaaaauaaaaaauuaaaaaaaaaaauuaguugggcauggugcugggcaccuguaaucccagcuacucaggaggcugaggcaggagaauugcuugaacccgggaggcagagauugcagugagccgggagccuguaaucccagcuacucaggaggcugaggcaggagaauugcuugaacccgggaggcagagauugcagugagccgggagccuguaaucccagcuacucaggaggcugaggcaggagaauuccuugaaccugggaggcagagauugcagugagccaagaucacaccacugcacuccagccugggugacaagagugaaacuccaucugaaauaaaauaaaauauaaaaguuaaagcagucauccuggcuuuuaggaacccgcagaaucaggagguaagcuaaaagucgucucccuuuugucacgauggaaugugaaauaggugcauuuuccuucugacuuaugauucuguuucacggugccucugcagaaauucaguacguccccaugggcaccuguguccuucaggaguugaggaaauuuucuccauuccuugucccugucccuagacucugccagcucgugcauguagaagcucccgggaaaacugucaaccugugcacauucaagaccgccauauacuuguuauugaaaagccaucagucaugugagcagaacuuuuuuaugguugagauuguccccagggaaacccgccuugcaauucagaccuuccacggagaucgauuccaaacucucaucccguucccacuuccucguucccauggaggcugcgguucucucucucugugccgcuuacagauugucauaccuauuuccaaaaaugacacagaaaacuucaacguguggcuaaauuugaacagagaaaaauaagcaaagaauucaaggcgcgaggcguuuucagggagagagggagagcuuuugcaugguuugaagggaugaucuuuaaugaguugagggucaccuagaauagaauuaaacuguagagagcaaauuguuggaaaugcaaggagaaacuucggagaagacuccaacacagccuggaucugggagaugagacucagguaacaaaaaguuugaauaacaugguuaauaagauugugguaacagauaggacugaacuuugcacucugcaaacaauauacauuuuaaagugcucuuggaauaguuagaaaaaucaaucaucuguuaaaucugaaaaaaaaaaaaaaaaaacaacaaaaccccaccccaaaccaauacauuccaaaaaagcagacauuguacggguucuaaucucuggcugcaaguaagcauaacuggaauuaauuuuuaaaagcuuaacugaacaagcauguaagagagacuccuaccacuugauaauuaaaaagaaaaugaaaaccaaaaaaacaaaaacaaaaaaaccgaaaagggcugggcaccauggcucacgccuguaaucccagcacuuugggaggccgaggcgagcggaucaccugaggucaggaguucgagaccagccuggccaacauggugaaaccccgucucuacuaaaaguacaaaaauuagcugagggugguggcgcauacccuguaauccuagcuacuugggaggcugaggcaggagaaccgcuugaaccccgggggcagagguugcagugagccgagauggugccauuggacucuucuagccugggcaacaagagcuaaccuccaucucaaaaaaacaaaaaacacaaaacaaaacaaaaaaacaaccaaccccuaagucuuaaguuggaggaucgaaacacugcaaggauagacuauuugaagaugacaaugaugugaacauggagacaaaggcagagguuuaaaugauuauagaggaaauuugcuugauaauuuauuauaugaauauagagagaaaucacaaaaaugagaugaugaauauuggaaauaauaagcacagacgaacugauuagaaaacaaauagaacugacaaaaucaaaaagcuggaucuuuuagagagaugcugcucaguaggguggccacaacccacgugaaaauuaaauuaaaaauucauuuucucagucgcacgagccaaguuuccacugcuuaggggccauguaugguuagugacuacugaaauggauagaacagauacagaacuuuuccauagcugcugaacguuuguuggacagugcuguuuuagagggaggaaucaauaaaacagaaaaacuaagacaaaggagggggagagaacaaauauuguagauaaaauuaagaaugaaggccuagcgcgguggcucacgccuguaaucccaacacuuugggaggccgaggcggguggaucacgaggucaggagaucgaaaccauccugguuaacacggugaaaccccgucucuacuaaaaauacaaaaaauuagcuaggcgugguggccgcgccuguagucccagcuacuugggaggcugaggcaggggaauggcgugaacccgggagggggagcuugccgugagccgagaucgcgccacugcacuccagccugggcgacagagugagacuccaacucaaaaaaaaaaaaagaaugaaaauagauguaauuuauuuauuauugauugauugauugagacagagucucacuuggucgcccaggcuggagugcagugguacaaucucagcucacuguaaccucugccuccaggguucaagcgauucuccugccucagccucccgaguagcugggauuacaggcgcccaccaccacacccagcuaauuuuuguauuuuuaguagagaagugauuucacccuguuggccaggcuggucuugaacuccugacuucaggugauacacccgccucggccucccaaagugcugggauuaaaaacagaugucauuuaaauccauaaaaaauuguaaagacagcucuacuaacaauuuuggaaauauuaaaaauaacuucauuuacugauucaaguguuacuuuuauuuagcuuaauuguuucucuuuaccagaaauugaggcucugaauuugccccagagaauggguaugccauucucucucauaagcuguacucucuuauuaucaguaauuucuaaauagccuguaaaauuuauauggacucaaaaugcaggaaacaucaauagguugaaacucaacaacuuguaaaaaguuacuccuguacuuaauugcauaaaauguguauugccuacaugaaugagaauaaaaacuuccaaaaugcccccaacaaacagggguuuuugcaccuugccaugaguagcuuucuggagcaagccggagugguuagagcugugacucggcaaccacaaacacaaccauuuuuguguggaaguguggcucuucagccuuuuuuuuuuuuuuuuuuuuuugagauaaggucucacucuguuacccaggcuggagugcaguggcgugauccuagcucacugcagccucaacuuccuggacucgagcaauccuucugccucagcuucccaaguagcuggaacuacaaucaugugucaucaugcccagcuaaguuuuauuuuuuuuaaucuuuaauuuuuuuaagaaauagagaugaggucuugcuauguugcccaggcuggucuugaacuccuaggcucaagcaauccuccugccucagccuccccauuagcuggaacuacacuuguguaucaucaugcccagcuaauuuuuaauuuuuuauuuauuauuuuuuuaaagagauaaggucuugcucuguugcccaggcuggucuugaacuccuaggcuccagcaauccucccaccucagccuccaaagugcagccucuauaucuugaacuccacaccucaaacccagauuguccacaugugagcaccugucuuuuugguuugcuguuucucucgugaguuguauccaguugcccaagguggaaaguugggcgucauccagcagguaaguccugacaccuccaccuccccgauggcuucagaagccagccucuucuuuucuguuuccucugccucucaacuuccucauccaucuaccauaagccagaaaaaugacccccaaaugugaauccgaugguguucuuucugccugacaucuuucuuuggcuucugcugugggguaaaguccaagccccuugguucccugucuuuccucucuggucuaaucuucuauuccucucauccuguacuuugcccuucaucaacucugaacuguuuauaguucucugaacauagcccgagugauucacacauuugcauguacuguuccucuccugcugugauaaagggacagucaccuaauccccgccccuccguugcauuuuuuuuuuccuacaagauuuauuaugcaccuacuguguguauggcucugggaugcuguaauaagcaagacagacacaucuuucccuucacggggcguaugugucucgugcauacugggagggcagggacagggucuccauucauuucugcauuccaaugccaagagggugucagaucugggugggucgagguagggaacagguaaacauaacucacagugugaugccguguuacagccaggcuggguuccucacgccugugauggcagcgcuuuggggagccaaagugggaggauugcuugaagccaggaguuugagaccagccuaggcaacauagagagacccgcucucaaaaaaaaaaaaaaaaaaaaaagcugucgcaguggcacucuccuguaguccuagcuccuugggaggcugaagcggaaggaucacuugagcccaggaguccuagacugcagugagcuaugauggcuccauugcacuccagccugggccacagaguaagacccuguuucaaacaaacaaacaaauuuaaaaaaucaaacaaacucccacucccccaaacuccauaccacacccucuccuggucucucugggagaccuggauucgaguucuggcagagcugguuauuggcaaaguagccccucuaugccucgguuucuccaauucuaauggugaugauugcuugaauaauugaguuaauaugaccucauugauggauuggaccgugugugcugcaaacagauuacacacuuuaaaguguauucaugccuguaaucccaacacuuugguagacugaggcaagaggaucacuugaggccaggaguucuaaaccagccugggcaacgaguccccaugucuacaaaaaaauagaaaaaauuagccaggcauagugaugcacgccuguagucccagcuacucgggaggcugaggugggaggauggcuugagcccaggaguuugaggcugcagugggcgaugaucacaccacugcacuccagccugaggcgacagagugagaccccccccccaaaaaaaguguauuuaugggggugaauguuaaaugagaauguccacucgcugccuugguuuacuggaacugcaaauucaauggggacacacaaguuuucaaaugcaugcggaauacuggcuggagguuaccccaaaaacguagccuguggauuuuaagaauguauuuaugaguaugguucucguuuucugggugaguggugggugagaauagagggugcacuggcccggcgaguucggagaugcggacccucccccccugcaaugugaggaauuuugcugugugacccuagugagccgcugcaccuuucuggaccccucccgagggaggccuggggucagggggccccucggcagucccgggagcugccacgcggugacccgaucuccucccgggcacacgcccagcgccgcgcgcagccuaagccaccccgguggaugcuugaugagcccuugcaagcucgguuucuccuuuucccuagcuuuuuccaaaguuccauccguggcagacucgaccugcggggucugcagccacgaggggcccucccagggcgcccuuuccucuggccgggaccgcccggcggcggccacugcccgagcgccagucuggggagcggagcccggcgcacccggggggcggggccagcgccccugcagcacgcccgcccauuggcugagcgcgagggcggcgcugcggccgccgcaaccgccggggccggauuccccggagcggagugcgccccgggcuuugugcugcgcugaggccuccggcucgagggggcggagccuugagcgccuagggcucccucccucgcccccaugggcacacacgcagacacgggcacacacgcagacacacacacacgcccaucauggacacacacacacgcucgcccaccauggacacacacacacucccaccauggggacacacacacacucccaccauggggacacacacacacacacacacacacacacacucucacucuggaaccgaccaauccuggggcugcacagacacacacgcgcacacacucucucucguucucucucucucucucucguucucucucucucucgcucucucucccacucuggaaccgaccaauccuggggacacacacacacacacacacacacucccacucuggaaccugccaaucacacacacacacacacucccacucuggaaccugccaaacacacacacacacucccacucuggaaccugccaaacacacacacacacucccacucuggaaccugccaaacacacacacacucccacucuggaaucugacacacacacacacacacacacccaaacacacacacucccacucuggaaccugacacacacacacacacacacacacacacacccccacucccacucuggaaccugccaauccuggggcugcucuagcgaggagaccccugggaccccgccuccuuccgggccucugcgugcgcaguauaucuccuaagagauccgcagcauggagagggcccgcccccguggacggacucacucccuccccacucacucacucacucgcuuacucacucacucacucucucuccgaagagaagaagccugcggcucccgaagcgggaaggcccucugguacucuguucccuuucuagccucuauaugcgccguaugucuccaaagagcugcgcaguucuauuccaaaggcgucaucgcguguggggcgguauugucaggcaaggaaaaggggcgcuuccccgcuucaaggacacgcgcuccugcggucgucgcugcugaccacgaagcugucaaaaguucaccuccuuggcugcccccaaccccugccccuuugccauuaaaucauuuacuagauuccaacuagaggaauuuggcuccggggacucgaaccucugaggucagggucuggggccagugugggagagaaaggccuugaauggaaacaaaauaaauuacuuuaaggaguuuauaaaacucacacuuauagggagagccgcggggcccuguggucaauguaccagcaggcccaugacgcaacuguuccguuuggaaauuucuggaaagcaguaauuuuuggaaucauaaaucuugaguauuuuuuuuuuaaacuuuggaaagguuuuuaaacuuuuuuuuuuuaaguuuuuuuuaaacuucggaaaguuuuaagcuuuggaaagaauguaacaaaauguuauuaacauauguggagcuaucgaaucauuuaauggugguuucuguauuuucuguuuuguuuuuuaucacauaccuucuuaauuaagaaaaacccaaacuaauuugaacuuuaaaagggaggcaaacaaaaaagugucagagugacuggauuuuugugcgcaagucauuuaacaaugcagcgcugcgucuccuauuucucuggcuuuuaaccuugcuuuggacaaauuggucgcuuuuuguuuugaugucguuucaagcuuacggaaaaauugcaagauuauaucuagaucaaucaauuguuuacguuuuauucuacuuguuuuauuaccuuucuaauauauuuaugcacacacauuauauacauuuuuuuccccugaacuauuugagaguuaguugcaggcaugauacauacuccuuaauucuucaguggauauuuccuaagaacaagaaaguucugaggccaggcgugguggcucaugccuguaaucccagcacuuugggaagcugaggcgggcggaucaccugaggucaggaguucgagaccagccugaccaacuuggagaagccccgucucuacuaaaaauacaaaauuagccaggcgugguggcacaugccuguaaucccagcuacucgggaggcugaggcaggagguucgcuugaaccugggaggcagagguugcagugagccgagauggugccauugcacuccagccugggcaacaagagcgaaacuccgucucaaacaaaaaaaaaaaaaaaaagaaagaaaagaaagaaaguucucuuacauaaugaugguacuggugccguugucaaaaucaggaaauuaacauugauacaguauuuuaauccaaugucuucuauaaucuuaucuguugucucaauauugcccuauauagauuuuuuuuccuaggcgaagguuccaaucuaggaucacacuuugcauuugaaugcugcugucucuuaaguccgcacaauuccucaguuuucugugucuuucccaacauuggcuuuuauuuauuuauuuauuuauuuauuuuuauuuuuuuuugaggcggagucuuacucugucacccaggcuagagugcaguggugagaucuuggcugacugcaaccucugucuccuggguucaagugauucuccugccucagcccccaaguagccgggauuacaggcaugcgccaccacacccagcuaauuuuuguguuuuuaguagagaaaggguuucaccauguuggccaggcuggucucgaacuccugaucuccagugaucuuccugccucagccucccaaagugcugggauuacacguguuagccaccacaccuggccaacauuggcaguuuugaagagcacaggccaguuauuuuaucgaaugaccucaagcuaggguuaguaauauauggaaagaaagcuacacaaauauuuugucuuuuucauugccucauaaugggaaguacguguuguugccuugucccacuauugugggcaauguuacuugaaguauuuuuaacuagaauuuuuaagaagaaauacauuucccguaaggcucaguacccaagacaugcauauaccugaaugaaaaguuucccacaacaagauuuacucuugccauuuucuaguacugugggauuuuuuccuuuucuuuucccccugcaggaggggaugcugcugggggcugaggacaaugcuaaaccuggaugucucgaggacaggggaugggguuuuugugucaucuauguucugaugcuuuuucauuuaauacgagaacagguuuccuaugauuuggcacacugggacauucgacauguguuuguugaaugaaaaaaagaaaaaagagaaaugcuaacaauuuguugaauaguccauaaaagagcaaagcuggccuggcgcgguggcucacaccuguaccagcacuuuaagaggccaaggcagacggaggucacguguuugagaccagccuggccaacauggugaaaccgcuucuccacuaaaaaaaaaaaaaaaaaaaaaaucaguuggugugguggcgugugccuguaaucccagcuacucaggaggcugaggcaggagaaucgcuugaacccaggacauggggguuacagugagccaagauugcaccacugcacuccagccugggugacagaaagagauuuugucucaaaaaaaaaaaaaaaaaaaaaagcaaagcuauuauuaaaacacacuccacacuucaccccugagccccauauugauuuuguaauaaggcaaagauaauuuuuuuuucuuuuuuugagaugaagucucauucugucguccaggcuggagugcaguggcacgaucuuggcugacugcaacgacugccuccuggguucaagcaauucuccugccucagccucccaaguagcugggauuauaggugccuaccaccacgcccagcuaauuuuuguauuuugaauagagaguguuucaccauguuggccaggcuggucucgaacuccugaccucaagugaucuuccugcaucagccucccaaagugcugggauuacaggcgugagccaccaugcccagccaacaaagaugauuuuaagagaaccuuuguaaaagcucucaccgaugccugucauuauuagaauauuugggaguagaaucauguaacugaucaauaacauuguuuacugucuagcagaggcuuuugaaaaauguauuuccuggcugggcauuguggcuuacgccuaugcccaguuugggagcucggggagagcggaucucuugagccuaggaguucaagaccagccugggcaauauugugagaccucaucucuaccaaauguauauauacauauacaaaaauuagccaagcauggugguguacgccuguagucccagcuacucaggaggcugagguaggaggagcacuugaaccugggaggcggagguuacggugaaccaagaucaugccacugcacuccagccugggcgacagagugagacacugucucuaaauaaauaaaugaaagaagaagcuacuugaaaaaaauauguauuuccaaauauaugucaguuuugacaggauaguacacauacauaguaaaaaauaaaaauaaaauagggcacuuuuuugugucccuuucagagggacauaugucccauguguccuccccccuccugccccuaauuuuuuuguuuguuuuuuuaugagauggagucucacucugucgccaggcuggagugcaguagcgugaucucagcucacugcaacuuccgcuccccagguucaggugauuuuccugccucagccucccauguagcugagacuacaggugcgcgacaccaugcucagcuaauuuuuauauuuuucguggagacggagucucaccauguuggucaggaugguuuggcucuccugaccucgugauccgcucaccuuagccucccaggcuuagccuccuuagccugcugggauuacaggcaugagcagaagaaucucuugaacccgggaggcggagguugcagugagcugagaucgugccacugcacuccagccugagggacaagagugagacuccaucuggggaaaaaaaaaaaaagaaaaaaaagaaauacugcaucaaauugcacuugccucuuggugcaagauucguuccuuugcuuugaacugccucccugaagcaaauugguguuucugugacucccucugucuagggaagggguccuuuaguggggacauugucuuucuuggggaggguccaccagaggacucugacacagcggucuccuuucuccuccgucaacuuaguuagauuuuagucccugaucuucucagcaguguauagugaaaaagccaccgcagcugaaaguuucaggaagaugauaguugcuucugugugcucacccaggagcuuuugggagguuuagggagaacugggggaaaauugggaccagcagcucaauguggcuuugaaggggagacagcggauggacacagaacuugcauuuuuggagaggggaggucuggguagauguucccuacauacacagcagcacuugugugcaggugugagggagugacagcccccggacgguuuggcauuuuccugcaagucugccaucuugucuggcagacauagccugggcugcugacugucccuaccccaaaccagaauuugggcaggaacggacacuugggcucauuacgugucaaugagggggaucaggucaggggcacagggagaggaaagucaaccccguccuccacuggggcuguuucucaucuugcaugacacguggcuuucauaaugucuucacuuugcggucucucucaccagaagaagcugcuguuuuguggcuaguucaucugugucaugcccuuuccccagccugggcugccugugauuuuuuucuuuucuuuucuuuucuuuucuuuucuuuucuuuucuuuucuuuucuuuucuuuucuucccucccucccuuccuucuuucucuuucuuuucuuucuccuuucuuucuuuuucuuucuuuuuucuuuucuuucucugucuuucuuuuucuuucucuuucucucucucuuaucuuucuucuuucucccucuuucuuuucuuuuuucucuuucuguauucuuucuucuuucucucuuucuuuccuucuuucuuucucccucccuuccugccucuuucuuucucuuucuuucucccucuucuuucuuucucucucucuccccucccucccuccuuccuucccuccuucuuucuuuuuaucucucuccuuccuuccuuccuucccuccuucuuucugucuuucucuuucuuuucucucucucccuuccuccuuccuucccuccuucuuucacucucucuuucuuuucucucucucuucuuuuuaaagauagggucuugcuuuauugcccaggcuggagugcaguggugcagucacagcucacugcagccucaaaccccugggcuguagcaauccucccaccucagucucccgaguagcugggacuauugguuuacgggugugcaccaucacaccuggcuaauuuuuuuauuuuuguagagacaggggucuggcuauuuugcccaggcuagucuugaacuacuggacucaagagauccucccguguuagccucccaaagugccauuacaugcacaagccacugcgccuggcaggcuugugauuuucauguggagcuuuucacauucugucuaacaauccgaguucagaggaaccaguauggggagcaagaguauguggaaacguccagcaccaguuuagaggacucccacucagcuagggggugcaguggccaccccgaguggcuuuucuuucuuuucuuucccuccuucccucccucccucccuccuuucuuucuuucuuucuuucuuuuucuuucuuucuuucucuuuucuuuucuuucuuuuugagacagagucucacucucucuuccagcaguggcacaaucucggcucacugcaacccccgccucccggguucaagcaauucugcugucucagccucccaaguagcugggauuacaggcaccugccaccacgccuguauaauuuuuguauuuuuaguagagaugggguuucaccaugucggccaggcuggucucgaacuccugaccucaggugauccaccugccacggccucccaaagugcugggauuacaggcgugagccaccguucccagccucuauuuuuuuaaaauugacaaauaauaauuguauauguuacauauuuaugggguaccaugugauguuuugauaucuguuuacauuguagaauuacuaagucaugccaauuuaaaagcuaucaccucacauacuuaucauuguuuuaugguuaaaaauaucuacauuuuuggcaauuuugaaauguccagugcacuauuacuuauuauagcaaccauuguguccaauacauaacuaaagcuuauuucuccuaagugaaauuuuguaguuugaucaacaucucccuacagaguuggaaacaccuggaaugagcuuauaguguucgaaggauagucuucaaagaauugguugggcgcgguggcucacgccuguaaucccagcacuuugggaggccaagauggguggaucccgaggucaggaguucaagaccagccuggccaacguggugaaaccccaucucuacuaaaaauacaaaaauuagcugggcgugaugacgggcgccuguaaucccagcuacucaggaggcugaggcagagaauugcuugaacccgggaggcggagguugcagugagcugaguucucaccauugcacuucagccuggacaacagagugagacucugucucaaaaaaaaaaaaaaaaaaaaaccaccaaagaacacaggucagcauguuuauuuaacccauuagugagggaacagcaggauuauaaagccaaaacauguauagucacugaaauaagaaggcaguguuagcugugaggcugcuuaaugucccauaggacaauaaaacuguaaucuuuggggaugauuuuuuucuuuuuuuuuucggcaaggagagauaggaucucacucuguuacccaggcuggucucgaaugccugggcucaagcaauccucccgccucagccucccaaagugcugggauuacaggcaugagccuccaugcccagcugagaguaucuuuucucugagaugaaaauaauuuguagcauaucugucuguaaguuaacucuaauuuccuugagucuaguuccuaauagaaauaguaaaaucggccaggcguagugggucaugccuauaaucccagcacuuugggaggccaaggugggcagaucacuugaggucaggaguucaagaccagacuggccaacaugcugaaacccagucucuacuaaaaauacaaaaauuauccaggcaugguugugggugccuguaaucccagcuacucaggaggcugaggcaggagaauugcuugaaccugggacacagaguuuacagugagcggagauggcaccgcuguacuucagccuggacaacagagcaagacucgguuucaaaaaaaaaaaaaaaaaguaauaguaaaaucaauuacagguacauuuaacuagugcagguugauaaacuaucuggcccaucacuugcuuuuauaaauaaaguuuuauuggaccuagccaugccucuucauguacauaugucuguggcugcuaucaugccaucguggcagaguugaguaguuucaaccaacaccauauguccugcaaagccucaaguauuugcuuguggcccuuuacagaaaaaguugaccaacuccugugcugacaaaugaaauagcucagauaggccugucagcuagggcuccaacacaggauugcaaagucucgcagccucuggccuuguuugcaaugguuggauaauuuuucuucccauugucuaggccggaaggacuuauguguuugagagguuuguguuaggccauugaugacgccucuuuugaaugaaagggcugacccucugaaguggcuccagcccaggaaacaagccccuuccucuuguguguguguuuccuugccagagugcuggaacuccguggguccuggaucauuguugucugccuuguauauugcuuccuucaauugaauuucagcccucagguucccacagacagaucaguguuaaugauguugauaauuaugauaauuauagauacccucuguaguuaauuucuaucaagccuaaaaaugucucuaucaaagaaucugauguguuacugacgucauccuguuuauuucuugcaacagccuuaagaaggaaggaagggacucuuauuaacaauccccccucccuuuuuuuuuuuuuuuuuuuuuuugagauagagucucgcucugucaccuaggcuggaguucaguggcacaaucuugacucacugcaaacuccucuugcguucaagcgauucuacugccucagccucccgaguagcugggauuauaggcaagcaccaccacacccgacuaauuuuuguauuuuuaguagagacggguuucaccauguuggucaggcuggucgucuugaacuccugaccucaagugguccacccaccucagccucucaaagugcugggauuacaagcaucagccacugugcuuagcccuauuagaacuuccuaauauucuuguuuuuuuuuuuuuuuuggacggagucucacucugucagccagccuggagugcaguggaucucagcucacugcaaccuccaccucccagguucaagugauucuugugccucagccuucugaguagcugaguagcugggauuacaggcgcccaccaccacgcccagcuaauuucuguauuuuuaguagagucgggguuuuaccauguuggccaggcuggucuugaacuccugaccucaaauaauccacccaccucagccucccaaagugcugggauuauaggugugagcccccgcgcccagccccaagauaauuuucaagagugauccaugccauaaggaaaauguaaugagauaauguguuagcuuaugaauggagcaggaagggcgacuucugcuggggaagucagggaagaucuguguaaggaccugaaggaugcaaaggagcaagucacaaggggacaagggaccagggugcuccacccagaacagcuugugcaagguccuaagguagggcugagccugggugugugugggugggaggugcagaaaggaggccagccugggagaagaauuuagcaagacuggcagggauuagaccccccaaggccuguagggaguuggcuuuuauucuguaugccugaacugucucgucugggagacgguagucaucuguggcuaguaaacauuggaauugugucaggcacaguggcucauacuuguaaucucagcacuuugggaggcugaggugggaggaucgcuugagccaggaguucgagaccagccugggcaacauagugagaccccauuucuacaaaaaauuaaacacuuagcugggcgugguggcgcauguccauuauuccagcuacccaagaggccgaggugggaggaucaccugagcccaggagauugaggcugcagugaacugucacugugucacuguaccccagaaccuaagugacagagccagaccccaucacacacccaaaaaagaaaucguuacacauuuuauccauaugacaaaauaucacaaguaccccauaaauguguaaaauauucuguaucaauguaaaacuuuuuaaaaauuuuaaacugaaauuaaaaugaaaugcaguuaaaaguuuuguuccuugguaaaaauuggagcccugguacacuguuggugggaauguaaaauacugcagcuaggcugggcacaguggcucacaccuguaauuccaguacuuuggggggccagggugaguggaucacuugaggucaggaguucgagaccagccuggccaacacggugaaaccccgucucuacuaaaaauacaaaaaaauuagcggggugugguggugggcaccuguaaucccagcuacucgaggcugaggcaggagaauuccuugaacccaggagguggagguugcagugagccgagaucgagucacugcacuccagccugagugacagagugagacuccaucucaaaauaaauuuuuuaaaaaagaauaaauccuauauuauuccacuuauaugagguuccuagagucaucagagucacagagacagaaaguaaaaugggaugucgggcgcaguggcucacaccuguaaucccugcacuuugggaggcugaggcaggaggaucacgagguuaggaguucaagaccagcccggccaacauggugaaaccccaucucuacuaaaaauacaaaaauuagcugggugugguggugggcgucuguaaucccagcuacucuggaggcugaggcaggagaaucacuugaacccgggaggcagagguuacagugagcugagaucgcgccacugcaccccagccugggcaacaaagcaagacuccaucucaaaaaauaaaaauaaaaaaaaagaaaagaaaaagaaaguaaaauggcaggugccaggaguuggggaggaggaugagugugacuguuucaugggggcagaguuucaguuugguuaaggugagaaaguucuggagaugggugguggugaugguugcauagccacauaaaaguauuuaauaccacugaacuauacauuuaaacaugauuacaauggugaauuuuaugcuauguguauuuuaccacaauuaaaaaaaaaauuggauuuccuaguugcacuaagcacauucagaagccacaggggagaaguggcuacuauguuggauggcccagauagagaacauuuccgucaucgcagaaauuucgaccagauggugcuguucauauauggauguagcuucuggggccacuucuguucccugaguuuggccggugggauccacugugcugagaaucacagucuggggauuuggggugaagaacacuccccaacuuucuuucuuauuuuuuguuuuguuucauuuuuuguuuugagacagagucucccucugucaccaaggcuggagugcaguggcaugaucucggcucccugcaaccuccccucccagguucaagcgauucuccugccucagccuccugaguagcugggauuacagacgcccaccaccacacccggcuaauuguuuguaucaucaguagagaugggguuucaccauguuggccaggcuggucugaaacuccugaccucaggugauccgcccaccuuggccucccaaagugcuaggauuacaggcaugagccaccacaaccagccuuuuuuuuuuccuuccuuccuuccuuuucucucucucuuugucucucucucucuuuuuuuuuuuuuuuuuugacagaauuuugcacuuguugcccaggcuggaguauaguggcacgaucauggcucacugcagccuccaccucccagauucaagugauucucgugccucagccuccugagcagcugggauuacaggcaugcaccagcacaccuagcuaauuuuuguauuuuuaguagagacaggguuucaccauguugaccaggcuggucucaaacuccugaccucaggugauccacccgccucgaccucccaaauugcuaggauuacaggcgugagccaccacaccgagccacauuugcauguuuaaguaacuaacaugucuccuccauuagaccuugugcucccaaaggcaggaucugcagccacuuuuuuccccacaguggccacaguaucuagauuagugcaagcaaaugucuguugaagcaaucagugguuugggggcaaguuacuuaaccucccuguaccucaguuuccccauuuguaaaacaaaaaaauaaaggagcuaacaguguaucuacuucacauguggggugcagcagcaugcuggaguuggcuugcuggagccaguggugaaauuuucaggcaauuugugagccauuuguuaaacauagauauucauaaaaauuacauaaaccuacaguuaaacaaauuacauuaaaaacaaaaguuuuuaaauuaacaaagcuuuuuaaaaguaacaaauacucaaaacucaccaccuccuaauaucauacgauguuuuccuauuauuugugcuguugagguuauuuacuacuuuugugucaauaguagauacauuuuguguauacuuauaaauacuacuuagaggaaugcuacuguguaucuuuugucagcuuauguuuaguaacuucauguugguggccugaaauccaccacugguaggaauauuuacaccauggaaaucggcaaaugcuauauaaaucugggccucccugggccccucccucaggcagcuguuaaacauuuacaagcucaccaaugguuuggaggcuuaaaccaguuaauagaugugucugacauguggguaaugauguagacgugccgcuuuuacuguuaguguuugguuggcuuucacugucugauccagaauugcugcauaugcagacaggaauuggacaaagccauuuauuuauuuauuuauuuauuuauuuauuuauuuauuuauuucccucucucucucucucucucuccaguuugcccgaccaucuguaagucacacggcugcaccgccgaaggccucuguugccacagcgagugccugggcaacuguucucagcccgacgaccccaccaagugcguggccugccgcaacuucuaccuggacggcagguguguggagaccugcccgcccccguacuaccacuuccaggacuggcgcugugugaacuucagcuucugccaggaccugcaccacaaaugcaagaacucgcggaggcagggcugccaccaguacgucauucacaacaacaagugcaucccugagugucccuccggguacacgaugaauuccagcaagugaguucuggaugugggucuggggggcagccgagaggagaaggaacgugggguugguugugacgaugccgcuuguuaaaacugugugcaaacccaggguuaauuggcuaugagugaggucucugcucucagaugcuacuuuugcacccuguuuugguccugggcuugggagugggaguugacuaccuuuuucucuaaaggaccagauaguauauacuucuggcauugugcccaccauucuuuuuuuuuuuuuuugagauggagucuugccgcaagacucccaagcuggagugcaguggcacgaaccuggcucacugcaaccucugccuccuggguucaagcgauuuuccugccucagccucccaagcagcugggacugcaggugccugccaccaugcccggcuaauuuuuguauuuuuaauagagacaggguuucgccauguuggucaggcuggucucgaacucccaaccucaggugguccaccugccuuggccucucaaagugcugugauugcaggugugagccaccgcacccagucuggcauuguggaccucaguucuaagcuuucugugguuggcuucagaacaagaaaauauaauaaggacagaguccuugguuuucccuaaaauccuccacguggccuguccucacugauguagcuucaucauugucacauaaaggauauaccaaggucuuucgugucuucccugaccuguagccugguggugugccaagauuagcccagaacauacugucuccaggaggaagagacucgcuucugcauuauucucagggcuuugcuguucucugaaggacaguauaaucaaaccauuuccugccguuugggugagaaauagcaggguuuucucucuucgacagagucagauuuccuacgcacaucgcagacuuucuguucguacugugagcuucuuccaugagcuauuuuggggccguaacugaguugcaaaaaucuguuuccugguuuuuguauugagguuuuauguuuuguuuuaaaacacacacacacacacacacacacacacacacacaccacaaaacaacacaaaaacaaaucagaaacagacacacaucaagaggccuugagcugaccugcuuacguaaaguaucuuccucuucagacuugagaauuagccaagcgagaguguuggggugggaaauuguauuucccuggguggagagggcgggaaggaaaacaagcuguaauuucaguucuuaugacucuuucuuugaguguuugugaaaccugcaaguacaauauguuuuguuuugcucguuguugauaaaaaccuaccaaaaaaaccuuuuggcuuuauugaccaaaagggucuauaaaucaccuuuucauaccagacagacuuuuguuuuagguuuuuuuuuuuuuuuuuggccaguguauucccaagauugaggaaaugaccauauuccuuuugauucauuucuuucuuuuuaaaaucacaauugaaauaaaaaaaauggguuaauaucuucuggcaagauguuuguuuaaaagacauuggccuuaaauaaaaggcauuuuucccucaccuuaacaauggccugagaaauauagcaaccuccuuugauuuucucacugaugaugcgggagaugcuaaaacagaaacccugagaaauugaccgcacauccuugguaucugggaccuuuccugaacggaagaaaacaaaggagaggggggugcauugucaccguauuuuauugcguagguuuaaaaaaauuaauauuuuuauuucugaagcuuuuaauuaauuaauuuauuuauuuugagacagagccucacucugucacccaggcuggagugcaguggcaugaucucagcucacugcaaccucugccuuccagguucaagccauucuccugccucagccucccaaguagcugggauuacaggugugaggcagcaagccuggccaauuuuuuuuuguuugugcuuuuguuuuuuugagauggaguuucauucuuguugcccagacugaagugcaauggugcgaucuuggcucacugcaacucagccucccggguucaagugauucuccugccuuagccucuaaguagcugggauuacagacaucugucaccauacccagcuaaauuuuucuuguauuuuuaguagagaccggguuucaucauguuggccaggcuggucuugaacuccugaccucaagugauccacccaccucggccucccaaagugcugggauuacaggcaugagccaccgcaccuggccugaagcuuuucuuuuuaucuuaugaaagacuuaaucguacuguggcauuuucuaaugugguuugauaucaaauagggccagauguuuucuuccauucugguggcuuaucugggaaggaguucuugauguuuucagagcagaguucugggaacccauguuaaaaggccuuggccaggcacaguggcuuaugccuguaaucccagcacuuugggaggccgaaguggacggaucaucugagggcaggaguucaaggucagccuggccaccacggugaaaccccgucuuuacuaaaaauacaaaaacaaaaaaaaaauuagcugggcauggugaugcauaccuguuaucccagcuacucgggaggcugaggcaugagaauugcuugaacccaggaggcagagguugcagugagcugagaucacgccauugcacguuagcccccaggcaagugugacaagagugaaacugcaucuccaaaaaaaaaaaaaaaaaggucucaccaucuacugucguuccaaaguaccugcugggauguaauagcacagugcugcuuccugagaugagaaggaccagauauuugugaugaauaaauuuucaaugcguaugggguauccacugggaaggggagaauuaccuaaaauccuugauucuucuuggccucucucacuucuuccuauuaagcugaggucucaaauuugucuacaccuccaucuauuucaccaucaugucuggucugacccaguccccuugaacaaucucuuugcuccugcuuccauucuagugacacugguaaaaaguggccaccugggccaggcgcgguggcucacgccuauaaccccagcacuuugggaggccgagguggguggaucaccugaggucaggaguucgagaccagccugaccaacauggugaaaccccaucucuacuaaaaauacaaaaauuagccaggcgugggauuacagugggcgccuguaaucccagcuacucgggaggcugagacagcagaauugcuugaacccgggagguggaggucgcagugagccgagagugugccacugcacugcagucucggugacagagugagacucugucucaaaagaaaaaauaaaaguggucaucugaucauaugccauguccuucccuaaaacccuccgguggcuucccaagaccaauggacagaauccaaacuccucaucgggagggcucggccaguucucauucucauuucauuccggugcccccuggccgugguggucguuaccgcaggagcuuuuccugcaacuugcuacauccgcuuuccucugugccuuucaauuagcuguucccucuuccuauaaugcuugucccugcauuugagaaugauccacuuuuuccccucgucaucuagauggcagcuuaaaagucaccuccuuggcaaauccuucccgucugagucaaucauccgugcacucucugucacaucauuuaguuuuaacucuucgauuugucacuagcugauauuuuugucuuuuuuuuuuuuuuuugagacaaggucuuggucugucacccaggcuagagugcaguggcacccacauggcucacuguggucucaacccccugggcucaagagauccuccugccacagccuccugaguagcugggacuauauaggcacacaccaccacaccuggcuaaaaaaaaauucuguaguguugggggucuugcuauauuccccaggcucgucuugaacuccuggguuuaagugauccucccaccuuggcuucccaaagugcugagauuacagggccugagccacuguaccuagccuuuguugucaauuuauucacucuccccaaccagaugauaagcuuugugaguguaucagcuagcucuuguugcguaacaaaaccaccucagugcuuaguggcuuaaaacacuccuuuaggagcucugaugauuucauguguugacugaagguuugucuggccugggccuguuuagcuacggcugaugguuuaggggagccucuugugucuuugauggucagugggggucucucuccauaagucucuuaccccagcagccaggaagggcagaccucaauguucaagugcuuuucaagccucagcuuguaucacguuugcaaauauuccauuggccaaagcaagccauauggccaagcccagauucaacaggugggaacauagacuccacuucuuggugggagaggcugcaaagaacucauggucauuuauaauuucccacugggaaagcauauuaucugcuuuguucacucauguauaccggcagcugagaacggggguuggccaagggccagauaguaaauauuuucagcucucagggccauauggucucuguuggagcuacuuaacucugccuuugcagcgugaaagcaggguuagacgauguacuaaccaauaaauguggccauauuccaauaggauauuauuugcaaaaacagguggccuacuggauuuggcucccagcccacuguuugccaacuccaggcuuagagcauugccugccacauaauaagaauagaggcaauaaaagaagucaaacauuuggucaguauuuuguuucugccucagcuguucugccacuaccuggguguacuugcaacaccguucugacaccauccuccuccaaaguuagcaucagacgccacaaguuuaaggcucagcccuccaugagauuucccuugcuucagacacuggcagcaucuuggggaucccccagccacccacacuucugacuaacuggcucuaaauugggggauucccacaaacuguuuggguuucauaauuuacuagaaggaacucacagaaugaaaauaaaccuggccaggugugguggcucaugccuguaaucccagcacuuugggaggccauggugggaggcucacuugagcccagagguucgagaccagccuggacaacauagugagaucccaucucuacaaaaauuuaaaaacauuagccaggugagggggugcaugccuguagucccagguacuugaggggcuuaagcaggaggaucgcuugagcccaggaguucgaggcugcagugagcuaagauugugccagugcaccccagcccggguggcagagcaagaucuugucucaaauuuaaaaacccugcuauacaauuacaguuuuauuauaaaggauacacauacggcaagaucugggagaguucuagaugcagaauuuccauauugccuccucguggcaacagcauguaucacccucuugacauacugguguguccaccagcugggaaguacuacugagcuucagcguccagaguuuuuguuuguuuguuuguuuguuuugagacggagucucacucugucacccaggcuggagugcaguggcucaaucucagcucacugcaaccuccacaucccagguucaaacaauucuccugccucagccccccgaguagcugggacuacaggcaugcaccaucacgcacggcuaauuuuuguauuuuuaguagagacaggguuucaccauguuggccaggcuggucucaaacuccugacuucgugauucaccugccucagccucccaaagugcuaggauuacaggcgugaggcacugcacccggcccaguauccagaguuuuaauuggagucucauuccuuaggcgugauugauugaaaucauugaccaugugauucaacacugccauuuccagcccccucaucucccuggagguccuaaaagccccaacccucugaucacaggguuguucuuucuggugaccgccccccacccucauguuaucuaggcacccccccccccacaagucaccccgacauuccuaacacuccuaacaaaagcauuccugugacucagaaaguuccaaggguuuuugaagcucugugccaagaaccgggaugaagaccagauacauacuuuaugauccuacagucacaaaaaucacucugaagaguugaauacccaggagugugagaacaacagcagcagcaacaaggaugccaccaauaaaaaaugacccuuguagcaacggauaaaauugcguucugugugcgaagugcuuuugugguaugcuucauugaguuccucaucacaagcuguggcguuggugguguuauuuucagaugaagaaauggagacuguaacaguugggaaucuugugguuucaugcaccagaaccccaacucaaauuggcuuaacuggccgggcacgguugcucacaccuguaaucccagcacuuugggaggccgaggcggguggaucaccugagguugggaguucgagaccagccugaccaaaauggagaaacccuguuucuacuaaaaaaaaaaaaaaaaaaaaaaaauacaaaauuagauggggcaugguggugcaugccuguaaucccagcuacucgggaggcugaggcaggagaaucacuugaaccugggaggcggagcuugcagugagccgagaucgugccauuguacuccagccugggcaacaagagugagacuccaucuuaaaaaaaacaaaaacaaaaacaaaacaaaaaaaccauugacuuaaccaagauuaaaggaguuuguugguacccauaaccaaaaaguucagggaguugguucagguauagcuguaucaagaagcuuaagcgauguaccugaucagucuccuucaucuuuauuuuccucuuuguugguuuuguuaucaggcagcuucucccucacccuucaccccaugcuagcaagauggcaaaacccuuagauacuccagaaggaagacaauuuccccuuccagcauguucuagcaaaacccucacugcacugacuuaaguucuguacccaccaccucugagcccccacaggaauagaagguggugcucagcuuggcuuggaucuugugcccauccuggaucuagaagggcuuuggcaaccaagaacugaucucagagaccccguguuggggaggacugguucccaaaggacuccugggggcugugaguuugauggcaucaggcugcaggcuggcaaaaccaaaggcugcccaagucacuugccauuaaacauggggucauguuacagccguaguugcaucacaucccacacagaacagcaaauguccugucuccuuggaguagcagguugaauucugccacguugggguaacugucaguucugccacaucaggcccaucaucucaagguaacggcacauucuuauuaccacaugcauuaguccauuucugcacugcuauaaagaauacauggaacuggguaauuuauaaagaaaagagguuuaauuggcugacaguucugcaggcuguacgggaagcauagcagcuucugcuucuggggagaccucaggaaacuuacaaucguggcggaaagcaaaggggagguaggcacaucuuacaugacugaaggaagagagaaagggggaaggugcuacauaguuuuguuuguuuguuuugagacagauucucacucugucacccaggcugggcugcaguggcacaaucucggcucacugcagccuccaccuccugaguucaagcaauucucaugccucagccuccccaguagcugggauuacaggugggcaccaccacaccugguuaauuuuuguauuuuuaguagagacgggguuucaccauguuggccaggcuggucucgaacuccuggccugaagugauccgcucgccuuggccucccaaagugccggaauuacaggcaugagccaccaugcccggcuggugcuacauacuuuuaaacaaccagaucucgugagaacucacucacuauacacugccaagggguauggugccagaccauucaugagaacuccgcccaccaugauccagucaucucccaccaggccccaccucccacauuggggauuacaauuugacaugagauuuggguggggacacagauccaaaacauaucgccacgauaaugcuaugagucccauugcugucacgcacaggguagaucaugguccugccuccaugggauauggugugaaucccaucacugugggguccagcaggaguccugucccaucacuuugggguaaaauaugagucuugucacuuugggguaaaagcaagaggaccugcaaccauaggguaauggcauaauucucucacuuaaggcagugguucuuuucuggggacaaucuggcauccucccuccccaggggacuuuuggcaauguugggagacuuuuuuuuuuuuugagauggagucugacugugucucccagcuggagugcaguggugcuaucucggcucacugcaaccucugccucccagguucaagcgauucuccuaccucagccuccugaguagcugagauuauaggcacgugccaccacacccagcuaauuuuuguauuuuuaguagagacaggguuucaccauguuggccaggcuggucuugaacuccugaccucaggugaucugcccgccucggacucccaaagugcugggauuacaggcgugagccacuuugccuggccuggaggacauuuuuaauugccacaacuugugggagggaugcuacuggcagcucgugaguggagccuagggaugccgcucaauauccuccaaugcauaggacgccacccccacuaccacaguggagaauuacuuggccccaaaugugaacaaugcugaggucagaagaccuugccguagcaugauggacuuaugccaucacuugagacccugcauagugugcugucuucccaggcugaucuugaacucccaggcucaagcaacccucccuccuuggccucucaaagugcaggaaugacaggcaggagccaccacgcccggcuccagaaucuacauuuuuaacaaucaagcgauauguccuauugcagaucggcagacuguguuuucagaaauaucaucucaggcagaaagggccgggugcaguggcucacaccuguaaucccagcacuuugggaggccgaggcggguggaucacuugaggucaggaguuugagaccagccuggccaacaugguaaaaccccgucucuacucaaaaauacaaaaauuagccaggcacgguggcgggcaccuauaaucccagcuacuguggaggcugaggcaggagaaucucuugaacccagaaggcagagguugcagugagcugagaucgcaccacugcacuccagccugggcaacagagcgagacucugucacacaaacacacacacacacacaaagaaauaccauaucaggcagaaagaugccugagaugucugaaggaccuuggauaccgugacaccccccuccccuuucucuuucucucucucucugcuccguccuuagcuugcugugcaccccaugccugggucccugucccaaggugugccaccuccuagaaggcgagaagaccaucgacucggugacgucugcccaggagcuccgaggaugcaccgucaucaacgggagucugaucaucaacauucgaggaggcagugagugucucugugugggcgucgggggugccuguugggcuccaugucccucugagcugugagcggggaagaaaagcagugcagacccugcugcgugcuccuacagcacuuuuaggauggucguucaguggcucccccauggauagaaccaugcugggagucugccucaaaaccugaaaugaacagcucagucuuggccuuacuaaccuugagauucucauuuucuacuuugggaguuggggcaucaggaaucugcauuuacauuuauuuuuauuuuuauuuuuauuuuuagagauggggucuugcuccauugcccaggcuggaguacaguggggcaacucuagcucacuguagccucaaacucuugggcucaugcaguccuccuaccucagccucccaaguagcugggaguacaggcaggugucacugugccgggcuaauuuuuuuuuuuuuuaauuuuuuuccagggccagguucucacuauguugcccaggcuggucucaaacuccugggcucgagcaaucuuccugccucagccucucaaagugcagggauuacaggcaugagccaccccaccuggcuuuggaaucgucguuuuuaacaaucaagcaauaugcccuauugcagaacugcaggcuguguuuucagaaauaaaucucagggccgggugcaguggcucaugccuguaaucccaacaguuugggaggccgaggcagguggaucacgugaggugagaaguuuaagaccagccuggccaacauggugaaacccugucucuacuaaaaauacaaaaaaauuagccaggcuugguggugcgugccuguaaucccagcuacgcaggaggcugaggcaggagaaucguuugaacucaggaaguggagguugcaaugagcugggaucgcgccacugcacucuagccugggcgacagagugagacuccaucucaaaaaaaaaaaaaaaaaaaaaaaaagccaggcgcuguggcucaugccuguaaucccagcacuuugggaggcugaggugggcggaucacuugaggucagaaguuugagaccagccaacauggugaaaccuugucucuccuaaaaauacaaaaauuagcugggcacgguggcacaugccuguaguccuagcuacuugggaggcugaggcaggagaaucacuugaaccugggaggcagagguugcagugagccgagaucacaccacugcacuccagccugggccauagaccaagacuccauuucaaaaaaaaagaaaagaaauaccaugucaggcaaaaaggcauuccuuuguuuauuucuuuagcgaacauguacugaauacucacagugaguaagggaaaguccuuaccuugauggauuuuugcgcauaaguaaaucgacagauauuguaaggucagguuguggucugugcugugaagggaagugcagcaggguaauagguggaauggaaaugggcaacuuuucccuauaaagggcucuuucaugaauauauucagccuggcaggccgggcagucucugccguaaccacucaacucugccguuguaauaugaaaacagccauagacccaugucagcuagcaggcauggcuuuguuccaauaaaacuuuauuuacaaaacagguagaauuuggccagugggcugucauuugucaaccucuaaaauggagacuaacagggguugcuauuuuuuuuuuuuuuuguaguuuuaguagagacaggguuucaccauguuggccaggguggucuugaacuccugaccucaagugauccaccugccucgcccucccaaggugcugguauuacaggcaugagccaccagcaccaagcuggggguugcuauuuuagagaagucucugguaugggaaaggaggguuugagaugaugauggaacaagccaaggagauauaugguggaauaauauucugagcaacagacgcagccagugccaagguccuggggcagaaguaugcuugacccauuuaaggaaugcuaaggacuucagauuguguucuaagcaugaugaguuuugagcuggguauguccagucauuugcagccugaggguuaucuucucaccauggagaaucaugagaagauugaaauaugucuauagaaacccacuggauauucucuccuuuccuuagacaaucuggcagcugagcuagaagccaaccucggccucauugaagaaauuucaggguaucuaaaaauccgccgauccuacgcucuggugucacuuuccuucuuccggaaguuacgucugauucgaggagagaccuuggaaauuggguacgugggccugauuguguguauggccugagugcuaacuaggaaguucguguauuagaacaacuuaaggauuuuuuuggccaggugugguggcugaugccuguaaucccagcauuuuaggaggccaacgugggugaaucacuugaggcggggaguucaagaccagccuggccaacauggugaaacccugucucuacuaaaaguacaaaaauuagccaagugugauagugcaugccuguaaucccagcuacuugggaggcugaggcaggagaauagcuugaaccugggaggcagagguugcagugagccaagaucacacuacugcacuccagccugggugacagagugagacucuguccaaaaaaaaaaaaagaaaagaaaaggaaaaacuuaaggauuuuuuaaaaaucaaauaaaaacaaauaaaaaacaaauaaaaguauaucuggcaaaaccucgggaaaaaagaacuuggaaugugccuaaagguccauccagccaaaaauuguaaaagcuuuuuuauagucauucuugagaaacaaaagugggagcagcccaaccuuggugcccauccuccaaggguacaggcuggaauuuuugcuaaauuugcuguuugggcugcauugugaguagaguuuggcaugcauaaaaugaacauucccucuuagucccgguuguccauccuaauuucugggauggacuccaucucaguauauuccaguauauuccaaccuucuccuugagguccuagaaacucuauuagcaaaacagcagaaacucaaacuagcuagaucaagauugacucauaggcaggaggucuguggaagacccagauucuuuccaucuuugugcuccucauggucacaagauggcugccucagccccagccucacaucuguagaacagacagcaaauggggaaagggacaaaaggacauguuaaucaacaugagcugguaagugacuugagaagguggucuaaacaauauaguuuagacuauauuaucuguacuccagccuaggcaccagagugagaauccaucucaauaaaacaaacaaacaaacaaacaaaaaccuucaauggcuccuuucuccuuauuaaggauggccacauguucuuggucuuggucuggcaugcaauauacuagagggucugguccauugcaacuacagcuauuuccugucaccuauuggccaaaacaggcuacuuugcucuucccugaacucagcuuaggugccucuguguuaucaguauuuccccuauuugcagaaauugguuucugcaaaaccuauuccucaguccaucacagacucaccaccccucuucaagacugagcugagccuccuuccuggccaugaaaacuuccucaacuuccucuguuauccacauucaacaaauauguguugaguaugugccaagcaaguggagaggauuaggcacguagcacugaacaagaucaacuccgagcauggccacaccaucuuggaguuguagaagaccagccguugaaugacuagauguguguguuuuuuccauaggaacuacuccuucuaugccuuggacaaccagaaccuaaggcagcucugggacuggagcaaacacaaccucaccaucacucaggggaaacucuucuuccacuauaaccccaaacucugcuugucagaaauccacaagauggaagaaguuucaggaaccaaggggcgccaggagagaaacgacauugcccugaagaccaauggggaccaggcauccuguaagucacugguccccaaccuuuuuggcaugagggaccgguguaguggaagaugguuuuuccauggacuggugguggguggggaugguuucagcaugauucaagugcauuacauuuacuaugcacuuuauuccuauuaugauuacauuguaauauauaaugaaagaauuguacaacucaccaucauguagaaucaaugggaacccugagcuuguguuccugcaacuagauggucccagcugggggugaugggagacagugacagaucaucaggcauuagauuuucauaaggagugugcagucuagguaccucauguacacaguucacaauaggguucacaccccugugagaaucuaaugccgccgcuaaucugacaggaggcagaacucagguggucaugcaagcgauggggagugacuguaaauacagaugaagcuucacuugcucaccuaucacucaccuccugcuguacagcccuguucguaacaggccauggauaaguacuggucuguggcccaggggcuggggaccccugcuguaagugguccacaaaccagauaauguggcuguccucucucauccaucacagucacccccaggggguauuacuucccucuaacaacucacugugugauaggcuuucuuacugagggcagauucugcacauuuauuaauauuaucacuaugcuuacugugccauauaguaccggauacgggaugaagucauacaagcacugaaugaauggaugaaugaaugauggaugaauggaugacaccuucuuauauguguaucaggcugaugcugaagacuucaaaguugaguaaaauaccuaugucagucugcaucuccugggaagugacugccaaguugaaguuaggagugcagaaaauguauugaggguaauauucauaaaauaugaaacagaggaagagcuucuuuuuuuuuuuuuuuuuuuuuugggacagagucuugcucugucacccagggcuggagugcaguggcgugaucuugccucacugcaaccuccuuccccuggguucagguaauuaucucgccucagccuccagaauagcugggauuacaggcacaugccaccaagcccggcuaauuuuuuuuuuuguauuuuuaguagagacaggguuuugccauguuggccaggguggucuugaacuccugaccucaggugauccucccgccucggccucccaaagugcugagauuacaggugugagucaccacgcucagccaugaagagccuuuugacaauagcgugugucugaccucugugaacagagagcgggaaggagggaggauagggcugggagagucucagauggugaugcaucccugagucuuggccaaacccagaaagagaucaaggccacgguugucugcagggaaguucugcauugcaaagggacggccaggcaucuaccaagcucagucauaggugggggcuguccagggagagucagguuuuggcuggaaugcuacagcagguccugcaguuucugcagcugcaggcugccugcugacugcacuucccugacagauucuaaacagugagcugccaagggcuucugggauaccuucauggggaguuaguuacuuaugucaaaauguagugcaagggcugggcaugguggcucacgccuggaaucccagcacucugggaggccgaggcaggcagaucacuugaggucaggaguucgagaccagccuggccaauguggugaaacuccaucucuacuaaaaaaaaaaaauacaaaaacuagcuggacgugguggugggugccuguaaucccagcuacuugagaggcugaggcaugagaauugcuuaaacccgguagguggacugcacuccagccuuggugacagagcaagacugucucaaaaaaaauguagugcaaggagagagagcgagguuggggugagguuuaggagaggguuugucuucuaggcagagagaauuacuuagaugcgucucuccgaugucuaaugaucugcagggucucuaaacucacuuggcauagguuuauuugcacuggaguugcaccuccuuccaggucagucuuacaaguccauaugcgagacaacguugugucaggacaaacaucacccuuggaaaucccuuccuccaauaacuauuggccgguuguccuucuugcgcggguacagacugcgcuuauucaguugacugucuggcugagucaagucauuggcuuacgugagugugaguggccaaguugcaaaacuggcucuuaccuuugaaucuucccccauucauacucagccaggcacauggggaggagacccuuaagggaauagcagcgucaccucugccuucucacggucccuccaggaagugugggggucccaggcuuuggucugaaacuacacugaaauagcucauuuuugccuuuuguuuuaacuuuuccaggugaaaaugaguuacuuaaauuuucuuacauucggacaucuuuugacaagaucuugcugagaugggagccguacuggccccccgacuuccgagaccucuugggguucaugcuguucuacaaagaggcguaaguagaagaguuagagagacgcugaggaggcgagggcuggcuggcucugugcuugcuacguuugugcuccaaucugccccucuuggguuccugucuaucucccuccuccuccuggaauaaauaucuuagguuccuuuuuacaaucucaccagucgauggcaugcaaagucaauagugucugcuuuuaucaaaugccuaaaauggaagcagacagcuuucccauagaagcccggacuggccaguuuccuggggcaauauucuauuuugccuugccuguguaugucucaucagacauccuuaguagucaggagcucagucuacuaaguggauguuaucaaauguauugcuuaucuauuuuucuuuuuuauccccaauuuuuuuuuuuuuuuugagacagagucuugcucuguugcccaggguacagugcaguggcagaucuuggcucacugcaaccucugccucccggguucaagcaguucuccugccucagucucuugaguagcugagauuaugggcauacaccaucacacguagcuaauuuguguauuuuugauagagacggguuuugccauguuggccaggcuggucucaaacuccugaccucaggugaucugcccaccuuggccucccaaagugcugggauuacaggcaugagccaccgcaccugaccaguaguaauauuaauaauaguucuagcccucaagauuuaccuugugccuugcugagcacugacacacagucuaaucuuaucaguaacuugugagggagcuccugcuauuacuauuauuacagauugaguaucccuaaucugaaaaucugaaauuuauaaugcuccaaaauccaaagcuuuuugugggccgacuugauacucaaaggagaugcuuauuggagcauuucagauuucagauuuuuagauuagagaugcugaaccaguacaaugcaaauuaacuaguaaaaugcaaauauuucaaaaccccaaaauauccaaaauccaaaacacuucuggucccaagcauuuauuuauuuauuuauuuauuuauguuuuugaaacagagucucccuuugucgcccaggcuggagugcaguggugcgaucucagcugaugcuaccucugccucccggguucaagcaauucuccugccucaaccuccugaauagcugggauuacaagcaucugccaccaugcccagauaauuuuuguauuuuuaguagagacgggguuucaccauguuggccaggcuggucucgaacuccugacuucuggugauccgccauucucggccucccaaagugcugggauuacaggcgugagccacugcacuuggccaagucucaaguguuuugaauaagggaugcccaagcuguguuuuuucauugagaugucaggguugacaguuccuuucucuuuggcuguucccgaguuauuuuuucuuguggcauuagauuguugggugaguaacaugugacccuaugggauguaacuucccaggccucaucugcacggcacucagugugacggucuuguaaggguaacugccuucugcuguuuugucuugaaagcccuuaucagaaugugacggaguucgacgggcaggaugcgugugguuccaacaguuggacggugguagacauugacccaccccugagguccaacgaccccaaaucacagaaccacccaggguggcugaugcggggucucaagcccuggacccaguaugccaucuuugugaagacccuggucaccuuuucggaugaacgccggaccuauggggccaagagugacaucauuuauguccagacagaugccaccagugagugugucuugggaaugugaauucguaugugaaucagaccucuugcuuuuaauaggcugaugcagugagguuguauaaaaugcuccuugauaugguuauuggcuuuuuuuuuuuuuuuagacagggucuuacuuugucacccaggcuagagugcaaugcaguggggugaucauggcucacugcagccucaaacuccugggcucaagcaauccuucugccucagccuccuaaguagaaggaacuaccagaguauaccaccauguguggcuuuuuuuuuuuuuuuucuuugagaugaagucucacucugucacccggacuggagugcaauggcaugaucucggcucacugcaaccuccgccucccagguucaaguaauucucccaccucagccuccugaguagcugggacuacaggcaugcaccacuauacccagcuaauuuuuguauuucuuguagagacagaacguugcuguguuacccaggcuggucuugaaccccuggccucaagugauccuccugccucggccucccaaaguccugggauuagaagugugagccaccuugcccagucaguuauuggcuuuuaaaggagcuggguauugaggcuuauaguuucagacgaggcaguagcaacaagccacuugaugggaauauuuauauuuuucauccuauuaugaaaaauugucaaauauucacaacacagaacaaaaccccauaguuagccgccucccagcuucagccuuuggucauuuuuguuucaucucgacgccuguucccucuucccacuuguuacuucuuuuuguuuuguuguuuguuuuggccuggaguauuucacagcaauuuaauuauguuuguuuguuugagauggagucucacucugucacccaggcuggagugcaguggcgccaucuggacucacugcaaccuccaccucccagguucaagugauucuccugccucagccucccaaguugcugggauuacagcacacuuggcuaauuuuuguuuuguuuuguuuuguuuuuugagacagagucucacucugucacugaggcuggagugcaguggugugaucucagcucacuguaaccuccccgucccaguucaagugauucuccugccucagucucccaaguagcugcaacuacaggcgugccaccacgcccagcuaauuuuuguauuuuuaguagagaugggauuucaccauguuggccaggauggucucaaucucuugaccugcaaucugcccaccuuggccucccaaagugcugggauuacaggcauaagccaccaugccagccuuuuuuuuuuuuuuuuuuuuuuuugagauggaguuucgcucuuguugccuaggcuggagugcaauggcccuaucucagcucacugcaaccucugccucccggguucaagcgauucuccugccucagccucccgaguaacugggauuacaugcaugcaccaccacgauuggcgaauuuuuuuuuuuuuuuuuuuuuuguagagacaagguuucuccauguuggucaggcuggucucgaacuccgagccucaggugauccgccugccucggcuucccaaagugcugggauuacaggcaugagccaccgcgcccagccauuuuuguauuuuuaauagagauggggcuucaccauguuggccaggcugcucuggaacuccugaccucaaaugauccgcccaccuuggccucccaaagugcugggauuacaggcaugagccacugggcccggccuaauuauauuuuuguaaaaccuaagugcuucucuuauagcaguaguucccaaaggagguuaacugcucugccagggaacagcugccaaucaaugucuggagacauuuuugguuguuacagcuguggagaugaaaccacuggcauuucgugggcggaagccagagaggcuguuccauguccugcaacacacaggaugcacccuccuucaugacaaagaauuauccaguccuaaaagccaauaguacuaagggugagaaaccccguccuguaggcucaaauucaagcuuuuuuuuuuuuuuuuuuuuuuuuaacggaguuucacucuugucucucaggcuggaguucaauggcgcauucucagcucacugcaaccucugcccagguucaagauucuccugccucagccucccaggaagcugagauuacaggcgcccaccaccauguccagcuaauuuuuuuuuuuuuuuuuuuuuuuuaguagagauaggguuucaccauguuggccagguguagucucgaacuccugaucucaggugauucagaugauucgcccaccucggccuucuaaagugcugggauuacaggcaugagccacugugccuggccucgaauucaaacuuuauaaaucaacccuaucuucuucaguuaauccccgcucauucauccuguaucuuuuagugacaccaaaagacuuacaguuuucagaaacuucuagcucccagguguuuggacucccuccccauccccagcucccucggccaccuccguuacuuuggguuuuuuggguuuuguuugguugguugguggugguuuuuuuuuucuuuuuuguuuuguuuuguuuugagacggacucuugcucugucacccaggcuggagugcaguggcgcaaucucggcucacugcaagcuccgccucccagguucacgccauucuccugccucagccucccaaguagcugggacuacaggcgcccaccaccacaccuggcuaauuuuuuguauuuuuaguagagacgggguuucacuguguuaaccaggauggucucgaucuccugaccucgugauccgccugccuuggccgcccaaaaugcugggaugggugcccucaugaugucuuuaacuugugugucccccgccauccucccaccagcuuucuuugcacacuguuucucaugauggacccauuuccuuucucccugacagaccccucugugccccuggauccaaucucagugucuaacucaucaucccagauuauucugaaguggaaaccacccuccgaccccaauggcaacaucacccacuaccugguuuucugggagaggcaggcggaagacagugagcuguucgagcuggauuauugccucaaaggugagugcaggcagcugugcuaggaucggugggguuugcacacgugugucugaugcacuuugcuucaccucuagggaagcagcuaucucuuccugugucucagugucggaaggcacacacacacacacuccauucuaucucauaugaaaacacacauacauguuuuuaucuauuuauuuauuuauuuuauuuuuuauuuauuuacuuuuuugagauggaguuucacucuuguugcccaggcuggagugcaaugacgcgaccuuggcucaucgcaaccuccaccucucggguucaagugauucuccugcaucagccucccgaguagcugggauuacaggcacgcgccaccacgcccggcuaauuugguauuuuuaguagggacgggguuucuccauguuggucagccuggucucaaacucccgaccucaggugaccucaggugauccacccaccuuggccucccaaagugcugggauuacaggcaugagccaccacacccggccuauuuuuuuuuuuuuuuugagacagggucuuacucuguugcccaggcuggagugcaguggcaugaucucugcucacugcaaccuccaccucccaggcucaagcaauccucuugccucagccucaugaguugcuggaacaccacaauugucugcaggugugcaccagcaugcccagguaauuuuuuuuuuuuuuuuuuuuuuugagacagggucucacucugucacccaggcuggagugcaguggcaugaucucggcucauugcaacuucugccucccaggcgcaagcgauucuccugccucaggcuccugaguagcugggacuacaggcgccugccaccacacccggcuaauuuuuguauuuuuaguagagaugggguuucaccauguuggccaggcuggucuugaacuccugaccucaaaugauccacccgccucggccucccaaagugcugugauuacaggcaugagccaccacgccuggcccuggcuaauuuuuaaacuucuuuuuguagagauggagucuccuuauauugcccaggcuggucucaaacuccuggcuucaagcaauucaccccccucagccucccaaagcgcugggauuacaggcgugagccacuaugaccggcucauacauacacauuuuuaaacaucguaacacaagcacgcacugaagacuugugucaaaaccagauuuuucccaugucuuggcaccauuucccucugggauuuucuccucuugucucuccuucuuucucccucccugccuuccuuguucucuucaucccuccucacacugauggggaugcagcuguguuaacccacgcaagacuucugugcaaagcuagaaacacaacuaaugguuauugacaaagucagggaaggauuuuggccccacugagauccuuuaguuguaaggaucgaaggcagcaagaauugguuaucucauaucccccaccccauacuuucaauuaaaaaugucugccaggcuuggcgcucaugccuguaaucccagcacauugggaggccaaggugggaggaucacuggaggccgggaguuugagaccagccugggcaacauagcaagaucccaucucuaaaaaaauuuaaaaaaauggugguguacaccuguagucccaguuacuugggaggcccaggcgggaggaucucuugagcccaggaguucaagucugcagugagcuaugauuauuccagugcacuccagccugggugacagagcgagacccugucucuauauauauaaaaaaaauuauacaaaauuaaaaaaaaaaggcauuaagugcauucacaauguugugcaaucauuuuauuguauaaaaauuauaaauaaaauuuauaaauaauuauauaaauaauuuuauuauaaaacuuaaugacaaauuuuucuuaaucuuguuuacuuaauagaccuccauccaucugaaggaaaauggaauaauauuuaaagucucaaacuaguguguauacauuaguuuaaaauuauuauuauuauuauuuucuuuuuuuuuuuuuuugacacggagucucacuccgucacccaggcuggagugcaguggcuugaucuuggcucacugcaaccuccgccugcuggguucaagcgauucuugugccuuagccuccugaauagcugggauuacaggugcugccacuacaccggcuaauuuuuguauuuuuaguagagacgggguuucaccauguuggccaggguggucuugaauuccugaccucaaaugauccacccgucucagccucccaaagugcugggauuacaggcgugagccaccgcgcccagccuaaaauuauuuuaacauuggguuuuuuuagaacccaccaaacuggagaagcaucugucacuuuuuucuuuuucuuuuucuucuucuuuuuuaagauggggucucacucuguuguccaggcuggagugcaguggcacaaucauagcucacugcaggcuugaacuccugggcucaaacgaucuucccgccucagccuccugaguagcuggacuacacaggacuacaggccugagacacuauaccuggcuaauuauuuaaaauaauuuuuuaggccgggcacaguggcucaugccuguaaucccagcacuuugggaggccgaggcggguggaucaccaggggucaggaguuugagaccacccuggccaauauggcaaaaccccgucucuacucaaaauacaaaaauuagccaggcgugggccuguaaucccagcuacucaggaggcugaggcagaagaaucgcuugaacccgggagguggagguugcaaugagccgagcuugcaccauugcacuccagccuggguaacaaaagcaaaacuccaucuaagaaaaauaauaauaauaaaaauaauaauaauuuuuuagagguggggaucuugauauguugcccaggguggucucgaacuccugaccacaagcgauccuccugccucagccucccaaagugcugguauuacagaccugagccacugcgcugggcccauuuccuucuuuaguuuugguuuccuugugcaucuugauguauuuuucuugagauauuuucuguuagugauauccucgguccaugacccuggaggagaaggccagggggccacuggcgagguguggcugaggccaggagcucaacauuugcucuuggcucuggcccugaccugcugaagggcuuuggcuaaguucccaagcaagucaccgucugccuccuuuuugggagaaggggcgggaggacagaugaucucugggagcugucccagcucuaagcucauaugcuauauguaugugugugacaucauccccgccugagccgaggguugcaaacgugauuuaucugcucugaugcuuuauauaacuccagggcgaguccagucaucagcuccgcuguaagcuguuggcccugcauucaaguaaccagaaccacccgugagagcugccaccaguaaugucacucgaagcuuccuuuuuuuuuuuuuuaauuccgaaagucuaaaucuguaauuaccaagggaccauuuaaacaugguuuuauuuguaauugucacaaaguuaauaucauuaaaaggaaacucacuaaggacaaauucugugugauuucacuccuaggaggucccuagaguccucagauucauagagacagaaaguagaauggggagugccagggacugcggaggggacggguugaggacagaguuucaguuugggaagaugagaaaguuccggagaugaugguggugaugauugcacaacauugugaaugcacuuaauaccacagaacugcacacuuaaaaugguugagauuuaccgggcacaguggcucacgccuguaaucccagcacacugggaggccgaggugggguggaucacuuugaggccaggaguucgagaccagccugggcaacauggugaaaccccgucucuacuaaaaauacaaaaauuaguugggugugguggugggugccuguaaucccagcuacucaggaggcugaggcaggagaaucgcuugaaucugggaggcagagguugcagugagccgagaucacgccauugcacuccagccuggcaacagagcaagacuccaccaaaaacaaaacaaaacaaaaauugagaugguaaauugguauauuuuaugugaugcuuauuuuuccacaauuucaaacacacacacacacaaauaaauaagcuuacaaacccuuccuguuaauaucacuaguguauauguuguuaccacgguaaaauauacaucacauacaauuuauuauuauaaccauguuuaagagcacaguugagcugcauuaagugcauugccgugguugugcggccauuaccaccaucaucuccagaacuuucucaucuucucaaacugaaacucuguccccaugaaacacucacuccccuucuccuucccccagccccagcacccaccauccuccuuucugucucugugaaucugauucuagagacuucauuaugcucauuuuucuuuucuuuucuuuuuauuuuuuugagacggagucucgcucugucacccaggcuggaguucaguggcgugaucucggcucacugcaagcuccgccucccggguucacgccauucuccugcgucagccucccgaguagcugggacuacaggcgcccgccaccacgcccggcuaauuuuuuguauuuuuuaguagagacgggguuucaccauguuagccaggauggucucgaucuccugaccucgugaucugcccaccuuggccucccaacgugcugggauuacaggcgugagucaccgcgccuggcccauuaugcuucauuuuucuaaucucaggaaaaccacaguguaccauguuucaugcaguggauucuaggaagagguagcagguaucaggaaugauaccugugccugaacaaauaucccuuccucuccaaauaauaauaauaauaauaauaauaauaauaauaauaauaauaauaccaggagcuucccuuauucaggcaguucuacauuuuuuuuuccaucuguaaugcuguaacuagcucccaucagaguuaacccaggcaggguauucuaugucuauuuauaaacuuaagaaguauuuuccagucucucauaggcuuuuaaagcuguguaaauacuuggguuuccgaguggauacucaccauucacaggaagguacuugauacacgauuuagagcuuauugucuauccucgaggcauuaaggggaggagagaaaauggaauuuccuuugcucagcagucaccaggcaccaagcagaguggcagcaggggagguggcucuccagggacuguugcagauuuugcuuguaaagagcuguguccguccaucucaguggcuguaccagaggcauaacugugcuugcaccgugggucacaagaacccugggauuugacuucggggcuuaagacaugaccagcugcgguacuuaaguauuguaggcugggugcgauggcucaugccuguaaucccagcacuuugggaggccaaggcgggcagaucguucgagcucaggaguuugagaucagccuggccaacacagcaaaacucugucucuaccaaaaaaaaaaaaaaaaaauacaaaaaucggcugggcgcaguggcucacgccuguaaucccagcacuuugggaggccaaggcggguggaucaccugaggucgggagaucaagaccagccuggccaacauggcaaaaccccgucucuaauaaaaauacaaaaaaaaugccaggcgcaguggcucaagccuauaaucccagcacuuugggaggcugaggcggguggaccaccugaggucaggaguucagaccagccuggccaacauggccaaaccccgucucuacuaaaaauacaaaauuagccgggcaugguggugcacgccuguagucccagcuacuugggaggcugaggcaggagaauggcgugaacccgggaggcagagcuugcagugagccgagauagcgccacugcaguccggccugggcaacaagagcgagacuccaucccaaaaaaacaaaaacaaaaaacaaacaaacaaacaaaaaauuagccaggugugauggugcaugccuguaaucccaguuacggggaguggagcugagacaggagaaucgcuugaacccaggaggcagagguugcagugagccaagauugcgccacugcacugcagccugggcgacagagcaagaccccaucucaaaaaaaaaaaaaaaaaaaaaaaagagagaaauaguauuguauuuuguauuuuuaggacugcuaccuuuauaagcuacugguguucuucuucauuuauuaauuuuuaaauucccuuuucuaugcauguuugaaaaguuccuuccucuaucuccucucaugccuuuaggucaggguuucucugucuugguguuuuuucugucuggcguuggaucauucucuggggugggacugucccgagcacuucagggugcucagcagcaucucuggucuucacccauuccaugcuccaggaggacgccccagccagguccugacaccuaaaaauaucuccagauguugcccaaugucccuaguaggagacaaaaucacccccugggugagaaccauucacugaucaagucugauuucuggacucaugaauggaccccuuagaauuccauguggaggcccaguguggugacccaggccuguaauuccagcacuuugggaggccgaggugggcagaucacaugaggucaggaguuccagaccagccuggccaacaugaugaaacucugucucugcuaaaaauacaaaacauuagccagggugguggcaggcgccuguaaucccagcuacuugagaggcugaggcaggagacucacuugaauccaggaggcggaggcugcagugagccaagaucacgccacugcacuccagccugggcgacagagcaagacugucucaaaaaaaaaaaaaaaaaaaaaaaaaaaagaauuccauauggcauucuacucugcccucccaucuuauuugugugguugauuaauugauugauugauauuuucaugcagcugugaccuggcuccuucuccuccuccuucuucuccuucuucuuucuuuuucuucuucuucaacaugauuucacucuguugcccaggcuggagugcaguggccccaucucagcucacugcagccucgacuucccaggcucaagcaauccuccuaccucagccuccugaguagcugggauuacaggcgcacaccaccaugccuggcuaauuuuuguauuuuuugguagagacggaguuucaucuuguuggccaggcuuaucuugaacuccugggcucaagugauccuucccccucagccucccaaaguucugguauuacaggcaagagccacuguaccuggcccccuuuaucuuuuucuaacccccucccaccauucucucucucacccccuuccagcuauauugguuuccagagauuuuuuuuuuuuuuuuugagagauggaaugcuuccucugucacccaggcuggagugcaguggcgcaaucuuggcucaaugcaaccuccgccuuccagguucaagugauucuccugccucagccucccaaguagcugggacuacaggcaugugccaccacgugcagcugauuuuuggauuuuuuaguagagacagcguuucacuauauguuggccaggcuggucucgaacuccugaccucaagugauccuccugccucggcuucccaaagugcugggauuacaggagagggccaccacgccuggccagacguuuuuuaaugugccaagaaaauuccuguccuggggccuuucugcuggguuucugcuaugucugaauugcuuuacaccacgauauguggauggugcuuuccuuugcugaauucaggaugucucaguggugacuuucuuugagaccccuucaugaaaauggcacccgcagacacccacuguucuuuuaccccaacaucugaccugugacuguguauuuaugaguuuauuguagacuguaaguccacugaagacagaagcauugucugguuaccuuauaaucuucaguccugugauuauggugucgggcaguuguugccuuuuuuugagacagagucucgcuguugucgccuaggcuggagugcaauggcucaaucucggcucacugcaaccucugcuucccggguucaaacaauccuccugccucagccuccugaguagcugggauuacaggcacccaccaccacgcccggcuaacuuuuguauuuugaguagagacgggguuucgccauguuggcuaggaugguccggaccuccugaccucaggugaucugcccgccucggccucccaaagugcugggauuacaggagugagccaccgcgcccagccaccuggcaguuucuauuagguuggugcaaaaguaauugugggccgggugcaguggcucacgccuguaaucccagcacuuugggaggccaaggcgggcagaucacgaggucaggagaucgagaccauccuggcuaacacaaugaaaccccaucucuacuaaaaauacaacaaauuagccgggcguggcagcggccgccuguagucccagcuacucaggaggcugaggcaggagaaugccaugaacccaagcgguggagcuugcagugagccaagaucgcgccacugcacuccagccuggguaacagaacgagacuccaucucaaaaaaaaaaaaaaaaaaaaguaauugugguuuuuugccauuacuuuuaauagcaaaagcugcaauuacuuaugcacuaaacuaauaaaacauguugacaugcacuucucagaugacacucuagauacagauauuuuauuuauuuauuuauuauuuuuuugagacggagucucgcucugucacccaggcuggagugcaguggugccaucucagcucacugcaaccuccaccucccagguucaagcgauucuccugccucgaccuccugaguagcugggauuacaggcaugcgccacuacaccuggcuaauuuuuguauuuuuaguaaagacgggguuucaccauguuggccaggcuggucucgaacuccugaccucagguggucugccuaccucagccucccaaagugcugggauuacaggugugagcugccuggccuauuuuuauugguuauuuuacuuuauuuuuaguagagacaggguuucaccacauugcccaggcuggucuugaacuccugggcucacgugauccucacaccucggccuccgaaagugccaggauuaagggugugagccacugugcucggcuauauuuuuaaucuuuugagacaggguucuacucugucacccaggcugaaguguaggggugcaaucauagcucacugcagccucgaacuccugggcucaagcgauccucucaccugagccucccaaguagcugggaccacaggcgugaaccauagugucuggcuuuuuuccaaagcggagcucaaaucuaggcucugucucagcucagccucucugagaaggcccccuucacuguguguguguguggugcguguguggugugugugugguguguggcgugggugugguggugugugugauuugugugguguguggugugugugaaguguguaugugguguguguguggugcguguaugguguguguggggugugugguguguggucugugguguguggcguggguguguguggugugugugugauuuguguggugugugugcggugugugguguggugugugaggugugcauguaguguguguguggugcguguaugguguguguguggugcguguguguggugugugguguguguggugugugugugguuguguguuugugguguguguaugugugguguguuguguggugugugugguguguggugugugugugugguuguguguuugugguguguguaugugugguguguugugugaugugugugguguguguguguggggggguguguggugugugugugugugguguguguguguggugugugugugugugggguguguguguguguguauguguguucagccgcagagacuugagccccccuuuucuguuucuuucuccagggcugaagcugcccucgaggaccuggucuccaccauucgagucugaagauucucagaagcacaaccagagugaguaugaggauucggccggcgaaugcugcuccuguccaaagacagacucucagauccugaaggagcuggaggaguccucguuuaggaagacguuugaggauuaccugcacaacgugguuuucguccccaggucaggacuuggcgcugggcucucuuagugggugccaauuggcuugguguugguggaaggucauuacuuagggaccgagagguagugggacccagagacggcagaaggguggguggagucugaauggagcccuuuccuggguggaggaagagaucuugcaguuucgaaauuucgaggggaauuuuaucaggaagagcaaauaaucgcacaaaaggggaaaaauggacaaaacucagcauuugccuuucuuaccucuccugagcuggucuccacgugaguuccaaaacaaacuccguuagacgauuaacauuuuuuuuuuucucucucucucuuuuuuuuuuuuuuuugacagagucucacucuaucguccaggcuggagugcgguggugcgauuucagcucacccuuuccggguucgagugauucuugugccucagccucccaaguagcugggacuacaggugcgcagcaccacgcccagcuaauuuuuauauuuuuaguagagacgggguuuugccauguuggcuaggcuggucucuaaccccugaccucaggugaucugccugccucggccucccagagugcugggauuauaggugugagccaccgugccuggccgugauuauugaggcuuuagcugagcgcagugguguaagccuguggucccagcuaguugggaagccgaggugguaggguugcuugaggccagccugggcaacauaaugagaccccaucgcuaccaaaaaaaaaaaaaaacaguuuaaaaauuagucaggcaugguaaugcaugucugaacuccuagcccauggggaggcugagaaagaaggaucacaagaggccaggagauggaggcuacgauaagcgaugauggcgccacugcgcuccagccugggugacagagugagacccugucucuaaaaaaaaauuaaaaguaucuguucagauguuuaccaaugcuauucauccgagcagacuuuucucccagaaccaccaguguguaagaauccucuuuuuuuuuuuucuuuucuuuuucuuuuuuuguugcauguuuccccuaugacccugaguccaaaagaauguucagggggacagccaaggcuucaaagugguuacuguuucaccuguuacaaacaaaauguuggcuaggcacaguggcucacucguguaaucccagcacuuugggaggccgaagugggagaaucaguugaggccaaagguggagaccagccugagcaacagagugagacccuaucucuacuaaaaaaggaaaaaaaaaaaaaaaauagccagacauguuggugcaugccuuguagucccagcuacuccggaggcugaggcgggagaauugcuggagcacaggaguuggaggcugcugugagcuaugauggcaccauugcacuccagccugggcaacagagcaagacccugucucaaaaaggaaggaagggaaaaaaagaaagaaagaaaggaauggagggagggagggaaagaggaaggaaggaagagagaaagaaaaagaaagaaagaaagaaagaaagaaagaaagaaagaaagaaagaaagagaaagaaagaaaggaaagagagaaagaaaggacagagaaaggaagggggcaagggagggagagaggagggaaggaaggaaggaaaaaaggaaaagaaagaaaagaaagagaaagaaaaugaaaaaaagaaggaaggaaagagaaagaaagcaaaugaaggaaggaaagagggaaaaagagagaaagaaaguaaaagaggaaagaaggaaggaaggagagagagggagagagaaaagagaaagagaaaagaaaaggagaaagaggaaagaaaccagaaagagagagagaaagaagaaagaagggaaagaaaagaaaaauucugccagacuuggagaaguggcugagucaguugugauguccacauguagucacguuugacaucccagggccaccucagcaggccgucucuggggagaauuuucucugauuucuuccccuucccuugcuggaccccugcaccugcuggggaagauguagcucacuccgucuagcaagugaugggagcgagugguccagggucaaagccagggugcccuuacucggacacauguggccuccaagugucagagcccaguggucugucuaaugaaguucccucuguccucaaaggcguugguuuuguuuccacagaaaaaccucuucaggcacuggugccgaggacccuagguaugacucaccugugcgaccccuggugccugcuccgcgcagggccggcggcgugccaggcagaugccucggagaacccagggguuucuguggcuuuuugcaugcggcgggcagcugugcuggagagcagaugcuucaccaauucagaaauccaaugccuucacucugaaaugaaaucugggcaugaauguggggagaaaccuucacuaacacacucuugcuaaaacauagaaucaugggagugcuuccuggguacccccucccugccuucuguuugcagccacuguuugcucacuaaacaucucugcaccucccgcgugcauuugcagagguggguggggguccccggagucugagcuccccgcggcugggugccccgacccagcagcuccuacaccaugaauggagguugaucuggaaacagaauauuuucaugaaagggcgacaggguaugaacaaaagaacaccgugucgcucacugaauuccacggaggagagucagggaucucuuccuuccuuccuuccuuccuuccuuccuuccuuccuuccuuccuuccuucuuucuuuuuuuccuucuuucuuucuuuccuucuuucuuuucuuuucuuuauucccucccucucucccuccguccgucccucccucccuuccuucuuuccuucuucuuuuuuuuuuggauggaauuucacucuuguugcccaggcuagagugcaguggugcgaucucggcucuccacaaccuccaccucccggguucaagcaauucuccugccucagccuccugaguagcugggauuacaggcaugcgccaccacgcccggcuaauuuuuguacuuuuaguagagacaggguuucuccauguuggucaggcuggucucgaucucccgaccucaggcgauccgcccgccucggccucccaaagugcuggaauuacaggcgugagccaccgccccuggccagggacguuucuuuucaacuugagucuuaagagaaugaagcaguaugguccugggagagagaaaaagcuuggagaacuugggagaaaggcaaggagauguuuaccugucguggcuuuugggaggaacaggaggugagacuaaagaggcaaguugggaccacuuggagagauuuucuuccuuuagcagaguguuuauuuauuuauuuuuucccaggcaccuguguggccugaucugcccucuaguggccauuugcaauacuaacuguagccaagaagggucuaaaaauguacgggcuugguccaaagcagaucucaaucucaguccugcuauuaauaauauucggguggcucacgccuguaaucccagcacuuugggaggccgaggcgggcggaucaugagaucagaagaucgagaccauccuggcuaacacggugaaaccccgucacuacuaaaaauacaagaaauuagcugggcguggugacgcagcuaccccaggcggggcaaucacuugaggccaggaguucgagaccagccugaccaagauggugaaaccccguuacuacaagaaacauaaaaauuagccgggcguggugacacacgccuguagucccagcuacucgggaggcugaggcaggagaauggcgugaaccugggacgcggagcuugcagugagccaagaucgugccacugcacuccagccugggccacagagcgagacuccgucucaaaaaaaauaaaaauaaaauaauauuuggggccacagcuggacuugguagcucacgccuguaaucccaacacuuugagaggcccaggcggggcaaucacuugaggccaggaguucgagaccagccugaccaagauggugaaaccccguuacuacaagaaauauaaaaauuagccgggcauggugacacacgccuguagucccagcuacuugggaggccgaggcaggagaaucacuugauuucuggaggcggagguugcggugagccgagaucucgccacugcauuccagccugggugacagagcgagacucugucucaaaaaaaaaaaaaaaaaagaauaaauacauaauacuaauaauaauaauaaauaauauuuggggucagauuauucuagggcacuguccaacaacacugagaagcaucccuggcuuccacucaucugaugccaguagugugucuucccccuaaaguaguaauaaccaaaaauaucuucagacauugcuaaauaucccccugggugauggggucagaaggacccuugguugagaugaccagguuagugugggauugcuggauaauaaaaugcugccuaggccaggugcuguggcucaugccugaugccuguaaucccagcacuuugggaggcccaggcaggcagaucaccugaggucaagaguuugaaaccagccugggcaacauggcgaaaccccgucucuacuaaaaauacaaaaauuagccgggcaugaugaugcacgccuguaaucccagcuacuugggaggcugaggcaggagaaucgcuugaacccagaaauuggaaguuacagugagccaagaucacaccacugcacuccagccugggcaacagagcaagacucugucucaaaaaaaaaaaucaguugaugcuuugucuuuugccacuucauggucuuuuugguuauaaucuuuuugguauauaaacucauuuggccuguuugaugagcccauuuuacaucucugguuguugagauaccaauuucucaguaguuacucaugaagcaccaacgucuugguuauuuucacgagacccauuugugccuguauagaaauuaucugaaucuugcuaauacggacauaucuuuggcuugauaagugguggagcuguuuucuuuuccauucuacaauguuguuagucuuuuaauacaaaaagaccauaaagagaaucuuaagaaaugcccccaaaguaggauuuguuuucugaccacacauuuucugaugacgcugcaauagaaacuaaaaguuaauuucaaaagauuaaacagaaaacuucacuucuuggugguuaaaaguuaaacacuuacaggcugggcgcagugacucacaccuguaaucgcagcacuuugggaggcccaggcaggcggaucaccugaggucaggaguuugagaccagccuggccaauauggugaaaccccuucucuacuaaaaauacaaaaauuagccagaugugguaacgugcgccuguagucccagcuacucaggagacugaggcagaagaaucacuugaaccugggagguggagguugcagugagccgagaucacgccacugcccuccagccugggcaacagagcgagacucugucuaaaaaaaaaaaaaguuaaaaaguuaaacacuuacauaucuaucgggccaaagcagaaauggaaacuuccauugaaguccuuuuggaaaauaaugaaaaugugaauaucacauaccuuaacuuguagaauauugucaaagcuuggcuuugauguuacuuagcagacuuaaauggauugauaaauuaagaaauaaacuuuaaacuauaaaacuauaaauguguuaggaagggaaaagcaauaacagcuaagccuaugguaaacauaaucaaagggaaaacacaaaccagaaggaaagaagaugacauaaaacuagcgucugaagaaaauuuuaauguguuaaguucuuuggacaauggugcacuugcuaaauuugaaaguuucaguaaggugggaaaauuuaacuugucuaaauggauucaaaaagaagcagaaaaauuaagugguuaugaaccuuggaaaaagauaugugucaaauaauuuccucaaaaaagucccuuggcccagagaguuuuauagacacguucuuucaaauugugagagagcaacuauuuccuauaauagaaaaacuauuuuagggcacagaaaucuauaaaaguuaucccaguucauuuuaugaaaugaacauaacacccuuaaagaacuugacaaagagguugagcaugguggcucaugccuguaaucccaguacuuugggaggcugagguggggggcggaucacaaggucaagagauugagaacauucuggucaacauggugaaacacugucucuacuaacaauacaaaaauuagccagacaugguggcacacgccuguaaucccagcuacuugggaggcugagccaggagaaucgcuugaaccugggaggcagagguugcagugaaccgagguugcgccauugcacacuccagccuggcaacagagcaaaacucugucucaaaaaaaaaaaaaaaaaaaaaagaacuugacaaagauacugcacugaacaaaagccacaggccaagcuaauaugugauguuagauucaaaugucccaaauaaaacacugcacuggcaauauuguuuaucuccaaaaugcaaggaugguuuaagaucagaagauuugauaacaucaucuaguucaucaagaggugcaauaaggaagaucauaucuguuucaauaaccuuaauuuaaaauuccuaacuuagagaaaggggaggaaaaaaagaggcuucauaaaacucauaauagaauauuucuucuacaagauaaauauuaccuagguuaaaccaacagccaagcuaacaucauucuuaaaauuauucuuagcagaguuaggaacaaaacaaggaagccccaucucaucauuacuaauuaacauuucucugggcauccagccaauguaauaagacaagaaacagaaaucagaguuguaaagaauggaaugugggaaauaaagucauugcuauuugcagagcgucuagcucaaggguaggcaaacuauggcccaugggcuagcugccuguuuuuguaaaugaacucuuauuggaaugcaaccccacccacuuguuuacacaucauguagggcugcuuuaagcuacaaugacagaguaguugugacagaggucauuuggcuugcaaaacccaaaauauuuauuaucuagcccuuuacgggaaaauuuuguugaccccucuucuagugugucauugaaaacccaggaaagccaauuaugaaacuuuuuaaaugaguuagaguuugggaaaguagguacauagaaauaagcaaaaagacuguagauacacaagcaauaauuagaauauaaaauaagggaaaagaucccuuucaaaauugccguaaaaccuuagcacaacucauaauaaccccaucuagaaugacuuauaaaggaacacguuuuaaaguguuacugauauauuaaauuguacaaauaaacaugaaagccuguuucaaaucauuuaaagaaagcuuacuggcaaauggaaaagaguaaguuguauagcacgauacauaaaagguuaauauccuuaaugaauaaacaacacaggaguaaggaaaacacaagaaauucauggaaaaacagacaaaagacaaggaggggacaauucuuuggagaaucacagagaaccaauaaaggaaaaaugaagucacacucaguaauauaaagauccgcaaauaacguagucgagugauagcauauuuuuaaucucuuggguuaaagaucuagacaaacaaacauagaaagaaaaaaaaaaacuauuaaggcuuagggguugcugagauuguccuggaaugcagucucauggccugcuggugcaaccacaagucaauauagaguuucuggacaaccauuuagcuguagguauuaagaagcuuaaagaguuucuuaucucccugaaccuaguaauauuuuccucuaggaaucuacuuuggggaaguaauaagacaaucagacaaugaucaaaggaauauuuauaacagcaaaaaaaaaaaaaaagagccaugugcgguggcucaugccuguaauccuggcacuuugggaggcugaggugggcagaucaccugaggucaggaguuugagaccagccuggccaacauggcgaaacuccgucucuacuaaaaauacaaaaauuagcugggcaugguggcggacuccuguaaucccagcuacucaggaggcugaggcaggagaaucgcaugaacucaggaggcggagguugcagugagccaagaucacgccgucgcacuccagccugggcgacaagagugaaacucugucucaaaauaaauaaauaaauaaggaggaugguuaagugagugacgacucacguagcaaauggaauauuuuacagucauucaucguuuuccaaguuuucugcagggaacacaugcuacuuuuguagaugauggaggaaaacccuaauauuaaaaaggaaaagucccaaaauucucuccuaaaauguuauguugaaaggaaaauauuuaguaaaugcuuccaauauaauaaguagacaaaguuuacuuauaaaacaggcuugauccucaucauguucacacauaauauuuacagggaaaaaauuguccaaaggaagcagugggcuguggauuuaugagugauuuauauuuucuuuucuuuuuuuuuuuuuugagacagagucucacucugucgcccaggcuggagugcagugacacgaucucagcucacugcaaccuccgccucccggguucaagcaauucucuugccucagccuccugaguagcugggauuaaagcugugcaccaucaggcucggcuaauuuuuguauuuuuaguagagacgggguuuccccauguuggccagacuggucuugaacuccuaaccucagguuaucugcccgccuuggccucccaaaguacugggauuauaggcaugagccaccucgcccagccuacauuuucuucuuuauccuuuuuucuuuguauuuuaaaauuuguuagcuaucaaccuuuguuguuuaauaugucuucuuaagggauggggagaagugugccaauugcauagauguuucuuggaguuaaucuuccugaccugagugaugugauuccuuuucuaagaauugcagcuuaaucacucaaauuauacaggugcccuaagcagcaauaagaaggaaaagauguauuuuuuccuauuuaaacugaugaugucgaucaguagcuugggccaaugagcaaaugccauuuggcagggcuuccugaaaagcuagacucuuacgugcuuuuggugucuuauuuuugucacugacccuggcuggccuauuuaucugcaaaaugaaaaaccugaaaucgagcaugucgaggggaauaucggugugugucuaccauugacggucuuagaagcacucaucccucacgaggugggccugcucuaauccuucagaugcucacaaggguauauugaaagcugcucugaguggucauuccuggcagucuguauuguaauccauguuccccauugcugcacccuccugcgcucugaucuuucuucuuaaucaagccuuuuauucuccagugucacuuuuuuaaaaaaaaugauggugauggugucaucauacauguccuacugucguuccaggccaucucggaaacgcaggucccuuggcgauguugggaaugugacgguggccgugcccacgguggcagcuuuccccaacacuuccucgaccagcgugcccacgaguccggaggagcacaggccuuuugagaagguggugaacaaggagucgcuggucaucuccggcuugcgacacuucacgggcuaucgcaucgagcugcaggcuugcaaccaggacaccccugaggaacggugcaguguggcagccuacgucagugcgaggaccaugccugaagguagggcugcugcuccgggguccgagugucaugggugggacaucaaggcugaccaaggacagauucuccacccucuaagcagugcauaucuguauuuuaccuuauuggccuucauuuuuguuugagacggagccuugcucugucgcccaggcuggaguacaguggugcgaccucagcucacuccagccucugccaccuaugucaagugauucccugcuucagccucccaaguagcugggacuacaggugucugccaccacgcccagcuaauuuuuguauuuuuaguagagaugggguuucaccauauugcccaggcuggucuugaacuccugggcucaagugauccacccacaucggccucucaaagugcugggauuacaggcaugagcaccgaaccuggccuuuuuuuuuuuuuuuuuuuuuuuugagaugaagucuugcucugucgcccaggcuggaguacaauggcgcaaucuuggcucacugcaaucuccgccucccugguucaagcaauucuccugccucagccuccugaguagcugggacuacaugcgugugccaccacaccuguauuuucaguagagaugguuccaccauguugcccaggcuggucuccaaugccugagcucaagugguccgccaaccuugagcucccaaagugcugggauuacaggcaugagccaccaugccaggucauauuuuaaaauuaugagucauaggcaaucauuauguaaacuuuagaaaauacaccacugcacucccgccugggugacagagcaagacucugucucaaaaaaaaaaaaaaguuauacgcagaaaguaacccauuuaaucuuccuaacaaucuugugggaugaguuuuagauguccguucucugacgaggaaaauggguugugggaaaaugacgucaccagcccaagguugcaccauggacagguggcagaagugggaucucauccaagaguuacaucccugccucucacuuccucuccuuacagccaaggcugaugacauuguuggcccugugacgcaugaaaucuuugagaacaacgucguccacuugauguggcaggagccgaaggagcccaauggucugaucgugcuguaugaagugaguuaucggcgauauggugaugagguaaggcccuugacucuugggcaugccccugcacacuucagcaugccccuucagaguugcacuugguaccuccuuccucugcugaaauuuugauuccagugcuucucucaucagguacugugcuauuaguacuuaaagccuugauaccugacuucgcaggaagaugggucagaaaugccaaucuaccagcuuguuacuuuucuuaguuucucacauugcuuuccagcuguguccucuaaguugaaugaugucugccucccaccacaacaggagacucauuucacuuuagaaggaguuauuugagucuuaaaaccuuauaaauugcuggguacaguggcucacaccuguaauccaagcacuuugggaggccgaggcaggcagaucacuugaggccaggaguuugagaccagccuggccaacauggugaaaccccaucucuacaaaaauacaaaaauuagccaggcgugguggugggugccuguaaucccagcuacucaggaggccaaggugggaagcugaggcaggagaaucacuugaagccaggagguggagguugcagugagcagagauugcaccauugcgcuccagccugggugacagagugagacucugucucaaaaacagcaacaacaaaaaccuuauaaguuacuuucauuagaugcuuccauugagccagacaccaugcaaggugcugggugagugcagagaugcacaagacauagaauccaagacaaauaacccaaaagaacccaaacaguugcuaagcucuucccagggcucacuguaugucccaaacacauucagcacguuacacagaguaucucauugaucacauuuuauuaccucuaggaaauuuugagaggccccauuauuuuuauggacagcuaggcaaaaaaaaaaaaagggccguuaauucuaauuuuauuuuuuucguagaauauagauccugaguacuguuaaguguuuguaaaaugcauugcuuguaagaugcauuccaauuucagaaaugccaaaaugcaaaaauaauauaccucuugggacugaggaaguacaauacguccucacauuaucccagugagcuggguacugaggcuuccagaguuuaaguugcugcacaaaaccuggaagaauagaaucaugauccaaaugcaugacugauauuucaauccagaaacugccaaauuuuuuuuaccauaaaggucuggauaguaaacauguuugacuccguggccagaugauuucuguuacaacuacucaauuccaccauucuacugagaaagcugccaugggugauauguaaaugaauggaugugguuguguaccaauaaaacuuuauuuacaaaaacacgugguggaccagguuuaguuggugggccagaguuugccaacaacuaacagagauuacagcaaaaugucugauuuccuggaacuuugagagggaguccuccuauaaccagguggaccucccucuaccccuccugggaccacaucuacucuuggcaaccaaagauuuuggcuuugacaauaauuuacaauugagaucuaauucuaaauuauuguggcuugugggccaaaucuggcuugcagagcauuguaaagaaugugcaacaggguugaggucaggaguucaagaccagccuggccaacauggcgaaacuccgucucugcuaaaaauacagaaauuagcuggacguaauggugggcgccuauaaucccagcugcuccucgggaugcugaagcagggagaauugcuugaacccgggacgcaaagguugcagugagccaagaucgugccacugcacuccagccugggcgacagaacaagacucugucucaaaaaaaaaaaaaaaaaaaagaauacgcaacagagacuauauguggcccuucacagcuucacagaaaaaguaaacuuucaaaaauagaaaguguccuuacugaacuugucauucugggccuauuuuggggcccuguuugcuaaaugaauggcuugauuugccuuuuuuaacauucauuuuuaaaauaaaauugcuaaaugaauggcuugauuugccuuuuuuaauauucauuuuuaaaauaaaauuccuuaucauacagagcucagcuaguuuuuaauuggcagaaacgugcauaugccucuaauccauauucaugaguuacuuuccucugccuuuugaugucucuguccacaauagccuuuggaauuaugauuuguaguugcuagauagaauuuaaucucaugauugggguaucauuuauuuuuggggauuuggauugccucugguuuuuaccauguuagguaauacuaauuuuaucuggaaaccauuuuagcuuuuuggauugacagcuuuaguuauuguuucagucaguucuugcugcguaacaaacugcccccaaagguacugguuuaaaacaaaggacauuuauucuuucucucaauucugcagguucacugggugauuccuuuguccugggccaguuuggcuggggcuggauggccucauucacauggcuggggccucagcugggggcacuuggagcuuuguccucauguguucucucacugcccagugagcuagcccaggcaaggaaggacaugccccauauacaaacacuucuuaggacucuguuugcaucacauuugcuagugucccuuuggcaaagugagcccauggcuaagcccagaaugaggaaguacaauacauccucugaguaucucagugagcuggauacugaggcuuccagagucucauagacacagaaagucaugauucccugggggccauaauugcaaaguuuauuaauauauuauccuauauguauuaauccuguagguccuaaggaaauaauucaaauuuggggcagggaacaaagcucuaugcauaagauuuucaucaguagcaaaauaugcaaaccacuaagauguccauccauuggagaauggacacauggaagacggugcauccauagaauugguggaugaagagccauugaaaaugauguuugggggccaagcaugguggcucaugccuguaauuccagugacucaggaagcugaggugggaggauugcuugaggccaggaguuugagccugggcaacacagccagaccccaucucugcaaaaaaaaaauuucaaaauuagcuaggugugguggucuaugccuguagucccaucuacuugggaggcugaggagagaauugcuugagcucaggagcuccagguuauagugggcugugacucacucacuacacugcagacugggugacagagcaagaagacucugucuccaaaaaaauaagauaaaauguuugggaugaccuuuguucaguguaauguagaaguuaaaauuacaugcucuggaguuuaguucguuuguguuguuaucccccagcaguuaagaaucccccuguaucugcugggugcaguggcucacgccuguaaucccagcacuuugggaggcugaggcggguggaucaugaggucaggagaucgagaccauccuggcuaacacggugaaaccccgucucuacuaaaaauacaaaaaaauuagccgggcaugguggcgggcgccuguagucccaacuacuugggaggcugaggcaggagaauggcgugaacccaggagguggagcuugcagugagccgagaucacgccacugcacuccagccugggcgacagagugagacuccaucucaaaaaaaaaaaaaaagaaaaagaaaaaagaagaaaaaggaaucccccuguauccagacuagcuuaugauagaggaaaagcuucuuagcucccagaguugaacaacugaagagcuucucacauggcuggauccaggauuccuuugggucgguugcaucuuuuuuuuuuuuuuuuuuuuuuuuuugagauggagucucacucacucugucauccugucauccgggcuggagugcaguggugcagucucagcucacugcaaccucugccucccuguuuaagcgauucuccugccucagccuccugaguagcugggauuacaggcacccacgaccacacccagcuaauauuuguauuuuuaauggagacgagguuucaccauguuggccuggcuggucucgagcucuuaaccucagguaauccacccaccuuggcaucccaaagugcugggauuacaggcgugagccaccaugccuagccugggucaguugcaucuuaacggcuccuggcagugagcccaguagccccugguuguccaccggugguuguagugguuccaaaccucauuucuuugcagugccaaacccagaggaagacagagugcaucccagcauucccagcuagacugaggucaugugacauccagugcccaaucaugugaccagaggaaugcuguaugcugauuggcuugggcaugagggauuuuuuuuuuuuuuuuaauuuagaaacagcuuuauugagcuguaacuuacauaccauaauauucacucccaccacaugcuagagagaauuuuguaaauggaguaaaauuacacuccaacaguauaaauugugcacauaaaaauaaaguuuuaggccaggagcaguggcucacgccuguaauccuaguaccuucagaggccaugguggguggaucaccugaggucaggguucaagaccagccuggccagcauggugaaacuucguaucuacuaaaaauacaaaaauuagccgggcgugguggugcacgccuguaaucccaacuacucgggaggcuaagacaagagaaucacuugaacccgggaggcagagguugcagugauuccgagaucacaccacugcacuccagccugggugacagagugagacaccaucucaauauauauauauauauauauguaaauaaauaaauaaaguuuuacaucacuuuuuuucuugaucaaagcaaugcuagguaauuaaggacauuguuggcaauaacagaaaugugucuaugaaaagguucuuaagaaggugacuguaaccucacauucuccuuucauuuucucccccaucucugcuucucucuagggugaacacaguuggucugggugggauugggguugugcuguguggggcagaggcuguuggggauucgugaugggaauuccuaauagugacccuugggucccaggaacaggagacacgggccagucaaaggcaugggaagaagcuaggagaaguuaggauucgaguuaaauccagugccaacagggugaccaguugucuagguuuagccaggacugagggcucccugggaugugagauuuucaauguccacacucagaaaguucugggcaaauggggacaaguuggacacagaagcagaaaaaaaaucaaggagggucugcaguggaaacgggcauuguucacucugcagaaucuguauucuugcugucaacaaugccccgaacuuccucuggaaucugcuccucacccuugaguggcucucaccucccacucucaaccccagccugguaccagggcaaaacacaaaacucagccccaaauuagccaugacaaaaaugcaaaucaagaccacgaugcaauaccacuucaugcccacgagcguggcaaaaaacaaacagacggacaauaacaagugucggugaggaugaggagaaaucggaacccucauacauugcuggugggaacauaaaauggcacagcugcuuuaggaaagaguuuggcauuucuuucauucuuucuuuuuuuuuuuugagauggagucuaucucuguagcccaggcuacggugcauugguacgaucuuggcucacugcaaccuccgcuuccuggguucaagugauucuccucccucagccucuugaguaucugggacuacaggaacccacgaccucgcccggcuaauuuuugucuuuuaguagagacgagguuucaccauguuggucaggcuggucucaaacuccugaccucgugaucugcccgccucggccuuccaaagugcugggauuauaggcgugaaccaccgugcccagcugguggaagguauuuuuuuuuucuuuugcuaguuucauaaacaaagccaccucuagcuauuuaauugcauuuucaguaucucccguuaaaaaaauuuuuuuuuucagagacagagucauggugugucacccaggcccgccauccgccaccaugcccagauaauuuuuuuuuuuuuuucaaacagagucuugcuuuguugcccaggcuggagucucgcuuuguggcacacgccuauaaucccaguuacucaggaggcugaggcaggagaaucgcuugaacucgggaggcggaggucgcagugagccaagaucaugccacugcacuccagccugggugacaagagcgaaacuccgucuccaaaaaaaaaaaaaaaaaaaaaaaaaaagaagaugcauuuccccuuuguccuggauagcagcuaccuuggguuucuauauuugcuuauuugucccucucuacucggugacucauuccacuuggaagaaacuuuggacuggaguucccugcccccaccccugccaccagacugauuuguuuucuugcuguuauugucacacgauaagcaugggguuguuggcuuuuuuuuuuuuuuuuuuuuuaacauuucuuucucuucuccacucuccaccccccuccuaaauguuccagcccgguucucugcaugcacuauuagcuuggaacugugucgaaaacuuuucagaguuuugggcucgaugcuugcagguuucauggucuuauucccaagagccuccugucucuucucauaaguucuggaauuaucucuaguuacgugcuuaucacaggguauguuucccacuuugcaaaucuccauuuggguggaucccaacuguuuuauuuauuuauuuauuauuuuauuuuauguguuuauuuuugaggcaaaguauaccacauuuucuuuuucuuuuugagacagucuugcucuguugcccaggcuggagugcagugucacgaucucgacucacuacaaacucugccucccggguucaagugauucuccugccucagccucucgaguagcugggauuacaggcgcacaccaccacaacuggcuaauuuuuguauuuuuaguggagacgggguuucaccauguuggcaaggauggucucaaucucuugaccucgugaucugcccgccuuggccccugaaagugcuggaauuacaggcaugagccaccgugcccgggcuucaacuguuuuuauaaugauuaaaaaaaaaaaaaucgaaaggcagcaccguggcaaagaaagagcuuuuuuauuuguccuuagacauuaagcacauuuauccauuugguucugaugugacagaggcugggaguugcagggaaaggcaggaaaucuggcauaggcccugcagauccuucauuuccacucuuuucuaauuuugcuggauacauggcaaaaauauucugcaguggucuuaaggagaaguucuagagccagacaguucucuuuuuuuaguuucuuucuuuuuauuuauuuauuuuuuuugagauggagucuugcucugucacccaggcuggacuuaaguggcgcgaucucggcucacuacaagcuccgccucccggguucacgccauucuccugccucagccucccaaguagcuguagagccagacaguucugaguucaagagcuggcccugccacuuugcagcuaugagaucucggacaaaccauauaaucucuuaaaccaggggucagucaguaagcuauaucccauaggcuaaauguggccugcugccugauuucuaaugauuugugagcuaggagucacuuuugcauuuuauuuauuuauguauuuauuuuugagauggagucuugcucugucacccaggcuggagugcaguggcacaaucuuggcucacugcaaccuccaccuccuggguucaaguaauucuccugucucacccuccaaguagcugggauuacaggcgugugccgccaugcccagcuaauuuuuguauuuuggguagagguggggguuucaccaucuugaccaggcuggucucgaacuccugaccucaggugauccgcccaccucggccucccaaaguauugggauuacaggcaugagccaccacgcccugcccacuuuugcauuuuaaaaugauuaaaggaaaaacaaggagagacgugaaccaaagggugcaaaguuucagaugggaggaauacguucuaggaauccacugcucuguagaugaauggugacuauagcuaauaacacauauugcaaaauggcuagaagaauagauuuuaaauguucucacaacaaagaaauaaguacaugaagugaugaggauuuaauuagcuuguuuuaaucauuccacaauuuauacuguaacauaacuuuacacuguaccccauacguguacacaacuauuauuuuuauuuuuguuuauuuauuuuagagacagggucuagcucugucacccaggcuggaguacgguggagccuucauagcucacugcacccuugaccuccugggcucaagugauucuuccgccuuagccuccugaguagcugggacuacaggugcgaaccaucgugcccggcuaauuguucuauuuucuguggaaauggggucuggcuauguugcccagguuggucucuaacuccugggcuccagcaauccucccuucacggccucccauagggcugggauuacaggcacgagccacugugccugaccuauaauacuguugucaauuaaaaauaaaacaaaugauuuuuagaaagauaauauuauggaaauuaauauuaauagaaaauagauaauagggcugggagcuguggcucacgccuguaaucucagcacuuugggaggccgaggugggcggaucacuugaggucaggaguuugagaccagccuggccaacaugguaaaacccugucuuuacugaaaauacaaaauuaggcaggcgcgguggugagcgccuguaaucccagcuacucgggaggcugaggcaggagaaucacuugaacccgggaggcagagguugcagugagccgagauuaagccauugcgcuccagccugggcaacaagagugaaacuccgucuggaaaaaaaaaaaaaaggaaaagaaaagaaaccaucaggguuuaaugcucagcuucuggcuuaggaagucuggcucuuaccgauaaugauaaccucugcauauaucuuuauccauagcacuaugguuauaaaauucugcaauucucaaagucgcuuaugugucuuagucugugcuuugcugccuuggcgucauuucugagcaggauccuggcugugagcucccugcgagggguggacacucccagaugugcaaagcucagccacccuccuucuccuccucucuuccucccaggagcugcaucucugcgucucccgcaagcacuucgcucuggaacggggcugcaggcugcgugggcugucaccggggaacuacagcgugcgaauccgggccaccucccuugcgggcaacggcucuuggacggaacccaccuauuucuacgugacagacuauuguaagucuccauggcagccucagcugacuggggcugugcuuagcacugagcauggugggacauugcaggggaugacuuggagaggccgcaggugcuggcccuggccuugacucucaggccuaucagcugcugcggugcuugcccucuuugauccugcacuuuuuuuuuuuuugagauggaggcuugcuuuggagugcacuggcacaaucucagcucacuguagccuccgccucccggguucaagugauucucccaccucagccucacaguagcugggacuacaggugcccaccaccacgcccggcuaauucuuguauuuuuaguagagauggcauuucaccauguuggccaggcuggucucaaacuccugaccucaagugauccacccgccucggccucccaaagugcuggaauuacaggcaugagccaccaugccuggccugauccugcacuuaaaaaaaaaaaaaaaaguuucagagguaccugugcaguucauuauauaaguaaauuguggcugggcacgguggcucacaccuguaaucccagcacuuugggaggccgaggcgggcagaucacaaggucaggagaucgagaccauccuggccaacauggugaaaccccaucucuacuaaaaauacaaaaauaaauuagccaggcaugguggcgggcgccuguagucccagcuacucaggaggcugaggcaggagccucaggaacccgggaagcagagcuugcagugaaccgagaucgugccacugcacuccagccugggcaacacagugagacucugucucaaaaaauaaaauaaaauaaguaaauuggguguuguuggggguuugcuguacagauaauuuugucacccauguaaucagcauaguaccugauaggucguuuuuugauccuuucccucuucucacccaccacucucaaguaggcaccuguguuagucuguacuuacacugcaauaaagaaauaccuggccgggcacaguggcucacaccuguaaucccagcacuuugggaggccgaggugggcggaucacuugaggucaggaguucgagaccagccugaccaacauggugaaaccccaucucuacccaaaaauacaaaaauuagcugggcauaguggugugcacccgcagucccagcuacucaggaggcugaggcaggagaaucacuugaacccgggaggcggagguugcagugagccgacaucacgccacugcacuccagccugggugacagagugagacucugucucaaaaaauaaaaaagaaagaaagagugaaagagagagagaagaaaaagaaaaagaaagaaaaggaaagaaagagagaaaaagagagauaaaagaaagaaaaagaaagaagagaagagagagaggaagaggaagaggucugagacugggacucaguaauuuauaaagaaaagagguuuaauuggcucccaguucugcaggcaguacaggaaccaugaugcuggcaucugcucagcuucugaggaagccucaagaaacuuucaaucaugguggaaggugaagugggagcaagguguuaagacggggagauggugcuacacacuucuuaaacaaccagaucccaugagaacccacuuauuauacaguacccaguagggauguugcuaacccauuagaaaccgccuccaugauccaaucaccucccacccggccacuccuccaacauuggggauuacauuucaacaagagcuuuggguggggacacagauccaaaccauagcagucccggugucuacuguucacuucuuucuguccauguguggucagugucucacucucacuuaugggugagaacaugagguaguugguuuucugucccuguguuaauucaguuaggauaaucaccuccagcuccauucauguugcugcaaagaacaugaucucauucuuuuucauggcuguguaguauuccaugguguguauguaucacauuuucuuuaucuggcaauccugcacuuccucaucuguacauggagauaauaacagaaccacuucaggagguggagggacauuuuaaugacacaaauguuaagugccuggcaccuguugcuagugucuccaucuuuguuacuagaguuuuuuggcuagaugagguggcucacaccuguaaucccagaacuuugggaggcugaggcaacaggauugcuugaggacaggcauuagagaccagccugagcaacauagcgagacucugucuccacaaaaaaauacaaaaauuagccagcuaugguggugcaugcuuguaaucccagguacuugggaggcugagacagggggaucacuugggcccaggaauuugagguugcggugaacugugauugugccacuguacuccagccugggugacagaguaagacccugucucuaaaaaauaaaaauuaaaagaaguuuacaucugucaaaagucaugcugggaucgggacuagcuauguaauuugcaagacccagugaacaaugaaaaugcagaacuccuugcuuuaaaauuauuaagaauuuggccgggcacguuggcucacgccugucaucccaguacuuucggaggcugaggcgggaggaucaccugaggucaggaguuugaggccagccuggccagcaaggugaaacccugucucuauuaaaaauacaaaaauuagccgggugugguggugcaugccuguagucccagcuacuugggaggcugaggcaggagaaucacuugaacccgaaaggaggagguuccagugagccgagaucgugccacugaacucuagccugggugucagagcaagacucugucacaaaaauaaguaaauaaauaaaaauuaaaauaaaaugaauaagcauuucagaggggcaacagcagagcauuaaacugacagaaaaggguccugcauccacugccugagaugugggagggauggaaaugagcagugauuuggggcagggguggggaagagugugcuuccagaauacugaccucugagcccacugccuggucccacugcaccuacgggacuguuucgggacugcuggaaaaucaggauguggaagagcagcagagagguuuauggacaagggagggaaggaacaggguggcccacccauuccaggaguggaugugauuuuugaugugaacuuuguuggaaacacauugauaugaaacauauauuuucuuauucuauuucaguagacgucccgucaaauauugcaaaaauuaucaucggcccccucaucuuugucuuucucuucaguguugugauuggaaguauuuaucuauuccugagaaagaggugaguucagugaguucaguggugugcugggaacaguugguucucugggggaaaacaugccuugauauagguauaggcauauuuaaguuuauuaugaauuuugcugauauaggauguguaacaugcaauuuacagauaauugucauaauaugauauacacaacucuuuauuguaaauucccucuagacaguugauucucacagaauguuuuuauugauuuuuuuuuuugcccaaaccuuuauauccgaagcuaaccuauuauugcaauugauaaacaaguaaagcuccaaugugaauguugauuaauuuuucaaaauuuacauuaaggaguaggacuugacugggcacaguggcucacaccuguaaugcuagcacuuugggaggccaaggcgggugaaucaccugaggucaggaguuugagaccagccuggccaacauggugaaaccucgucucuacuaaaaauacuaaaaaauuaaccgggcaugguggugggcgccuguaaucccagcuacucaggaggcugaggcaggagaauuacugaacccugguggcggagguugcagugagcugaaaucgcaccauugcauucuagccugggcgacagagggagacuccgucucgggaaaaaaaaaaaaaguaggacaaaacugaaauaagacauauauguucaucagugauaugagugacgucuuugcugagucagaugguaauuuuuaaauaucagaagaacauuuugugccacaugcaacaucacaguugcagacaugacacgcuuuuaaguuuaaucuacaugauuaaacauuuuucucagcugggcacgguggcucacaccuguaaucccaacacuuugggaggccgaggcgggcggaucaugaggucaggaguucgagaccagccugaccaacauggugaaaccccgucucuacuaaaaauacaaaaauuagcaagguguggugaugugcgccuguaaucccagcuucucaggaggcugaggcaggagaaucgcuugaacccaggaggcagagguugcagugagccgagaucgcaccauugcacuccagccugggcaacagagugagacuuugucucaaaaacaaaacaaaacaaaaaaauauuuuucucaucacuuucucaagccuggacaaacaacagaacaacaaauccaguccugaguuauagcauuugccaguuucuguaauguaaauauucccaggaugucuaaauucaagcuguagacauaauauuacugagugcaguguuagaaagagauacauaauagcuccccauugaauccacccuauggauacaauaugguguauaaaugauauaauguaaauaaccucaacugcauugaucauauuuaaauguaguaugagaguuaggaagugaugaguuuugaacauguauugucuuugcuuuuaggauaauuuauuuaauuguaagccucuauaauuuauauuuuuuguucuauuuggaaggcauuguacaauuuaaucuuuaaugaugcuuguauuuaacaacuggcucacuaguuuccugaaaauuuaauaauuguuucucaucagucgggaugagcucgcucuagaacaguacugggugaguggcuuuuaaguguuacauggauggccauaaauuauuuaaaaagccagccagagcccugcauggucgugcauaucuguagucccagccgcucgggaggaugaggcaggaggaucacuugagaccaagaguucaagaccagccugggcaacauagugagacccugucuauaugaaauuuuacaaauuagccaggugugguggugagcaccuguauucccagcuauucagaaagcugaagugggaggaucucuggagcccagaagguuaagacugcagugagcuaugauuauaccacugcccuccagccacaacagagcaagacugcaacucugaaauguaaaaacaaaaacaaaaacaaaacaaaaaaaaaaccacccagggagggaugagugcucccauguugaugcacuuacauaccugucugaugggcuuccauucaaaacauaaaggucccccaucccugcccuagacugcaucuaggauuauggggauucugcugguaagggcugccauuugccuuggggagucuuguaugaaacaccuuucugcagagucccaugagaaucucaagcuaacgugccucguuuuccuccuccaggcagccagaugggccgcugggaccgcuuuacgcuucuucaaacccugaguaucucagugccagugauggugaguaccaucccuucccuguggguggccagaacccuacucaucagcuuccuuugccuucaccauugagugagagugaaggauggguuccccagggaggccaagaaaagcccucuuauucauuugagcuugccaaacugcccuugcugcagaaaccucauuacugugugcaucuggacacaugguauuuggcaccugccugaaugggcucaucuagccggucugggacccuugggcagggucgaccacuugggcugggcucagcugggcaguucuucuggucuugccuggcuucacccauguagcuacauuuugcuggugugucagcuagcacucgguagucuuagaugauuucacucacaugucugguggucaguaggcuggguggucccaaggugggggcccuaagcugggggaggcugagccucacucuguccaucuagccucuuaggcuccagcaggcuggcucaggcuucauuccaugguccucuguugguuccuaguagaaagcuccagggcaagcuccagggcaacaguccauuccaaaucucugcuuggacaauucuuguugauucccauugaccaaaauaacucacaaggccaugcccagggccaagggguggugagauagacuccaccuuuucaugggaagagcuccaaguauccuggcuuuuuuuuuccccaaccuauuacaaccugucuuccauccccuuggcacuuugcagaaacaguagucucaggugggaaguagcaucauuccauagcaagggucugaaaucagacaagaaggauggggaugcagguuugccucaggacauauuggccaggaucuuggaccaguuguggcuccuuccuugagucucugccaugcccucuccaugggugcagaugccuguccuguucucggccauaugcccagugcccggcauggguccuggaucacagaacucauuucaugaguguuuucgaggggguuugggugagggcuuggguggaagguggcugcagacccccaagggauccuccaaggaugcuguguagauaaguaagaaguaguguuuccaugcucuguguacgugccggacgagugggaggugucucgagagaagaucacccuccuucgagagcuggggcagggcuccuucggcaugguguaugagggcaaugccagggacaucaucaagggugaggcagagacccgcguggcggugaagacggucaacgagucagccagucuccgagagcggauugaguuccucaaugaggccucggucaugaagggcuucaccugccaucacguggugaguccagugggggugggacaugggcuggcuuuccugacccuucccuuucucugccuccuccuccugcacagagcgacagaggacacaggguguaaccuccuacccaccccucacuccacuaagcuucccauccuagaggugugaggagggaucauucccuucucaaaucccauccucucccacuucgccuggaaccagacucuaucacugucucaucacuuucuggaauguuucauugcuuuccagaaucuuucaucacuuucuggaaucuuccaucauuuucuggaaucuuccaccacuuuccggaaucuuccaucauuuuccacaaucuuccauugcuuuuuagacucuuccauuucuugcuuuuuccuggcaccuuuguaacccaggaccacauagagguccaccugauaccaccugcccucguuccuacucuccuuugaaggcagcaccaacucuuccugccuuucugcuccuuuguuccucuuugaguccuaugugcuuucauccuugccacacauauuuauggggcauuuaaagcccugcucuugucccugugauacaguggauaccugccccuguagagcuuccaaaacagcaggcggagacagacuccaaaaccuuuauuuuuauuuuauuucauauauauauauauauauauauauauauauauauauauauauauauauauuuuuuuuuuuuuuuuuuuuuuuuuuuuuuuuuuuuuuuuuuuuuuuuccugaaacggagucucgcuuuguugugcaggcuggagugcaguggcacaaucucagcucacugcaagcuccaccuccuggauucacacuauucuccugccucagccucccgaguagcugggacuacaggcgccugcuaccacgccuggcugauuguuuuuuuuuuuuuuuuuugagauggagucucacucugucacccaggcuggagugcaguggcaugaucucagcucacugcaaccucugccugcuggauucaagcaauuauccugccucagccucccgaguagcugggacugcaggugccugccaccacgcccagcuaaugcuuuuuauacuuuuuuuuauuagagacgggguuucaccaugcuggccaggcuggucuugaacuccugaccucgugauccacccgccuuggccucccaaagugcugggauuacaggcgugagccaccacgcccagugccuggcuaauuuuuuuguauuuucaguagagacgggguuucacuguguuagccaggauggucucgaucuccugaccucaugauccgccugccuuggccucccaaagugcugggauuacaggcgugagccaccacgcccagccuauuuuuauauauuuuuaagacagagucucucucugucgcccagaguggagugcaguggcacaaucucggcucacugcaaccucugccucccagguucaagcaauucuccugccgcggccuccugaguagcugggauaacaggagcccaccaccacacccagcuaauuuuuguauuuuuaguagagaugggguuucgccauguuggccaggcuggucucgaacuccugaauucaggugauccaccggccucagccucccaaagugcugggauuacaggcauaagccaccacccccagcugacuccaaacccuuuauacauuaggagcaaaugcuauggaaacaugaagaaagggaggaaaggaggguuggacagggguguauuugagcaaagacuuagaggacaugaggagcugggcccuguggauguggcagggaacagagagccaggcagagggaaugauuaaaauacaaaggccuggcugggugcaguggcuauaaucccagcacuuugggaggcugaggcaggcggaucaccagaggucaggaguucaagaccagccugaccaacauggagaaauccugucucuacuaaaaauacaaaaauuagccggguguggaggcgggcaccuguaaccccagcuacucgggagacugaggcaggagaauugcuugaacccgggaggcaaagguugcagugagccgagaucacgccacugcacucuagccuggguaacagcaagauuccgucucgaaaauuaaaaaaaaaaaaauacaaaggccuaucugucugcuguccgggcagguaugucugcucuccuagaccagggcugagcacgcugcauccaggccacagggugcugugugugacauagacaccagggagggaggagaacccuggugagucgaaucacggacccuccuccaagaacccugguugcuugcucugcaggugcgccuccugggagugguguccaagggccagcccacgcugguggugauggagcugauggcucacggagaccugaagagcuaccuccguucucugcggccagaggcugagguaagcugcuucgggggacccagcgggguacucgguggagcacccgcuccuggccuccucggaucccagugcugcugaaacaccaaccccguguuucuguuuuagaauaauccuggccgcccucccccuacccuucaagagaugauucagauggcggcagagauugcugacgggauggccuaccugaacgccaagaaguuugugcaucgggaccuggcagcgagaaacugcauggucgcccaugauuuuacugucaaaauuggagguucgucuggcuuucugcuuugaaaacauaacgacccaggccagguuugauuucagaaggaaguugucuauaaugagccguuaagucuuuucugauaauauaaaggggcaagauacuucuuuuuuuuuugugggguuuuuuuuguuuuguuuugucuuuuuguuuuugagacggagucuuacucugucuguugcccaggcuggagugcaguggugugaucucagcucacugcaaccuccaccucccagguucaagugauucaccugccucagccuuccaaguagcugggacuacaggugugcgccaccaugccuggcuaauuuuuguauuuuuaguggagaugggguuucauccauguuggccaggauagucuugaucuccugaccucgugauccuccugccucggccucccaaagugcugggauuacaggcgugagccacugcaccggcuuuuuuuuuuuuucuuuuuucugacauggagucuugcucugucgcccaggcuggagugcagugacaggaucucggcucacugaaccuccaccucuuggguucaagcgauucuccugccucagccuccugaguagcuaggauuacaggcgugcgccaccacacccagcuacuuuuuguauuuuuaguagagacggaguuucacuguguuggccaagauggucucaaacuccugaccucauaugauccaccuguguuggccucccaaagcacugggauuacaggcaugagccacugugccuggcugggcaagauuuuggauggggaccccccaccagcugucauuuaauugcauguauugauaaacucacuuacccauucacuucuuuaaaagauauguuuguaggaccgggggucccgccuguaaucucagugcuuuggaaguccaauguguaaagacugcuugaguccaggaguuugagaccagccugggcaacauagugagacuccaucuccuugaaaagauuuuuuaaaaaguggggugugguggugcacaccuguggucccagcuacucaggaggcuggggugggaggauugcuugagcccaggagguggaggcugcagugagcugugacagcaucacugcacuccagccugggugacagugagacgcuauuucaaaaaacaaauaaaaaaggaauauagaggggaccagagcagcgugagaugugaggaugaggagagaggcagaaaccagacccagaaggaccuugcgugucacagcaagucaucucgacauuaucuuacauuagcaaggggcagcaggaagugauaugauucuauuuaugacucaaaaagacaucuccuggccaggugcgguggcucaccccuguaaucccagcacuuugggaggcugagguggguagauuaccugagaucaggaguucgagaccagccuggucaacacggugaaacccugucucuacucaaaauacaaaacauuagcuagacaugguggcagacagcuguaauccuagcuacucaggaggcugaggcaagagaauugcuugaaucagggagguagagguugcagugagccaagauugcaccacugcacuccagccuggaggacagagugaggcuccauaucaaagaaaaaaaaaaagaaaaauguagcuucuuugugauuugguaccuucuuuucccucccuuuaaacaguagcccaucuucccccuucacuuccccaugcguacccucagaauccauucuuacuggauuuggccaccacccaggugagcgcagacgugggccaggugaaccccucuuagggcucugugagagguggggcagucaagguggcagaugcuaggaccaaggcugaagguuaagagcgugugaaccuuuuguguugucagacuuuggaaugaccagagacaucuaugaaacggauuacuaccggaaagggggcaagggucugcucccuguacgguggauggcaccggagucccugaaggauggggucuucaccacuucuucugacauguggugaguuguguguggauggguggauggacgcugggcuugaauuccaggugcuagugagagccaagagcgggggaaggaagccugccauccuccuggacgccccaucaaggaaaggaaggcagcguccugucuuaggaucuucccacggcuacucuuauguccugacuaauccuguaggcauugugaaccccgaaaaucugagacaggucucaguuaauuuaggaaguuuauuuugccaagguugaggacgugugcccguggcacagccucaggugguccugaggacaggugcccaagguggucagagcacaguuugguuuuauacauuuuagggagacaugagacaucagucaacauauauaagaugaacauugguucggucuggaaagacgagacaacucgaaguggggagggagcuuccagguuguagguagauaagagacaaaugguugcauucuuuugaguuucugaugcgccucuccaaaggagccaaucagauaugcagguaucucagugagcagaguggggacucugaauagaaugggaagcagguuuguccaagcaguuccuagcuggacuuuuuccuugaguuuagugauuugggagccccaaauugauuuuccuuucacagcauuuaugaacugcagcaugaauuguuuuauuaaguggcuaaccauguucuagaaaccaagagauguguuuguguguguguuuguguguguaugugugugcauauguguguuuguguguguuugcaugugugugcguguguguguuuggguguguguguuuguguguguauauguguuuguguguuugcauauuugugugugcaugugugcgcaugcguguuuguguguauuugcaugugugugcacguguaugugcguguguguuugcauguguguguuugcauguauguguuggcauguguguuugcgugugugugugcguuugcguguguguguuugcgcgcgcgcgugugugugugugucuaaauggcuucuuuguuacuacuaucaacugucaucggcagguccuuuggcgugguccuuugggaaaucaccagcuuggcagaacagccuuaccaaggccugucuaaugaacagguguugaaauuugucauggauggaggguaucuggaucaacccgacaacuguccagagagaguguaaguguagaaaggguuuaaggugugugagguguucguugaaaggguauugcccuuuacacgugugcuugguuuugccuuuccuaugucuacacgcucaccguguuugcaugcuguauguuacagguguguuuguguuugcauagcuugucuuuacaugcaugcuugcauuugcauauugcauugugguacacacacuugaguucccauaugugcuacauguacgcuuacguuugcauauuauauauuuacauagguauuuauguuugcauauuauauguuucugugugcaucagcauaucauggcacauguacaccucauuuacauauuauaagcacacauguuuacauauuaugucuuuaccugccugcuuguguucacaaaucauaugauuuucuugcauauuguaucuuuggaagguugcacaaaacaccuauagcgguaguuaucuugggagaagggaacuggagaccugggguugggggagagagaccuguuugccuguuaauuuuuuuuuuuuuuuuuuuuuuuuugagacggaaucuugcucugucacccaggcuggagugcaguggugcgagcucggcugacuucaagcuccgccucccggguucacaccauucucuugccucagccucccgaguagcuaggacuacaggcacccaccaccgcgccuggcuaauuuuuuuuuuuuuuuguauuuuuaguagaaaugggguuucaccguggucucgaucuccugaccucgugauccacccaccuuggcuucccaaagugcugggauuacagccgccuguuaauucuuuauacacuuaaaauuuugucagguagcugggcauggguggcucacgccuguaaucccaagcaauuugggagaccgaggugaacgaucaccuaaggucaggaguucaagaccagccuggccaacauggugaaaccccgccucuauuaaaaauauaaaaauuacccaggcgcggucgugggcgccuguaaucccagcuacucaggaggcugaggcaggagaauugcuugaaucggggaggcagagguugcagugagcagagacugcaccauugcacugcagcaugggugacagagugagauucugucucaaaaacaaacacagacacacaaaaauuuugucaggcauacauauuauauauuccccccuccaaauauauaugcauauguacauauauauauauuuagaugaagucucgcugugucacccaggcugguagagcgcaguggcacaaucacagcucacugcaaccuugaacuccuggacucagccuccuggcucaaccucccaaagugcugggauuacucuugagccaguuuugaaaugaggaaucccuuuucaaaaccaucuuucaggcuggacaggauggcucaugccuggaaccucagcacuuugggagguugaggcaggaggauggcuugagcccaggaguucaaggcugcaaugagcuaugauugcgccacugcacuccauccugggugacaaagugagaaacccugucucaaaaaaaaaaaaaagcggccaggcaugguggcuaacaccuguaaucccagcaccuugggaggccaagguggguggaucauuugagccuaggaguuugaggccagccugggcaacauagcaaaacccugucucugcaaaaaauacaaaaauuagcuaggcaugguggugcacaccuguggucccagcuacuugggaggccaaggugagaggauugcucgagccuaggaggcagaggcugcagugagcuaugaucaugccacugcacuccagccugggugacagaaugagacgcuguguccaaaauaagaagaagaaaagcaaaaagaaaacaccaucucucagcaccucuagcaaugcuauuucugccuugacaauuguccacacacacagccagcaucugaugugagcacaugugguccgugggugucggcugcagggacaagaguggggguuugggaggaugcguggcagggcccccagacucacccaggacguguccuucugccccgcagcacugaccucaugcgcaugugcuggcaauucaaccccaagaugaggccaaccuuccuggagauugucaaccugcucaaggacgaccugcaccccagcuuuccagaggugucguucuuccacagcgaggagaacaaggcucccgagagugaggagcuggagauggaguuugaggacauggagaaugugccccuggaccguuccucgcacugucagagggaggaggcggggggccgggauggaggguccucgcuggguuucaagcggagcuacgaggaacacaucccuuacacacacaugaacggaggcaagaaaaacgggcggauucugaccuugccucgguccaauccuuccuaacagugccuaccguggcgggggcgggcagggguucccauuuucgcuuuccucugguuugaaagccucuggaaaacucaggauucucacgacucuaccauguccaauggaguucagagaucguuccuauacauuucuguucaucuuaagguggacucguuugguuaccaauuuaacuaguccugcagaggauuuaacugugaaccuggagggcaagggguuuccacaguugcugcuccuuuggggcaacgacgguuucaaaccaggauuuuguguuuuuucguuccccccacccgcccccagcagauggaaagaaagcaccuguuuuuacaaauucuuuuuuuuuuuuuuuuuuuuugcuggugucugagcuucaguauaaaagacaaaacuuccuguuuguggaacaaaaguucgaaagaaaaaacaaaacaaaaacacccagcccuguuccaggagaauuucaaguuuuacagguugagcuucaagaugguuuuuuugguuuuuuuuuuuucucucauccaggcugaaggauuuuuuuuuucuuuacaaaaugaguuccucaaauugaccaauagcugcugcuuucauauuuuggauaagggucuguggucccggcgugugcucacguguguaugcacguguguguguccauuagacacggcugaugugugugcaaaguauccaugcggaguugaugcuuugggaauuggcucaugaagguucuucucaagggugcgagcucaucccccucucuccuuccuucuuauugacugggagacugugcucucgacagauucuucuugugucagaagucuagccucagguuucuacccucccuucacauugguggccaagggaggagcauuucauuuggagugauuaugaaucuuuucaagaccaaaccaagcuaggacauuaaaaaaaaaaaaagaaaaagaaagaaaaaacaaaauggaaaaaggaaaaaaaaaaagaacugagaugacagaguuuugagaauauauuuguaccauauuuaauuuuuaaagucucugguauuagccucauaaguuauugacuauuccccgggguuggcggggaguggggacaugaguuggucugccuguuguggggccgggaaggggagggagucaggcacaaguggccucuuuguuuggucuuaaaggcauccauuucugggaaugaagccauguucgcugcuaacacuuuuggauguugugaggccacguggagugugugagagacuagguuuuauggauggucugguucagguaccaggucugcuggaagguuccuguucggauaagcugguagcuaccuagcucugagccugccuucaagaacaccuguguucauccucugauucucuguguguaccucuuguggcguuuccucucccgggugugaacauccuaaccguuauugugcaaacccaagaacgucagaucccaaagcacaacaaccuggauggacuuugggaacaucuaagcaauguaagagagaggugcacugagaguacgucuugguccccuccacccugagagcaucugacgguccucaguacugaacucccggaagcugcucugagcccggugaccucaucugggccagguguggugccugagcugaaugcucaggugcuuacaguguugcaaucccuaagagaguagagucuggaggagaaaccgugaaaaagaccuuacacaccaccaagaacuuccgaaugggcgugaauccaccguuucuucucuuugcaaaaagaaccaccacagcugcucaaagaacacagugaacucaucacuuugguucaucaaaaaaucaucgcccaugcguuauuccugagugcauuuucuuacaacuuuuugacugcuuccuuuucuucuucucuuaagaguugugggcuuaagaaugggauagagucauaauggcaaccuccaagcccucucaauucuugauuaagaacacagguagacaugaaucccaauugucuauugcuaucuuauuuauaugauucgggaaaauacagcauguaaaaauauugcugaggagccucagugauuggguacaagaagcaagaguacagaaauuauuuuugccaaauuuauuuuguaaauaugagggucuguaccuaaauuuaaaaaaaaaacacguagaacuagguauuuuguucucuucuuaguaaauuuguagugguuguauacuacacuagcugcaauuuucacauuuuucuaauucagaaagguuuuucuuauauuaggggaaaaaguauuuauuuuaauauauaaaaucacucugaaaaucacucucauaaaaaauggagcgcauguaaauuuuuaucaaagaaaaauaaacaggugaaugggggauagugauuuucuuuuuucagcacagucuaccucaguguauuguuaagaugugauucaaucauggacaucuuugagauuucagaauucuaccuggaaccggucugaaucagggaacguguguaucagcugauucgaaugccagggaccaguaagaauuuugagggagggaguugggauggagaagguauggccuuuaugcgagcauagauccuuuucuuccuggcugguaauauucuucucugaauuuaaucuuccuuuaaaaaaaaauccuccaucuauugucacuauguuccccaaacauaaacuaaguuccaggcugucaugauguaucugauauaugggguaacccagcaagguguaccuuccuuuggugagagauggcugccggggcaaagacgggcuuugauucagagcaagcauucccaccuguuccauggaaucccccugaagugagcacaaaggugcccugggcucccugaugguuuaugcccacuccuuucaggcuggugaugcaccuuacacacaaacaccuaaugcaaugucuuuuuaaauucuccaagugggaugggagcaugugagggaaauuccaauccaaaacccauuaaugugcugaacgcuuuuuuuuuuuuuuuuuuuuuuuuugcaacaacaccuuggaccucuguguugggguuugacugaccucaagcugauauuauuggaccuugugcagcuuugauaacccaugugagagucuaggcaggaccaguggggcccaaaucuugcugcucuuguacuuuuaggcacugcccuugcagacucaccuuucuccaccugcccuggagaaagguagggugugcugggccugccccuugcaaaugggauucaccaguuucauuuauuugacucuacugccacagugaaaagagcaaacagcuauuggguugcaaaccuccuuugacauuaggaaauguugacuuuguaacaauaaaacuuugguccuagaaagacacgguuguccugggaguuuguaguguuaaguugcaacaacaacaacaaaaagcaacaaaaccagcuuaggauaacacuuuuuguugcuuguucuuaaagaugucucacuaugauuaaaacccuuuucauuaauguagugaaagccacacaggaguuccuucuuccaggaggagaauaccaagcacaucacuuucucucugcaucagugaugucaaauacgcaucagaaaauguucagguuuuaggagcuguccuaggugcuguuucaucauuggaagcagugagaaagagaagcacugcugcuugucuggauauaggcugaggaugauugagagaagcugugggaacugacacaagggucugcauaggucauccugugacccuggggacuauguuaccaacugacagacagaucuuucacuguauccuagcagggcagguaguccaccaagaaaugugcuuauuggauugggagguguuuauuuguagucugcuguaacacgugugaaagagcaggagcgucaucagcauaugacuugcgcuggucauccgguaaauggaugugcuguagucccagugcuaaucauuucucuccuucacaguggguggaaguuuaggguuaaauguccuuugaaugucaccuggugaguccuugacaccuuaggcucuucagaaacaaugguuuuguugaggauggggaacagggaaugccgauuuuauauacaugguacacagagaggggugucacuucagaaaaucuuccagcauguucuucagaauauuaauuuauaugcgaggugagguugggaaugaaaagaacaggucagcacuuuuuuuuuuccuagaacauacaaaagaacaugguggacuuucagggagugcaauggaaggugaauauuuccuuaaggguccccgagaaaugggagugaggggaggggacacaauggcuuuuugagcuuacuuuuaccuucugauacuagucaagguccagaaccagccaccagccaaauuucuaucugggugcgggccacugaaaauccuuguuaaaaaccagaucacaaaucuggggcucuuggucccauuggagaaggaaggaagagccucaaaauaagugugcacccaugcacauauucaggaacagcuuguuuagucuuuacacuuugccugaaaguugcuucuccucgucccuuugugugccuggguggccucggcccugugcguuggcaacgcaggaucaaaugugcugcagcuuuugcagaaaacaacucagaaacacaaaaccccccaacagcucaauuauuauuuuuucaauguuuuccuacaagagccaaguagcaccauguacagaagacgccuuuuuuuuuggaauauugaaaucguucugcauguaaaauaugggauaaugaccuguuuauauuaaaauucugauuaaauuaucugagaaua

SEQ ID NO: 191826 - RNA, 27063 nt, Homo sapiens
gcauccccacccacuaaucccagcgucucugguuacgccucccagcaauggcgccaccaucggucccggagucccagugaugcucugugccauagagcccccauaacuucacuacuacgugauaguaaauccccggcaaaaaccagcagcgccuugcaagcccacgccaccccaagcaucccaggacucuucugaaacguggguaucagacgccuuccgcggaugccccggcaguacucccgugccucccagcuccugggucuuccccggggcaggcuugcgucgggagccgaguaucuaggugcccacucccggaccccacgguuugcgggcccguuuuccugggguggggcauucagucuucgacggaguagggggugcggccuggggggugggguggucaggcuugaucaacccugcagagggcagugacccgggaggaagucaccaggugcagaggaccgugcccuguggggaccugccugcaggcugcugacaguggguaccaggucggccuuuggccccggggugggguuggacaggcgggcgucugguaggcccuacgcguaggcgaagggagcaggaagccggggacccgccucaucuccuggccagggccgagaggucgguuugcuccaucccuuagucccgcagcgccccucuagccucgccccuggcagcuggagacgcuucccccgccaccccagagggcagggcuugagcugggggcagggcuugaggcaggggagaggugggcccagauugacgacuugcacggguuccuucgacuccuugauuucccaggacuccgggcuaccagaucggccguccagcuggaaucaaccgauggaggcuccgcugcaaacuggaaugguaagggguggggcggagaccggguaggugccggcguggggcgccaagaggacuacaacucccggcgugcucagcgcgcauuacguggucuggcgauaacgcgcugcguccgcucgggcggaacuacguuucccggcaugcacugcgggccgccgggccucagggaagagucgcgcccccggggagggagcagcacuggcccauucugcagauggggacaucgagucacgggcuggcuacgaacuccucgggggcgaagguggcggagagggauggguuccaggacguccuggcgcccggggaaggcucggcgggacggauuugcggugcgcagccagugccguucgucccucaggugcuuggcgugaugaucggggccggaguggcggugguggucacggccgugcucauccuccugguggugcggaggcugcgagugccaagugagcacccgaggggccccucuugggaggcuguaugguggggggcccaaaugcccgggucccgaggcggcagagauggggauuugcuggcgucuguucgcgguaccccagcucuggcaggguggagucugcacagagcucggagugccccuguccccaccuauccccagaaaccccagccccggauggcccccgguaucgguuccggaagagggacaaagugcucuucuauggccggaagauuaugcggaaggugaguccgggaccccugggguccgcccugaccacacagaggccgcgccccuucccuauuuacacuucuuaguguccgccaccgcuccuuccuugauggagacccccuggauccgucugccucuucuccaaggucugaauuagcaauucacccaucuccgccuucauucucccaggugucacaauccaccuccucccucguggauaccucugucuccgccaccucccggccacgcaugaggaagaaacugaagaugcucaacauugccaagaaguaaggcugugcugggugugaccugguauuagggguuaucucaggggccuuuugaguaaucagcuuacaccaaaguguuguggaagucuucccauauuggcugcgcgcuguggcucaugccuguaauucccagcacuuugggaggcuaaggcgggcagaucaccugagaucaggaguuugaggccagccuggccaacauggcaaaccucaucuguacuaaaaauacaaaaauuagcugggcgugguggcaugggccuguaaucccagcuacucagaagggugagacaggagaaucacuugaaucugggagguggagguugcagugagcugagaucaugccacugcacuccagccugggcaauagagugagacucugucucaaaaaaaaaaaaaaaaaaaaaaaaaagaagaagaagaagaagaaagucuuccuguuucagagagacaucucuggacucuccucucagagcucuuccacaccagacaugcugucucuaggguaucucuucccugagggcuaccucagugaccuucuccuuccacuggaguaucugagcuauuuguucccaagucaauaucucagaggucuugccauauacuuagugggggggucuacaucagggguuuccauguagguuauuucaugagucucuucacaugagugguuuucuuccaggguaccucacugagguaauuguguuucuacgaucuccuaaaggggcuaucuccagccuccagccucucuucuccggggguuaucucaggcaucucuguacaucagaaggcaucuuuccuauguuauggaccuugaaguucuucccacacuaaggaggcugucucaggaguuucuguucccuaggggcuaucuuaugaauuuucuugcacuagaaauauaggaaggaugcaucagagaucccuguuggcagcaaggucugcgagaaaggcucuccaacucucuuugcaaguugggugcuggcucugggaucccugugcgucauguagucuaccuggaggucugccucaaggguuucuucacaccagggcagggcucuccaugaucaauaguccugcaauggcaguccuuucuuuuuuguuuguuuguuuguuuguuuuugagauggagucuugcucugucacuaggcuagagugcacuggcacgaucucggcucacugcaaccuccaccuccucgguucaaaagauucuccugccucagccucccgaguagcugggacuacaggcucauaccaccaugcccagcuaauuuuugcauuuuuaguagagacgggguuucaccauguuggccaggauggucucgaucucuugaccuugugauccguccgccucggccuccuaaagugcugggauuacaggcaugagcgacugagcccggccaauggcagggcuuucugugaguugaguagaaggacuaucucaaaguuccccaugaucaguugagggucuauaccucagguuucuccacaucacaggagcugucuguaguguuugcacacucuuaagggacuacccugauaucuucaugauugucagagggcugucugagcuuucugugaccuagggaagaguuagcccaagaucucccugaucaaaaaaggaauaaucauaacaauuauaauuauuauuauuauuuuggagacaggaucacacuuuguuguugaggcuagagugcaguggcacaaucacagcucacugcagccuuuaccuccugggcucaagagaucucuccugccucagccucuuaaguagcugagaccaugggcaugcaccaccaugccuggcuaauuuuuaaauuuuuuuguagagaugggagucucacuguguugccugggcuagucuugaacuccuggccucaagcaauccucccaccucggccucccaaagugcugguauuacaggcaugagccaccacgcccagccaaaaaaggaauuauaucugaauuucuugauuucacugaguuuaacucagggucccauccuccaaggucuaucucagggaucuuuugccagcggagggucuuucucagcaaucacugugacuuguggggaagggcucucccagguccacgauuagcagaggggcuaucuggauucuccacuuauaaugagggcuacuucagggaccucuguggcugucagaggggcugucucaagguucucugagacugggaggaaggucuaucucaggaauguuuauguagaacagagagacuguaucugcggucuucucauauauuggaagcuaugucaaaggcauacucacguuaaggggacuaucucaggaaucuacucugugacuacuggaaggaccguuucaggacccccaugauaaacacagguaccauuucugggccuacccuuaucuuggaagcuaugucaggggucugccuuccuaaaggguucagcucaggggccuaugccuaguggaggggccaucucagagaacuuuaggucuggggucauaggguuuuuccauaaagggccagauaguaaauguuucaggcuuugcuggccacauaugguccccauugcaacucuucaacucugcugcaugggagcagccauaaugauaugcaaauacaugaauguggcuuuguaccaauaaaacuuuauuuaccaaaauaaauguggccagccgggugcaguggcucacgccuguaauccuagcacuuugggaggcugaggcgggaggaucacuugaguucaggaguuugagaccagccuggccaacauggggaaaccucaucucuacuaaaaauacaaaaaauuagcugggcgugguggcacccaccuguagucccagcuacuugggaggccgaggcaggagaaucgcuuuagccugggagguggagguugcagugggccgagauuucgccacugcacuccagccuggguaaaagagcgagacuccugaggcagggcacaguggcucacaccuuuaaucccagccuuugggaggccgagucgggcggaucaccugaggucaggaguucgagaccagccugcccaacauggagaaaccccaucucuacuaaaaaugcaaaauuagcugggcgugguggcacaugccuguaaucccagcuacuagggaggcugaggcaggagaaucgcuugaacccuggagguggagguugcagugagccgagaucgcaccauugcacuccagccugggaaacaagagcaaaacuucgucucaaaaaaaaaaaaaaaaaaaaaaagguggccagccugauuuggccagcgggccagaguuugcuguacaugagcccuggggaaagggguaugcgggggucuuagguuugccugagccuucuccgugccccccucacccccggcaccccuccccucccaccaggauccugcgcauccagaaagagacgcccacgcugcagcggaaggagcccccgcccgcagugcuagaagcugaccugaccgagggcgaccuggcuaacucccaucugcccucugaagugcuuuauaugcucaagaacguccggucaguguuggggugcagguggggguggagggcugcagacguggggccgcccugaccuccagccucugucgcccaccgccuguccaacagggugcugggccacuucgagaagccacucuuccuggagcucugccgccacauggucuuccagcggcugggccagggugacuacgucuuccggccgggccagccagaugccagcaucuacguggugcaggacgggcugcuggagcucugucugccagggccugugagugggccuccccaggggcugcugcaggaggaugggugguggggaugggcagcaggcauuggucuguagagcugguggucuuuggagaugcgucaucgggagucaggggaacgggugaccgaggacauuugggguagucugcguaguugcucaguaguuacaaguauugaacgaugggagaugccugcucguuggaaggguugguggguuccccugagaagggaugagaagugucagugaucauugggauggaugagggggcgacaugccagucaccagggcgaggccacugaggguccacggucuccugugucucaggacgggaaggaguguguggugaaggaagugguuccuggggacagcgucaacagccuucucagcauccuggaugucaucaccgugagugaccaguuucugaggcaggggggcuggggugcaaggucccacccaagggacuagguugaaggaaaucacaggguccccaaucucugguucauccguuaugcugccgauggccccucacgggacuggcgccaggaaggauuaggggaguagcgagggggacucgcagccucugcccuugucucucuucacgcccuccccucccccagggucaccagcauccccagcggaccgugucugcccgggcggcccgggacuccacggugcugcgccugccgguggaagcauucuccgcggucuucaccaaguacccggagagcuuggugcgggucgugcaggucagugggccuucgccuccugucacccccugagggaccccacccuggcccccacccauuccaggcuccaagggaccgaggcccagcagccagcaggcgcuggagcugugguuaucggccuggagcagccagaugucugcagccgcggacuccucccuuagcugccucgccccauuuccccagacugugggucucucccugguucccgcccgaccccuuaugcugcgaacuagcccggcccaccaucuggcccugccccuuaccccgccccaucuuauggccacgccccucgagcccugcagaucaucauggugcggcugcagcgagucaccuuccuggcacugcacaacuaccugggucugaccaaugagcucuucagccacgugaguggguggcggggagcgagcacaggggggaugggggcgaggucucccucccaggacaggccacaagcuguucucugcccccaggagauccagccccugcgucuguuccccagccccggccucccaacucgcaccagcccugugcggggcuccaagagaauggucagcaccucagcuacagacgagcccagggagaccccagggcggccacccgaucccaccggggccccgcugccuggaccuacagguacccagggacccgaggccagccgagcccaaucucccaggaagccccgucucagccgccagccccuuuuucaguucugcauagagucaaccugaccuuguccagccccacagggacuccauagcgggguacccaggucugacuccuaucugguaccgaggaagcuguggccucguccccaagggcccauuggaauugcuuuaacuaguuaaucagucgccagcaucuccuuaucucccaaccugcuaauccuccuaguggcucugaggggcaggagccugaacaugugucucccccaggggacccugugaagcccacaucccuggaaacccccucggccccucugcugagccgcugcgucuccaugccaggggacaucucagguuuggagcacugggucugcggggagggccauggagcuuccagguuugaauccagguccaccgccugccugucuugauuguuuuaaucugcgaaaugggaacacugccaguacuuccccaggcacuguuuuguagauauucauugagauagugcuucucccaccuguuaagagggauucagagggagagugcaggcguugauuagucaugucugcuacagcaguggcccauggcacauugguauccauuggucucagacugcaacugugguuacucucaucuuuuucuuuucuuuugagaccugucucccaggcuagagugcaguggugcugucauagcucacugcagccucgaacuccuaugcucaagugauccuccagccccagccucccaaauagcuggaacuacaggccugcaccacuacaccuggcucauuuuuuaaaaaucuuacucucaucuuuaugguuuuuguugccccccugccugccugcaggcuugcaggguggcccccgcuccgacuucgacauggccuaugagcguggccggaucuccgugucccugcaggaagaggccuccggggggucccuggcagcccccgcucggguaaggcuugggacccugcccggugguggagcccgcaggggaagguggcugggagggagcaucaggaggucacaagccugccccacucagacccccacucaggagccucgugagcagccggcaggcgccugugaauacagcuacugugaggaugagucggccacugguggcugcccuuucgggcccuaccagggccgccagaccagcagcaucuucgaggcagcaaagcaggagcuggccaagcugaugcggauugaggugggcagccgaggggagcugggcacagggcgcaagggaggccuggcugcgcccaucucaaccccccuaccuccccaggaccccucccuccugaacagcagagucuugcugcaccacgccaaagcuggcaccaucauugcccgccagggagaccaggugaggcugaccccugaccuguaaccaugccaccugagaucauucccuaugacuucugugaccucugaucccugcccuuugacuguaagaccagcaccuucucccauagaagcagaccucucucauccuaucauuuccaaccucuaacccuuggguccugugacccccacccccuaaccccacccuauguccucuggaccugucaacccuucaccugugaccccugaaccuuuugcccuaggacuccaacuccuagaucucuccugccugcccuggcucuuccuguaauucuguuuucugaacuucugauccugcaguauucacuaacaugucugcuucucaugcugaccgcugccaggauaggggcucaauaaauggcuacaaaucgccaucuggccucggaaggccaugaaccagcccugggucgggguuucagggccuuguggcggcacccaggauguguaggaaaauguauccuaccauucuguccacuguccauauggggaaacugaggcccaucaaggguuagugacccgacuaccagcugaaagucaggaagccucaggguaggaggaggaggaggaagaagaagaggaaaguugaaacccacacucuguccccagaguguggcagaugaucuagaaaguucucugcuuccucaucaguggaaugagguaauaaagaagagaugccuaguucgcagaaccccaguaagacuucuuuuuuuucuuuuuuuuuuuuuuugagacggagucucgcucugucacccaggcuggagugcugcaguggcgugacgguggcucacugcaagcuccgccucccggguucacgccauucuccugccucagccucccgaguagcugggacuacaggcgccugccaccaugcccggcuaauuuuuuguauuuuuacuagagaggggguuucacuguguuagccaggguggucucgaucuccugaccucgugauccgcccgccuaggccuuccaaagugcugggauuacaggcgugagccacugcgcccggccuuuuuuuuuuuguuuugagacagagucuugcuguugucacccaggcuggagugcaguggcacaaucucagcucacugcaaccuccgccuccuggguucaagcaauucuccugccucagccucccgaguagcugggauuacaggguugugccaccacgccuggcuacuuuuuauauuuuuaguagagaugggguuuugccauguuggccagccuugucucaaacuccugaccucaggugauccgccugccucggccucccaaagagcugggauuacaggcaugaaccacugugcccagccuacugagacauuuuugauuguuaggauuucacagggugcuguuccugacaccugauggguagagaucagggaugcucaaauguacagagcagcaggccggaaccauacaguccauuauccacagugugggguuugcaagagugacaaguggucagggaggguguuuagcagcagcuuauagggagcgggggcuugaggugacagugagcugucauaggcacugggaccccagcucugccccaggcuugggggagagaagccuggggcaggguugggguggggugggagcuguggucccacuguuagccggcuggaguguugcugugucacuugacccagugacucugcuguccccuugaaccacccauggcagggaugggcucuuuucuggagaggaagucaaggcuuuugccagcuguucuuagaauagcugaggaaguaagguuacccuguggcuucuuugggggccccugggcccugcuuaucugggagacugcuggccacaacccagcccuggccugucaguguaccacgcuggucugcagccccucagagcuucucugcguuggcaggacuuuuguuagggacccugugcucuccugugcuucuccuugaaacuuuuuuuuuuuuucggagacggagucuugcucugucgcccaggcuggagcgcagcggugcgaucuuggcucacugcaaccucugccucccggauucaagugauucucccaccucagccucccucgaagcugggacuacagucacgugccaccacgccuggcuaauuuuuguaguugcacuagagaugggguuucaccaugucggccaggcuggucucaaacuccuggccucaagugauccacucgccucagccucccaaagugcugggauuacaggcgugauccucggcaccuggccacagucuggaaauucugucuuagaagguuccagcauguguuuauaucuccugggacugugccucacccaggggucccugcaguguuuuggcagguggagcuucacuggguaccagacagguuggugugguggauaaagaaggaaucucuccauuucugggcgguuucaguuccuuauuuauaaagggauggaacaggaagguuucuagcuggucaggcuacccaaagaagaaagaaacguguuuacccagcauuugccccaucucgaacugugugcugcuggcuggacaagaggcaggaaaauggcugggcacgguggcucacgccuguaaucccagcaccuugggaggccgaggugagaggaucacuugaggucaggaguucgagaccauccuggccaacauggugaaaccccauuucuacuaaaaauucaaaaauuagucaggcacgauggcgggcgccucuagucccagcuacucgggagccugaggcaggagaaucacuugaacccaggagacagguugcagugagcugagaucgcaccccugcacuccagccugugcaacagagugagacccugucucaaaaaaaaaaaaaaaaaaaaagugggcagggaaaacccuuaguggucccugcccuugggcagcccaccguauucugagagacaugacucaaaggauuacacaaauucuuguaaaaucauaagugcuuagugucacaaaggaaaugaucuuggcacuacaaagucuggcuuagacaggguggcaccucuaagggcaugaccuaagaaggaaggagggggaggaacaaacugggugcaggugggaggaaaggucauucuaggcagaaggaagagcuugugcaaauguuguguggugggaagaaauagguugaucucuaagaaauaaaaaaggaagucagugggccucaagugaaacaauauuuuuuggggggguguaaugguuuuauugagcuauaauucauguacuauacaauuuacccauuuaaaguauauacuuuaggcugggcacaguggcucacgccuguaaucccagcacuuuggaaggccgcggcgggaggaucucuugaguccaggaguucgagaccagccugggcaucauggcaaaacccagucucuacaaaaaacaaacaaaaaaaauuagccaggcaugguggcgcaugccuguagucccagcuacacgggaagcugaggcaggcauaagccacugcaccuggccaugcccaccuaauuuuuguauuuguaguagagacaggguuucgccauguuggccaggauggucuugaacuccugaccugaggugauccgccugccucacccuccuaaagugcuggaauuacaggcaugagccacugcacccggccuuauguaagggcuucuguguagacauauauuuuauuuauuuuuuuaaagguggggucucacuauguuucccaggcuggucuuaaacuccugggcucaagugauccucccaccuuggccucccaaagugcuuggacauauguuuucauuucucuuggguauauaccuaggaguugaauugcuggguuauaagccaauucaauuuuuuuuuuuuuuaagagggagucucgcuaugucgcccaggcuggagugcaguggcgcgaucucagcucacugcaaccucugccuccuagguucaagcaguucuccugucucagccuccugaguagcugggauuacaggcacacgcugccacgcccagcuaauuuuuguauuuuuaguagaaacacgguuucaccauauuggucaggcuggucuugaacuccugaccucaagugauccauccaccucagcuucccaaagugcugggauuacagaugugagccaccauggccagccucuauuuuuaauuuuuuuaagcacuguguguuuguuuguuucuuugcuagacuguuuuccaaagcagcggcaccauuuuacauuuccacugacaguguaugugaauuccagucucucuacauucucucuaacccuuuguaauucuagccaucuuugugggugugaaguguaguaugucauugugguuuugcuuugcauuucucuaaugacuugacguugaacagcuuuuuaugugccuauuggccauuuguauaucuucuuuggagaaguuuuuauucagaucuuuugcccauuuuacucuuacuuuuuuuagagacgggggucucacuauguugcccaggcuggucuccaacuccugggcugaaacuaucaagcgauccuucugccuuggccucccaaaaugcugggauugcaggcgugagccaccgcacuuggccuuuaauuuauuuuagagacggggucuugcacuguagccuaggcuggaguguagugacgcuaucauagcucacugcaaccucaaacaucuaggcucaagcaauccuccugccucagccuccagaguagccaggacuauagacacaugcuaccaugccuggcuaauuaaaaauuuuuuuuuuuuuuuuuuuuuuuuuuuuuuuuguagagacaggguuucacuauguugcccaggcuggucuugaacuccugggcucaagcgaucuucacaccuaggccucucaaaguucugggauuacaguugugggccaccacacccagccccuucaguauacuuuaaaucagggguguccaaucuuuuggcuucccugggccacauuggaagaauugucuuggaccacacauaaaauacacuaacaguuauagcugggcauaguggcacacaccuguaaucccagcacuuugagaggccaaggcgguuggaucacugaggucaggaguucaagaccagccuggccaacauggugaaaccccgucucuacuaaaaauacaaaaauuagccaggcguguggcaggcaccuuuaaucucagcuacuugggaggcugaggcaggagaaucacuugaacucuggaggcagagguugcagugagccgaguuuguaucacugcacuccagccugggcaacagagcaagacaccgucucaaaaccaacaaaccaaaaaaccccacuaaagauagcugaugagcuaaaagaaaaaaaaucgcaaaaaaaaaaaaaaaaucucauaauguuuuaacaaaguuuaugaauuuguguugggccaaauucgaagccauccugggccacgugcagcccgugggcagcaggguggacaagcuugcuuuaaaucaucucgagauuacuuauaauaccuaauacaauguaaaugcuauguaaauagucauuauacuguauuauuuagggaaaaacggggaaaauagucuguaaauggucugcgcaggugcaauuuuuuuuuccugaauauuuuagauccaagguugguugaauccuggguauauggaacauauauauauauauacacacacauauauauacacacauauauauauagagagagagaugcugcucaucuauauauaaucuauguaaaaaaauuuuucuuuuuuuuuuuuuuuuuuugagacggagucucgcucagucgcccaggcuggagugcaguggcgcgaucucggcucacugcaagcuccuccucccggguucacgccauuuuccugccucagacucccaaguagcugggacuacaggcgcccgccaccacgccuggcuaauuuuuuguacuuuuaguagagacgugguuucaccguguuagccaggauggucucgaucuccugaccucgugauccgccugccucaggccucccaaaguguugggauuacaggcaugagccaucgcgcccggcuaaaaaauauuuuuauauuuauuuauauuuauauauagauggugcuuauauccaaagucuuuauucucuccuucauguuucuuuuuuuucuuuuuuuuuuuuugagacggagucucgcucugucgcccacgcuggagugcaguggcgcgaucuuggcucauugcaagcuccgccucccgguuucacgccauucuccugccucagccucccaaguagcugggacuacaggcgcccgccaccacacccggcuaauuuuuuguauuuucaguagagacgggguuucacuguauuagccaggauggucucgaucuccugaccucuugauccgccugccucggccucccaaaguucugggauuacaggcgugagccaccgcgccuggccuucuucuucuuuuuuuuuuuaaagacagugucucacucugucgcccaggcuggagugcaauggcaugaucucagcucacugcaaccucagccuuccagguucaggcaauucucuugccucagcuuccugaguagcuggaauuacagacaugugccacgacgcccagcuaauuuuuuuauuuuaguagagacagguuucgccacguuggccaggcuggugccgaacuccuggccucaagugauccccccugccuggccucccaaagcgcugggauuacagccgugagccaccgcgcccugcgccuucauauuuuucuuaacccuuccuuucuucuuuaauuuuuuccugugggggcauguugaccugagcugggguccacgcuguccggguucuguguucaucacauccccugcccgcacaggacgugagccugcacuucgugcucuggggcugccugcacguguaccagcgcaugaucgacaaggcggaggacgugugccuguucguagcgcagcccggggaacugguggggcagcuggcggugcucacuggcgaaccucucaucuucacacugcgagcccaacgcgacugcaccuuccugcggaucuccaaguccgacuucuaugaguaugacagcccgaaguuggaguguggguggcacucggaggaccccaacccgugggaguggccagaaccccaucccucaaccucacuccuggaagagcagaagggagcccccagaucuggccucccagcgccgguguaggacgguuuugaggccuuccucuuucaucccaagucuguuccugcaggaucaugcgcgcacagcccaguguggugcugagugcggcgcacacgguggcagccaggaugucgcccuucgugcgccagauggacuucgccaucgacuggacugcaguggaggcgggacgcgcgcuguacaggugcagcucccaccgcgcugcucaggcccggccuagggguggggaccuggggguggucagaccuugcugaccuccacgcccacucaggcagggcgaccgcuccgacugcacuuacaucgugcucaaugggcggcugcguagcgugauccagcgaggcaguggcaagaaggagcuggugggcgaguacggccgcggcgaccucaucggcguggugagcgcgacccccacccacugaccucuggccuuuuccaggccagucccucgacaacucacacacaucaucccggguaauccagggaguggugaaugcagcucccgaccucugaggucacccaguccacuccccgcccagaccucauuucguuggaaaaaggggauuccgccugucguggaucccuguccucucccucuccccagagcucuaauggguagcgagcgaggcuugcuucccuacacccccauugcaggggagcccuagauggggcaguacagcccccuuuccacccaucuucggccuccucauuccccacccaagcagccccaaucaugcacgcggccccccagguggaggcacugacccggcagccgcgagccacgacggugcacgcggugcgcgacacggagcuggccaagcuucccgagggcaccuugggucacaucaaacgccgguacccgcaggugcggccuguugugggcggggcagagaggcggaggcgggacuccgggggggugggggccgggccuagugugugggcggggcuuacagaggggcggggucgagggaggggccgaagcgagagagugagggcgggggcucucgggggugggacccagguaacgggcacccaggagccccggcauaggagggagaggugggaccuggacagccgcuucccaggucucacugaaaugccggccuccaacgcccccaggucgugacccgccuuauccaccuacugagccagaaaauucuagggaauuugcagcagcugcaaggacccuucccaggugagagccggccggcccagagcgugcugggagauguaguccggcguccagagcaugcugggagggaagccuucuuuccugagggaugcugggaaauggaguuccgcgaagaaaucgugccccugaggguuucaaacccuaaguaggacccaggugcagagcauucuggggaauggaguucguguuccugagcaugcugggaaacgaaguccucgaccccuggcgugcuaguuaaugggcucgaaaguaaaucaguggugccggggagggagucuuaggcgguggacuuggcguagucugcccgggagucagggcuugcuggggaaguccacggccuggacguugagagaaagggaguccuagaucagaauaugauggcagggccgucaugguggcucaugccuguaaucucagcacuuugggaggcugaggcaggaggaucgcuugagcccaggagauugaguuugaaaccagccugggcaacauaguaggacccccgucucuacaaaaauuucaaacauuagcugggcuuggugacacaugccuguagucucagccacucaggaggcugaggcgggaggauugauugcuugagcccggaggucgaggcugcagugagccgugaucgugccacuguacuccagccgggaugacagagcuagaaccuguuucagaaaaaauaaaacagcaaacaaacaaaacuccccauaccaugauggaaaauagucuguggauuguuguuuaggacucugggcaccucgccuucugaaguuacagcuugcugggagauguagcccccuguuucagccuguggcuucagugagcuagaacagaauggggcgugcggugggguuggaggccugcugaaaugagggccugaguuucuacauugugguggccagauucugggccagcccagcaaccuagauaccccuuuucccuccagggguucuacccaauuggcccugagcccuagaucccccaaggcgggggcagggcgguaguggcagaaaagacaucauuaagaaauuacagaggccuggggcggugggucacgccuguaaucucagcacuuugugaggcugaggcaggugaaucacuugaggucagggguucgagaccagccuggccaacguggugaaacucaucucuacuaaaaguacaaaaauuagucgggugugguggugggugccuguaaucccagcuacuuggacggcugaggcaggagaaucgcuugaaccggggaggcagagguugcagugagccgagccuacgccauugcacuccagccugggcaaccagagcaaaacuccaucucaaaaaaaaaaaaagaaagaaaaaaaaaaagaaaagaaaaggaaagaaauuacagauagagaauacaauaucuagaagacaaaagagggucaucuugccguguggcugaaagagggagggaggaagggagggagaaagaggcuuuucuaaggacagugagcugagacuugacaacuaagauggggccagacaugaaagagaaaccaggggugcugcacaggaggcuggugguuuugaagcacugaggaggaaagcgaucaaggggagaggugauggggguugggggguaagucacauaggggcuaggggcuguggacaggcacuugagcuuauuuagauuguuauuguuagauuggggaggaaggauuccaccaguaaggaggcaacaagaggucuaggcaagauaugggaguugacagcuggucuaggcuguuaguggagaaacugggaagcaacagcugggucaaaaguagcuuuucuuuucuugucuuugucuuuucuuuuauuuucuuuuuaagacagggucucgcucuguagcccaggcuggagugcaguggcacgaucucggcucacugcaaccucugccucccagguucaagugauucuccugccucagccucccaaguagcugggauuacagguguaugccaccaugccuggcuaauuguuguguauuuuuaguagagcaguguuucuccauguuggcuaggcuaaaaauagcuuuauuucugccucguuuuauguucaggucccccauuagacagaggaaccaaggccagaaugaggcaggggcacuggccaauugaucucccaagcacagugaaucugaaugguuguagaguuguguaauggaucccacugaggugaucagggcccaaaguggaggguagauggccagguuuuaacaaaagagggaauaguaguugaggcugaggguccaggaccagagccauggcuuucuguaugguagagucaagacuuugggcaacugggggcugcagucugggagcacaggagcaagaauuucagauaaggaggaagaggaagaagaggaggaggaggguucaucucucuggacacagguucgcaccacaaaucucauccauuggguucuuagcaggcucuggguugggugugcccccacacucggaacucaccaacccagccagcaaccuggcaacuguggcaauccugccugugugugcugagguccccaugguggccuucacgcuggagcugcagcacgcccugcaggccaucggucaguggggugagggucaugggugggggcuggcggugggugggacauuagugagugagagauguuaggguaggucauuugggggguggaggggaacagggccacaggggcgggguaauggguauucuuuucugaguuaggccccagcccuguggaccaugguucccagccucccuuccccaccuaccccuagguccgacgcuacuccuuaacagugacaucauccgggcacgccugggggccuccgcacuggauagguguguguugcagaagggaguggggaggguggugggugggccuggagccucaaauucuuucagaccugaguucaaguucuuggcuuccaaccacggagccugcgucuuacccauaggucaauggggagauucgcaguggugugaaucugcccaccggagcacggacuuccgugguggggguuugggugucuaaguuccucccagcaacggagcuauguggucucggggagcacacugaccccaggccaaccccaggaugacgcugcccccuucccacccuagcauccaagaguuccggcugucaggguggcuggcccagcaggaggaugcacaccguaucguacucuaccagacggacgccucgcugacgcccuggaccgugcgcugccugcgacaggccgacugcauccucauugugggccugggggaccaggagccuacccucggccaggucggaagcccgugcccccugaucucacccaccucgggucccguccuuugcccucccgugccugcaccaggccacgugcacccucgccauggggguaggcgaucagggacccagguguggccagguggugguggggcggcuggugaccucagccguccguauuccgcagcuggagcagaugcuggagaacacggcugugcgcgcccuuaagcagcuaguccugcuccaccgagaggagggcgcgggccccacgcgcaccguggaguggcuaaauaugcgcagcuggugcucggggcaccugcaccugcgcuguccgcgccgccucuuuucgcgccgcagcccugccaagcuggugaggagcgggccggcccccaccuucuaggggcguggcuggugggcgaggcuugggagacuggggcggggccugggagggcugaggacaggcucgaaggucaggguaccccugggggauccgccggaccccgcccucaugcuccugggucgcgacuaucucccccaucccagcaugagcucuacgagaagguuuucuccaggcgcgcggaccggcacagcgacuucucccgcuuggcgagggugcucacggggaacaccauugcccuugugcuaggcgggggcggggccaggugagggcggggcuugcucucugggggcggggccuggauguccgaggguggagcuuccugggagaaaccgugggggcggggccuggguguucgaggguggagcuuccccuccgggagagaccccguggguaggggcggguccuuuguuccuuagcagugcgggaggugggaggagguaggggcaggggaguuccugcagguggggccuagcgggucacuggggcccauuuucccggcaggggcugcucgcacaucggaguacuaaaggcauuagaggaggcggggguccccguggaccuggugggcggcacguccauuggcucuuucaucggagcguuguacgcggaggagcgcagcgccagccgcacgaagcagcgggcccgggagugggccaagguguguguugcgaggagggauugcugcaccccaggagugccauaaaacccgugguuccaaccuaaccugaucccaugggggagccuccggggucagggugacccuuccugauuaaaucuaugauccccagcuguccggacuuuuauagauaagcuucuaggacucuggguaaccacuuugggaccuccugucuacugacccuaacccauaacccccaacgagagcacccagggcccuuggugaccaccuuguggauggccuuggaugaccacaucaucccuaaguguuccuuuuuuuuuuuuuuuuuuuuuuuuuuugagacugagucuugcucugucgcccaggcuggagugcaguggcacaaucucggcucacugcaaccuccaccucccagguucaagugauuuauccgccucagccucaugaguagcugggauuacaggcacgccccaccagcccggcaaauuuuuuuguauuuuaguagagaugggguuucaccauguuggcuaggcugcuuuugaacuccuggccucaagugaucugcccgccuuggccuccaaagugcugggauuaccagugugagccgcugcaccuggccccuaagugcugcuugcucacccccuauugaugaaccuuaucugugaccccauguaacuccuauuugacccugucuggccccuugucccuagagcaugacuucggugcuggaaccuguguuggaccucacguacccagucaccuccauguucacugggucugccuuuaaccgcagcauccaucgggucuuccaggauaagcagauugagguaggcccaccucauccccugcccugccuaccccuccccggaggagcccccugcuccucccccaccucgaucccuguccccgcaggaccuguggcugccuuacuucaacgugaccacagauaucaccgccucagccaugcgaguccacaaagaugguggguguccccgcccagccugcagcaaccgcugacgccacgugggguuggggggaugcuuccgggagggccgcugagcuucugggacguuguuaacacgagugaccguccacccuggcccgaucaccgaccacuaaccgccacccacuaaugccccggagaccccagguacguccguccuugggggaggggagcagggagacucgucggacgccuuaccccccucacgccauccccgcaggcuguguguggcguuacguccgggccagcgccuccuacugccccuaccugcccccacugugcgaccccaaggacgggcaccugcugguggacgggugcuacguuaacaacgucccaggucagcgagcccaucgggccggcugggccuccggcgugucugagcgugucugugcguguuugugucugugugucccaccgcgcaggcucccuguggcgguacgugcgcgccagcaugacgcugucgggcuaccugcccccgcugugcgaccccaaggacgggcaccuacucauggauggcggcuacaucaacaaucugccaggcaaguggccgcccgcaccacccgcacacgcaagcaccucccgcaccacacacacgcacacgcgugggcacacacagacaggcucgaugacgggacacaugcccaagcugcccaugcaggggugcagacacacaugcgcacacauacgaucacuugcacaaaaugauacaugaaugugccuguggacagcgacaugugcaguugagaucuacauucuggccaggcgcgguggcucagccuggaaucccagcacuuugggaggccugagguggguggaucaccugaggucaggaguuugagacccgccuggccaacauggugaaaccccgucucuacuaaaaauacaaaaaauuaaccaggcugguggggugugccuguaaucccagcuacucaggaggcugaggcagauaaaucacuugaaccugggaguuggagguugcagugagcugagaucaugcuacugcacuccagccugggcgacagagcaagacucagucucaaaaaaaaaaaaaaagaaagaaagaaaucuacaucuaccugcuggcgugcuguguuaagcacaaguggauguacguacaagagggacaggugcacacguccacacacacaucaggggacaugcagguggaaugcaacacucgugugcacaccagcuauauaugcacaugcuuucucucaggggcagguagggcuuacacacacguguacacacaggcacaugugcacagaugaacacgugugucagugaaauagggcauuugccaacgcaugccagucugucccguuuguccugcacguucccucaaacacgcagggaugugcacacacguagauaggaugcggcaccucugaccgaguuaagucaugccuaccaccuuuaugggugcaggugagaagcgggcagguacacaacuuaaaaucucacaccccagaagugugcauauaugaacagacauguacgccaacugcacacaugcucacaaucuuguaggccaggggugggcaaacuauggcccacaggcugaguccugcccucuguuugauuguauaaauaaagcuuuauugagcugggcacaguggcucaugccuguaaucccagcacuuugggaggcugaggcggguggaucacuugaggucaggaauucgaggccagccuggccaacauggugaaacccgguuucuacuaaaaauacaaaaauuagcugggcguggugguguaugccucuaaucccagcuacuugagaggcugaggcaagagaguugcuugaacccgggagguggagguugcaucgagcccagaucgugccauugcacuccagccugggcgacagagugagacucugucucagaaaauaaaacaaaaccucccaacaccugaccccccuccucaacuucaguugcaucauuugcacgucugugcaugacagcaugguguuugcauguguggguauucucucuuuuuuuuuugcgugaucauuugcaugauggcaucugugggacuggguugaacaucucugccccgggcccccgaggggagcagcccgcugaccccccuggccccacagcggacaucgcccgcagcaugggugccaaaacggucaucgccauugacguggggagccaggaugagacggaccucagcaccuacggggacagccuguccggcugguggcugcuguggaagcggcugaaucccugggcugacaagguaaagguuccagacauggcugaaauccagucccgccuggccuacguguccugugugcggcagcuagagguugucaaguccagcuccuacugcgaguaccugcgcccgcccaucgacugcuucaagaccauggacuuugggaaguucgaccagaucuaugugagugggcaggaguggcauggugccugcauaggugguccggcuaagcuuugcuacuuaaagcccagagugguaugagggggaggaauccaggaggaauccaggaaucccaucuggaaucucuggaaaacagaucagugaucaauuggugaugucugcaggggauguaguagggguguggcugugcaugugcuguguaagaacuuucuccuuauaggccagcugcaccccuggaagcacuguauagugauuucuacugccauuucugcauuggugggaaugagaauagugaugaagcagaaaugucugccacaguuccaggagagggagguagcagugcguguguuaugugcuacugacccugaaaaaugugccauagcccaagccaauugaaauugaucagggggccaggcaugguggcucaugcuuguaaucccagcaccuugggaagcugaggugggaggauugcuugaaaccaggaguucaagaccagccugugcaacauagcaaaaccccaucucuacaaagauuaaaaauaaaaaauuagcugggugugguugugcaugccugucaccccagcuacuuagggggcugaggugggaggaccgcucgagcccaggaguuugaagcugcagugagcuaugauugcgucacugcacuccagccugggugacagagcaaaacucugucucuaagaaaaagaaagggccaggcaugguggcucaugcauuuaaucccagcauuuugggaggccgaggugggcagaucacuugaagucaggaguucaagaccagccuggucaacauggugaaaccucaucucuacuaaauauacaaaaauuagcugggugugguggcacaugccuauagucccagcuacuugagaggcugcagcaggagaaaucgcuugaaccuaggaggcagugguugcagugagccaagauugugccacugcacuccagccugggugacagagugagacucugucucaaaaaauaauauuaauuuuaaaaauuaaagauaaaaauaauaaaaauuuuuuuaaaaagaaagaaauugaucaguagcugcagcccagaagcccugagucugagaagagaugugugaugucccuugugggcucacugggauagcaugccaugagaaauucaagauguuugcugugggcuuggggauggcgacauccacagauguacugccuguuugcagacuucaaaauaagcucacacaucaccaccuuguguuauuugcuacccagcacccugcauggggcugugugggaaagaacauggagagauugauugguaaugucugucaagggcaggacaggggauguguaggcgagugugcuaugugcagcugacucugaaauagguuuagucucaaaugcaacucccccagagaaucaggcuuuugaggggccagagaaugggcagacagaguggggacaagcaaagcaggguugcagacauggacccagccccucauuucccacaggaugugggcuaccaguacgggaaggcgguguuuggaggcuggagccguggcaacgucauugagaaaaugcucacagaccggcggucuacagaccuuaaugagagccgccgugcagacguaagccugugaugcccccagggccacucugacuccacugauuacagaacccaagcccccuuaaagucuccccgaaaccucagaugaccccacaugucccuggguuuugcugagcucucagaccucugcugacuucagagaguucccacccuaggaucuccucugagcccccaaugcaccacugggccccccaggggccccaagacucugugggcccccccuaagagccucaccagugucaccccacaggugcuugccuucccaagcucuggcuucacugacuuggcagagauugugucccggauugagccccccacgagcuaugucucugauggcugugcugacggugaggggcccaggggaccccccaagagggaggggaguggcuggagauggcaggccagccccaauccccucaccugugcccugcuccccgauuccaggagaggagucagauugucugacagaguaugaggaggacgccggacccgacugcucgagggaugaaggggggucccccgagggcgcaagccccagcacugccuccgagauggugagaguggguggcccaggguccccucacaucccccagagggucaugaguacagugucaggcaggggagccgggggcguauuugagauccugugugugcugggugcuggcugacaugugacgcaucagugucccgugcugggugacgugugugugaccuucccucgcaggaggaggagaagucgauucuccggcaacgacgcugucugccccaggagccgcccggcucagccacagaugccugaggaccucgacaggggucacccccucccucccaccccuggacugggcuggggguggccccguggggguagcucacucccccuccugcugcuaugccugugacccccgcggcccacacacuggacugaccugcccugagcggggaugcaguguugcacugaugacuugaccagccccucccccaauaaacucgccucuuggaaaugg

SEQ ID NO: 191827 - RNA, 1985 nt, Homo sapiens
ggugagacccuacccaccccccugcccgcgccgggccucguccgcuccccggccccuuccccgcgggcgugugggucccgggcuggggucucggcguccgcgaucccgagcccgcucgcuucggccccccucaggaggcugcgaggaggguggguuucuccccaguguagagguacggggcgagggucgcggggcccugacccuacggcaguucagcucacuucagcccccaucgcagcccggugguggggucuuaacgaucccucucccaucucgcgcgcccagggcccucgccacggacggaucugcaugcuggggcgggggcggcccggagccccugggacaccccuccccgcugguucucccaccucccacgcagaccucguuggggucggcuuagcauccacacaccuccccaugcauggugggggcggguucucagcugccccuccgaucccgucucggcgcccgcuccccaccccauuucucuucaggagcccccuaccccaucucccucuccccgcaccgacagcugaugggaggaccacaguugcucagcauccagcuuccuuucuggagagcacgggggugggaggcucccaacaccucugggccccuccucccagccuucagaacccaggcccauccgcgucucaaaggacgaaggguuccugcgugacacaucggagcugccugccugagggcuugggguuggggguuacccgccccuccugccuggccccacggauccccccuguuaaagcccccaacccuccuggcuuuuggucuugacacgcuccuaccccacucccacccuccacccccuuuacucuggcuuuccgcagggggccggcaggaaaguucccgagggucgucugugcuggagcgcagggcggggcaggagcgacugcccauauccccucguggugccucaucuuugucaccucccugcccuagaucugacgccccuccccccauacacuaguuuucuaguuacuccuguagguggcggagcgggcaggaaggcgcuuucgcaauugaaccgucugcaugcccgaggguugggugguuucggccuccucuucuguucccccucgugucucuccucccaccuuguccccacucccgcuagcccgcugccugccgaggguauaagacuccccccucccuugauuuaucugguuacguguaaucgaggcguguuuuacgcgcaucucuuugcaagugggaagucggcacuggagcacacaacaguggcaugggucgagggugucccagggccccucgcgguucucccuccuuuccucccggccugcuccccuucccauugccccugacaccugcacuuccuggucuccccgcaggguggcggcggcauggaggcgcgcuucacgcgcgggaagucggcgcugcuggagcgcgcgcuggcgcggccgcgcaccgaggugagccugagcgccuucgcacugcuguucuccgagcugguacagcacugccagagccgcgucuucuccguggccgagcugcagucgcgccuggccgcgcugggccgccaggugggcgcgcgcgugcuggaugcgcugguggcgcgcgaaaagggugcccggcgugagaccaaggugcuaggcgcguugcucuucgucaagggcgccguguggaaggcgcucuucggcaaggaggcggacaagcuggagcaggccaacgaugacgcgcgcaccuucuacaucaucgagcgcgagccgcucaucaacaccuacaucuccgugcccaaggagaacagcacgcucaacugcgccagcuucacggcgggcaucguggaggcggugcucacacacagcggcuucccugccaaggucacggcgcacuggcacaagggcaccacgcucaugaucaaguucgaggaggcagucaucgcucgagaccgggcccuggagggccgcugacccugccggagauaaaggauacagagagccccuccccacgug

SEQ ID NO: 191828 - RNA, 1985 nt, Homo sapiens
cacguggggaggggcucucuguauccuuuaucuccggcagggucagcggcccuccagggcccggucucgagcgaugacugccuccucgaacuugaucaugagcguggugcccuugugccagugcgccgugaccuuggcagggaagccgcugugugugagcaccgccuccacgaugcccgccgugaagcuggcgcaguugagcgugcuguucuccuugggcacggagauguagguguugaugagcggcucgcgcucgaugauguagaaggugcgcgcgucaucguuggccugcuccagcuuguccgccuccuugccgaagagcgccuuccacacggcgcccuugacgaagagcaacgcgccuagcaccuuggucucacgccgggcacccuuuucgcgcgccaccagcgcauccagcacgcgcgcgcccaccuggcggcccagcgcggccaggcgcgacugcagcucggccacggagaagacgcggcucuggcagugcuguaccagcucggagaacagcagugcgaaggcgcucaggcucaccucggugcgcggccgcgccagcgcgcgcuccagcagcgccgacuucccgcgcgugaagcgcgccuccaugccgccgccacccugcggggagaccaggaagugcaggugucaggggcaaugggaaggggagcaggccgggaggaaaggagggagaaccgcgaggggcccugggacacccucgacccaugccacuguugugugcuccagugccgacuucccacuugcaaagagaugcgcguaaaacacgccucgauuacacguaaccagauaaaucaagggaggggggagucuuauacccucggcaggcagcgggcuagcgggaguggggacaaggugggaggagagacacgagggggaacagaagaggaggccgaaaccacccaacccucgggcaugcagacgguucaauugcgaaagcgccuuccugcccgcuccgccaccuacaggaguaacuagaaaacuaguguauggggggaggggcgucagaucuagggcagggaggugacaaagaugaggcaccacgaggggauaugggcagucgcuccugccccgcccugcgcuccagcacagacgacccucgggaacuuuccugccggcccccugcggaaagccagaguaaaggggguggagggugggagugggguaggagcgugucaagaccaaaagccaggaggguugggggcuuuaacaggggggauccguggggccaggcaggaggggcggguaacccccaaccccaagcccucaggcaggcagcuccgaugugucacgcaggaacccuucguccuuugagacgcggaugggccuggguucugaaggcugggaggaggggcccagagguguugggagccucccacccccgugcucuccagaaaggaagcuggaugcugagcaacugugguccucccaucagcugucggugcggggagagggagaugggguagggggcuccugaagagaaaugggguggggagcgggcgccgagacgggaucggaggggcagcugagaacccgcccccaccaugcauggggagguguguggaugcuaagccgaccccaacgaggucugcgugggaggugggagaaccagcggggaggggugucccaggggcuccgggccgcccccgccccagcaugcagauccguccguggcgagggcccugggcgcgcgagaugggagagggaucguuaagaccccaccaccgggcugcgaugggggcugaagugagcugaacugccguagggucagggccccgcgacccucgccccguaccucuacacuggggagaaacccacccuccucgcagccuccugaggggggccgaagcgagcgggcucgggaucgcggacgccgagaccccagcccgggacccacacgcccgcggggaaggggccggggagcggacgaggcccggcgcgggcagggggguggguagggucucacc

SEQ ID NO: 191829 - RNA, 18477 nt, Homo sapiens
agcugugaaccaaccccgcucacggcuaacaagcccacccaccauggcgagccccacucugagccccgacuccucaucccaggaggcccugucggcccccaccugcuccccaaccucugacuccgagaaccucagccccgaugagcuggagcugcuggccaagcucgaagagcagaaccggugaguugggggcugggggauggggugaaaucuuggggugcagucugggcccccacaggaguucccaggugcccucacauucagagccaggcccagugugugcaaugugacagccaccuccagaugcuggaugagggacagacaccuccuuucauccucccaacccuggcugaauauauguguccccacccuguucagaugagacugaagguuugagaggucaagugaaucugugaauccgccgcgguuaauggagccaggacuggaggaagagucgauucgggccuuccugcuuucuuccucugacccuacccccauuuaaaaugcagguuuuaggcuggacgugguggcucacaccaccgaacacuuugggaggccgaggcagacggaucacuugaggucagguguuugagaccagccuggccaacauggugaaauccugucucuacuaaaaacacaaaaauuagcugggcaugguggugggugccuguaaucucagcuacuugggagccugaggcaggagaaucacuugaacccgggaggcggacgcugcagugagccaagaucacgccacugcacuccagucugggcaacaagagcaaaacuccgucucaaaaaaaagggggcgcugagggcaguggcucaagccuguaaucccagcaguuuaggaggcugaggcagguggaucaccugaggucaggaguucgagaccagcccgaccaacauggugaaaccccauauuuacuacaaauauaaaguuagccaggugugguggcaugcaccuguaaucccagcuacucaggaggcugaagcaggagaauugcuugaaccaggaggcagagguugcagugagcugagaucacaccacugcacuccagccugggcgacagagcaagacuccaucucaaagaagaagaaaaaaaaaagaacaagagggaccuaaucccugguguccucuaagacccccaggagggggaggaugggcugggcucgccaaggaucccuguccccagggagucacugguuccccucugucggcccuuccugcccaggcuccuggaggccgacuccaaguccaugcgcuccaugaauggcucgcggcggaacaguggcuccucgcuaguguccagcuccucggccuccuccaaccugagccaccuggaggaggacacguggauccuguggggccggaucgccaacgagugggaggaguggcggcgcaggaaggagaagcugcucaagguggggggcggccaggcaggcagggcugggccgacggcgugggcagguggugcggucacucagccaccaggcagcgccagggucugcggggccccagccugggcacagcggcagcaguggagaugugcaggcacuuucaggguguccugccagagcacagggacaggagagagugagucaggguggugcuggacaggcccugcacccucgagugcccaugugcuugcugcccuguagugcccaugaaggaugggggugugguggcucacgccuggaaucucagcacuuugggcggccaaggugggaggaucgcuugaggccaggaguucgaggccagccugggcaacguaaugagacuccgacucuauaaaaaguuuaaaaauuagccagguaggccgggcgcaguggcucacgccuguaaucccaguucguuggaaggucgaggcaggcagaucaccuaaggucaggaguucaagaccagccuggccaacauggcgaaacuccgacucuacuaaaaauacaaaaauuagcugggcgugguggcgugcaccuguaaucccagcuacuugggaggcugaggcaggagaaucacuugaaccugggaggcaagagguagcagugagccaagaucacgccacugcacuccggcgugggcaacagagugagacuccaucucaaaaaaaaaaaaaguuuaaaaauuagccaggcgugguggugcacaacuguagucccagcuacucaggaagcugaggcaggaggaucgcuugagcccaggaguucaaggcugcagggagcuaugaucgcaccacugcacuccagccugggugacagagggagacccugucucugaaaaaaggggguaaaaaaaggauuggggaccaugaguucugugccaugcuugaggccuggaugagccacgccugaggagcugggcuggguggccacggggaggcugcgcugggaccgaguccagcccccgcuucccgcucccguggccaggagcugauccgcaagggcaucccccaccacuuccgggccaucguguggcagcuucugugcagcgccacggacaugcccgucaagaaccaguacuccgagcugcucaagauguccucgccgugcgagaagcugauccgcagggacaucgcccgcaccuacccggaacaugaguucuucaagggccaggacagccugggccaggagguccucuucaacgucaugaaggugaggcccagggcuccccgcucccucggucccaaaggaaggagaaguuccccaguucaccggcugugcuggacggcgggacccugcucucaggacuuguucccuucuaggcauacucgcugguagaccgggaggugggcuacugccagggaagcgccuucaucgugggccugcuccucaugcagguagguggcugggggguggcugggcuccugccagacaacagcccacccugggcucggcccccaagagauggacagaaguggcguguccuccacccagcgucuugcuagggguagauccuccuucuccauccacacccgugaccucugccaaucgccaggccaaggcccagugaguggcaccugucugguuggguccugucugcuguaccauccaggacagagaccggguuuggagggauaggcugucucucucugccacaucucaggguuggacaggaaccucaggcuggggacuuaagccauccagcgugguguuuauggggcuugggggucuccuccagagaaaucgggaggcugacagggagagaggacgcagcugggacaggagguauccuaaccagggggaugcuggcaguggccagcccuggguucagguccagcuccccuguuuccugccgaguggcccuuggcaggugaccucagccucaggucuuccaucaguaaaacagcuugugaggacacagggaccaacagugugucaugagagucuagggagccagguaccgacauggacaugggccccuguaccccagggcccugaugagcagcgagaugccccuccccgcugcgcugcccugagcccccccaccugcccguccccccuagaugccugaggaggaggccuucuguguguucgugcggcugaugcaggaguaccggcugcgggagcucuucaaacccagcauggccgagcucgggcucugcaucuaucaguucgaguacaugcugcaggugagcagggccgcaggagagcagggcugcaggagggcagggccacaggugggcagggccgcaagggagcaggaucgcagaagggcagggcuggcacccuagaccauacccgggcaccucuuggacugaaaauuccaagccugugaaaucacaccuggacguuccaacuccaaaaggcacuccucuuuccaugcagcacugcccugaaggaugcuuggaggaacaggagagccaccacugaaggggggcucccagggcugcugaggcagagggguggggcaggcucacaucggacacagccacagccaccucccugucugcuccagagugugguggaaggagggaguguugucugccugccugauuacuggagagccgcagacgucuguuuauaaauagcagcccccgcagggccugcucccggcuggcaggcagagccgccaaggccguuugcgaacauacacacacccgcaugcauacacacacacgcagacacacacacacacaccggcccgccucagcugccauggcagguggggcugugcagucaucccuggaugugacagccccacucccugggccuggaucauggacggugcuguagccuuagggggccugguagugccacaagcaggaggccugggcugcagagaaggcaccaccccaccucaggcuggguagcagagcccucccacagccaagcuugcaaacucagggcgcagagagccccuggcgcugggaggaagcccgggauccuaacgccuucuccggccucaguuuccccagccgucugccacuuucuggcugucuagaguucaggccaauccaacacagcuugcacaaagcuuuaugcugggguccaagggagguacaguggcuggcaggucacguaacaagguggggggggggcuccccccagggccagaggcugccacuugcccaugcuccaccucugggucucagggugucuguggggagugacccaacucccccagccucagacacacccucucaggcugucgugaggaccccaugagcugccacgggcgcaucaccuacccagggugggcccccaacacaggcggcuacagaucuugccaucccugccugucccccaccccgugcuacucaaagcucgggggugcuucggccucccucagacagagugcugagggagcaccaggaagggagccucaggcugcccagcgcagguccaggaaggcucccuggaggcggggacacugaggcccagcaccccccggugggagggcgucccccucacugugcccacccggccucccaccccugcaggagcagcucccagaccucaacacccacuuccguucccaaagcuuccacacauccauguaugccucguccugguuccucacacuguuccugaccaccuucccacuccccgucgccacccgggucuuugacaucuucauguaugaggugaggaccgauggugccuggggagggaagagagccccuugggggugguuggaacaggagccucccugcccuccaccucccacugccuuugccgccuuugcaggggcuggagaucguguuccgagugggccucgcccugcugcaggugaaccaggcagagcugaugcagcuggacauggaggggaugucccaggugggccgggagggccagggccgguggggcugcccccaaucaggggcuucgagucacaggaugcccucacaagugacagagagggcccggcuucgaggguggaagguggugugccugacaucccugaucuguucccauccacucuguuccccugaggucucccuaagggaccagaggacccccuaggcucugccagacacagucaggggccagcagccuggccgcagggagacaggaggcccaggcugagcccugggagccccacugcccaccuccugcccccaaccccgcagaugccccaaagccugauggcagaucaugacugacugaccaugagggcauccccacccugccgcccagccuggugagggcacaggagggaguuugggggucuaggcaaccucacgccuugccccgccccagcccggccugccuggaggcccugcugcuggccagccugccucccaccgcuacuucucugcugugcgggccccugcccccuccccgcguccuccagcuggugcuucagggaagaaugcacaaaggccacgguuguguccgugaacaugggcaggcauuguccacagcuaccagagggggccagcugggccgggugcaggagcuguguccccccugggcuuaccuuaacccuuugcacaggcccgaggcccccggcauacccauccuccuucccccacgaagguccccucugucagaccccccgacccucagccuucacucccaggagagccuccuuggccugcuuuucuuuuuuucuuuuaccuuuuucuuuuuuuuuuuaagucggaguugcucuguggcccaggcuggaguacaguggugcaguccuagcucacugcagccuccaccuccugggcugaagcgauccucccgccucagccuccugaguagcuggaaccagagguguacaucaccauguccagcuaauuuuuuuuuuucagaaauggggucucacuauguugcccacacuggucucaaacuccugggcucaagcuauuuauuucucccaccucaggcuuuuaaaucauugggauuauaugaaugagccaccacauccagcaucugccagcuuuucuucuggaaacuaaggcuuuggcugcaggcagucccccauucccuccccucacgcucagucuuuccauugcuccacaaacacugaggacacggcguugaggacauggcgacaccccgggcagacccguuccugccccccuccagggcaacagggcucgggcggcccccgguggucagggccugcauguuggugaccaggugaccggcuguguccccacaguacuuccagagagugaucccccaccaguucgacagcugcccggacaagcugguccucaaagccuaccaggucaaguacaaccccaagaagaugaagaggucggugccugcugggcaaccaggguacugguaagaaggggggacccccgagggcaugacaguaaccacggggcccucccgaucugcaggcuggagaaggaguacgcagccaugaagagcaaggagauggaggagcagaucgagaucaaagugaguccaggggcccaggggcggggacagggaugggaggccuuugggggcugcccuccguacucuaaagaucggccgcuagggggcgggccuucccagcgcacaggcggacccggcgguccuuggcggacaggccuccgcccaccugcgccguccuucaccuguuaggccagcugugagcgccucccccgccugacgccgcgguaaccaagacagucaaggucccugccccgcugggccgcccagcgucauggggaagcaaucaauaaaccacugaacuagagugcggacucuaaaugcucuggacaaggaugugcacgcggugggcaaggcugacuugggcagaggcuccgggcccagggugucgagggcuaaaggcccagggcagcagcgugccuugggggcuggaggaauuccaagaagguugcaguggaggaccccgcaaggggaccgcccucuggggaaagauggagcacgcagggcccagacaccaggguguguagggcagggugugggcacucacccggggccccugguuccuggggcaacuggcccaccagcccugccaggucaggggguuuccugagugugcaaagcuucucucuccuuccuugcgcauucuucccuuuacacgugauuuuaguuauuuacucaacaagcauuuauugccgggcgcgauggcucaugcauguaaucccagcacuuugggaggcggaggcagguggaucacuugaggucaggaguucgagaccagccuggcuaaugcagugaaaccccgucucuauuaaaaauacaaaaauuagcugggugugguagcacacaccuguaauccuggcuacucgggaggcugaggcaggaaaaucacuugaacccgggaggcggagguuacagugaggcaagauuguaccguugcacuccagccugggcgacagagugagacugugucucaaaaaaaaaaaaaaaagaaaagaaaagaaaaaaaacauuuauugagcaccugcugugugccaaagucacagcugagacugagggcgcaccagugauaggaagggacacagacacaaacccaacacagccuggcuccaugcucuucaggggcagagccgcacaguggcuaacacuggaguccaacagacaaggauucaauuccagcuccagcggcacaguggcucacaccuguaaucccaacacuuugagaggcugaggugggaggguggcuugaggccaggaguuggagaccagucugggcaacauagcaauaccccgucuuuacaaaaauauagaaauaaauacaaaaggugugcccagcuccugcaaggauggcugugcuuggugcugugauggguugaagccagagagaugauagggaaacccaggggccagggaucagggcuccagauugcuaugaggaccagagaccugaaauagcucugacccagcugaacugagggacuagggcaaugcccugccccacucugacucaguuuccccacaugacaugcaucaaugacugucaagucugcgguucugucugacugcauuugcuuccugggaauguucuagguguuuccaucaccuuuucuccccagaagaaacccaggaaauauucugugugaccugcaguguggcagggcccucacucaccugccaauccaaacaauuucuguaccaccuuaguaucaagcaagggggcacagguacagucgagauucaacucguuugcaaaccucaccugcuccccagaguguccugggggaaccuaaagugcaaauaucuuuuucuuuuuuuuuuuuuuuuuuuggagauggagucuugcucugucacccaggcugcagugcagugaggugaucucggcuuacugcaaccccugcucccggguucaagugauucuccugccucagccuccccuguagcugggauuacaggcaugcaccaccacgccuggcuaaucuuuguguuuuuaguagaggcuggucucgaacuccugaccucaggugauuugccugccucggccucccaaagugcugggauuacaggcgugagccacuacaccuggccuaaaaccgcaaauaucuagccaaaauccaucagcacagaauggaaggcaggagcaagggagacgucuucgaaaccccagccagggaacagagaaaaccacuggggacagguugcucucagcaggucaugggaauguaguugucgagaaaggaugcaugaucagcacgcuggacccagacucaaagaggagccugcccccggaauugaacccgggugcuuggggcaaagcagcgaggggugggugguggcugcucgacagcugcuucccccacugauucccgcacaacccuuggcagacugacccacgugugggaaggagucuucugagggggcguggguacugacuggcccccaaacacacacacagccacgaaggcacugacguuauuuuuacugaacccagguuuguuuuaaaacuuuauuuuuuuguaaucaagccagucugaacaggaauuggcccuguuuucugaaaucgcugacccagaacguaagaugcuggcugugcccugcccggaaaaguggccuggcccuaaggggacugaccccggcaguggguaaaugaggggugcauguagacaggcguggggggcgggcuaugacgugaucuccccccacccccauagagacuucggacggagaaccggcuccugaaacagcggauugaaacccuagagaaggugaggggcguggccacugugaggacauggucgccauggggugugacccaccaugcggggcauggccgcuaaccugggguggacuccuccaagucuucuccucucuggaggacuaagcagcccuaccuuccugccccaggacccgaccugaacccgauuuggagugcccugcaacugggggcgacucguauggugauuaauccuggagugggggcgaguuacaacccaguggccugcagccacgggaauccauuuguguucugugcccuccccggcugcacagacggggaggggugaggaggagggagaacugccacuuugauggacgagccccguaauugggccacaagccaccccacccuguaauuuggaagucuugcccucaaaagaaaggaaaggaaacccaguggaggagaagcguggcgccaugguggggagccacagcccggacucugcuccccaacaugcuaaagauggggguggaauugggggcucacugagccccagccccgggagcccccaauuccugcuccucacucguccucacuugacccuccacuggccacaggaaguggguuggcagccggauuugguugcccucaccccaaagccuuguucugccuuaaaauuacaacgcacccccuccucucccacucuccaggagguccgcacgaagccaaaagucccccugccccccacaguuuuuccagccagcagcggcccggcugacccuggagggugggacaguggguuucccagcccugcggccucccccacagccgcgggcacccccgaccuccccgcucacaccgaaccccucuccaggacggagcuggcucuagcuuuggucuuccuccggguccucuccugcugguucucuggucuucccuccucucucccccgcuucuagagauaguccacugcguuagugacaagugguucuugucugucuccccucuccuguccccgcgccuuccgcucugccuccucccccugucgcugggaacccccuucgccggguaggagagcgcugcucuggcugauagguuaauccagguacuguagcuuuuuauccccucuccggauuccuuccuggccccuucccugcacccugcacaugacagccaguaaccgccucuucccugccauucugcgggcaggccuggcgccaugcauggagcagcuggggaccgcuucugggggacacagaggcuucccgggggggcggggcaugugaaguggggagaaggguguguguggaggggcugugagugcguuugggugugaauguccacaugcauguacagaaagcuuccuccgggcgacacaggguggggacccaggagggcuggggaaccuaaaaccauauucacauaaggcccuggugugugcagugcugcggucacacacacacacaacacaugcacacacacacacgcacacacacgcccggcccucacgcugcugcucucugcuccuaccugcaaugccugcuaccaccuucucuagcucaccugcuccugcugccaccucaucuugaauggcuuuaucuggaagcugccacccgccaccugguggcuuugagccuggaauggggggcccaaguuggguaggggacaaagaugaggugggggaaaaaagggggucuuagcuccaggcagguggaggccccagagcccaggacuagagaagaugccgcugggagaggugaaugcccuggggagcccagcccucuccugccggggccucagcuguccccagauccucacccucaccggcagagucuggcaugaauaggcacagguggccucgcugugccccuggauaaggaucccaacuggggcagagacugagagccagaguggggaaggagauggagcuuuccaagcccagggcuagcucuguuccucccgggcuccuccagguguccuauuccugccugucacccacccacguccccaggcccagugggacgcucaucccaggcucugaguacgggaggcccccaccucacuuccccccaccuccacucucugggccucccccuguggcgggaggcagggccuugggugggagccgagggucacggccucccccugcccccuguccucgcuguucucaggggcaagugacacgggcgcaggaggcggaggagaacuacgucaucaagcgggagcuggcgguggugcggcagcagugcagcucggcggccgaggaccugcagaaggcacagagcaccauccggcagcuacaggagcagcagguaggggcgggugugcggggcugcugggcggggccaugacccgcgcccccgcccccgcccaacgguuuucuuucagggcucauaaucugccccgccucagcaccuggcccuccuguuccuuucugggguaaggggaacccagagacaagcgcagauucucccccagcagcuccacauucugagacauccugauauccauuucuugccaccucauagugugucugcaguaucugacuucccaacccccagccucagcacggaggccucugaagaccgggcugucccugcaggguuuccucugugucacaggcagcagacagggcugugacuccuuacggaggcucuugccuguccccagggucugaaggauuguuaggugucccuggggggccagccauggagaaugggagcagggcaguccgggacuguuuggggagcucugagccagcaggguggggcugagggggcaccuugagugucuugagggccaugaacuuugggucccaugaugggcaggcccaugaguggggccccaccccaagauuuucuucuccugaaagcuuuuagaacuuaacugcgaccuggugcaguggcucacgccuuaaucucagcacuuugggaggcugaggcagguggaucaccugagguuaggaguucgagaccagccuggccaacaugaugaagccccaucucuaauaaaaauacaaaaauaagcuggguaugguggugcgcaccuguagucccagcuacucaggaggcugaggcaggagaaucacuugaacccgggagguggagguugcagugagccaagauggcaccaccgcacuccagccugggugacagagcaagacuccaucucaaaaaaaaaaaaaaaaaaaacuuaacugcagcugcacucagcaguuggccuuccugaucgcagggacccccaguggcugcaguccuaagcccugcaggccacagggacacaugcccuggaggggccgggagcgacgcuguaggucccgcugccauccuggccugacccagcagggccuggcagugggguguagguuggagaaaccauggagugcuugagaaagaagagccauccaauacagaggugcccccuccgcccccaggcccagagacuguggcucaagccuuggcccagggauucuagcggauccacugcuccuggggagaaggagagcuucacuguuucucacuuguccccaugaaccacauccguaugaugcuggcguuguggcccucagagucugugagcacucuugucccaccuugcucugaggcagcauggacauuagggaaacugaggcugggcucaucccacccacugcaugaggccgccuuucaggcucguuagagagacuccaccagccaccccugagcuccaaccuuggggggaugcagagaucggggaggcccaaggccaccuccucaggcccaaagggaggccacugcaggcaagaugagguggcccagaggagccacauggggccuggaggccaucugggccgaggcagagccaccgucacacguggaucucagagacccacaggaagaggaugguggcugggagggcugaggcagucccccagagaacuguccugccaggccacaaggucagugagagggagcccggcucccaccccagggaccagguguccuuuuucagguccagguggcaguguccaucacuccaggggcccccacuggggaacuucugagaagccagggcauggagcaagagggugauacccacaaacucuuuccucauccuucccugauuugaaauggagggugggaugcagaggagagagguggaaagacaggugcacagccccaggccucucccccacccccugccucgcccaccauguggcuggaacggugaccacccagcaagaacccaucucccacccucaccagugaucccggaaaaccagucacuggggucccgcggggcauccgaaggccaaggcaagucaccuuucagaauguccccucugugcagccuuuccaggaaggaagcuggaccgggccagcugcauggaugccaggaccucuaggcccugagcaucaggggguccagcccaggacaccccaagccugggccccucucccugcugaagggcucuggggaggcggggagaagccagcaggcauggaggcugcccaucccccagccauggccuggggccccacgcagcucucugccucccccaggagaacccccgccucacagaagacuucgugucccaccuggagaccgagcuggagcagucgaggcugcgggagacggagacacugggggcccuucgggagaugcaggacaagguucucgacauggaaaaggugcaauggggaggcagacgggcaggugucggggggacccuggggcacaggagggguccuggauaagcuuugggagugaccccaggucagaaucccccacccccaugcacacacaaccauacauaugcacacacacagcacaaccccacgcggggcaugcccacgcuccuguaugaggcaaacuccagcagcguggcagcuucuaugagcuucccggauaccugcaucccaccuguguguguuucccccaguacuggguuccaggaaggaagggaggagagagggggaugggggagggggacaggaaggagagaaaggaaggcccaggcccauuguggcugccucccuacacauucccaugcagacaccaucccagggcuucuggguuccuccccaacugcucucugacuuggcaucgacuccacucucccacggagcucccagaggaaggaaagcacccagggacccauucacacauucagcaggagccauuccccacccccucgagccugcacuauuuugggaguccucccaaauggaggacugagaggccaucugcuuccaggcccucaucaccagccaagagcugggcuccgcucccgccucccuccacuucauagggaagugugccuccaggacaugcugcuagaucugucccagcccuagacccaaacacgggucagugcggaccucauccagaaagcuggauuuggguccuggagcacaaauccuccaucaaugagcccugggacaccaggacagggccaaggcuggcacucagccuguucccagggagagggacugccuggccugguguggccuggccugggggccagagggcagacaggguguuucugcuggggcagguccuccaccugaucaugucccugaggggauggaucucagaccucggggagucagugugugcagcgcggcguuuauggggguugcccuaggacacccugugagaguaggugcuguuacuacacccauuuuauagcugaggaacuccaaccggguuccacaggcgaguccgcuccccgugggccuugucaagggggucgcccucccccaucugagccgcccaaggcagagcucaggaggaaacguggcugggggcguuuguccugcaggaagggccaugcggcugcgcugcucccccaggcccugaccccacucuucccgcagaggaacagcucgcugcccgacgagaacaauguggcgcagcugcaggaggagcugaaggcgcucaaggugcgggaaggccaggcgguggccucgacgcgagagcuuaaacugcagcugcaggagcucucggacaccuggcaggugagggccgggugggcgccggcgggcagagcgcccccuagggccauccccucgggguucuugggcggaggcugaccgccggcuucucggcuucaccccccaggcccaucuggcccgcggcggccgcuggaaggaguccccacggaagcuggucgugggcgagcugcaggacgagcugaugagcgugcgucugcgcgaggcccaggcccuggccgagggccgcgagcugcggcagcgcgugguggaacuugagacgcagguggacucggggggccugcucguuggggaaggggcgugguguccguggccagccccugaguuaggcccugaccgccgccguccuccguccucccuuccucccuaucccaggaccacauccaccgcaaccuucugaaccgcguggaggcggagcgcgcggcgcugcaggagaagcugcaguaccuggcugcacagaacaaggggcugcagacgcagcucagcgaaagccgccgcaagcaggccgaggccgagugcaaggugcagacccccgcggccccgcccugcccguggcaccgcccccggacgcgccccuacaugaggccccgcccccaauccgccucugccggcguccugccucccgaucugccccugcccgcgguccucccgcccccgcccgcggccccgccuccugaccugcuccugcccgcgaccccgccuccugauccggccccgccuccugaccacccccccccgcggucccgccuccugauccgcccccgcccgcggccacgccuccugacccgcccccgcccgcaccucccuugcccgcggucccgccccugcccgcgguccugccuccugacccgccuccgcccgcggccccgccuccucauucgccccugcccgcggucccgcccccugaugcgccgcgcccccugacccgcccuccuuuccccccaaucccccgaccccagagcaaggaggaggugauggcugugcgacugcgggaggcggacagcauggcugcgguggccgagaugcggcagcgcauugccgagcuggagauccaggugaucggcggggccggggucggggggcgggggcgggggcagggcccggggcaggagcggggccggaccccaggcccagcauggcacuggccccgcgugaccuggcgcaccccgcagagggaggaaggccgcauccagggccagcugaaccacucggacucaucgcaguacauccgcgagcucaaggaccagaucgaggagcugaaggccgaggugagccggcgcggggaugccggggacaggccugggugucgucggccugggacgagccgagcgcaggugccuugcggaggaugcggcugggagggcggggcagaaggccgguccacgccugcagcgccggucccccgccccaggugcggcugcugaagggcccgccgcccuucgaggacccgcuggcuuucgaugggcugagccuggcgcggcacuuggacgaggacucgcugccgucgucggacgaggagcuacuuggcguaggcgugggcgcugcccugcaggacgcauuguauccucuguccccgcgcgaugcgcgcuucuuccgccgucuggagcggccggccaaggacagcgagggcagcucagacagcgacgccgaugagcuggccgcgcccuacagccagggucuggacaacugaggccaugcccagcgcgcccggagucaggaggccgcagccgcggggggcgcccgggcaguccgcguucugcuccccaccugccgcacuugacaaacuacgcgcccucuguggcucggccaccccuaaagcgaggcccggcgaggcagcgcagaggguaggguccgaccugggcuccucagggccccggggcaggcucucuauccccagcaguguuuacccaucuuggucuguaccccuccgggcccucuggcguuccaggggugccuggaggggcugacugcucucuuaacaggagggcagagggcaggggacagacgacccagaggucccagcacugaaugagcaggcagcucccaccuccuggcaggcuuccuucugggacaggggcgacauugcugggaagugcucaggagguagccgaggccugaggaaggagagcgccagcucugggcuggacaucagcaccccacaacacuccucgggaugaagugacccuugacuagccccuggccaucucuaggggagucaggccgcuggggacagauggccaggccggccucuccugccuggcgcaggcaccguggccccugcagcggaaaccaaagucccccuacuaugugcggggcgccuggggacugaguggcuaacgggaagccucccugcuucucuggggccagagcagcuuccaggaagugaagagaccccucuccccagugccccacaucuuucucugggagacacucgcgcccccuauccuggccagugauggagggguaucucuacagggguccucggucuccaucuacuucccuuucuucauguguuuccagccccacccucagccagagccaggcccccaggcaggagcuucccagcgagcggccuccccucacuuccuccugguggucccguugucucugcugaaucagagcugagaacggugccaaaauccaacgaugccccccaggccccuuccucccuucccccggccccccgggccucaugacccugggggcugccccccucggugcucccggagccuccaguagaguagcgucacaagcaaucucccuggcgcuuccuggguggggaccccugcuccguccccgcuuccuagcugcccacuuuucaguguuacgaagccuggggaccggggcaggcacccacggggcucuccacacgcccccuacacugcccgccaccauuuugcacacugccuguucacaugucgcccaggcgggaaaaauggaaaauaaaguguauuuacacaguca

SEQ ID NO: 191830 - RNA, 1671 nt, Homo sapiens
uaagcgcucaauaauagcuuuuauuaucauguucggcucagaggcagggaggaguggaacggcaugggagggcugcgggaggcacggcaggggggucaggggcaaguggcaggagggcggauggggggcagcggugggcaccggggcagggcgcgcugaccuguccuggggcccggguugggggcagaaaugagccugcccacgcugucccgccacggcaggcgccacgcauccucgacacagccgccauggcaggccuucgggcuccgucuccgggacaggcggugcagggcaaauugguaugcagcguccgccccgugggcccgggagagccugccccgcagggaccagagcccaaggacgggcucaacacucagucaaggugggguugacgacggccagacaacaggggagggaggagggacaaggggguccccacuuccagggacgcacaauagcagagccacuuacacgcuggggagggggcggugcggggguccuccucccgcccgggauucagagucgggggugggggccagccgggcgggugagaugcgcagagaggaagggacagggcggauaaaggcacgagguggggcuccggccaggccaggaagggacaugggaggggucucgagggggaggggcugggcuucucccaacucccucccccucucccccgggcugggggcuccggggcgggauccugagcgcaguccuggccccgcggcgccccccgccgggccggcccucugagaccccggcgcagggccggcuagggggcgccgcgccccucacaccaacgcguagucgaacugcccgcgcucgagcgccuccuuguggucgguccaggacgaggcgggcaugcggcuguaggggucgagcaggaugcgcacgcagcgcaccaucaacagcaccagcaccacgagcaggcagagcacgaaggcgaacaccgugcgcugcuccgcguccaggcccgcgcccaccgggggccccgucgacggcggcaggggcuccggcgacagcguccacgucgcgcucauggcucacaucgccgcgcgcccugcggaggaggggacccgccccgggcgccggggaugaggcugcgcccucccucccgcgccuccuccgcuucgcccccuccugccgccgccgccgccgccucccuuaacgugcccgaccccaucccccgcccgcgccucgguccccgggcuacgcccaugcccggcccgccggaucgccgccaccaccacgcggggacccaacucuggccgugcgcgcaggugggggcgcugagagccgggaaacggagccgcgcccggccugggccgcacacaacaggugcgaaagcgcggccgcggcccgggcgcgcggcguggggacgguccccgcggccccugcccccgcucccuuuguucucggcggccugggacccccucccccaccgcccccgccccggcgcgccccucacccuggcuucgacccggacggggaccgaccgcccggcggccgcgcucucucagggacccgcgccggcugcgcguucggccucuccccggcggcggcggcggcggcccgggcuccggcucagcccaccccacccgccccuggagcggcggagaccgaggcaggcaagcagcgcgcgagccgggccgccgcggcuguuccuau

SEQ ID NO: 191831 - RNA, 9902 nt, Homo sapiens
agaugggacagcuuggccuacagcccggcgggcaucagcucccuugacccaguggauaucggugagucuuuuccuugaacaugacugagaugaacagcuuuucccuccagcacaacuuguuccuacuuuauacaaccuccuucccuugccauaugccuggggcuuaagaggggggauguucccaguacccacuccccuccucuuccucaguccuuaccacuucccuccacgaccccagguggccccguuauucguccaggugcccagggaggaggacccgccugcagcaugaaccuguggcuccuggccugccugguggccggcuuccugggagccugggcccccgcuguccacacccaagguacuguguucggcaaugccuaccaccaagugccccucuccccaugcccccaccccaccccuuuugucucuuaucuccuccggaagucuccccaaucccaucuccacugaauucucccgcuccugacaugcaggaacuccugguguuugguuagcucuugggauggggucggggagauggagaguccccaguuccuucuucgagagccccauggagucuuuugcaagacuccuaaagaugugagggagcagaggguggcuuccagcugugggcaaagccaguuacugccagggauguauuguagaauccuaauccugccgagccaggggugggguuggagaucagggcccuggagacugacaagaguggauucccauccuggucccuccaugcaguccagcugagaguuaguugcuccuaaaccauuuuuuuuuuuuuuuuuuugagacagagucucacucugucacccuggcuggagugcaguggcgcgaucuuggcucacugcaaccuccgccuccugggcucaagcgauccuucugccucagccucccaaguagcugggacuacaggcguguguaccaugcccggcuaauuuuuguauuuuuuaguagagaugggguuucacuauguuggccagaguagucucgaucuccugaucucaggcgauccgccugccucagccucccaaagugcuaggauuacagguuugagccacugugcccggcuuccuaaaccuuuaggagccuccguuuccucagcugcaaagugggaaucuaaaauucccacugcauggcucugacuugaggguccagugagcucaugccugcaaaagacuaggccucaugucuggcggcggcaauaguaacuguuccuguuauuaauagggaacucuuuccuucuuccccacucccuaccgcagagcaagcacuugaggauuucagucgccaaaggacaauuccugggccugggguguccccacgggagcccugacacuggguccuacauccucugaguuucagcagcuggccaaagcagggucccuggcugggcggcagacccagggucccacccuccuucccugucugcccccaccugacccaccugccccucggcugggucugauggguccaaguccuuggccuuugccugggaaggggguugggcuguggucugauuguuuugcuaucagagccaggcccagcccagcccuucgauccuggccuccagccuugggaacuaccugccuggcacugcaguccgagguuccaacagaaugcgcugccccuugcccucagaggccgcgguugggagacaccuggagggcucgaguccucccuuucccugcuccugcugggcugggcucugcagggacucagacucggccucuggagguuaguucuggcagaggugagauugcagagaacuccaaaggccauuuaggcagagaauugcaccccagcuuccuccacuaucucaucagcucauccucggcucauucauuccaccugcucauccccccagaacuuucuggcaucaccuccuccuccucugggcaccccccacagugccugugcuucccccuuucugcagagaucaguuucccgggagcucccugaagacaacacuaggucuaauucaucuguguguuucaucucugcuugucuagacauugacauuuacugagagcucuuuacuuuguauuaaaacaauuuuuuguuuguuugguugguguuuuguuuuguuucauugagacagaguuuugcuauugucgcccaggcuggagugcaauggcgugaucucggcucacugcaaccuccaccuccuggguucaagugauucuccugccucagccuccagaguagcugggauuaaaagcgcccacuaucagccaggcacaguggcucacgccuguaaucccagcacuuugagaggccaaggcggguggaucacaaggucaagagaucaagaccauccuggccaacauggugaaaccccgucucuacuaaaaauacaaaaauuagcuggucgugguggcgggcgccuguaaucccagcuacucgggaggcugaggcaggagaaucgcuugaacccgggaggcagagguugcagugagcugaaauugagccacugcacuccagccugggugacagagugagacucuggaaaaaaaaaaaaaaaaggcgcccaccaccaugccuggcuaauuuuuguuuuuuguuuuguuuuguuuugagacggugucucacucugucgcccaggcuggagugcaguggcgcgaucucggcucacugcaagcucugccucccggguucacgccauucuccugccucagccucccgaguagcugggacuccaggcgcccaccaccacacccggcuaauuuuuauauuuuuaguagagacgggguuucaccguguuagccaggauggucucaaucuccugaccucgugauccgcccaccuuggccucccaaagugcugggauuaaaggcaugagccaccgcgcccggccuaauuuuuauauuuuuuaguagagacgggguuucaccauauuggccaggcuagucucaaacuccugaccucaggugauccacccaccucagccucccaaagugcuggguuuacaggcaugagccacugugcugagcugccaaucagcucauuuuuaggagggaagaacuuggcuggggaggggugguguuggccccuccucacagugcaccugcacuccgagucacccuuuuccccagagcaggaguagagguggccuugguccguucauuugcugguuccacacccuucccagccgggacccaaggguccucuccaaccucuggcugucccaauauccagggauaaggggugagccaggaggcuuuuucuuuccuaaggcuguuccucagccucugccgggccuggaaggguugugguaugagcagacagguaugcagacaggugcccuugccuguggcuggcccugccaaguuaacaugcaagggugcgaguaucugggcggcugugugguugcaggugucuuugaggacugcugccuggccuaccacuaccccauugggugggcugugcuccggcgcgccuggacuuaccggauccaggaggugagcgggagcugcaaucugccugcugcgaugugaguggggccgugggggcuggggggguggggugcacacacagccuugcugccagccuacacccuaaccugggcaccccccucugcucaccacagauucuaccuccccaagagacacaggaaggugugugggaaccccaaaagcagggaggugcagagagccaugaagcuccuggaugcucgaaauaagguuuuugcaaagcuccaccacaacacgcagaccuuccaaggugggcaagaccucugcugggcaucuagggggccugcccucccugccugcaagcccaugugugguucagaccccgagggagggaauuggagaccagaauacugacaccugccugaaccccaaacaaagccaguugcuggugaguggggcaccaagugaaugaccaacugauugagucauuguccaguuuuuguuucuggagauggggucuugcucuguugcccaggcuggagugcaguagcaugaucauagcucacugcggccucaaacuuguggguucaagcaauccucccacuucagauuccccaaguagcugggauuacaagugugugccaccaguccagcucuuuuauuauuauuuugagacagagucuuacugugucacccacgcuggagugcaauggcgccaucacagcucacugaagccuugaccucccaggcucaagcaauccuccuaccucagccuccugaguagcugggacuacaggcaugcuccacuaauccagcucauuguuauuuuauuuuuuauuuuuauuuuuugagauggagucuugcugugucauccaggcuggagugcaguggcacgaucucggcucacugcaaccucugccuccugaauucaagcgauucucccgccucagcccccuaaguagcaggagcacaggcccacgccaccacgccuggcuaauuuuuguauuuuuaguagagacgggguuucaccauguuggccaggcuggucucgaacuccugaccucagaugaucugcccgccuuggccucccaaagcacugggauuauaggcaugaaccaccaugccuggcuccagcucauuauuauuauuauuauuuugagacaggguuuuacucuugucacccaggcuggagugcaguggcacaaucacaucucacugcagccuuguguuccugggcucaagcaauccucccacgucagccucccaaguagcugggauuacaggcacacaccaccaugccuggguaauuuuuuauuuucauuuugcagagacagguugugccauguugcccaggcuggacuugaaccccuggacucaagcaauccaccugccuuggccucccaaagugcugggacuacaggcaugagccacugcacccagccaguccagcucuuuuaaucaggacacuuuccacugguacagauggaaagcucaagcacaugggagacucauuggcuuaaauaaccagucaacagcuucaggcucagcuggauccaggagcucaaaggaugauggcagagcucuugcuuauuucucucuccauuucuccagcaggcccucaugcuguaaagaaguugaguucuggaaacuccaaguuaucaucguccaaguuuagcaaucccaucagcagcaguaagaggaaugucucccuccugauaucagcuaauucagguaaggacucuuggucaugugacugucucccauccaucaccuuugcugaggguugagggcucgugauuggcucacacugggacaggagauucaccuccaggacccaggagaggugguugugcggucagugccgcagauucacaggggaggguccucgguggcuguccacugcugugacucagcgcaaagacaccacagcaagugagaaaguaaagccccaggggaguggcccaagagcuccagggccccccaaagccagcaauucuccagcagggaccgggugguuguccuguaauucuacugaauucugacauugugugugugugucucucucuauauauacauauaaaauauauauaaguaaauauauaauauauaaacauauauaauauauaaguaaauauauaauauauaaauauauauaauauauauaaguaaauauauaauauauaaauauauauaauauauaaguaaauauauaauauauaaauauauauaauauauaaguaaauauauaauauauaaauauauauaauauauauaaguaaauauauaauauauaaauauauaauauauauaaguaaauauauuauauauaauauauaaauaauauauaauauauaaauacauauaauauauaaaaauaauauauaauauauaaauauauaauauauaaauaauauauaauauaaaguauauauaauguauaaauaauauauaauauauaaauauauauauuuauuauuauuuuuuuuugagauggagucucacucuguugcccaggcuggagugcaguggcgcgaucuuggcucacugcaagcuccaccuuccggguucacgccauucuccugccucagccucccgaguagcugggacuacaggcgcccgccaccacgcugggcuaauuuuuuguauuuuuaguagagacgggguuucaccauguuagccaggauggucucgaucuccugacuucgugacccacccgccuuggccucccaaagugcuaagauuacaggcgugagccaccgcgcccagccuaaauauauaaauauauaauauaaauauauaaauauauaauauaaauauauaaauauauaauauaaauauauguaauauauaaacauauauguaauauauaaauauauauaauauauaauauauauaauauauauaauguauauauuuauauauaauauauaaauauauauaaauauauauuauauaauauauaauauauauaauauauaauauauauaauauauaaauauauauauuauauauaauuaauauuuuuuuauggcagggucucacucuguugcugaggcuggagugcaguggugccaucucggcucacugcaaccuccgccuccaggguucaggcgauucuugugccucagccacccaaguagcugggauuacaggcaugcaucaccacgucuggcuaauuuucauauauuuauuagagaugggguuucgucauguugcuuaggcuggucucuaacuucuggccucaagcaauucucccaccucggccccccaaagugcugggauugcaggcaugagccacuguguccagcugacauugucuaucuggagguagugacacaauccacagguuaaggacucagucccacaagacugcccccauuucagaugcugguugcaaguagcaaguugucacuuuauuucugacugauugucuguaagucagggcuuccaccucugguuggaucauucgauagaacagcucacaggacucauggaagcgcucuacuuguguuuaccauuuuauuguaaaagauuacaaaggggcugggcaugguggcucacgccuguaauccuagcacuuugagaggcugaggcagaaggaucaauugagcccaggauggccgggcgcgguggcucaugccuguaaucccagcacuuugggaggcggagguggguggaucacgaggucaggagaucgagaccauccaggcuaacauggugaaaccccaacucuacuaaaaauacaaaaaauuagccgggcgugguggcaggcaucuguagucccaguuacucuggaggcugaggcaggagaauggcaugaaccugggaggcgggccuugaaguaagccgagaucaagccacugcacuccagccugggcaaaagagcgagacucugucucuaaauaaauaaauaaauaauaaaaaaauugagcccaggaguuugagaccagccugggaaacauagcgggacccugucucaagaaaaaaaaaaacaaauuuaaauuagcuaguugugguggcaugcaccuguaguuucagcugcuugggaggcugaggugagaggauuacuugagcccaggagguagagguugcagugagcuaugaucauaccauuggaacuucagccugggggacaaaaugagacccugucucgaaaaaagaauaaaaagauauuacaaaggauagggaugaauaagccagauggaagagaugcuuagguaggcaaagacuggaagggacucaaguguagaagcuucuguucccguggaguugcaguacaccaccccucccacacacggauauggucacaagacccugaaccccauaguucaggcuuucuuuuuuucagagaugaggucucacucucuccgccaggcuggagugcaguggcgcaauuguagcucacugccuaauugagcagcuaggacuacauagcucaccgccucagccucccgaguagcugggacugcaggccaguacccucagcuuaccagggauuuuuuuuuuuuugagauggagucuugcucugucacccaggcuggagugcaguggcaugaucucggcucacugcaagcucugccucccggguucacgccauucuccuggcucagccucuggaguagcugggacuacaggcgcccgccaccacgccuggcuaauuuuuuguauuuuuaguagagacgggguuucacuguguuagccaggauggucucgaucuccugacuucaugauccaccagccucagccucccaaagugcugggauuacaggugugagccaccaugcccggccuaauuuuuuuuuuuuuuuuuuuuugagacagagucucacucugucacccagguuggagugcauggugcaaucauagcucacugcaaccucugccuccaggguggguucaggugauucuccuaucucagccuccugaguagcugggaucauaggcaugcaccaccacugccgacuaauuuuuguauuuuuaguagagaugggguuuugccauguugggcaggcuggucuugaacuccugaccucaagugaucugcccaccucaacuguccaaagugcugggauuacaggcgugagccaccacgccuggccuucaccagcaauuuuuuuguuuauuuguuuuuauuuuuaguagagacggcguuucacuauguuggccaggcuggucucaaacuccugaccuugugauccaccugccuuggccucccaaaguucugggaugacaggcgugagccaccaugcccagccaaccagggaauuuuuuagaagcuucaucacauaggagugaaggaugauuaacuccauugccaaccuucuuccccuuccuggagaaugggaccaaaagcuccaaguuucuaaucaauggcuuggucuugcuggugaccagcccccacccagaagccaaccaagagucaccucauuagaauaaaauauguccccauuacccaggacacuccaagggauccagagcucugugucagaaacagaauucaaagaccaaauauuagcacaaaaggccaggugcgguggcucacaccuguaaucccagcacuuugggaggccgaggugggcagaucacaaggucaagagaucaagaccauccuggcuaacacggugaaacccugucucuaaaauacaaaauuagcuacuaaaaauacaaaauacaaaaauacuaaaaauacaaaaauacaaaaaauacaaaaauuagccgggcauggugguacucgccuguaguugcagcuacuagggaggcugaggcaggagaaucgcuugaguccuggaggcggagguugcauugagccgagauugcgccacugcacuccagucuggcgacagagcgagacugucucaaaaaaaaaaaaaaaaaaaaaaguuagcauaaaagauucuagcacuccuauuacucagaaauucacaaggguuuuaggagcuguagggacuggagguagagacaaaugcauauaguuacuauuauuuuacagccgucaauuuuacuucggccucucucauugcuucugcaggacugugagccggcucauuucugggcuccaucggcacaggaggggccggaucuuucuccgauaaaaccgucgcccuacagacccagcuguccccacgccucugucuuuugggucaagucuuaaucccugcaccugaguugguccucccucugcacccccaccaccuccugcccgucuggcaacuggaaagagggaguuggccugauuuuaagccuuuugccgcuccggggaccagcagcaauccugggcagccaguggcucuuguagagaagacuuaggauaccucucucacuuucuguuucuugccguccaccccgggccaugccagugugucccucugggucccuccaaaacucuggucaguucaaggaugccccucccaggcuaugcuuuucuauaacuuuuaaauaaaccuuggggggugauggagucauuccugccuguua

SEQ ID NO: 191832 - RNA, 24853 nt, Homo sapiens
gcauugugggaagggcggccggugcagccgcagcugccaucuuaggggcgccuggcgcuacggguuucucguuggaggcggccuucguggcagcuguagacgccgggaaaaggcauaaaguccguuggccgacaccuuucuuuccuccggccucgguagaaccgccagcccgcguccgaaggcggaggcgaggggaacuggccgcgugaggggccugaggcgagcgguuagagcgucucccggaaggaugggccggucucggagccggagcucgucccgcuccaagcacaccaagagcagcaagcacaacaagaagcgcagccggucccggucgcgaucccgggacaaggagcgcgugcggaagcguuccaaaucucgggaaaguaaacggaaccggcggcgggagucgcggucccguucgcgcuccaccaacacggccgugucccggcgcgagcgggaccgggagcgcgccucguccccgcccgaccgcaucgacaucuucgggcgcacggugagcaagcgcagcagccuggacgagaagcagaagcgagaggaggaggagaagaaagcggaguucgagcggcagcgaaaaaugugagugcccgcgcggggagggaccggggcgugcggagagcagggcgcggggcgagggcguggggccggggcgggacggugcgggccgggagaauggcggggacgguccggggcuggggaccgggcgcgggaacgggucggagaggcggcggcggggcgggcaggcuuggcguuuggaaagcuuggggugggacagacccagaaguuguucgggauggaaaauucgagggcuugagcagaaaggguuuaagagaaggcgauuuuggcgcgagagaggaguggugucccggaaguagggguggaguucggagugaggucggagagcugcguuggcuugugaggccgggagcgagccggccugcagauguggaggguggugagcguuugcuggucggcuugaggaggagagagaagggaauuaaccuuugagaugcgaaucacagcuggccagaagcauucuauugaagcucaaauuugggacaggacuuaacuaaucucgggaaucauacacuuuaggugguccgccagaaaaaugcauuuucacuuuaguguauuccuguuguuaagguguugggauugcuuuuuuccccuugagccuacacccucaccccuuccuugagauguuaaaaaaaaaaagcauagaccuuaaguguacagugcgaugaguuuuuugaccuuugaauucaccuguguaaucaccaucccaaagccuaccgcuuuuuuaacuugcuuucuauuccuguagcaaacacgugcaguuuuguuguuucccuuacacugugcuucuucagaagacacuugaaggguugauuuuauuuuggcguugcucccaugaaggauauuuagugaaaacuagaguuagaguguguuuccgaaaaugucagcucucaaguauuucuggcuaugaaaguagauguggauaaauaaucccaaacuaaaggaauuuuuggguuuuaaaauuuagggauuuguuguguguuuugcuuuaugaucaucguacuuugaugcucuggguauucaguuuccaaaaaccgcauugaaaaguagauuugaacaguccuacuaacucccuauugaaccagccguacuuggucaguucuucagugaauauuuagaaagugcucaugaagcaagaacguuacugaauuuaugauuuucucgaggcgaguauaugugugcugaauugacugcgugguuuguaguuuucuguaguuggguuuguguuagguagauuuuccagcacacacacacagcuuguuucuaaaaccaaaguuacuaaaagguaggacuggagcacuaauauuacagaggaagcuguaccuggagcuguuuugcuuccaacacuccuuuaaaacacaugcaacacucauuuuuccuguacuuagaacugucagugauacauaugaaaacaaaguucaaguaaucguuucaaauuaaaccuugauuuuguagaauacaacuuuugggucugcaacaaggcccuuagcuguaaagaucucaaauagcuaucaacagauggauguaugaaaaguuaccuaagacauugcugagauaauuucuacaugugaaaacaaaggagaccuccaaagaguaauaacuugccuuucacuagaaagcuaagauauguaggaaaaaugaaaagaaacuugguaugcaaagaauaaauagaagcauuuagcagguuucgcauguauagcagacaagaaauucaggaaugaaauacggcaaauagaggagcuauaugguucucugguuugagagaagacacaaacugccaauaguauuuaggagggagaagggaccaggacuagcagccaccuguacucuaaauuccugggugccguacaauaggcauuuuauuuaauauauucuaaugucuuggaaacaaugcaaaagaaacaauggaaagacuuaaguguuggagcuuuggcaguguaaggaaacaguuugcagucuacauauccuguugguuauuuuauucauuuaacugauguuuauugagcauuuaauaagugccaggcacugugcuagguacuguuaauauaaagaugauuggcccuucuccaagagcuugaucuagcucaaagacagaucauuaaauaggcaauaauacaguguaguaaauuuagugacaguaauauaaacuguauaaaggaaguauccuguguggguggaggauauaagaauaugacaaugucaggcaagguauaggacauauguggagcacagaaaagagccuccucccccgacuccugccaaaauagaggaaauggucuuaaaaguggaaugaucaggugacuguugacuuagaacacgaaguucuauaaauauuuaagucauggagugacuggagagguaaauagaggcugggaaucauguuaggguuauuguaugucauauuaaagagcuuggauugcauccuagaaacgggaaggauuuuaagcaggugaaugacauggugccuuuuuuguuuugauuguuguguaggauggaaacuaagagguggguacagaaguuuacacaggaguagugaggaugguuguuggaauggaaaagagggacagauuuaagaaacauucaggguauauuaaauggaaugugggacuucagaaaaagaauguugguucucauguuuauaguguggcuguugcaacucaucuaccaaauguuucaguaacaaccauguggcagguacugguaaaaaugucagaaacuuuuuaaauaguggauaagggagagggaaaggggauaagagaauggugccuucacugugagcacuaguuuuggauauacuguacugaguuuauccagacuugaucaugugagacugaagccuagcugagaggggcuucgcugaaugucgugaaaccuugagaguauauggaaugacccagggagaguguggagagaggagagcgguucauucaagggacugaaagaaccuuaggacaugccuguauuugcaguuaggaagagggagaagagccuaugguggaagcagaaagaaauaugguaaaaaugcauagugucaagugcccuuacaagaaaucuaguuagauggaaagagaccguaaaauaagaaucaaccauuggguuuaacuaauuaggaauucuuugguaagauuggaaaccuuauugguuuaccacuuauaauucugaguugcugaauaaaucaccucccucuaaccuuguuuuuaaaucugugaaauggagauaaucugucuugcuuguugugaaaauuggagaugauguauuuaaaguaggugauacuuggcauguaauagcucucaauaaguaauguuauuuaauguaacuaacuuacauggagccagaccgagccugaugaauuucagaagugaucuuaugaguugucaucuuaaugcugagaagguaggccuuuacauuuuuaaagacuuuugcccucaauuuugaauaggcaguucacaugguucaaaauucaguucaaaagaucuuccucucauccuugcgucccagccauucagugugguucuucucaccccucccccacaccaguagcaccauuuucuuaaaugcucuuuugagaugcugcaugcauguuauauuaacuguugaaaaaauagacaacugaaaauaacuugcagcaaaucaggaaaauguuaauggcauaguaacuuacucuagccugugauaucuagguucgaauauccuccguguucaacuggaugacggauuaagggccuucuaaauuagaguaucuacacugaacugggaucuauauaagugauucuuagaauacuugggcaguucauugugagagcaaagaagagcuuuuaggagaaaauugauuauauggaaccgcauauuuuuggagguuaaggcucugacagaacauuaaggcauaagaccuagcugauguuaagaauauguauucauuuauuuauuuauuauuuuuguagagacagagucacuauguuucccaggcugaucuugaacuccuggccucaaguaauccuucuaccucagccucccaaagugcugggauuacaaaugugagccaccgugccuggccuauacuuuuuucuuccuuuuuuuggucguuaaaucugugugcuugucuuugccuugcuuauuuguccugcagaaaccgguguagggugguaguauagugcuugcuugagaucguuagcuuuggcaucuacuuagguucagagaaacagcucagcaacauccagugugcucgagucuagaaacuucagcuccuuguucuuaguuuccucaguaaaaaugggauacauacccacugcauaggaauaauuaugugauuuaaaugaugacaugguauauaaagcuuuuggcacaauauuauauguuaccuauuaaguaauaaguaaaugcuguuugcuaauaauuauuaagcgauuccuagaaguaaaccccuaggauugaguucccacauuuuaaagauguuuuaaaauaauggugccaguuacucuguaacagugccgaagugcuguagccuuacuguuuuguuuuuaauaguuagcauuuuaaaguucagugugacuagugguuuuuuuuuuuguuuuuuuuuuuuuuuuuugagacagggucuugcucugucgcccaggcuggagugcaguggugcaguggcgcaaucucagcucauucuccugccucagccucccgaguagcugggacugcaggcacccgccaccacacccagcuaauuuuuauuuuuuauuuauuuauuuauuuuuauuuuuaguagagaugggguuucaccguguuagccaggauggucucgaucuccugaccucaugauccaccugccugggccucccaaagugcugggauuacaggcgugagccaccgcgcccagccugacuaguguuuuuaaaauaccugagagcacagagaaaauaggaccuaguauuauaccauuucauugaaaaccuugaagaucuugauuuaaugcuuucgucaguauaacauauuauuggcagggaaauggauauucagcagaggagcaugaggaaaacauuagagaaaagaacaucaugagggugacaacugcuauggcaaggguuuugaggagugaauaggcuguuagaugauaccuauuuugcaagacacugacccacucaagaaaguucagugccucuuaugggaguaggcauaauagugguuuuaucauugauuaugaugauaaauuugccaucaguaaagaugaacucaugcuuaauucaguuguauaugugcucacugguuugcugaauucaguguauggugaggggauaaaauugagcuuuccuucagcauuguuucuaaaauuugauuuaaaauuuuuuucugauuacugaaguagcauuuuuaauuuuaccaagaaaaacagcagaaauuauauucuugcuaacacuugcaggcaaacaguuuugcugugguacccugaacccugccuguugcaaagcuucauuuucauauugggaugccuugcaguuccuccaggaacaaagggagauaagcagcuuugugagaaacugcacuaggucauuucucauucuccaguguuucaguugagcgugggacuuuccacuugcccucccuuugggcuauaaagucgcugagcuguaguuagaauugacuccuuagcagcggagcagcccacggccugccuguacugccuguuacaugggcccucugguuugaugucaucaguggaaauagaagcagggaacugacauucugauuuggcauuugcuguaaguaaauuuauuuggcucauuuucuccuuacugaccaaagcuauggaaaugaggcccuguuagccacugcgcuuuugcugagggauggcuugacugccaaaaauaaccuugaguguguaucaggucucuucugccuucaccaaauucuuaagauggcaacuuuuuacuccuagggccuucuuucuacuuuguguggaauuuuaauuggaacuguguuacauuauccuuuuuuuuaauagucgguacuaugauccaccuaguauuguuaauuaaaagucacauuguaccgguuuugaaauuuuaaauauuaaguuucuucuuaggcuucucuacauuuacuaauuucagaagaaccaacuagcaaaaguguguguguguguguguguguguguguguguguguguacacuuuauuaugagaaauuuacauauucacaaaggcagauuauuauuauuauucuuggguacucauuauccagauucaacaguugucagccuuguuucauugauuaguuuucuuuccuuuugggugaaguagagaaacaacauuuuauauggaaaugugauuuaauuucuauugaaguugcugucugguuuccuuuuauaugcucccagugauugauuuuuuuuaguauuggggaagauaccugcucucucacugagcugcuguagauaaagacuucaaacaacaaaguccugagaaugaguguugggcaaacaucuaggcccuuaaaggaaaauauucuuucucuaguaccuacugucuccuugacagaagaauguagaggauaaauguagaaacugaaaugaaucagauuaagacacauugguguuaguguguuaucacugaauaaguaacaggaguugaaaaugagagcccuugggugagaauugaaucaucccgaagaauagaguugaguugaaguggauugggguauuuaaaggucacuuagaaacuauaaagucuuuacuaaacagauaaauugaaugauucucauauauauggaugucaaaugagugaucaaaagauaaagguugcagguuuuauuuaauuuugagaaaguuggaacaugaaucguccucuuaggauugagauuuacugcaagagccucagaauuuauucauucagcacaaauuauugucucagugcuauuaacuagaaauaguaugaacaauauaugcaauguaaaauuuuuuuaguaaccuuaagaaauggaugaaauuaauuuuauuguauauuuuuauccaaaauaucauuuuaacacgcaaucaaauaaaaauaggagaucauuuauauucuuuuucuucauacuaaauuucaguuuggaccagacacauaugacugguggcugucacugaauaucauugguaugaaaugugcaggauuuccaguggugccuugaugaaugucaguaauuucagcacagaauuuuauuuugaguaaauugguuuauaauaucaaaaugggauuggaguaauuaaaacuguaguaucaugcuuuauugaacuuuuucugguaauaaaaauauauuuuuacccacuuucccauuucuagaggagcuuuuaauugaaaauuaacaaaaggaagaaaagacauaguaaggaacuauaaagcuaaagaacuucaguucaaaacuuaaguuggucauauuuucaguaaaaacuacgcacuauuaguccagcaaucugaaucucuucaaucuguauuuauucucucuuugcuuagcgggaaaucaauucagccaaucugaguugccugcuacauaauuucuccuucucuguagcucagccccagacgaagugauuggcaaaugagcaaauccauauguuuuaacaacuuguccucugauuauaaagucaauaacagaauagguuuucuguccggauuuauuguuccuaaauuagaacuaaugaauuaggcucuuuguauauaccuguucuccuguauuuagaauaugauaaaggaaaaaaagauuuuauacucauuugaauuucuguaucaguuaacaucuugguaucugucauuuccucaaaugugacauggaaaugaauucugaaaaaaucacugaauaauaucaggcucaauggcuugauagacuuaaaacuaguuuuguuuaaauuuauaguuuuaaaaguaaauaccuaacuuguuuuuuucacuuuguuugcuagucgacagcaagaaauagaagaaaaacucaucgaggaagaaacagcacgaagaguagaagaauugguagcaaaaaggguggaggaagaacuggagaaaaggaaggaugaaauugaacgagaaguucuccgaaggguggaggaagccaaacgcaucauggaaaagcaguugcucgaagaacucgagcgacagagacaagcugagcuugccgcacaaaaagcuagagagguaacgcucggucguuuggaaaguagagacaguccauggcaaaacuuucaguguuggguucugccuccugcucaguucagaaagagauggaauacagacuaucuaauuccuuucucgucuaaacuuaacauugcugcgaaaguuaauuuuuuagccuauucagaagugcugacugauaacuuaaaaguuggaagcuuuuauaaaacauauucaaggauacuuuuugauuuaauggaacuggcuauuugagaaguguuugaaacuuuugccauggcugcaggacuuacauucuuuuuugggaggacgguggggagacagggagugguaaagggaaaagguuaaaaauccaccugugguuguauauucuucuauucugucacucuguuaccuagacugugagaggcuuuugccuucagucagauuaaaaagagcagggccuaacauugagugauagcaccugcuuugauaaauagguuuucucacucuucuuuuuuuccuucuuuuaucccucacucccuccccuaaacccugcuucagcacaauggacuaauucuagcauucugaucauaaggcccuccauuuuccuaauguguuucaaggaaucuuuuuaggaaaaauauccagauuauucauccacuuuuuuuaguaucuacuaacaacuccuuuuuuucucuagagaguuaugaaggaacagguuguccuugucuggagucaagcuaaacacaugauuuguuuuaucagcagcuggagcagaaguugaaaaugucuuucugugagacaguaauuugcuacugaagcuuuauggcuuguuugcacugauuacuccaggauccaaaaacuuggugaaagucacugaaacacucaaggcaaauuacuuuacagcccugagugucugucaccauaguuugcauaaugaauaugaaucccauuggugugugauguaggaaauccuguaguuguauuuucuugaacugaaauauuugacucaaaauaauuaagacucauugucauuuuucaucuuggcauuauuguggacaaguugacauauuaaaucucuuugcuuucugguaagcuuagcuuuuaaaaugcauuuucccuuguccugucuuuaacuagauauacaugcuuauauuuauaguggguuucacagacuauaaaauugaauguaugaaauuuuuauuuauaucagugcuuuuaauaaugaagauauuuuuggaguaauggugcugucuuguagcgaguuauuaaucauaguaagauuuuuuucucuucauuugcuuuuuuuguuucauauuaacaauuuuuuuuuuacacggacacaacccucugacagucuuuccaaauauuaaaaucauuugaauauguaugcugugaucugaacacugcucaagccaucaagcagucuucauacaguuugcauuauaaaaucucauuaaauucuccaagaaaaaauaaguugaagaauuuuauuuccugaccaugcauccccuggauuucugaguuucaguucagauuguagaugacaauauaagcugccuuccgaaauugucaacaucugaauguuaaguccauuuuccccauggaagaagcccguaguuccaugaaguauggauuaccauuuguauuuuucacuaacaguaaauguauuuuucuuauuaauuguuugccuuaggaaugaugaauuacauuuuuuguuccuucuuaccauaaacaucugcauuccucagcucagccuuccuuguauguuguuucuuuauaaaugguugagcugcugaugcagguauugccaagcuaacaguacaaaucauuuuaaagaggaagcuggcgcguauggcagccgaggagcacacucugcaggacacuggacaagacaguaaauauucaacuuuuaaugcugauuaaaggaguauagguaaagaauacguagguauacauaauuggugagacaaauauucacuuuauuuauauuuuauauauuauuuuuuuaauuugguaaauacuauccaguuuuguaguuguccuuguugauuugugugauauuaaaguauuaguaauaauugccaggaaacuaucauuagggaggguuuaguugguugcuguuuggacugggagggaugauuuaaauuuagugcuagaaaccaauuuuagugacugcacaguuuaucauuugucagacagaagguagcuauaaagcuacccuguaagucauaucaaaaaaguucagaggaagauuaguaaauauuuaucaauaaaaauaaacauuuuguuuuucuaauaucuuaacauauccuccccuuuaggaggaagaacgugcaaaacgugaggagcuagagcgaauacuggaagagaauaaccgaaaaauugcagaagcacaagccaaacugguaaguguaaagcauacaugaaaaguguuuuguauuuugcuuuauuuccuuuuuucggauuuuguggauugauuuuugugcccuauaauuugacuuauuuuggggggauucucaggacuaacuuuaaaggcuuuuugaggcaaggauaggaacaauugagauuuuuccuuccaaucuggacagaacuccaaaauuugcagugauuuuaaaaaacaaguuuucuggggaaauuauuuuguucucuauccccaguuuuuucuuuccuaaccucauucacauucuccuaugccuaaaaaacuaauagcaacaacaaaagcuuggggguauauuuaaaccaacuauaauaugcagcauuuuacuuuguauuaguuggcuuguuaccaggaguagauaguauuuauuugauaguaagugcaccggaguaauuuccuauuccuaguuuauaaucuuaagaaauacagagucuucgguaauuauauaauauagaaagaugggggugggggaaagcaaguuguaagcuccaguuacaugguauaaagaaauuuugugguuauaaauguacagaaaaauauccaagugggucugaguaguuaacaguggaucccauugagaguagggaugaaggaagaccauaaauaaccuuaauaagaauguaaaaaguuaauacggggcaguuguuucuggaacaucaucuucugaaaaauagaguacucuggauaagagauaaugcuagaaauauuccagauaacuuagugagcauggcacaauggauucuugguaaauaucaccugguauuugugaaggccauaauggaaucuauuggaaagccauaauccgcuuucccgaagaaaaucuuaaaaucugcuaaggcagaaaaagcaauaggaaugugaaauggaugagucauucuaaguuauauugcugcaugcuuaugaauaaguaugugauaacuuuuuuuuuuaguuauucugggauuccauauaaggagagaaccucagugcagauaggaagaagagggaaaguguucaaucugaauuugagguuagaagguugagcuuugaaggguaaauacacucugguuugugaggcauggauguuucagaaaagaagaaaaaaauaugguugacaguuaaaucacugaagcaaaauuacugagcagguggaacuggaccucccauuaggacauguuaaagagauuggauagcugugguggguucauuauguggguggccuggaagcuuggugugcccagccaagaucuugaucccuucugacccugugguagcuagggacggcuuggccuccuugcauucuuacaguccucuauuauuugcccacaugaaaaauaaaaaauaugacuuucggugugugaucacuggaaaaaauauugguagucauaaccuaauacuucucaaaugguaguaaaaguucuguuuuuguuuuuuaaucccaguuugucucagaccucuacuuucgcaaaauacaauuaagaugaauuacuagaaaaaugaggucauauugcuguaaaaacuucuaaaacccuuaauauugauuuguccuuguuggggauugauuaguuuguagauuauaaguggucugugggccaugcuuuacauuagcacuuuucuagaucauacagauuuagauuugaucagagugacacuauucuugcuuuguuuuguuuuugagacggaguuuugcucuuguugcccaggcugaagugcaauggcgcagucucgggucauugcagccuccaccuccuggguggguucaggcuauucuccugccucagccucccgaguagcugagauuacaggcacccaccaccaugcccggcuaauuuuucuguuuuaguagagaugggguuuuaccauguugaucaggcuggucucgaacuccugaccucaggugauccacccgccuuggcuucccaaagugcugggauuacaggugugagccaccgcuccuggcccagagugacacuauucugauggcaugcuugugauaaacuucaguaaaaaacauaucuuagggaaaaagaggcuuggauuugagaaaguugaguaagaauuugaacauauuuaacauguuugcuuauaguguucaauaaaguugggagcguaguaaauugauacuggagaaauuuuuuuuuuuuuucuuuuuuugauggaaucucgcuguguugccuaggcuggagugcaguggcggagucucggcucacugcaacuuccgccuuccagauucaagcaauccuccugccucagccuccugaguagcugggacuacaggugcccaccaccacaccuggcuaauuuuuguguuuuuaguagagacgggguuucaguauguuggccaggcuggucucaaacucuugaccuugugauccacccgcaccguccucccaaagugcugggauuacaggcgugagcuaccgcgcccggccaagaaaaguuuuuuauuugguucuguugguagucauaugcuggcaggaaaaguaggguauucuuuguguaggaggagacaaaaaauguauaaagauggcacgguacacguugaggcccacuuccacuuuuauugccuuuuuccuuccccuuccucucaauuuugagcacuauucuuuaaucuuuauguauguuuauugggaaauauguaaaauacauucaaacuccuauuaaaaguacuugauaccauauaaagcaagaagaaugagaagcauucuggccucuagaaagugaugaaugaugaagggugaucaaagguaacuguuugcuaaaaucuauauugagaaaaacaacuggauggaaaaguagacaagccauuaagugcuuuaaaauaauuuaacauauuuuggaaacaaagacaacuccaaaaaaaguuacuaauaccauggaaauauuugguaagugguauagguaauguaagauaaugacauaguugcccuggguggccucggaaaccuuccuagaagagguagucccuugagcugggcccugauggguagguggaaauucuauuaggagguagacaagagugugaggaaaugaaacagggcaaaggccuuugggguaguagaauaaaacaaaggcuaggguguggaaacuugggauauuggaagaaggagcuauaguaaaguagcagccauccaacuuuauguaugcuaagaaguuuguguggaaaguggauuauagaaaagacaaguugauaaugaaaguaccuuggaaguggggagggagauuucuuaaacauuuuaacugaaaaaauaauacaaugauguuacagaucaguaaagaagacuaacuuccuaauuaaaaaggauauuuguacacaaguaggacaagaagcaacuacaauacauuucugaaaauauaucucaaccucagagaaacaaagaaaugucccccucuuuucuuuuuccuuaauagaaauccccuaaagccauuguuuuucauaguguccuguguuggcggguuauuauacagauaccucuuuaccugaugaucaugagaauuuaaauggguauaacaguuuccaaagacaauuaacaguaaaucaguaaauauaaaaaacuuuaauucugugucuaagaauuuaucucaugagauagaaucauuuacaaaugaauuuauguacaaagauacucucaaauuauuuaaaauagaaauguccaaguuguuggauucauuauuauuacacaguggguuuuucuguagccaaaaaguauuugauaauucaggggaaauacaaaauaggagguagcuaaauacaaaauuuauauauccaauaugauccuuuuauuuugagaaacauauacuugcacauuuuaagagacagaaaaauaagccaaaaugcuaaaaauaguuauccuuaauugguagucuuacguguaacuuuauacuuuucuucaguuucuacaugcuacaaguaauguauaucacuuuuuuuuaucacauagaaauacuaguaaagaaguuaaagucauacuuuugacuuuuaaguagccuuuugugacacaaguucacagauugaaucccguaaugacuaauaaggaauguguuagccuagccacacgagcucauccauaugugaaaaucauuaagugcucuaauccauggguaguuacuguuuuuuucaguuccacauuguguaccaagauauuugguuugucaacagagacaaaaguauuaaccaacaaacauacuuuauuuacaaaguaaaagcauccaaauaugacuugacuuggcuuuuuggcagauuguucuuuguucuugaguuaguguuggcgacacauaacuaucuuuagguauuugaaggguuaauacaauggaaaauuuuaauuuucuuuuguuaaaaauaaugcuuaaaauuuuuugaagucuucaugguguuuuuaugaugugccugggaaaaucucagauacuguucugaaauguauaugaauuuuacuuuuuuggagagggaaacagacuuaaaaauuggggauagauuuugcuauagaauaaaauacucuuccagaagguugugucagcagaaggaagaaacucucaaucuauacccuugucaagauuguaaaauacaaaccguacaaccuggcuagugaaucugguguaaacgccuaaacuauaauaauagauugauagauugauaauuucuaauaaaauuuuagguaacauacuggucaaaggaaggacaaauuacuuuugaugggagauggggguguuugggguuuuaaaguauaugcaaguuauaaauucuagauuuacagaucucuuuacuaaugaaauaguuuucuucucaccccuugccaaguucaucguguuauaccacuuuguaucucaccaguuuguuaucucagcaguuugagagaagaaaagauaugccauguuugaaaguugcuuauauaucaaauguguaccacauacauaaguuugaaauaaaccagaguuugcuuugcgagauggcuuucuuuuaaaugaguuuguaugauaggcugaaaaaucccuucuguccucucuccaugaaaaacaaucuguauucuagugccuggaauuugaaugugcccauauaugacaaggagggcggggcuuuugcagaugugauuaaguaucuugcaauggggaguuuauucuggauuaucuggugggccuuaaaugccaucacauguuuucuuagagaggcagagggaaauuuuagcauauagcacagacaggagaaggaagcuaaguaaagacagaggagagagauuuggaaauguuggcguugaagauugaagugauguaggcugaagccaaggaauccucgcagccaccagaagcuguaagagacaaggagcagacucuccgcuaaagacuccagaaggagaauggacacccuucugacaccuugcuuucagcccagugauacugauuucagacuccuggccuccagaauaaauuuauuuugagcuguuuaguuugugguaauauguuaccuaaaaauguggaagugguuuuggaauuggacaguggguagaggcuccaguuuugagucacaugauagaaaaugcauauguugccuuuaaagacuguuggcaaaaauauggauuuuaaaggugcuucugguuagggcucagaagcaaauuaggaacauauaaacuggagggaaagagauccuuucuauaagugauagaaagcuuggcugaauuguguccuacaguuguauauaaggcagaacuuaaaacuuuuucauauuuagcugagaauucuaaguaaguguugaaguugcagccugguuucuuccuguuuauaguaaaguggcaagaaaagcuaaauugaagaaugaacugauaaguauagaaagaaccaccagcacuggauguugggaauaucucaggcuacucagauggcaaaagguguucacuguuagaaaaacugucucuggaaagaaggccagggguauugcuagacagccuuuuguuuguguggaagaaacuaugcauguaacucauagguucccguacuaucucaguaaaagccagaaauagaugagauuauccaggaaauaucuauggagaacgauguuuaaugaugugacguguaggggaccuccaaaguuucugagaauguugugucagcagaaacugccaacugguacugaaaaagacacaugacacgaugaaggaagguguucagacuccugacagaauccaugcacauaggaaaggugaugugaaaacaaacacagagauuugaggauguugaucuuggagugaaguguccacacaccaagaaaccuuggcagccaccagaagcuggaagaggcagggaacagauucucccauagaaccucuggaggaagugugucccugccaacacuuuugauuuuuguuccagugauacugauuuuggacuucuugacuccauaauaaauuucauccaguugcaguuuguuacaguggccacaggaaaugaacacaguuggaaaaagaacaggguaucuuauaguagagcaagcauuucuauaaguugaaaugguacaauacuuaggaaaaauaaggcaccaaauguaaaugucaaauauuuuaauuugaaaugaaguuuuggguaagucagguaaggauuuucagagagcgagagguuuuuuccugauuguuaagauaaaaagcugguugaagaccuuauguuaauguauuugggacaguaauuuaaaaaauaaauuucuggacaugagugaguguauugacauugugaaggauggguuuguaggacacaaauuggaaacacgaagccacugaaggccagucaaaagauggggccuugaaucaccaaaguagcaguucuuagaaacugugagggagaacuaauaaacuuggugagugaagagguaugaaaaagccgggacgcaggggaaagucuguuguaggaaccagaaaagacacuccugauguaaucauuccuaauaaacucaugccagguaucccuaagcauuuaaggaaaacuuagugcacaaaauagugaaugaccaagacagaagaacuguaaaaagagagaauguaggauacagaagauuaaaagagccacaucuagauaauaccuuuauuugugaaauuuuagaacagaaaguauaaagaaaauuccaaaggcaucugauuuuccuuggcaaaauuauacagcagucucuccagagugcucaggcagugcuuuuuguacauaauauugcauacaaagcucaaucucagucacuuccuccuuuugaaacaguugucuucacuucagguaacauggaauccauggagauauuaucuaagguugaaguuucaaaaaugauuuaagauuauauauaaaugucacaagaggggaauuaagaauaaaaggggguaaagggaguagguggugauaggaauuuagaugguagcuaaugauauccuguaaugaugguuuggcauauuagaaacccuaaggagguaacugugagaauaaauauguugucacagggaugaaggggauccuugcguuuuacccuucuguuauuuaacauuguacauggaauaccucagaaaaauuuacugacguaguuuacuaagugucagaacuaaucguaucaaauauauuuuuuucauuuuuuuauucauugguuaucuaaagugggauauacauuuaaaaaguuauggaagggaagaugaauaaaggaauuaaaauuauaaauggcagaguggaucaggcuguuuaucuuggaagguuuaaaauguagaaaucacauuucugaauaguggcauaguuucuaauugugcuguuuuucauccauuucuauaaucacucuugaaauauuucuauggauuuuuaaaauuuuauaaaguuacauauauuucaaauagagaauagauuucaguaucucugucugcuaaagggacuguugcuaagaacuaccuugauuaaauuuauggacaguuuaagaaggagaaugcuuaggaagguaaucuuuauaaaaucaguagauccucuggguaaagacgguagggcagaggccgggcacaguggcucacgccuguaaucccagcacuuugggaggccagggcaggcggaucacaaggucagaagaucuagaccauccuggcuaacaagaugaaacuccgucucuacuaaaauacuacaaaaaaaggagccgggcguuguggcacgcaccuguagucccagcuacucgggaggcugaggcaggagaaucgcaugaacccgggaggcggagguugcagugagccaagaucgugucauugcacuccagccugggcaacaagagcaagacucugucuaaaaauaaauaaauaaauaaaauagggcagagauuacugggagggguaaguaggccuuuuaacuauaauggaacauuuuuuuguguguguacuucuuaccaccagucacucuuuagcuugggguacaaaguugaaagccaccuuugugagauugaacaggguuaugggcauaauggcuaggagggucugccccaguguauugguucugguauuguggauguuagcuuucuccuuggccuccaagcuguccacuacguaauccuugugagugaguugcuuaguauuacucaucuguauaaauacauauaugcauccccaaccccccaugcaaauacugcuuucuugugcauaaaugugaaacaagcagggaaaggagcaaugguuguauucuccggcaagucaagucaucaggaaagaaaaaguuacuacagagagaggguaggauuuaggaaaauaccuagcaaauaagguauagggucauaccacacuuacaagugguggaugaacaggaaaccagcuuuuaucacuugagagacuauauuaaaaugagagaugacgguuguuaguguuugaauagucuuuuuuuuugucaaaguguaauuaagauuuaugccuaaagccauaguagaacaaaauaccaauauuuguauauagacaguauauucaacuaauuuuuaaaucauugcauuaaauacuucuaguaggcacuguaugccuagcauuggugauuaacauuguugagccguagucccggagaaaaucaacucugcuguacauacauacacaacacacuuuugccuucuguauuuguagaccuaagugaagaaacuugauucuuuacccaaucuaaagugcagaauuaguauuuuaucugaaggaaguugcuuuacuuuaaaaaucuuguuuuuuuaauuaggcaaaaugaucacaugguucaaauuuuguuuuuuuaggaagagaaacagugaagucccuuuaccuuacccccaacccaauccccaauucccaaccccgucuccaaaaguguacucaguuacggguuuuuaaaaucuuuucagaaugucuguaaaagcauauucaggcagauacaaaugcauaauauuuuaauucucccuuuauugcacaaaaguagcauguacacaaggaacuuucuuuuuuucauuuaacaguguaacuuggagauuuuuccauugcggaacauaggggccuccuuuuuuccucuuacuuguuuuuaauggcuauacaauauucuccuuuauauaucuucaguaauuuauuuaguguaccccauauugguggauauuuggguuuuuuucacauucuuuucuuucuauaaacuguguuguaauauguaacccuguaaauauaucaguuucgcaugggugcaaaauuugcacauugcuguacaaguacauaauguaaauuccagaaaauguacuugcuggcauaaaguauuacgaagauguaauuuugauagugugagagugcucuuuauaugauagcauauguguguuaguccauuuuuugcugcucuaacaggguaauuuauaaaaauauuuggcucaggguucuggaagccgggaagccuaagaacauggcacaggcaucccaugagguuuccccaugguggaaggcaucacauggcgagcaagcuagacagagagggcccuagagagagagaaaagugguggccagacucgucuuuuuaucaggagcccauucccaugguaaccaacccacaucccacucggguaauaacagaauuaauccauucaugaggaugaaccccucauggccuaaucacugcuuaaaugccccacaucuuaauacuguuaacaaugccaguuaauucuaacagcgaccuuugggggacauacugaaaccacagcagugugcugucacacuuugaauuucugucuucuaggguaaaaaaugguauauuuguaauguucauuagauuucucuuauggauuaagguugugauguucuuuauguacccucacucuccagggcucuaggaugcuuuccuaggguugaguuagaaccuuagaagaaagugaaucugaguauuuauauugauaaaauguuucuuaggcacacacacacauccaaagaacccuuacuacaucuugauucaguugcacacacuaagcucuuaccccaaauuugugaugauuuauuaaaacuggauaaagugauuggcauaugaauucauuaaugaugaccgauagcaggcaguucuuuuuguuguaauaucagugaaagccuaaggaagagaguggcuauuugaaauagauucugauguacagguaggauuuccauagaaggaaagaauggcaugagcaaaagacgggggaacaagauagaaaggagaauuuagaagaggaguagaaacaaagcuggagccagguuauagaaaaucuugucuuagagaaacauuauacuuuaggaaguuaagcuguaugccauggacaguggauaucauuggcaauuugagaacaagaaagagugagcaguggucaagaaaggugagucuggcaguaucguguaggauggauugaaggacacacuggaaacgggcaccauuuuagauguacaaaagauauguggcccuaaacugaugaagcuggcaaaagaaaugaaaauaaacucuaggcagagaauauaaaacaagaaguaacaaacuugacugaagaaggaagagaugaaauaaagcuauagaauuugaguggcggaagggaaaguguaaagggcagauuuauuuuaaggauaaaguggaagaauuuaaaucuugaaacauguugaauuuugaagcaaguccuaggucucccagguggauguguccaguagccaggucuaaauguagcauaggaaaaagguuuuagagagcuguaucuuaaagauacauuuuagcucucuguuggauuuuccaccaugcucaccugccagauucucucacugcuuguaauucugaucuuuguuaucuccaaccuuacuugacugcgguugauuuguuccaacaccuaucuuuuagucuacgucacauugcugucuaaacuucuuugcguucuucccuuuuugcuacuuaagauaaaaucucaacauuuuuuauugcauaccggaguccuguuaccuuuuccaucuuccucugccauaaaugccuguaaaccagucacuuuacacuuuauuuaaaaaauacauauauaucaauggagacaaaagaaguaauuaguguguggcauuagagaauguaucagaagagagaacguuuuuaaaagacuuaagugaacagaagaauuuauuugaauaaagagaaaaaucacugaauuugauagauuuugaccauacagaagaaaauuuuaguagaauaauggagauggaaucaaugaccuaaaauuugacuuugaaugggaauagguaggcagcucaaaggaugcagcgaauguuuuaagaucacugucagauagaggggaaaaaggauaaaucaugauaacugauauuaaaaaggguuagagcaggcuuucucaauuuuggcacugauuggaucauucuuuguugugggagcugucuuccauauuauaggauguguagcauugucccagucuuccacccacuagaugccaggagccauucccaguuguggcagccagaaucaucuccaugcauugccuaauguccccuuggggaagggauuaaaauugugcuugguugagaauugagaauugaagauguguguaugguaucucuaggaagcaugagaagggccugacuuugguaaagagggggaaaucuguggaagaaugcgggaaagaaguugcuugacauggaaggaguugaaggcacugcaggaguggaaucaguuauaccaguguccuuuugaaauuagauagcacuuuauaguuagucaggucagaagguuuuguaauauuuuucuucagguaauugggucugucguguuucuugguugucuacugauacuauaauauagucccuuuuuuuucagcaugauuugaccacacaaaaagccccaguggagauuuuuuccuauguuucuguuuuuuuguguguguguaugcccuucaacuauaaauauggcaauugguagauaaccugcucuuugaguaaaucuguaccucgguuuauaauuaacaaucuauuaaucugguacaaugaaguuagagauaaaaauagguauagaacaaaaucugucaucucaacaugugauuuguggaaauuaauuuccacuuccaaaauguguaaaugcuuuuccauaauuuguucauuuauuuucauugaaaaugaaagacagaaaauguagauguaauuaauaaaggguucucuuuuaauuuucuuaauucuuuuuucucuaccaaacuaugugaccuucgucagauuuuaugacacaugccauuguguguaaguugucaccucauaacuaaaauauuuugaaggcauguaauucauaggaaguccuuguuuuuacccccuuuuuugcauuugcauuaaaaauuuuuuuguagauacauaauagauaacaccuguugcagggguacauaugauaauuuuuaauacauuucuauaauuaauuuuuacuuuuaacuuucaggccgaagaacaguugagaauuguugaagaacaaagaaagauucaugaggaaaggaugaaacuagaacaagaacgacaacgucaacaaaaagaagaacaaaaaauuauccugggcaaggggaaguccaggccaaaacuguccuucucauuaaaaacccaggauuaaauugcaaacucugaacuuuuuacaaagaaaaauggaaaaacuuuguaugguagcuucauguugaagugguuuuuuguuuuuguuuuuguuuuuuuaauuuguaaaaucuggaaaguuagcuuguucuaauaggggcuaugcucugcaauucccuuuuuuuuuuuuuuuuuccuuccacuaagucaaauccuuaucagaucauuguuguauucuaaggagugacguauuuuucaccuguuuggauucuauauuaguggucugaggaagagcagaucacauuguaaaacuauggauggucugauaaggcuuuuacugaccccacugacuucagaguuauacucuguuugcuacaucauaaugcugguuuugcugacuuuuuguuuuuuuauauauuuauaaaaaaagaaaaaguuggugauugcauugggaaauucccaggguauuacuggaccuaugugguguauuguuaaaccaguguccuugugauacuguugcucuugauguuccugauacagguaaggaaacaguuggucaacucugauacaaaguauauauacaguucaguauugucucuguucauuuuguuuuuauuucauugacaaaaucaaaccagcauuccccauuguguaaauaaaugauuuugcugaauaaaguaaagucuuaaauucauauguugaagcaa

SEQ ID NO: 191833 - RNA, 64724 nt, Homo sapiens
ggcucccgucuccgcccagucguaggcgcuggccgcugacauguugaggacuacgcgcggcccaggccugggccccccgcugcuccaggccgcgcugggccuugggcgggcuggguggcacuggccugcgggccgggcggcgagcggggggcgcgggcgggccuggcugcagcccacgggccgggagacgggugugcagguguacaacagccucaccgggaggaaggaaccccuaaucguggcgcacgccgaagccgccuccuggugggccgcgcgggacuggggcacgggcgggggccgaucguggcggagacuucccacggcugaacgggaucugggcucggggagggcguuuaggaagcugcauggagggcgccguucuagaagcugggggugcgcggugcuuuugcagguuugggugugaauugagcaaguaugaaaaccccggcuauucaucccccagaagugauuacuuuaaaaauuauaugaucauuauaacucagaaucgaauguccuuucuugcaaauauguuccacacgauggauuuuaacuuuguuuccagguauagcuguggaccaacuguauaugaucaugcgcaccuuggccaugcuuggugaguuuccuggauuugaauuuucauacuucaaaggaccauuuauuuuugaaagccuuuugcugauuucuuuuaucucuuaaguggcaacuuagggaugcagaauaauuccuacauuccaggcauugugggaaauguuacaaccucauuugguucuuauagggauucugagcacuuacacccguuuuacaggugaggaaacucagggagacaauggagcacugaaaaaugacccguuuuggaacuagauguuuuuugcuggguuuagugacaucaagaggccuuugcggggucccgggguccugcugaucagucauuccugggccccaccacuucuuagcuucacagcacugagcaggucacuuuauugcuuugaguccugguuucuucaucuuugagaugggaaugauaacuuggaucuuauaacaauuuuaguaaauaaugcccauaaaaugcugcuuaacacuguaccucacaugugagaugucacggggcucaauagugauugaguaacuuuccuaagaugacacauugaagagguauuggaacuggggugaggcuugguuucucugacugcgaagugguugcucucuugaccucuuuaacuguaagauguacugccuccuacauuugccaaaauuaccacuuuuccuaauauuuuguacauuuccaaaauauaauguacaaaaaugacauauuauagauuuuuuaaaacuuaguauuguucaguccuagacuaaaaguaaaaaguuacauuuacucuguauacuuuuuuuuuuucuugagacggagucgcucugucgcccaggcuggagugcaguggugcaaucucggcucacugcaaccucugccucccagguccaguugccgccuccuggcagcaauucuccugccucagccuccggaguagcugggauuacaggcauguaccaccacgcccggcuaauuuuuguauuuuuaguagagacggaguuucaccaugucagccaggcuggucucgaacuccugaccucaaaugauccaccugccuuggccucccaaaguguugggauuacaggcaugaaccaccaugcccggcauacucuguauacuuuaaauauacauuuuuccccuuuacuuugggcuaacauacuuuuaauuaucaaaagcauauuucgacaucuuucuugaauuauaaaauauguuggggaaauauuaaaaacaaaacccccacccuggaaaaccuuuccacaaagguagaagagaaagaaaacaguucuguuacugaauaagccuuaaaccagaaggggaugagcuaaaauaacugcaaagacagaaagaaaucucauccuucuauggagcuuuggggauacagccugucucagucuaugagucugcuguaacaaaauauccuaaaauggaugacuuauaaacaacagaaauuucuuucuuucuggggcuaggaaguccaagaugaaggcaccagcaaauuuggugucuguugagggucugccugcuguguccucacaugguagaagguagagggaauucucugaggucucuucuaugagggcauuaaccccagucaugagcucucugccuccaugacuuugucacucccagaggcuccaccuccuaaaaccgucaccuugggaguuaggguuucaaccaugaauuuggagggaagacaaacauucagaccauagcauaacccauugcuucaggugaguuacaguguggagucagaugacaagguaggcccaucuccucccaggacacugggaaacggggcguuauuuuccuugauuacauuucagaggugggucccagguuuugaaauuuucuugaguuguaaaacugccaagagguuuauuuagccauuuaaaagauugacaugcauuugaagaggacugaggaagaaauccuaaaaguuguuggggagagaaucucuucucauuuccaacuaggagagucaagucuugcaguuuaaauuuguauaauauuuaccuuuaugacuacagaaaagaauacacaucuuaagugcgcagcugaaugcauguuauaagcuguguccacacagggccuucccaggggcuggugggagcuugggacucuccuguugaccaccuuccugucagccuggccaaccccuccaggccuuugcugggcuggccugccccaccucccucuccccaucucagcucuccuagcauuguacuccuucagugguuauuuaugcaaccaucugaugucguuagcaugauguaauuauuucagcuccagcaggacagggaugcacacagugccugcugcagaaagguagaauuugagcaauggguagcacucaguucacuggaaagagacacccugaaaaauagccuccaccauuuccagaagaggucagagggauggaaacccuguuuggggaaaacaaauagaucaguuuggugcuaggggggaggagcaggggaagggauggggcgucaguugcagccagacuggggagggugcugcguggucuggcccagagaguuuggauuucaugccaugguagacggagucacacuggagcguuuugagggaagacucuuagcaaaugaaucauuucagcgaucacccagaugagcacacucacccaguggauggagaaaauggggcagaaagagccgggcugacgguagcaugguucaugguggagucacagaagcaagcugaggucuccugaugccauguucuucagacuuggcugcccggcacuugcaaggcgugugugugcguguuuguguauagaguggccccuguggucacagccugccugcagcgucucagggucucaaauugcucaugacccugcauuccgccagcucugccaagcuguggagccucugcugucuccaagggcaguuccgggacucagccugggcuccucugggccaagcaagggacuugacucuuguuuucauuugcuuuagguuccuguaauuuuuuucuuguaaaucucacaucuuuuagacucuuucccaacuugaggugaaugaaggagcauggugaugagaaugguaauaauagcuuguguuuuuagaauucaugcugcacaggcgguaaggcuggacagcaguccuguuagguggugggauuuugccaaauuuauaagcaagccgacugagcuguaagagguuaauuaucuuguugaguuuuggagauaguuuugucccuggaaucaagauuuggucucagcuguguuuggagagggagggggugugugggagguuaaagugauacaauaacauggcuaggauucccccacaccacccuaagagaaaacaauuuuacgaacugaaauuuaggccacauggauagcagaggugagugugacauuagauaaccuugaguuuuaagguaacuuuuaugggaaaacagauucuugagaugcuaaguagauuuuaaacccuuuuaguuuuacaagucugaauuaccccaguguaguauauaaauaagcuggcauuuuuaaauauucuacacuagugugugcauucuuaggaguaaucuuauauggcuuuaaugggaucguacuuguuuugauuugguauuugcuucuguuuugucauagugaaaaauuagaauuacucuagaacaugaacaagaauggugaaaacacgaucuuaacugagagauuguauuaugagugaauuuuuauacaauuaaauagacuucaacucacuuaagcaacaacuccaaaauuaaaaaugcuaauauuguguccugaaauugaugcaauaccuuugucaguuucuccugagaacccuuguggcgcaggcccuggugccaucagugagagggaguuuccuuguaccugcuccgcugaccuguccauugugcuacacaguagaaguuauggagcagcauguuaaaauguaauggauuuuuuacaaagauaacugaugacuuuguguaauaaagacauccugacacuuuuuuucuuucagcucauauguuagauuugauaucauucgaaggauccuaaccaagguuuuuggaugcagcauagucauggugauggguauuacagauguagaugauaaaaucaucaaaagagccaaugagguaaguggagaagaguuacaucuauugauaaugccauugauuaguguucugagcccuuccugaaagugguucuuggccgggcgugguagcuuacgccuguaaucccagcacuuugggaggccaagacagguggaucacuugaggucaggaguuugaggccagccugacaaacauggugaaaccuugucuguacuaaaaauacaaaaauuagucaggugugguggcgggcuccuguaaucccagcuccucaggaggcucaggcaggagaaucgcuugacccugggggggcgaagguugcaaugagcggagauugugccacugcacuccaaccugggucauggagacucugucucaaaaaaaaaaagaaaaaagaaagugguucuuguuugcauuuuacaaguaguucucacaucuuauuguccauguguggccaguggguguaaucugagacaugaaacagugcuggguuagcaggguuucuuuggugcccuaguaaaggaaguuaacaucuaucguauugugaucgcugaaggcuuuucuguggccucgugucguuaccuccuucuguggucgucuccuggcuccaaucuuacucccuccccuggccccucggccuccaagggaaaugacuugacuuucucuuuacugagggaaccagacccacugauuggacguauucauauuugugcuaaugaugccuuucaugucugugucuugauaguuuaaaaaguacuuuuuguaucuauuaguauuucagucucagaacaacccugugugcugcgcagagcagaccuuauugugcuuuuuuuaacacauuuuauuccauauuaaaaaauuauuugaagcgauuugagaucuacagaaaaaugacaagaauaguacaaagaucuccugcagccacccuggguuuccucguggccauuguuggcugcguugggccaucaucuucucucuguucuagacuuuucccaccaggccgccuccccucucugcacacgccacgcgugccuucagagcaaggucacuggcucucgaggcccgcacagcccucccagucaggaaccggacauugaugcagugcgcuggugugggugacauggacgucaaccccagguguugucccuguccccgagcgccucuuucuuuucuguucuagaaccccuuccagaguccuguugucuccucggucuccuucagucuucaguaguucccugucucauguccuugacacugucaaggauuguaggacuuugauuuuguaagguggcccuccacucagguucauuggauguguccccaucuugcagaagagucaagagguuaaggugaucacaucuugagguugcacagaccuucaggggcagggccacucccacagcucugacuucagcuaucucugggcaaguaccccugccaggugggaauggccugcgcacuuguggcggguagcagaagucucuuucccgugcaggcugagggccccacuggagucuggcccacaccuggaguguggugccuggcaagcuuugggaagacacaguggaugagguuguacaggcaggugggacauuggaggcgccuccucgggcucucccuguuggcugggggccagugccccgcacaucacuucuaccggaagggcuuugguggguccuuugacuuuaacugcuggugaggaagacuuuuccuaaagaagccauucugaugaaacgcugucacucuuugccccacaugcugucuugugucggcuuucuccauugcgggugcuuccucuaaucaccauucucucuggacauuuuugcccauuuucacaauucacugugguuuagcauacaagacagucuauucauuuguguguuaguuaggaugacuggcuauuuccuuuuccugaaucugaugaaggaauuuaaguaaagcugaccuaauuuugauguagacgagauguagucuugugauacuuugccaguuaccacugcuuuuaccagcauguguuacaguggaaauguucuaacauacaugaaguagagagaagagcauaugaacccaugcaccugucaccggcguccauggucagcaccuguuccaccccuguucucucugcuuuuuguggagaccaccuguggauuguccaguggugggcugcuguuuggcaguuugacccuccaagagcauuagacgguguuugucuuagucuguuuugugcugcuguaacagaacaccacagguuggguaauuuauaaugaauagaaacguauuugcucacuaugcuggaggcuggaaaccaagaucaaggugccagcaucuggcaagggcccucuuacugcaucaucccaugguggagggcaagaggucaaggggagagaaagaagcccugccaaaagcccccugcccccaccccuccuuggguuuuuuuuucuuuuuuuuuggagacagggucacacugugucgccuaggcuggagugcagugguguggucauaguucagugcagccuugaucuccugggcucaagcuguucucccaccucagcccuccugguagcugggacucagcugugcaccaccacacaugacuaauuuuuuucuuuuuucuauuuuuaguagagaugcgguuucacuauguugcccaggcuggucucaaacuccugagcucaagcaauccuccugccucggccucccaaagugcuaggauuacaggugugagccacugcaccuggccggaaagcccuuuuaagaaggcaugaagcccauccaagaggguggggcccucacggccuaaucacuucuucaaguucucaccucuuaauacuguuacaagggcaaauaaauuucaacaugaguuuuggaggggacaaacauucaaaccauagcaguguuucuggugcuuuuuaaaaaaaacuugcuggauuuuuuuuuuuuugagacagaauuucacucuuguugcacaggcuggagugcaauggugcuaucuccgcucacugcaaccuccacaucccggggucaggcgauucuccugccucagccucccgaguagcugggauuacagacacccaccaccaugccuggcuaauuuuuguauuuuuaguagagacgggguuucaccacguuggccaggcuggucucgaacuccugaucucaggugauccgcccuccucggccucccaaagugcuaggauuacaggugugagccaccacgccuggccuggauuucuuuuuuugaaaaaaaaauauacauauacauacuuuuuaagucagugagauuugaauuauagcauuugucugucauuguggcuucccuuccucuuuaaccucccgucacacccaugcaucuuccuuuugugaaaugggguggaacuagugacuaaagauuuggauuggaagucagaggccgccuuugggcuggggcguuuaucugaaaagaggcugaacuuugucauuuguugagugaacagagcucuucucuugucucuuaggcaugagucaaaggaauggugugagguccuugaggaacauuuucacugaggucucugucuuccuauuuucuauugauuugucuuucucauaacuggguagucucccaccgcauggggcuguuuagcaguucuagccuuuucccaauugcuguuuguauugcuucuggcuguuaaaaagagugcugcuaugaacauauaugcuuuuguuuuguuuacuuauaaauauauuuccuguggcugggugcaguggcucacgccuguaauccuauacuuuggaaggcuggaucacuuaagcccaggaguuagagaccagucuggccaacauggcaaaacgcugucucuacuaaaacacaaaaaauuagcuggguguggaggugugcaccuguaaucccagcuacucgagaggcugagacacgagaaguacuugaacccgggagguggagguugcagugagcugagaucgugccacugcacuccagccugggccacagggugagacucugucucuaaauaaaaaguuaauuaauuuccaaagcggaauugcuaggucaaagggggaacaguuuauuugauaucuugcaacugagagucagaucauugagagacuggcagugcuggaaaucggcucccacuuuaaauguauuucuucacauccuuacccccagccuauaagaggcaggauuuagaaggcaggugcgugaugucuaaggcugugcgugaaugucuagucaccagguaacccucagcagaggugguguuuggaaaugccccacugguaaagaaggaaggucagugguucggggcuuucaccugccgucggggcagccagagccugaaaugaaagcacuugguagcuucgugccucucaugaaucuucaagaucagaaagaauugugucaguccccauguccugguggcagggagcugguagaggcugagacacuggcugaguucuggagggagccccaugggacagagaaagggccccgcaggggaugggaggagaggugaggacacaguguacuuggagggugucaugggggcgauggggaagguggggcaggaacguugccaucagagaagcgggacaagagccccgaauccagggagcagagaacugcaggaaggaggagguggccagcgugguaaagggaggaagaagcaagaguuaauuucacagaugccacaaggagggauugguuguuaacuuuuuuaaaaauguuaugauuagaauaugaaaaacuugguagaauugguuaaacauucuaacuguagagaguaguuaauuuuugaaccagagaauuuccauacuugguacacagcaagauccuaagaugguauugaauaguuucuuuccucaaaauaaugucugacuucaauguaauaaaacauguaucugaaacccauaguuaugaaaacaucuguuuuuuaguauuuagugaaaagguaauucuuuaagaaaugcaaaucaaaaccacagugagauaacaucucaugccaguuagaauggcgaucauuaaaaagucaggaaacaacagaugcuggcgaggauguggagaaauaggaacgcuuuuacacuguuggugggaguguaaauuaguucaaccauuguggaagacaguguugcgauuccucaaggaucuagaaccagaaauaccauuuaacccagcaaucccauuacuggguauauacccaaaggauuauaaaucauucuacuauaaagacacauacacacguauguuuauugcagcacuguccacaauagcaaagacuuggaaccaacccagaugcccaucagugauagacuggaugaagaaaauguggcacauggaauacugugcagccauagaaaaggauggguucaugucuucugcagggacacgggugaagcuggaaaccaucauuuucagcaaacuaacacaggaacagaaaaccgaacaccgcaugguucucacucauaagugggaguugaacaaugagagcacauggacacagggaggggaacaucacacacccggcgccugucagggguuggggggcuaggggagggauaguauuaggagaaauaccuaauguagaugacggguugaugggugcagcaaaccaccauggcacguguauaccuguguaacaaaccugcacuuucuguacaugugucccagaacuuaaaguauaauuuaaaaaaaaaaaaagguaauucuuuuuauccaauguaaacuuuuuugaagguaaaauuaaaacuuuuauuuuucuucuuuaccuuuuuuauaauauaaaauuuacgauuuuaaacauuuuuaaaugugcaauucaguggcauuaaguacauuuacagcauuaaauggugcauaauuccucaagguucauccaccugcagccugugccggaaguuccuuccuuuuuauggcugaauaaugucacauugcauguacacucuccuugcugucuaucuucugaauauauaugcuuuuguuuugguuccaggacccccuccccacauaccaaaauccuuggaugcucgagucccugauauaaaauauauuugcacuuaaucuaugcacaucuucccauauacuuuaaaucauaucuagauuacuuuuaauaacuaauacaauguaaaugcucuauaaauaguaguacuauauuuuuuaaaaauuuguauuauuuuuuauuauuuauuuaguuuuaagauagggucucacucuguuacccaggcuggggugcaguggcauaaucacggcucacuacagccucacccucccaggcucagggauccucccacuucagccuccagaguagcggggaccacaggcaugugucaccaugcccaguuaauuuuuguauuuuuugaagagacagggccuucuaaguugcucaggcuggucucuaauuccugggcucaagcaacccuccugccuuggccucgcaaagugcugggauuacaggcaugagucacugugccuggcauuauuucuuaauauuuucuauaugagaucgauugaacccacagaugcagaacccuaggauacagagagccgacugugcugcguuuucuuuacccauauucuuccaccguuggacauuggguuucuucucaugcaagcuuuuaaaaugauaacaauaucuuucgugccaucugcuccaagacuuguuuuuaaaauauuuuaaauuauaauaauacacuuuccugagucacucccuugacuuuaauuuuuggcaccauuuuauagguugucagagauggaaagcacagguuuuaaacaaaucugggguaagaauuaaaagagguaggauauauucacauaguaacauuuuguuuuguuuuuguuuugagacagggucucacuuugucauccaggcuggagugcaauggugggaucucagcccagcgcaaccuccgccucccaggcucaagcgauuuuccugccucagccucccgaguaccugggacuacaggcguacaccacuacgcccagcuaauuuuuguauuuuuaguagagaugggguuucaccauauuggccaggcuggucucaaacuccugaccucaggugauccagcugccucagccucccaagugcugggauuacaggcgugagcuaccacggccagccaguaacauuuuauauuaagaaaaaucauuaagccaggcacgguggcucacgccuguaaucccagcacuuugggaggccgaggugggaggaucaccugaggucaggaguuugagaccagccuaaccaccguggagaaaccuugucucuacuaaaaauacagaauuagcugggcaugguggugcaugccuguaaucccagcuacucaggagcugaggcaagaaaaucacuuaaaccugggaggcagagguugcggugagcugagaucgcaccauugcacuccagccugggcaacaagagcaaaacuacaucucaaaaaauaaaaaacaaaacaaaaaaaccgaaaaauuauuauauaugucuccaaguaauucaagccaaaguuucucuuuuugugugccgggacacuggccugcaucacccuggcuuucuggaagaaggugaaauguugaggaagggcuggacacagggcccagccagcgggcuccuguccuggagagauagcuaacuuaaaaugauuuacgaucguuagagcuaccugagagaauccgaaauaggacuaggaccccauuuuagcgccuuucuaccucgucuauuuguuuuauggcagugagaaagcagcacuaccccgguaugaggaaugaucauauguuucagguuaaauguagcaagcaguuugacuuuuagaauaugaguuuccagccggacacgguggcucacgccuguaaucccagcauuuugggaggcuaaggcagguggaucacgaggucaggagaucgagaccauucuggcuaacacgguaaaaccccgugucuacuaaaaauacaaaaaauuagccgggcgugguggcgggcaccuguagucccagcuacucgggaggcugaggcaggagaauggcgugaaccuggguggcagagcuuacagugagccgagauugcgccacugcacuccagccugggcgacagagcgagacugccucaaaaaaaaagaauguaaguuuucucuccccagcaccagcagcaguagguggguauuccacuuacaacuccuugucauuguagcauuugugagccauguccuccaggacugggccguuggugcuggugcagccacgugcagagaagggaguauuggguguuugggguguauucuaccugaugagccuuuaaagugugugugcuuguguguuuauauguugucucuuucugaacuagauaaauuaauucuuuuuuuuuuuuuuuuuuuuuuugagacagagucucgcucugucacccaggcuggagugcaguggugcaaucucugcccacugcaaccuccgccucccgaguucaagcgauucuccugccucagccucccaaauggcugggauuacaggcgcccaccaccacacccagcuaauuuuuguauuuuuaguagagaugggguuucaccauguuggucagacuggucucgaacuccugaccucaugaucugcccaccuuguccucccaaagugcuggcauuacagaugugagccacagcgcccagccaauuaauuccuuuuuugagacagaguuucacgcuguugcccaagcuggagugugguggcacagucuuggacauugcagccuccaucucccaggcuuaagugauccuccugccucagccucccaaguaguugggacuacagguauaugccaccacgccuggcuaauuguuuuguauuuuuuguagagacaggguuuugccagguugcucaggccggccuagauaaauuaauucuaaaguucauauagaacagcaaaaaaaaaaaaaaaaggaagaauaggaaaagucuauaaaagaugaauauugagagggacuagcccuaucaaauaugaaaacuuuuauuuauuaauuuuuuuuuuugagacggaguuuugcucuugauguccaggcuggagugcaauggcacaaucucagcucaccgcaaccuccgccucccggguucaggcgauucuccugccucagccucccgaguagccaggauuacagacaugugccaccacgcccaucuaauuuucuguauuuuuaguagagacgggguuucuccauguuggccaggcuggucuugaacucccggccucaggugauccacccaccucagccucccaaagugcugggauuacaggugugagccacugcgcccggccaccaaauaugaaaacauuuuaaaagcuauagaagguuuuuguuuucucauauauauguauauauauguguguguauauauauauauguauauauguguguguauauauauguauguguguauauauauauguauauguguauauauauauauguguguguguguauauauauauauauauauauuuuuuuuuuuuuuuuucugcacagcuuuaugugguaggauugaccuacaauagauugcauguauuauucaggaaggugcaguuugccaaauguugaccuagggaugccccuguggaugcauccgucaccccugugucugugccccucgggacuccucccugcacccccuaacccucugguguccaagcaucugcugaucuguuaucuguggcuuuaaagccugcagaaauuaaacaccuguacaaagcacgcauaaacagaugauggaauacaccaaaaaguccagaaacagcccugauaaucaaugggaguuuguuuuaugauaaaagauggcauuucaaaucaguaggggugggagguagaguguuggcagcuaggggucaucuggagaaaaacauaagccagagguagauagaggcgucauagccgcauucaaggcaggucagagauuuaaauauaaaagagaccccaaggcaaauuugauagccucauacuggggaggcuuuguaaguuuguuuccaaauccagaagccauuuaugagaaaagauucagaaauaugaaagauugcuaaguauaaaaaugacaguuuuuacauuucaugaaacaaccauaaaguugaaaaacuguggaaaaauggaaauuauaucagcgauaaaagguuaauuucuuuaauauaaaaauacuuccggccuggcacggugacucacaucuguaaucccagcacuucaggaggccgaggaagguggaucaccugaggucaggaguucgagaccagccuggccaacaaggaaaaaccccaucuuuacuaaaaauacaaaaauuagccaugcaugguggcgugugccuguagucccagcuacuugggaggcugagacaggagcaucgcuugagcccgggaggcggagguugcagugagcugagauugugccauugcacuccagcguggacaacaagaacaaaacucugucucaaaagaaaaaaaagaaaagaauuccuaacauccaauaagaaaaagaccuauaccacucaauagaaacacagguguggauaacuacaggucauuuaaugcagauaguuccuaaacaugggagauguucagauuuacucaaaagagguaaaagcuuaaagagcaaagcacuugucagcugucacacugacaccaugugaaaguuggcugacccugcaggugagggcagaggaagacagacaccuccagguguugcuggucggguguagcuggcacagcuuuccuggaaggcagcuugcaggagcggccaaguccaugagccugugcccucugucuccugccuacgaguguagcucacaggcacacuugggcugcugcaaagugaccugugcacaguuguguuuguaguggugaggaugggaugugcaucgggacaggaccggguaagcacguagcgacacaucuggaagggggaguagaggccaccuugaaaggagcgaggcagcucaguguguccagcaugauggacccccaggauucugugugcugcgagggagagaagcuagcagcacagagcagaguguggaaugggcugcauuuggggauuccaagaaaaagaugcaaauguauauauauaaccacguucaugcuugugggaaaacuggucgcuguauuuuccuucugggaggaaagccaagucugggcaccccuucaugccauuugacuucuccuggcaauaaauuaccucugcagaaaaauauagauuaagcaaccugcugaucuuuauuauuuuauuuuuuauuuuuuugagacaggaucucgcucugucgcccagucuagagugcaguagggcaguguuggcucacugcaaccuccaguuccuggguucaagcgauucuccugccucagccuccugaguagcugggauuacaggcgccugccaccacgcucagcugauuuuuuguauuuucaguagcaacgggguuucaccauguuagccaggauggucuagaucuccugaccucaugaucugcccacgucggccucccaaagugugaggauuacaggcgugagccaccgcgcccggccaccccacugaucuuuaggcccaaaauugcauggaauuugagacuuccgggggagucugaagcggcaagaagacacaguacuuuuggguuuuuuccuuuggucuuuuguccccuggauagacauacauuaacugauuuauuguuguaaaggucugcuuugccacaaaacuguaccgcaggagaggggcugaaguguauuggaguaccagcuaugugcuaggugcuguguauuuucucucuuuaaugugauauuuauguaauguuuucuuuuacaaagcuguccugcccguauauacacagugguucuucuagcagucuaagggauuacuagguagaauaucuccaugcuguaaaguaacugaaggccaagagguuugauuauugauuugcccaagaccccaaagcuuaaacaacaccuggguagcaacgcauaguucaccagcuugcuuucuucaguggguauucuuugguggggcuuucuggguugacuaugccauucagagcccugggucucagggucacaugguugggaccuggccccacguguggcguugcgcuugagaaaguuucucaguauucuagagugguaauuccuucaccugugaaauggggagacuugguucccgaggcugcguggagcagcucggagagacuagcagguggcaggugcugugcuugggaggcccaaaggccauuugagcaggaccagcaguuaugaugcccggcuccauuccagagcuucacagugucuugugcaucuguucauguagaguuuuucauugaaauuaugaaauaacaugagcgaaccuagucuugugucucagccuccuuggauaauguggcaggggcugcagaugcgugcccccaaggcccccacauuuggaauugauuggacuguuuugauggucuaucuccagaaacccagccaugggacccgagggaaugaguacuccauuaaaucccaguuguaguguguuaaauuacuuucaaaauauuucuuuagaaguuccuuuuugaucuuucuuuuuuguuuguuuuggaagagagucuugcucugucgcccaggcuggagugcaguggcaccuucuuggcugacugcaaccuccgccuccugaguucaagugauucuccugccucagccaccugagucucugggauuacaggugugcaccaccaugccuggcuaacuuuuguauuuuaaguagagacgggguuucaccguguuggccaggcuggucucaaacucccggccucaugucauccaccugccuuagucucccaaagugcugggauuuauagcuaugacccacaacacccagccuccucuuuaguauauuuuugacuauuuuuuuuuucuccugaggauuaagggauaagauaggaaccuaguuucuuaucauacagacuggacuagggugauuuugcccuugucuuagaaaaguggaggauccuugguauguuuuguuuucuauuuuacuuuauuuuuauuuuuguuucggagauggugucucguccuguugccaaggaugggauugcaguggcacgaucauggcuguucgcagcuucaaccucauggucucaaacgauccacucaucuuggccucccaaaguguugggauuacaggcgugagccgcugcacccagcugguuuguuuuuuacuauauaauggaaauugugacauuauuucuucucuaaccagaagacaaggucaauaagccuuuuuuucuagcuaagcuacuaguaaaaguucaguaccuaaaaugagugcccccgcuuuggugagugggugggggcaaacugaggccgaggcaccggagguggccgggguauguuugcugucguguugugcacgugggcuuucuuguggcugggugguucuguugcgaaugccccagacucauuaacgugcacaucuaauccuucugcagaugaauauuucccccgcuucccucgccagucuuuaugaggaagacuucaagcaggacauggcagcccugaagguaaaguguggggcugguuguuccugccaugagggugacaggcgugagcaaugacagcuggugcuggcugaccugugcuucucacgagggaaacacggucacgucuccacuuccuugcagguucucccacccacgguguaccugaggguaaccgaaaauauuccucagauaauuucuuucauugaaggaaucauugcucgugggaacgcuuauucaacggcaaaagguaggguuuauguucuuuuuuuuuuuuucuuuuuuuuuuuuugagacagaguuuuacucugucacccaggcuggagugcaguggugcuaucucagcucacugcaaccucugccucccugguucaagcgauucucccgucucagccuccugaauagcugggacuacaaggugcgugccaccaugcccggcuacauuuuuuuuguuuugguauuuuuaguagagauaagguuucaccauguuggccaagcuggucucaaacuccugaccuugugauccaccugccucagccucccaaagugcugggauuacaggcgugagccacugugcccagccgguuuauguucuuaaaacuaaaacauuacugggauuuggagaaacuggauguauuuaucagcuguaggaacauacuaaaauuuacuucugucuugcuaggauuccaacagcaaagcuguugugggguuuucuacaauauugugucucuuugcgaaaugguugaauuaguucuaaauaucuuuuccagggagaggggaacgucuggacagcuagucuugguaacagucguggaaucuaggugguagguguacagguguucauugugguguuauuucaucuuuguuuagguauuuuccuaacaaaaaguuggggacaaacacaguaccuccagagaccugcucucuucuuauuaaaagucagcccaggucacccccgucuguuuggcuaucguuuuuucacaggccauuacgagugaguugcgggagucagagguugcagugagccgagaucacaccauugcacuccagccuggugacagagcaagacuccguccacccacccuccccugcacaaaaaacaaaaaguugcagggccaggcaugguggcugaugccuguaaucccaguacuuugggagguggaagcggguggaucacuugaggccaagaauuugagaccagccuggguaacauguuaaaaccuucuuucuacuaagaugacaaaaaaucagccaggccugguaucgcgcgccuguggucccagcuauucuggaggcugaggcaugagaauugcuugcacccaggaggcauaguuugcagugagccgagaucacaccauuguacuccagccugggugacauugccagacugucucaaaaaauaaaaauaaaaaagugaguugcagggcugggcgugguggcugauaccuauaaucccagcacuuugggaggcagaggcagguggaucacuugaguccaggaguucaggaccagccugggcaacauggagagaccccuucucuacaaaaauaaaauauaaaaauuagcuaggcaugguggcgugcuccuguagucucagcuacucaggaggccgaggugagaggauagauugagcccaggaaauucgaggcugcagugaaccaugauugucccacugcacaccagccugggagacagagcgagaccuugucucaaaaaaaaaaaaaaaaagcgugaguugcagauguucugucgcaucagccaugacacuucaacaugcaucucugcauaaaaggaguccagaugucauggucagaccucagacaaugaagaauuucuggcuagcuucgcguguccucucuguauuaaauauacucacuuguccccagggcaugugcugcgugugcauuuguugguuuagucuccucacuuuuuccccuccucuuucuuuuuuucuuuuuuucucuuuuuuuuuuuuuuucauuuuuucuggguaagcacauguagauucaagacucugacaggucaguuuuccuguggagcagucuguguuuagauuugcauguugcuuacugcaggugguuucauugguuugcggaugcuaaucuuugucugguggaccccaggcaaggcuggcgucuugcuguuuugcugcuuuggugaugaagcaucgccauaaauccgaacuaaaucccacccauccuggcugcaaacccugaccacagccucaucucuccaugaaguucuccuucacccagcacaguugaaagugaacuuacuuucucagccuugauaucucugcuguaccauuuggcagccaguucugcacugccauaguuugcuguuuaauguauucauauuuuguccccaucuagaucauaaauucucagaccauaaaaaccuuuugcuuuacugaaugacgccuuaaaguauccagccgacggcugaagauacguagguauugaauguuuguugcaaugagucagaaagcaugaagcacugcccuggacguuccuguccuuccuggguccuacuuggagcguaagaugagcacgugaggcccugaggaucugcucaguaggcucuguguauggaaguagcuuuuuacuuguucuaaugugguauauuuagauuuuguuucaaagaaaaacuuuuuuuuuuuuugagacagagucuugcucugucgccuaggcuggagugcaguggcacaaucuuggcucacagcaaccuccgccucccggguucaagcaauucuccugccucagccucccaggaaaaacuuuuuuuaaaggacuuaggugguugaauuagaguuugcaccagaaaacacaggaauuaauuuuuugcugucguguaacuugaaauaagauaugugggccugugcuuccauuuuaggaauaaagugauaaauguucacgagucuuuagggauucucgucuucacaggcuugaggauugaaugcuguuuguuguuuuguuacuguguuuuauuauaaacaauuuaaugauaguauaaauauaauuaauucaaaauacacuuacauucaaucaaaccccaguaauuuggacuuuguuacaauuccacaagggcuugguuguaauuugaucuuugaacucuuggugaaaaacaauuucuucagcaaauugauaacauaaagcaaagugaagggggaauguuuccaccauuuaagggagugguuucucuccagugaagcgcuuuuaaagcacuguuuauauucugacuucauagaaagcagcucccagggccuggaugucccccuccuguccucugguucauccccagcaccgagugccagcuuaauggucaacccugaaugaccagagaggacgcugcagggacagggcaggguuuucugagcacaauggucacuggugggaggaaaggccaguguggcuugggcaaacaaagccgggugacauuucaacagaaaacccugcccugucccuucagcguccucccuggucauucgggguugaccacuaagcuggcacucggugcuggggaugaaccagaggacaggagggggacauccaggcugaggacaugaggcagguccugggugcagcuuguguuugccaguugcaaaguuuccuugaucuuaccaacaccaguguccgcaguaaggacaguacugaugcaaaucaguaacugcauuaguaaaaaagaaugugaagacucaaacuuuguaaaggcuaaaaguugcacccacgccuggggccugaggacagcuacaugcugcugugugguuggagggugcuggaugguggcugcggaucugugguacugagaauggccauggucacagcccggaugagcauugccuccuuccuagggagacacauggccuggaacacacagcggcugcagccgggcagccuuggagcauagguugguagugcuuucuucuugacaaagcucccacucugagugccuccuccccagcucugcuuucuuaggcuuugugguggaaggggcaagggcagcccaggcuugcaggaggcucuggagaagguucugaccucagacugcaaagcggaccuuggcacucagccucacagacacuucaauaugcagaugauuuuuuuguguguuuuuuuugguagagauggggucucacuauguugcccaggcuggucucgaacucuucagcucaaacaauccuccugccucggacucccaaagugcugggauuggaggcgugagccacugcacccagccagaugauguuuucaaucugaguaaaaagguaguuuuagaagaugacugggcaaagaaagagugucuuugcuagcugguguguaacauaaaguaaagaaagagugucuuuguuagcuguuguguaacacaaggcacaagaucuaaaugaaggucagugauaacacuuuucuuuuuucugauuaaauaauugucucaguaguuuacagagaacuuacauuuguguuuucacuuucacgucuguguacucaugauauguccaaaucaugcauuuaucuuauaguauuguuuuuaauucugguuaacaaauauauuaagccaggcauggugucacuccuauagccccaccuacugggaagguugaggugggaagacugccugagccaaggaguucaaggcuaucgugagcugugauuguaccacugcacuccagccugagcaacagcaagacccugucuauaaaaauauaaauacuauauauguauauggggccaaaugcuauguucuguauuuaaauucuaauuacuuguuagauguuaagguugucaauaugcugauauucagacugagaagugaugaauucauaauugucuuuauaaacaggcaaugucuacuucgaucugaagucuagaggagacaaguauggcaaauuggucggcguggucccugguccagucggagagccagguggguuggccgggcucagcccugugggucccugaccucugccucgggucucagcucuggggagaugagaucuggagcgcagaccccuccacuugcucagacacuggccuuacccaggucacagcuguguuuuaaauuuagugugguuucuguggauggcuccagcuugugaggcauauaguucaaacggcaaguggggcaucguccacccccgcccccagcgugccuggcuccauucccuggagacagugcuggucacugucuccuuuuuccuccccaggguuuucagcgcacaugaaaaccucauacacguacaucauauuuucgcguucuucuguguuaccguacauuuaauucccauacgugucuuacuauguguuaaacuuccaaucuguuugaaucucuuccuugcucuauucuguuccagggaguuauuaggucaaaacauuuuuauggagaagaaauaguaagcgcaguauauggaacuaaauuuaaaauaauuugaaaaggauacugucuaagggaaucaaacaagaauaacagggacagaccccaaagacuguucaagguauuucugguuuuaggcacugucuuucugcgccauaaacugugccaaugaauccuaaccauccauagcacugaccccucagguucuuuccuucccccgccguggugcccugucccgcuccccgcacaggccggaacacagacgcccacaucagccacgugugaggcguggcuaccagcaggccgugugggcuuugcuuacacauguggaggagaaguuucugagaguuguacauucuggcaucaggaagguuuuuuaaaauuauuuauuuaauagauuugcuuuuuagagccauuuuagcuucauagcaaauuugagaguaagguacagagaauuccugucuaccugcuacccuccacaccgccccccacacugucagcaucccccaccauugacgcaucagcuuugcccagagaccagaguuggcaucaggguucacucucggcacugugugcucuggguuugggugaauguauagcgacauguuuccaccauuccagcaucacgcaggauacuugcacugcccugaaaaauccuguguggucugucugcucauccuucccucuuucccaucccuggaaaucacuggucuuucuacagucucuaguuuugccuuuucuagaaugucauauaguuggagucauacacugugcacccuucucagaauggcuucucucacuuaggaauacacaguaauuuuccuccgugucuuuucauggcugagagcucguuucucuuuaacacugagucacgucccagugucugaauuuacagcagcuuaagcacucaccuacugaagggcaucuucgcugcuucugaguuuuggcaauuaugaauaaagcugcuguaaacauccacgugcagguuuucagcucauuugggcagauaccaaggagcacaaugcuggguccucugggaagaggcuuauuugugucagaaacugcccagcuucugccagaguggcugcaccauuuugcauccccaccagugaggaauaagucccugucguuccacaucuucacagcagugcuuuuuaaaauaaaaaauauuuucuuauacaaaagcaacauauuuauauaauuuauaaugguacaaaauuaggaaauagaauuacacaaaacaaagauaauaaaaccaccauuuuuacauauggugaaaaaaaauuuuaaugccuuaguguauguuauuuccaaagcaaugguguugucuuuuuaauuuucaauuuaaauuguuguaauaacacaacaauagaaaacaccauuaaaaaauguccaacuugguugagcaugguggcucacaccuguaauuccagcacuuuaggaggccaagguuggaggaucacuugaggccaggaguucaagaccagccugggcaauguagugagaccccuugcugucucuaccaaacaaacaaaaaugcccagcucagugaauuuguguucaguggagacccugcggucacccccuaguggaaggagacaacaauggcaagggagcgaaggcaccugaguccuccgggucccacgcccuggccgauaaccucccgggcccugccugccagccucucugcccugcccugggggcaacuacugcccuaacucugacagcggccaccuccucauuuuucugaauggguuuauugcccaaacacgugucccuuaacacgacacuuagccuuagcuguucuauauuugugucuuguuuuuaguccacauguuccuccccuggcuucuuccccuugcugcucauuugagggagaaacgucaugugucucacgguucccccagugggauuucgcuugcucugaguuuuggagugucuguaacauuucccucuguccuguguguuuuuuugcaaacugguaguugaauguagaggcuuaauccaguucuaaauuucuggagaaggcuacuuuguagaugguguauuccucaccaggagacacguaagggcucugccucugugugucagcagcccuggccgcucuaggcuuagauccuucacugcaaaaagagguggcaugguggugcaacucccauucugcuuuauuugcuggaauaccuuuuuuguuuguuuguuuguuuguuuuuugagacggaaucucacucuuuugcccaggcuggagugcaguggcaugaucucgguucacugcaaccuccaccucccagguucaagcaguucucccugccucagccuccagaguagcugggauuacaggggcaugccaccacacccagcuaauuuuuguaguuuuaguagagaugggguuuugccguguuggccaggcuggucuugaacuccugaccucaggugauccaccccccccccccccccccucggccucccaaaguacugggguuaucggugugagccaccgugccuggcccauuugcuggaauacuuuuauacaggcagacugucaucugguuacucagugguacaguuuguauaagaaaggcaggaccuuuuccuuaacuuaccaguuuucagaacaaggaguuggcuuccauauuuuccucuggcagugaccaguucauguucuuccguugcugagagcucgugggcuucagugcacaugccguuuuaacccauugcugccaucaccuuauugagccucggcgugcccccucuuuugcugguagcagcuacucccgagucccuuacacucagcccuguuguaguuaauaguuuuguggcugucuaucugauaugguaagauauuccuggcucaucuuaaaauaagcuguuucuccuggaagucccauuuuucucuuuucuuucuucccuuuucuucccuuucccucccucccucccucccucccucccucccuccggucacgcccggugucccucccucccucucucucucucucucucucucucucuuucuuucuuucuuucuuucuuucucucucuuucuuucuuucuuucuuuucuuuucuuuuguuuuuuugagauagaaugucacucuuguuguucaggcuggagugcaauggcgcgaucucggcucacuguaaccuccgccucccgagcucaagcgauucuccugccucagccuccacaguagcugggauuacaggcaccugccaccacacccggcugauuuuuguauuuuuaguagagacgagguuucgucauauuggucaggcuggucucgaacuccugaccucaggugauccgcccgccucggccucccaaagugcugggauucuaggugugagccaccgcgcccagcucccauuuuacuuuuaaugggaaaugguguuuugagaacacagcaugggcaccauggauacucauuguugccaucugucauugccgucugucauuguuuccuggccucucccauagacugagguaaugaacgcaucugcuccguaggucacacugauacucaaauucagggccacgggguuucauuaaccccucugucuguucacaugugugguaaggacaacgggcgugaccggaugaccagugggcauccaccugcuuuaguccaucacggaccagcccugcccgaggcuugaccacgguuagaagguucccaugcacgugccuccuccccgccccgcguguccauauguuggagugcccagccuccgccugcgcugccuucuguagccccguccacucuuccccccucccaccgucuccagguccgcuuuuucccuguuguuuuugaagcucauuccccagcaguuucugaaggaagagcccuuucucgggaacaguauucucugcauuugugccuguggaugacagugugcugccuucuacuucaaagucaguuuggcuggaaauacaguccuuggccgcauuuucuguccuuaaguauuuuccuucggcauaagguguuauugaugcucucguuugccaugcacuauguaggaauuguucuguuugcuugggugcccagaggauguuauucuuaguaaagugacuaguaaugaaaacguagccuguccagucugacccagaaaaaguaucugugucugcacucuuuaaauucaucaaaggugauggacgccugugucagugcucccggguggaaagggugauauugggacguugugcacauggggugugccuguccugggcagaugggacagcagguuuuggugagcaugcgccacuggcagccucaccgcacggugaugggcaccuugcucagagucucggguccauaagccgcguuaccugacacgaucacgcgccuuucacucugugugauuaguaucuuuuuggaaaaaacaacccugaaacucaguuacugauaagcagaguauuucucguaagacagaauaaggaaaaaugggaaaaccccaccugguccacaguacauuccugagaaaugagccucuguggguucccggccgcccagcucucccugugcgcuggugcaucugaggugaaagcguugccggugcuccugucccucacgugggugaaacaggagugaacgagaagccaaggcuccuucgaagagacacagccuggggcgugcugcccacuggcggcuggaggggcuuccaccgggguggccggcuggauuucccuggugggggugaccagcugaguuucugugguggggggugacuaucugggcuucuguggugggggugaggugguggugacagccugggcuucccugguggggugacagucugggcuuucaugguaggggugacugucugcguguccgugguggggugauuguguuuccauggugggggugacugucuggguuuccguggcgggguggcugucuggguuuccguggcgggguggcugucugaguuucuguggugugauugucugggucucccuggugggggugacugaguuucugugguggggugacugucugcguguccgugguggggugauuguguuuccauggugggggugacugucuggguuuccguggcgggguggcugucugaguuucuguggugugauugucugggucucccuggugggggugacugaguuucugugguggggugacugucugcguguccgugguggggugauuguguuuccauggugggggugauuggguuuccgugguaagggugacugucuggguuuccaugguggggugauuuucuguguuuccguggugggggugacuggguccccguggugggggugacugucugaguuuccauguuggggugauuuucuguguuuccguggugggggugacugggucucuguggugggggugacugucuggguuuccauguuggggugauuuucuguguuuccauggugggggugacugucuggguuucuguggugggggugaaugucugagcauccgugguggggugacugagcuucuucccacugauguaccguuugucaucugcagcggacucugacaagcgucaugccagugacuucgcccuguggaaggcggccaaaccccaggagguguucugggccucucccuggggacccgggaggccgggcuggcacaucgagugcucugccaucgcuagguaaggugccugccgcuuccuggggguuggggcucaaguuccccuggugccugcucagggcagcagaggaugugcaugggagcaggugcagccuggcacgugugcccaugggugauuuuuugggaagagauuuuugccggagugugacgggccauggaacggggugaacgaaacccaugacacaucaagcuuuccugaccucagcacuuccucuguuuaguggagaggcugcuuuuugguucacacuugcagcugcccuguucccucacccuucucuguaguggcuggugcuuggggcccuggaggagagugcuugcaccuacaucccuccucgcuucgcacuucucuagcccccaaaucccucuccgccuucccgccagcucuucuagcucaggcaacucgcaugccagggugcucuguggcggaaaucuccagcuccucccagaucuuccuggagucccccagccacccucauguggguccucugucaccaaagcuccucuucccacugucugccugggaccgcagcugccugccgcccccacucagucacacgacacugcucuccuggcccacugcggcauccccuacucuggaaacacccucucuguccugguuucugccucucaguagagcuuucuccgccuucucccugguccccuuggacgcaccugagguguccacacccuguggcucugcccacagccaggggcaccuuggguggggugugugaaagacagcauaccgcccgugccccgugcugcacagcugcccauggggcucgccacaguuaguuucauguuccuguuuuuuuguuuugagacggagguucacucuucuugcccagguuggagugcaauggugcgaucucggcucaccgcaaccuccgccucccagguucaagcgauucuccugccucauccuccugaguagcugggauuacuggcaugcgccaccaccccggcuaauuuuguauuuuuaguagagacgggauuucucccugcuggucaggcuggucucgaucuccugaccucagguaauccgcccgccuuggccucccaaagugcugggauuacaggugugagccacugcgccuggcccacgguuaguuuguuaccguggugcugguuuguguggccugacccucugcaggcagcaggguacccagccgcgcguuuagacuguuccuagcguuucaguguuacagaucuccuuagugaauaaccacgcguauguuuccuauuuguagaaauggguuuuuuuuuucauuauauuuuaacuucuaggguacaugugcacaaugugcagguuuguuacaucuguauacaugugccauguuggugugcugcacccauuaacuccucaucuacguuagguauaucuccuaaugcuaucccuccccacucccccaccccaugacaggcccuggugugugauguuccccacccuguguccaaguguucucauuguucaauuccuaccuaugagugagaacaugcaguguuugguuuucuguccuugugauaguuugcucagaaugaugguuuccagcuucauccaugugccuacaaaggacaugaacucauccuuuuuuauggcuacauaguauuccaugguguauauaugccacauuuucuuaauccagucuaucauugguggacauuuggguugguuccaagucuuugcuauugugaauagugccacaauaaacauacgugugcaugugucuuuauagcagcaugauuuauaauccuuuggguauauauccaguaaugggauggcugggucaaaugguauuucuaguucuagaucccugaggaaucgccacacugucuugcacaaugguugaacuaguuuacagucccaccaacaguguaaaaguguuccuauuucuccacauccucuccagcaccuguuguuuccugaguuuuaaugauugccauucaaacuggugugagaugguauuucauugugguuuugauuugcauuucucugauggccagugaugaugagcauuuuuucaugugucuguuggcugcauaaaugucuucuuuugagaagugucuguucauauccuucgcccacuuuuugaugggguuguuugauuuuuucuuguaaauuuguuuaaguucuuuguagauucuggauauuagcccuuugucagauggguagauggugaaaauuuucucccauucuguagguugccuguucacucugaugguuguuucuuuugcuaugcagaagcucuuuaguuuaauuagaucccauuugucaauucuggcuuuuguugccauugcuuuugguguuuuagucaugaaguccuugcccaugccuauggccugaaugguauugccugcguuuucuucuaggguuuuuaugguuuuaggucuaacauuucagucuuuaauccaucuugaauuaauuuuguguaaggauagggauccaguuucagcuuucuacauauggcuagcuaguuuucccagcauuguuuauuaaauagggaauccuuuccccauuucuuuuuuugucagguuugucaagaucagaugguuguagaugugugguauuauuucugagggcucuguucuguuccauuggucuauaucucuguuuugguaccaguaccaugcuguuuugguuacuguagccuuguaguauaguuugaagucagguagcaugaugccuccagcuuuguucuuuuggcuuaggauugucuuggcagugcaggcucuuuuuugaacuuuaaaccauaugaacuuuaaaguaguuuuuuccaauucugugagaaaagucauugguagcuugauagggauggcauugaaucuauaaguuaccuugggcaguauggccauuuucacgauauugauucuuccuauccaugagcauggaauguucuuccauuuguuuguguccucuuauauuucauugagcagugguuuguaguucuccuugaagagguccuucacaucccuuguaaguuggauuccuagguauuuuauucucuuugaagcaauugugaaugggaguucacucaugauuuggcucccugucuguuauugguguacaggaaugcuugugauuuuugcacauugauuuuguauccugagacuuugcugaaguugcuuaucagcuuaaggagauuuugggcugagaugaugggguuuucuaaauauacaaucaugucaucugcaaacagggacaauuugacuucuucuuuuccuaauugaauacccuuuauuucuuucuccugccugauugcccuggccagaacuuccaacacuauguuaaauaggaguggugagagagggcaucccugucuugugccaguuuucaaagggaaugcuuccaguuuuugcccauucaguaugauauuggcuguggguuugucauaaauagcucuuauuauuuugagauacgccccaucaauaccuaguuuauugagacuuuuuagcaugaagggcuguugaauuuugucaaaaggccuuuucugcaucuauugagauaaucaugugguuuuugucuuugguucuguuuaugugauggauuacguuuauugauuuguguauguugaaccagccuugcaucccagggaugaagcccacuugaucgugguggauaagcuuuuugaugugcugcuggauucgguuugccaguauuuuauugaggauuuuugcaucgauguucaucagggcuauuggucuaaaauucuccuuuuuuguugugucucugccagguuuugguaucaggaugaugcuggccucuuaaaaugagggaggauucccuuguuuucuguugauuguaauaauuucagaaggaaugguaccagcuccuccuuguaccucugguagaauuuggcugugaauccuucugguccuggacuuuuucugguugguaggcuauuaauuauugccuuaauuucagagccuguuauuggucuauucagggacucaacuucuuccugguuuagucuugggaggguguauguguccaggaauuuauccauuucuucuagauuuucuaguuuauuugcauagagguguuuauaguauucucugaugguaguuuguauuucugugggaucgguggugauauccccuuuaucauuuuuuguugugucuauuugauucuucucccuugucuucuuuauuagucuugcuagcggucuaucaauuuuguugaucuuuucaaaaaaccagcuccuggauucauugauuuuuugaaggguuuuuugugucucuaucuccuucaguucugcucugaucuuaguuauuucuugccuucugcuagcuuuugaauguguuugcucuugcuucucuaguucuuuuaauugugauguuaggguguuaguuuuagaucuuuccugcuuucucuugugggcauuuagugcuauaaauuucccucuacacacugcuuuaaaugugucccagagauucugguauguugugucuuuguucuuauugguuucaaagaacgucuuuacugcugccuucauuucauuauguacccaguagucauucaggagcagguuguucaguuuccauguaguugagagguuuugagugaguuucuuaauccugaguucuaguuugauugcacuguggucugagagacaguuuguuacaauuucuguucuuuuacauuugcugaggagugcuuuacuuccaaauaugugguccauuuuggaauaagugcgauguggugcugagaagaauguauauucuguugauuugggguggagaguucuguagaugucuauuagguccgcuuggugcagaucugaguucaauuccuggauauccucguuaacuuucugucucauugaucugucuaauguugacagugggguguuaaagucucccauuauuauugugugggagucuaagucucuuuguaggucucuaaggacuugcuuuaugaaucugggugcuccuguauuaggugcauauauauuuaggauaguuaguucuucuuguugaauugaucccuuuaccauuauguaauggccuucuuugucucuuuugaucuuuguugguuuaaagucuguuuuaucagacacuagguuugcaaccccugcuuuuuuuuguuuuccuuuuguuugguagaucucccuucaucccuuuauuuugagccugugugugucucugcacgugagaugggucuccugaauacagcacacugaugggucuugacucuucauccaauuugccagucuguaucuuuuaaguggagcauuuagcccauuuacauuuaagguuaauauuguuaugcgugaauuugauccugucauuaugauguuagcugguuauuuugcucguuaguugaugcaguuucuuccuagccuugacggucuuuacaauucggcauguuuuugcaguggcugguacugguuguuccuuuccauguuuagugcuuccuucaggagcucuuguaaggcaggccugguggugacaacaucucucagcauuugcuugucuguaaaggauuuuauuucuccuucaccuaugaaucuuaguuuggcuggauaugaaauucuggguuaaaaauucuuuucuuuaagaacguugaauauuggcccccacucucuucuggcuuauagagguucugccaggagaucugcuguuagucugaugggcuucccuuuguggguaacccgaccuuucucucuggcugcccuuaacauuuuuuccuucauuucaacuuuggugaaucugacaauuaugugucauggaguugcucuucucgaggaguaucucuguggcguucucuguauuuucugaaugugaauguuggccugccuugucagguuggggaaguucuccuggauaauauccugaagaguguuuuccaacuugguuccauucucccugucacuuucagguacaccaaucagacgcagauuuggucuuuucacauagucccauauuucucggaggcuuuguucauuucuuuuuacucuuuuuucucuaaacuucucuuccugcuucauuucauucauuugaucuucaaucacugauacccuuucuuccacuugaucaaaucggcuacugaagcuugugcaugcaucacauaguuguugugccaugguuuucagcuccaucaggucauuuaaggucuugucuaugcuguuuauucugguuagccauucgucuaaucuuuuuugaagguuuuuagcuucuuuaugauggguucaaacauccuccuuuagcucggagaaguuuguuauuaccgaucgucugaagccuucuucucucaacucaucaaagucauucucuguccagcuuuguuccauugcuggugaggagcugcguuucuuuggaggagaagaggcgcucugauuuuuagaauuuucagcuuuucugcucugguuucuccccaucuuugugguuuuugucuaccuuuggucuuugaugguggugacauacagaugggguuuugguguggauguccuuucuguuuguuaguuuuccuucuaacagucaggacccucagcugcaggucuguugaguuugcuggagguccacuccagacccuguuugccuggguaucaccagcagaggcugcagaacagcaaauauugcagaacggcaaauguugcugcaugauccuuccucuggaagcuucgucucagagggcaccuggcuguaugaggugucagucagccccuacugggaggugucucccaguuggucuacucggggaucagggacccacuugaggaggcagucuguccguucucagaucucaaacuccgugcugggagaaccacuacucuucaaagcugucagucaggaacguuuaagucugcagaaguuucugcugccuuuuguucagcuaugcccuguccccagagguggagucuacagaggugggcaggccuccuugagcuguagugggcuccacccaguucgagcuuccuggacacuuuguuuaccuacucaagccucagcaauggcagaugccccucccccagccucgcugccgccuugcaguucaucucagacugcugugcuagcagugagcgaggcuccgugggcgugggacccuccgagccaggcgcaggauauaaucuccuggugugccguuugcuaagaccauuggaaaagcacaguauuagggugggaguguccugauuuuccagguaccgucugucacagcuucccuuggcuaggaaagggaauuccccgaccccucacacuucacaggugaggcgaugccccacccugcuucggcucacacuccgugagcugcacccacugucugacgagccccagugagaugaagccaguaccucaguuggaaaugcagaaaucacccgucuucugcgucgcucaugcugggagcuguagacuggagcuguuccuauucggccaucuuggaaacggcaccagaaauggguuuuaaaaaaaucacuguuaacucauggauuuuaguauacuugauagcaaauauuuauuuuaauaaacaguuuuaaaaaauuagaaacacaggaaaggaugauuaagguaaacauuuuaagcuaguagcuacaucagagauuuucagauggauaaauccagucaccucgaaaccugugggcuuuguauccaggauguguuuccuggcuggguguagaggggguuuggguggagauaauuaucucccacacgaggacucugcuccauucauggacucccagacagcuugaguauucagcgccgaguagggucgccccauuccaccaggagggaaggccuugucccccacgaccugccuaucuaaauuuugguggaucuucuucaagacccagaaagagauucccuuuucugcuaagcccccaccacuugcacugugguuaugcggcucaucuggaaacgcuuccgucauuccucagaccucaaacccuguuguuaguaggaagcaugggccugacuuuugaugaaaaaaaaguaaaaauguccagucaccagucacacuuuacuucuauguguuuaucaauacuuaauagcagacuauggcauauaaacuggguuguagauucauuuuuuagauucaaauaauuucucuaaagcagguagaaaacauuuagugaguuucaaauguaauguuaugugaaauucuuauuuuuguugaaagauuaaauaaugaagagaccauuauuguuguuccuucugagccuucucugauuuuaaaauagguguaacguagagaucaggagcgaaacuaacauagugaagguuguggccccauaguucagcuugugaaacuuucacgucguuguguuggcuucagaucuucggaagggagaauugcccauccaaauacaaaugaggccccucccauccccuccccacuccuggucccacagucuccuucacagcauuugaacugcagggaauguuagaguuacccuaagacgacccgucacuaagauguaaaaaucuuuuuuuuuuuuugagacggagucucgcucugucacccaggcuggagugcaguggcgcgaucucggcucacugcaagcuccgccucccggguucaugccauucucuugccucagccucccaagcagcugggacuacaggcacccgccaccacgcccggcugauuuuuuguauuuuaguggagacgggguuucaccauguuagccaggauggucucgaucuccugaccuugugauccgccugccucagccucccaaagugcuguguuuacaggcgugagccaccgcgcccggcuaagauguaaaagucuuagaacgucacacuacagcguguguuucugugaugccuguuuccccaggcucgagaccuccgugugcagugcuuccccgagcacagggaaccagaccagugggagcaggaaggaccucugcgagguguuggcaccuuagaaauuucucuaucuaucauuuuaagaaaauccaccggccugcugcgucgccaugcuucugcagcugguccagggacagagcuucgagugggcuggcccagccucauuucccccaucaaccccauuaauuuuuuuguauggguuugcagaaacgcgguuuuuauggaggcauggcacagcacuguaggagaaauggcaaccuguguugcuuugaacucucuuaccuuguuauucguaggugacuguuaguuacacuugcaaaagccaaaugaaacacugucaugauuuuauaguuccaucucuuguuaaaauuggaaaaccacuaaacucuaccuauugaaaguaaguaaagguaauuuuuugaguugaaaaagaaagaaagaaaaagagaaaaaaagaaccuggagcaaaaagaauuaagugccuuuacuaggaugaaaagucaugaauuacgggcuugugaugacaggauuucaguuuucauuugaaucaguuaaauuaucaugcaaauugaugcaaaacugagauccauuuauucauugaauuaaaaaggcuggaaggaauaaauagacgagguuagaagaaaauauguugcuugauugaaugaauucacuacuuugcacugugucuugcaguaugguauuuggaagucaacuggauauccauucaggugggauagauuuagcuuuuccacaucaugaaaacgaaauugcacagugcgaagucuuucaucagugcgagcaguggggaaauuauuuucugcauucugguaaguaauaacuucagauuaauuuguucuguuucaauucuagcaguucugucuuugucggcggaacagcuacauuuggaaauacauaguagaucagcuaauaggucaagaaauggauuugccucuuaaauuauuuuugaguuucaaucauuugaacaugagcuuccuuggauugcagcaaugauuauaccuuuuuggaacugacuagaauauggaaaauguuuggcaaugcuguucuauauaagguuucuuucaaguaaaacuauuaagaaggaacuugaaguaguacaauguaacgauaauuaugaacauccuuucugaagcuauaauguugucacuagacaucucugccaucuucuaauaacauugcccuuucuuccacuguucaaacaccuaacugaugaaccccagcugucugcucucagaaguggaugcaacaccaugaguuaagcaacaccucgaacccagcaguuuuggaauucacuuggaugcacuggaagagucguauuuccaaguuuacagggucacgauuaacuagucuuauuaccuuuuggggauggacagcuaagguauuugagaugaagaaagauaaagaguguuugguagugauaggauuuggagaugcaaacuucgacaucuaaaauacagaaaauuaacaaauacuaucuuuugaaguccuugaauugggaaauuaggaugucacaguaaagugacauuaagugcagaagugcucugguuuucugguccgcagcagaguucacuuggguuucuucgugaaaguacaugaggcugauugccccgaagucacuuccugcagcauguccuucaccccgggcuuacccuguugagucggggaacccagcaggcggcucugccccuaccauuaccuacuaugucugccucucacagugccccaguuuuugucuaaaaaugaagcagaaacaaagcuggcugcguggcuguuugaggacuuaggagcuguuguccagcaccccauaccauuucccuggggagggcucagcacuagcugaaauccacuuuauuccggugucgguggaguuucuaaucagaacaaacgccugccgcccucacuuccguuucagcuggcgcucacaugggaagggggugcacgcugcccagugguggaauauuuaaggcaucgccccucagggagccgagcacugauuuccacagccgggggccugcacuccacuuuugaccauggggaaggaggucucucuuccguggcccaaggacuucugaauuguguucuuggagaggaagcgugcugggagcccagauaguggggcugagacacugugucucaggcacagagguagucgugucccuugucccagaugaagaaagauaaagaguguuugguagugauagauuuggagaugcaaacuuugacaucugaaauacaggaaauuaacaaauacuaguuuuugaaacccuugaauugggaaauuaagaugucacaguaaggugacauuaaaugcagaagugcuccgguuuucugguccgcagcaggguucacuuggguuucuucaugaaaguaaauagaugaggcugauugccccgaagucacuuccucguugacuucguucagggcucaguucagcgcucccugaacugucugaggagcuggaguugcucccuccgcaggcacguuucugucugcagguuuauccuguucaguaggucaggguuuguuacugacaaccaugaccugcugugagcccuucugcgaguguggagcuggggggcaagaagggcagccuuagcugugccaacgcuucguccugucagguaaugaggaggggccgggucuagaaacggaggucguguucaccuuccgaugugggaaugggaaagcauuugcuguuguuguugaaacaauuucgcuccgucccccagccugggagugcaguggcacuaucugagcucaccgcaaccucugccuccuggguucaagcaauucuccugccucagcuguucuaguagcugcgacuacaggugcauaccaccauacccagcuaauuuuuguauuuuuaguagaagcaggguuucaccauguuggccaggcugggcucaaaccccugaccucaagugaucugccaccucugccucccaaagugcugggauuauaggcgugagccacugcacguggugggaaaguuuuguggcuauuuuucagugauuuuuuacuaccuguuaagauaccagcgaucuuuuucauacuaguuuggccccaaacaaaacaucagugucuccugacgcaggagaagugacaccuguucuccuguacccaguggauggaagagcuaagugggcagacacuaucccagccuguuagggcugcuauagccaaacugaaagcgggcguguuaugaacaacagcaaugaauuccucacaguucugcuggcugggaguccugcgucagcgcacuggcagacucggugucucgggagggccugcuucccauuuguagacggccgucagcucucgaggggccucuguuaugagagcacugauuccauucacacuggcucugccccugugaccucaucaccucccacaggcccugccuucaguuaccgucaccugagggcugaggauuuugacaggaauuugggaggacauaaacauucaggccuuagcaaauguguuuuauuuuccaacuaucaucaauuuuaaaaaaucagaaucgugcuugguguaaucacauuauauagaauuacauguucaaaguuauauauguuuuuuggaaaucacauucuaauugguugguugguugguguauuuauuuauuuauuuuugaggcagagucucgcucuguggcccaggcuggagugcagugacaugaacauagcucacucuaggcccaaccuccugggcucaagcgauccucccaccucagucuccugaguuguugggauguugggacugcaggugugccccaccacgcccagcuaauuuuuaauuuuuuuuguagagaccggguguugccauguugcccagacuggucuccaaacuccugggcucaagcgguccuuccaccuuagccucccaaagggcugguauuacgggugugagccacugcguccggccuggaggacuccuguuugaaguugugucagaaaaagaggaagagucuucuguuagaaacagaaagcccuucucuuggagauaagccuuguaaaaagcuacaggccagggagaauuucagggucagauucaggaguuccuuaaaugaguuugguuuuccuccugucuuucacauacauaggggaugaaauaauacccaggucaucaaagucugugaaaccaacugcaacaggaccucugauucuucccacucagagacccacaagugccacucuguuuuuggacaacggucaacaagcuucaccgccaagugccugauuugucaaaugagagcuuugucguuucuucagaugcugaccaguaucugaauucaguaucucugaauuacaggagaggagaaaauagaugaaauacugcugucaguaccacgguugcuggcucuuguuuagcuucugagucagcuggggcaccccugccaucugcucucaguguggggcugggugucccugcaccguggaacaagggcagguccugucuucccggaaggcccagcacgggugaagauuugggggcagauuuauaccaacauacacuggucuauacauuggauaugugcagguucccauucguuuccuggggagccaugugucccugaggccagagagucuccucacccagcucagacugaaugcuuuuguuuuuguuucagggcauuugcacgccaaaggcaaagaagaaaaaauguccaaaucauuaaagaacuacauuacuauuaagguaacgugcuuuuuguauuguaucucugaggugccgauagcuuguggaacccaucuuaaaggcuucugugucauuugagaaccacggaaucccauucccagugcccucuggccccuuucuuaugacgagaccugccucaccucccucccacuuuaaguggcucuccgccuaaucgcgcccucagcugugcgccucccgcagguuuccgcagucccuuucuugguggagcuucccuuucucuuuccguguuucaaggccggcgcccucuuccuugccuuuuccuuuuauaauuguugucucccucuuggugcaucugcugacuuccuucccgcccucacccaccaccucuuacugguguggcuuugggauuuguuuagguuuugcuguuugcccuuaauaggcucagagcuggcuggauccuuaaccaaccugaaaaauggcaucaugcuaugcugcugacacauggaaugugaauuuucgugugaauggaaaacaggcacacccacggagggcucuggcugacauaguuugaacuccuccuuugucuucuggccugucuuuaaagccagauuuaauuuaauugcaaaauaaauggagaagaauaguauccagaucucaccgccuaaauagcaaaccagugaaagcuguacccaucagauuuaggauacaccaacagggacugcuccucacaaaauaauuuguauauaguuuccuuaaguagaauuuuuccguuuuauccuaggcaaaauuucaaaccgauagaaaaguugaaagaaacaucacuauggcuccacccagauucaguaguugugaugauuuugcuguauuugcuguguaggaucuuuuucgccuacccagcuuagauucucccaccggggagccucaauuaaauugguaaauuagacucuggccaaagacagauuagcaagagaaaaacaaagagaaauguguuagagcgugcacggcacacguggagguggagcacaggguugcaugacacagaggaagguuggagcccggggccacgggguugcaugacgcagaggggguccaaacccagccacgggguugcaugguaugcaguggggucggagccuggccaugggguugcaugacgcagaaggggguccgaagccggccaugggguugcaugacgcagaggggggucggagcccggccacgggguugcaugacgcagagagagguccgaacccggccgugggguugcaugacgcagaggggguccgaacccgaccaugggguugcauggugcagagugggucggagcccggccacugcagggaccuugcuuuauugagcuucacuugaccgcacuucgcagaugcugugucuuuacagauugaagguuuguggcagcccugcaccaagcaaaucuguuggcacaauuuugccaacagcauguucucacuuccuuucugugugucauguuuggguaauucuugcaauauuucaaaguuucucauuauuaaaucuguuauggugaucuguggucagugaucucugauguuacuguuguaauuguuuucgggcuccaugaaccacauccauggaagacagaacuuaguauguguugugcauguucugacugcuccaccaacuguccauuccuuuaaaucugccccuccuuggacuccccuauucccugagacacaacauuauugaaauuaggccaguuacuagcccuacaguggccucuaaguguucaagugaaaggaagagucacacaucucucacuuuccaucaaaagcuagaaaugcuuaagcuuaaugaggaggguaugucaaaagcugagacaggcugaaagcuaagccucuugcaccaaauauuuagcuaaguugugaaugcaaaggaaaaguucuugaaggaaaucaaaagugcuauuccagcgaacacacgaaugauuagcaagcaaaacaaccuuauugcugauaauggagaaaguuugaguggucuggauagagaagaucaaaccagccacaacauuccuguaagccacagccuaaucuggaacaaggcccuaacuuucuucaguucuaugaaggcugagagagaugagaaagcugcaaagaaaaguuggaagcuagcagggguugguuugugagguugaaggaaagaagaccuagcuaaaauaagugaugaagguggccacacuaaacagcagaucuuucgaauguagaugaaauugccuucuauuggaagaagaugcugucuaggacuuuuguagcuagaaagaagucaauggcuggcuucagagcuucaaaggacaggcugacuauuguuaggggcuaauguagcuggugacuuuaaguugaaaccagcgcucauugacaauucaaaaaauccuagggcccuugagaauuacccuaaaucggcugggugcaguggcucacguuuguaaucccagcacuuugggaggcccaggugggcagaucaugaggucaggaguucgagaccagccuggucaacacagugaaacccuaucucuacuaaaaauacaaaaauuagcugggcguggugguggacaccuguaaucucagcuacuugggaggcugaggcaggagaaucacuugaaccugggaggcggagguugcagugagcugagauugugccacugcacuccagccugggcgacagcuagacuccaucucaaaaaaaaaaaaaaaaaagaauuaugcuaaguguacucucccugugcuguauacguggaauaucaaagcguguaugacagcacauccauuuacagcaugguuuacugaauauuuuaagcccacuguugagaccuacugcucagaaaaaaggauuccuuuccaaauauugacagugcaccuggucauccaggagcuuugauggagacauacaaugagaguaauauuguuuuuaugcugcuaacagaacauucugcagcccauugaucaaggaauaauuucaacuuuuaagucuuauuauuuaagaaaaauauuucauaaggcuauagcugccauagauagugauuccucugauggagcugggcaaaguaaauuggaaaccuucuggaaaggauucaccauucuagaugccaguaagaacauguaugauugaugggaauaggucaaaauauuaacauuaacaggaguuugaaagaaguuaaguccaacucucaugguugacuuugagggguucaggacaucauuggaggaagucacugcauauauggugggaauagcaagagaacuauuggaauuggaaauggauccuggagaugugacugaacugcugcaaccucaugauaaaaguugaacaaacgaggaguugcuucuuauggaugagcaaagaaagugguuucuugagauggaaucuacuccuggugaagaugcuguggacauuguugaaaugacaacaaaggauuuagacuauugcauaaauuuaguugauaaagcaauggcaggguuugagaggauuggcuccaauuuugaaagacauucugccguggguaaaaugcuaucaaacauuggaugcuacagagaaaucuuucaugaaaggaagagucaauugauggcacagacuucauuauugucuuguuuuaagaaauugccacaguaacucagccuucaucaaccacuaccuugaucagucagcagccauaauauugaaucaaaaccuuccaccagcaaaaagaugacucacugaaggcucauaugauuaucauuuuuguuagcaauaaaauauuuuuucauuaagguacguacauuguucuuucagacauaaugcuauuauauacuuaauagacugcaguauaauaguguaaacauaacuuuuauaugcacugggaaaccagaaaauaugugugccuugcuuuauugugauauucgcuuuauugugguggucuggaaccaacccuucaguaugucugaggucugccugugaaccaugcuaggccaaacaaaaaaaaaaaaggagaucugggcuugaggaggggcaggcaaguuuugggagggugacuaggaaaagugauaaacaaggauuguugaguaaaauuuguuuugcagauugagccucucuauugagaguuguuagggaguccucacccugcuacagcaggauacaucuuuuacaacugggagcuuuguuuacaaggaaaacuugcacccuguuuuuagagcauuuccugcaucugcuuguucucaguggucuuuagcucaaaauaaucuguaugccagggaggcauauucagggcuggcaggcugugguacccuucaggggcuuuaucuguguuuaugggaguggugagcgugugugugcaugugcacauuugugugagcauguaugcacauggacaccuguauauaaugcuuguuauugaccauuaggaaauacauugaagacaucaucacacuucucuauucuguaaccaacuccuaaaaauaaggaugcuuuccuacauaauccaaacaccuaaaaaguuagcaguaauuucuuaauauuaucuagucuguagucuguuuuucuuuuuuuguuuguuuguuuuuuuguuagucucacuaucacccaggcuggaguacaguggcgugaucucagcucacugcaaccuccaccucccagguucaaaugauucuccugccucagccuaccgaguagcugggauuauaggugcacaccaccaugccuggcuaauuuuuguuuuguuuuguuuaguagagacaggguuucaccauguuggccaggcuggucuggaacuccugaccucaggugauccaccugccucagccucccaaagugcugggaucacaggcaugagucacugcgccuggccuguuuucuccaguuauccccaaaauguguuuuauacuuuuauuuuuaaacgaggaguugaucaagguucauauguugcauuuguauguugugucuuuuuaggguuuuuuuuaaugugguuaaaaaaaccacguaacauaaaaguuaucaucuuaaccauacaguucaguaguguuaauauguucacauuguuaugcaacagaucucuagaauuuuuucaucuuguaaaaccaaaacuguggacucacugaacaacuucccauuuccccuuuccccaggccuuggcaacaacccuucuacuuucuguuucuaugauuuuggcugcucuagaucucguguaaguggacucacauaguaauuguccuuuugugacuggcuuauuucacuuagcaugguguucucaagauucaccugugcuccuuuauuccaugucaaaauuuccuuccuuuaggcugaauuauauuucauuguucuuucuagguuucuaaucuaaucuacagcagucuuucuacuuuuauuuuuccugugguguugacuuuuugaagagauugagccacuugucuuguugaacaucccacauuuuggauuugucuguuucauuguguugucauuuagcuuguucuucuaucuccuguaguucguuucacgggaagugaggguuaaagggucaguuugauccagguagaagcuuuuuggcaggaauaccuuguaguugaugcugugaacucacagugcauucccugggggcugcaaggucagguuguccuacgauucaugauggugaguuuuaccauuuguuaaggaaugacuaccagaucccucuacugcagaguuuauuuucuucuuaugaauauuaagcaucugagagguggcaugcugcaugguaauuuguuuccuaauaagcuuccacccuaugguuuuagaggcuucacuuugaucagguauuucauugguuauugcaaagucaugguugucuaauuguucccucuuuuacauuuauuaguuggcauucuucuuaaagaaaaguguuuuugucuuucuuuuuuuaguagacagagucagugauuuauauuuauuuaguguauugucaauucagucauuaucuuuuggguguugaaaucaucccggauuuagccagggagggcucuucugacuggcuccggucccccagggacagaccccucggccucuguugugcccuccugcaccugccugccuuuugcuuuccuacccagaccugccguuucuccaagcagccacccugccuuugaggggaaaugggauuuugaaggcaagauuugggcacugcgauguugauugcuaccagagugacacugcgucuacgcuuuuucaggggucagagcuaggggagagggagauaaaccugcacauacaaaauagauuccuuauuuggguuaauuuugauauauccaaauaaaauuuaauaucacagggcuuuuuaguuuuagcucuuuauuuuccucucuuacuaaacauaagagcauaucaacuuuuuguuuuaucuuaaaauacacacaaaauaaauuuaaaaacuuaauaccaauauuaccauuaacaguaaaacuauugaguaaaacuuaaggcuucucuuauuucuuuuuaaacuaauagcuuuauugaaauguaaugcacauacuauauaaguauacuauuuaaaugguacugcuuagugguuuguaagauauucgcaguugugaaacgaccacuaucuaagaacguuuuuuuuuuuuucuuuuugagacagagucucacucugucgcccaggcuggagugcaguggcacaaucuuggcucacugcaagcuccgccuuccggguucacgccauucuccugccucagccuccugaguagcugggacuacaggcgcccaccaccacgccuggcuaauuuuuuguauuuuuaguagagacgggguuucaccauguuagccaggauggucuugaucuccugaccuugugauccaccugccucggccucccaaagugcugggcuuacaggcgugagccaccacgcccggccucuaagaacguuuuuaucaccccaaaaagaaacgccacauccaugggccaucacuucucacucccaccuccucccagccccgacagccgcucaucuacuuucuguuucugugauucaccuauucuggacugaaauuucuuuuucucguggacugcaccccacuaaagcucuguggucugaacauacacucgcggcauguaaugaucuccuuucauuaacacaagagguucauuuguucuguuuguuuccagugugguggucucucucuuccccuuuucaauuuacuuuuuguuuugucuuuuuugagagucuugcucugucacccaggcuguagugcauuagugugaucucaacucacugcaaccucugccucccagguucaagugauucucaugccucagccucccagguagcugggauuacaggccuacaccaccacacccagcuaauuuuuguauuuuuaguggagaugggguuucaccauguuggccaggcuggucuugaacuccuaaccucagguccaccugccucggccucccaaagugcugggauuacaggcgugagccacugcauccagucccaauuuacuuuuauuugucauaucugugaaacauuugcaggguucagcauuaacacuaaagagagcauggagaaggcuggccuggagcccgccugcacccauuccuuccccagcagccacaguuguguucucuguuuuggauucaucuuccuguguuccguuacacacgauaggccaauacacauaaaccuuucuccucugucucauucaugaggcagugucguaugcaugccgccucuucccuaacaauuuaagugagguuuuaauuugauuauagacaugauggguuuaauuucagaaaguuugaaaacugcagacaagacagagaaccacacgguagaaaaauucaaagguacuaagucuggaaagcaggccuccugcccgaccacguucacuguugcccggcuucucuccugaagcagcgguuaguuuucucggagcaggugugugugugcacacaucucccuauagcugugcuucucacuuucccuucacacacagucguguaguuuugcgcuugcuugauuaaucucuuggccucagucgguuuucuaccauauggaguugguucauucucucgaauggcuguguaguccagugugugggugcagcuuaauuaaagaauccccuauugauggucauuuaaauccuacuguauuuuccacuaggguaugugcauuuucaauuuucacagacauugccaugucugcauuauuuuuagcagccucuuaguggcucauggcagggaggcaccgugauuuuauuucccuguuguugggcuuguuugugagaccuguacucugcaggcugcagugcugugaugaauauccuuuagcuaaauaucugugcacaucuaaugauuagugacuugagaaaagugccuugagguagaaucgcacaucagaagauacgggcacauucggaauguuuuggauagagccccuggugacuuuaucaacgagugugauuuacauuccuacuggcaguagauuaaaaugucuguuucccaggucucuccagcaucaaauuagaauuuuaaucagguuaccuuuuuuccuuuuuuucuuuuucuuuuuuuuucuuuuucuuuuuuuuuuuuuugagagaggguuuugcugucaccuggguaccuggugcaguggcaccuggugcaguccuagcucacugcagccuggaacuugugggcuccggcaaaccucccauuucagccuccugaggagcugggaccacaggcaugcacuaccacaccugcugauuuuguauuuuuucuagagacgaagucucacuauguugcccaggcuggucucaaacuccugggcucaagcaauccuccugccuuagccucacaaagcgcugggauuacaggugugacccacggcaccuggcccauuuuucuuguuaauuugugaagaauggcaacuagauuuuaaauuuccaugcguuugucuauuugcuguguugauuugucuauauguauuuacuggugauuuuucauuuauauuuuugguagcucgcaccuacccuagcccauaguuccuuggagauguuaaguuauugcccuacaucuuaaaaauacuugccacauuccugguuucuagcauaagacccuuucccgccaguccucuuugucuuggagaccacugauagaccuuuaugauagccugggugaaaacccaaugcuuucugcguaauggaggccacaguccacguagaaagagcucaacccuggagcucagauaaugguuuaaaaccugcuuucuaguuacuguacgucucaaagcaagcuagggccuggcccaguagagaggcucuggugccugcuucugcccaggggcuccaggggugugugcagcgcuggcaucauaggaagucccucggcaacuggcauguguacccagcgggcucccugugagugugcacccuguuaccucgugagcucacuggggcucacauggcuuguuaccauccccaccugaaggccaauccgguccuccggccugggcucugggagauugcuuaccuccuggagaguuccagcacgagcuuacacugccgucgccacauuuugccucucagggagccguggcagguugcacgguggaaccggaguaguauagaaacuugcugauaucagccggcacagagcaggaacacgcuaaaaaauuaauguccgugugcacccacaguauucaagaguuuucacaucauugucagaauacuguguaaugaagaaguuauaauauguuucuccuuuaguccguauaaacucaaugcucuagaaagauuagauuccagauuucuauuagaacuacuacuauagcucgcugcaguagcgcccgcccccgcaagagcagggaagauaagccuuuaauguuguugggguuucagagaacuaugagaugcgugaaaacacauugaggcuaauucugcaugcguuuacauucugagaggaaaaccccuuugagagaaagccaggugaaaucguuuuuggaaugaaguggggagcguggaggcugcuuguggagugguguuuccacaccgaaacccggagaccuaaauagggcgcaaccugaacugaaaccggcaggacauggcugugugcguuaauuggaaccacagcaccucgggugagggagggugucaaguaagccugcgaguugcgaauuagaggacccaggaguaauauuccuuuuuucacaauuugggaaggagcacccgggagauggacagacggaaauggaauuccagugugauuacugaugaacuacuguuggauuggacaggggcucuucacacacacacacacaaacacacacacacacauaccccagccccccuccccaccccaggccccuguggcagccuggugaagucuguggacccagccuuacaauuugcuuuaaauacguaaaauaaaauacauaggaucccaaaggccguugaugauacugaaguagaggagcgggggcucugcuugacucagcgguuagcucagcguggguggggucugauggcugccauccucucgugugaguuguggugugugaugucaucccuguggggucaccuguggcagcuguggccaccaugccaggcucugugcuuccagaugcguuugcugccuacacugaccaucgaaggaaauacccauuucggugcaaggcuggcagaaauaaacacauaacuguugaaccaucccaguucacagaucuccccgcccucccaccuucucucugugggccccuaggaggucuguggaccccagguugagcaccccuguguuagggcauuggcccagcagcuuucugauuaacgccaccccacaugagaaugccccucacugccucaggcacaggcagacaggaguugggcuguggggugggggcugagcuccuuccugguagaagacagaccagaccugcuccauccucugaagggacugagcccuggaggcagguggagcaguguccuccuccuuccagcucagcaguccagggagcccccuccuuucuacugggugggcgaggccgcugaagccugaagcagggacagccccuucuaccccaagacgcucuucaguuguguguguuuugcucucaguaggguuguugagcagcacggccuuagacuggucuuuuaugccucauaaaauaccauguguugugaugcaguauuuugagcuggacuccgccguuuccggcucacucucccuggcagcucugugcucccacgaccacccugcagaggaaguggguaucugagcucugaugagcgggugcagacuguggguuggugucagccccugugcucugggcuuguguugcugcccaucagccuagagaagaggguaucggguuuacccgagggagacggaaacgcaauucucacuccagcaaggucagcgacagcuuccugcgcaguggacaggcauggggugagccaguucugucuucugaggugguggcaggaaagggggcuuuggucagagccggcaccaugugcugcagauccaggcaaggagccacucgggcucccgucggagcgcgucccuggccaggggugcagucggagcucggcuuucuuucuuggggccacaguggaagcccaagcugggcagagcccucuuccuucucucccccacucaucucaucucuuaaaaguagcugccagagcugaacccugagcgccccacaggagguuuugcugagggcugagcugcuuuugcagugccucuaaugaccucuucuaagcuuccucauguagaaagcuccacuucuuucuggacagacguuuucuaauugaucuauaggaggauaccgguuggguucugaguuuuacuuagguuuaaccagaagcugggugguuuagucuucaagagacagacuuagcgcaugcuuuagcccaguguuuacaagaacugugccaccaaauaggaugagugaggcugucgccccuuggcugggcugagcuggaggucagccgggucugacguucaccgcaagcuucuccuggggguugcaggcaggccagagcuggugugccucccgccaccuaccuggucucuuccugagcacagcaucgcuccaugcugucugucccacgucccugucgugcagaaagagagcccaggcugagcacaggacacacuccuccuggagccugcgcaggugcggauuuucagugcaaaccggcuuucucuucuugcucuuuccacaaauacugagaucgaacguggaaaguucagugaggaaaucaccaggaaacaggugguaauugugaguuuggagggcucauuuucaucaagguuccugauuucuugauagguagagauaacuuauguaauuguagaaaguaacauauucucugaacagugcgaagcguaaaagcaaagccucgugacugccugucucucgcuuuaccaggacuuucugaagaccuuuucccccgaugucuuccgguucuucugccugcggagcagcuaccgcucaggugagccgagcacacguggaguggacuccccccccagcucggagacagucauucugacaggacugaaaacagcaaaaugcaggccagagaauaagcagaaccuuguugagugaggcugcugugugccuuacgguucggguugagagugaacccagaggacgagggaucccagugcuggucugggcccggcccacaguggaugugggcuuccucgucaagcucgaguccucuccacuccuucucucugggucuggacaagucgugaacccgcagcaccucggcuuccugcugugugaacugggagauuggaaggggccagccuggcacggccccugaacaugggagcccucaaacgugacccugccuguccugcccaggggcagcacuuccccgaacgguguguagcagagcaaggucuccuggaugggugaugacgguuccucccaugcugcacaguuaccugcugccccgggcuaggcucuuggccaggaguugucuagcacuggccuggcaugguggcucacguguaugaucccagcacuuugggaggccgaggcuggcagauguuuugaguccaggaguuugagacccgccugggcaacauagugagaucuuaucucuacaaaaaauacaaaaggccuggcacgauggcucacaccuguaaucucaacacuuugggaggcugaggcagguggaucacuugaggucaggaguucgagaccaguuuggccaacgugguaaaaccccaucucuccuaaaaauacaaaaauuagccaggcauggcgaugugugccuguaaucccagcuacucaggagggugaagcaggagaauugcuugaaccugggaggcagaggcugcagugagccaugaucaugccacugcucucuagccuggguggcugagcaagacuccaucugaaaaaaauacaaaaaaauuggcuugguggcaugcaccuguaaucucagcuacucaggaggcugaggcaggagaaucacuucaacccaggaggcggaggugcagugagcugagaucgcaccacugcacuccagccuggguaacagagcaagacccugucucaaaaaaaaaaaaaaaaaaaaaaaagucguuauccagagcugcaucccugguggcaagugagggcuggggacagugauacugcccugccuggcuugaccaccuaacuggcaauaaggucccaguguauggcuagugcugcaggagcagggccaguguccucuggagauggugacaguuccuuccuggugagcgaggguugcuguccuucuggccucugguguccccucugcuccauugacacugccgaggcccugggucgcugcuguugucaugccaccucccucucccccuucuugucccuccuacguagcucucuugcuccaaauugaugauuucaccuuuuuaaugaagacgaugggaguggggacaugcagccgaaacauaguuuauucucauucccccauggggugaaucuaucuggccagcacacuuuaugucacacacaaagcuuugguggguuugggugagccccugggcugguccccuauccaucucccuccccugugcugugccugcagaauuucacccggccugcagcuccugucagcgugagaggggcacacagacaccugcaccuuugaccaccgaaaggcuaccuugggccaugucuuuauccuggcucugacgccacgucguuggcuuucuacugcaaacucagguuuucugagacguggucugaaccucuccccuggguggaacugcagugcaucggcccaggggaccugcgcucacgggcgcacgagcuugagaaagaaguguggccagccucgugcucgccuggccucgugcagcaucuguguguggugugcacuuacgcgugaugaaagcagcccagccgugccgugagaggaagagucggggaggcgaaugggcuggagaaacuguuuccgccuggcuccguguugcuggaaacgggcagaggcggcggagaugaaucccgugugcgagcgcagagcucucuucccggcucgugcuugcuccccucguggcugggggcugugguccuuucaaagcuguucccugcggaucccuucccaggggcacuuugcccucggaagccccgccucccuucucgcagauuguggcaggauuaggggcagcaucuuguaugacuguccuaauugugugcaguucuuuuugagcuuugaauacgaaguuuggucugaaaagaggcuuucucaagccugggcagcucuuucaggaacacauucccagugggaauuuugggugggauucaggaggcaccgaucugccagugagggauuucuaggaacacaagguuagucaggacguggauccccacaguggacacgacugccccaccccgccgaggucggagguggccuugaggagcugggccgucgcuugcugucugagcuuccauccacgaauggugugggaguucgggaucuucccagacauucuuucuucaccuuugggaagauggagggggacggugguggcaucccuugcagucugugcugcgcugacacuuuggagaagugucucccaucuguagagcagaauccucuuuggagaaaugcagcuguccuugaccuugaggcagaaggcgucuccauccugggcaucugucugccccuccccaucuggaugccucaucuugcugugucauuaaugguaaucuuauucuaacagccucccaugcaucaacucuaucaguccccgaauauuaucuuuaaauuuugucagaucgcuuuguggguuucuggcuuuuucucuuuucuaucaagcuauucaaagcaaaaacugaaagugaauuuagaaaaaaaggaaaaauguuaaguaagauauuagacagcccugggggagguuuucacuguguugcuuccagcuugaagccaugucugauuuuggaauucucguuuugaagucaggacuuggaggcauguugagauguaauuuucagcauauguguccagauaggcucuuuuuauucuugugguuuucaaagagcuguuuaaagcagcacuccucaaaagcauggacuguggacucagacagccugggaaacagaguaggcacgagaagguucuagaaauauguggcuggcuuugcugauauccaaggauaugugaucauugcaaagcgauucacuccuguugucuuacccaucagaaugcaguagacuagaaaccacaagaaaugaacagauguaaacagaaacacuggccccucauccagguggccuaagaaacacccacagacucuaaagccaggucuggggacugcuccucccucccucuuugggcugucccaucacacacaggcacuuucccucgggagggccuucccuagaggugccucugaccccagggcggggcucccucuuuccagagcuagccauucauccgcaccuccauccauccagggcggggcuccuucuuuccagagccagccauucauccgcaccuccauccagucaguggaaaugcaccucuuggcuggaagcacugggagcaugucuccaccgccaccuuguucucccacggcaggugccacugagcugggacagacccuguggucuguguccagugggccuagggacucgcggucacuggagggcgugagagccacaugucccgcucuccguguggucccuggguggcagugcccucagaaaacacugauucugcuggaccagggcaggggcacagcauggugggcaccgccucagugaccaucucuuccuccucagccaucgacuacagugacagcgccaugcuccaagcucagcagcugcuccuggggcugggcucuuuccuggaggacgcacgugccuacaugaaggggcagcuggccugcggcuccgucagggaagcgaugcugugggagagguaagaggcccgccuagcacccggcguggcaccccuccuguggccugcugggugcugcuggugggcucuugaaggggaagaggggcccccaggagacagggcgcuggacaggagguuuggggucagggacugcccagagaggccccaggagacagggugcugggcaggaggugcagguguggggucaggggcuccccagaggccacaggggacugggagcuggacaggagguguggggucaggggcuccccagaggccacaggacacugggugcuggacaggagguguggggucaggggcucccgagacaucccagggagacggcgcuggcaggaagugugccuggggcccucgggcucugagcccccugcucagaguggcuuugggcucggguucccugugcgaggagcggagcugcucaucccucccaguccugacugugaggagccaaaaucuauaaaacacacaggccugggcccacagcaucgccuccacuccccacccacggguguccugggcagcgcugcacauucaucccggcaugcagagucuuccggauggucuuggugauaacccaccccugccacuucagcaggguaggcagccaguggccacgggaggcugagauccgggagccccgggcugggccuccccagccucucuuugugaguggucagccgugccgucucucccccaccgagucuuccuugccacuccccucaauaucuauugauuuuuaaaaccaucaugaaaaugcccacgugugucuuguauuuuaagugucacaggugaccucugcucugggacuuuuucuugggguaacaugacaguuugcaguugauguuacauaauuuucugcuacucaggaacucaagucuuugggaauaugaccuagagaaaguccccagauuagagcccccagcgucucucccuggggaaggacuggugugggggccgccuggggagaguggagcucccucugcugugacuguucucuccucuucccucaggcucuccagcaccaagagggccgugaaggcggccuuggcagaugauuuugacacacccagggugguugaugccauccugggccuugcacaccacgggaauggacagcucagggcgucccugaagguagcucaacgaacagguggccuugcgguccugcugccaggggcaugggucggguccucugguggguuuuucucaugucggcuggguggcaucucugcugauuucgccucccgcagcuucuguggaggaacucauggagcccgagucugccgcugacacacgggauggcacccagccuggggcuugacccucccgggccucagggccaccuggggaacaagcucucaggagccccugaggcugagaaauucugugugcuugauccucaggggacacaucucauguccccacugcauucauggcccuuucacagagagagcuuuuguggggaacuuuuuaaggaaagacccauuuaccccaaggcacuguuaugcaaucugcaccccagugugaugaccacaccaagcacccaggggucugagccuggacucgugggucacugcaaguguuuggcaggugggacaaagaccgugaaggcggcggcaggcuuugguuccugcacgucugaggguccccugccaggcccugggaggcgcugcgucaggagccccgugaccuuugaugacccgggaagccgaggcuguuugugccucucccaccucuggaaacaccuggggguucuggccacaugcucuguuaguugagcaucucuguggaggucuccaucccuggcugcgugcaguguuggguuucagagcaccagcagguggggcagggugccaugugcccuugccgggugccuucgguccaaauacugcagacgcgcagggcucgccucugaggggggcgggcauuugagucacagccggcugcaggaacaggcugccccgcacugaaggcagccaggccgggcuggggcaggucccgcagccaggcugcuccugcacgggagcuccuccuccucagcccguccgcggccuccugccuucaccgcagcugcugccggcacuaccaggcuggcccagcucuagggcaacaggggccucuuguggcaaggggcgggacaaguaaagaggcuggcuuuuguccugcgcuuuuccuucccaagcuuugcaauucuggggcaccugcaaacuaaggcuagugucacccaagggucucugugcuugguaacugaugugagccacguaccaggauuuccccguuuucugagaaacccagcccagugcccacucagccuccaccuaccaugcgccaccugccauacuccacggucaugcuucacccgcgaagccugaugagcuagucaccacccacaugacugauggguaaacugaggcacaagagauuccucaugcaccuauaguuguauggucugcagugagguagccgaugccagagcuguguccucccuccauagaagccaggagaaaggccagacugaagugaccugcugaagccuuugucuuuugacauugaauuccguuugcccacugccaucaagacugcuuuuaaggagcuucugcgacaugaucucuuacaggaaccugaagggccgagaaguccugcuguguuuggugccaucaucucuuacuuugaacaguuuuuugaaacuguuggaauuucucuggcaaaucaacagguagguccuauuauuuuaaaugcuuaauucuggaauuuucuccauguugggacaauaaccuuuacccuuuuaacuuggaauagagcauuaugaugccacacuaauguauuuaccuguuuaaaaacauguuacuuuccuggaaaaauaaacacacucagagccaauacuuauuaauuggaauugcacaauucuacuucugcaguuggcaaacucucgugcgcagaaccagagaugaguccaucucagcaacagaaugucgccagcucugcacacacguuuauguucaaagacucucagaaugugcagaagucacaggcacaguaagagaacauuuuuuccugacccauuugagggcaaguuggcgaccugagcccccuugccuggcacauguuuuguacggacaggacgggcuccccgacaggcacgagucaccugcaccuucccagcgaggcucacccuggcugugcagugaagguggacgcugccaggcuucuccacauuccuucucuuccguuguaacucaagagcauuuuugcaaagagacuuggauccuaugaaaauguccucuuccuuaucaggcucaccugaaacucguuuauucuaucaauacagauuugagguuuccugccuuauucuuaaaguccccaccaucacuuuguauguggcugacagaggccccuuggggcuggcgcugugucccugaacaucccugucauucuuuggacacccuuguagaauucucagcacaaggcgcucuggcucuuuugggguguggcucggcugcugcugccuggacgggggcugccacucuagaccagcugcccagcaccccgagggucccgccgcuugggacuggggcccaagcaggugugcugaaggccuggcucugggccaaacaugucucgcuggcucucaacagagaacuauagugucuuuuccaaguuuggcucauuuguauaccuguugaucaccugguagacuuaguuccccuuuccagcaguccggcgucuguugccaaucacauaaaagucgacuggugugagaugacccaaguuuuugcaauguacauguucauuuuuagggguggcuuuccggagucuguuuugaguaagaaaagugggaucuggccaagcucugccuagcccuugucaaagauaucucauucaccuuccucuggccgcaaggcccaaugucugggcccacucugggcucauauuucuguaauaacaaaaacugucuuuuaucauggaagcaauaacugaggggugugugagguuuaaguaguuugacaccaaggucaaauguugugucuguuucuuauuuuacacacauggauuuaacaaauagguacagcugccccuuccacaccgccccaggaucuguucucagugggaggacagcgcgaggccuucugcgcaaaucccguccucagcaccugaggcugugaaucucagaccauuugccgaaacacacgugugcaagcgcucagucgcugccccccagccucauccucagguugcuccugauaccucggccacaauugcgugaggucuggaagccagggagcguuuguguucagggcggggcggcaugcagcccccagcccuuucuuccaacucccgagugaggaucacucagccuugcuuggacgacagaugcucagaguugaguggagccuugcccagagcccagcgcucgcgggcuguacccaucccugccagacccagaaagaggcccagcugcagggaaucagggaagcccagggcugggugggugucggcccagagcccaaccacgggguggggagggggcauccacaauccacagucuccgggggacguaaccgcgcccugcuggcuucaguacguuucaggagacggcagcgaggcuaccuugcauggugugguggacgagcuggugcgguuccggcagaagguccggcaguuugcgcuggccaugcccgaggccacgggggacgcccggcggcagcagcuccuagaaaggcagccccugcuggaagcaugcgacacccugcgccggggccugacugcccacggcaucaacaucaaggugagugccgcaccaaggucagggacaucaccccaggagccggguaggucaacaggacguggggccaucagaggcccagacaucccccgugaccaugcuuuuuuuuugagacggaguuucacucuugucacccaggcuggagugcaauggcgugaucucggcucaccacaaccucugccucugccucccagguucaagcgauucuccugccucagccuccugaguagcuaggauuacaggcaugcacucccaugcucggcugauuuuuuauuuuuaguagagacagguuuucuccacgugggucaggcuggucucaaacucccgaccucaggugauccucccaccucagccucccaaagugccaggauuacaggcgugagccacugcgcccugcccaugcuucugaguagagaaacccacccccauaaaaaaugaggugggagggccgugagggaggggccaaguuggcugcaggggacgcugagcacggggacguggguccugcucagcccccgccaccuccugcaggugccuugaagcuccuggccuucugcuggagguaguggggcccuuucuaagcgccuggcaagcuuuuuaggacaggccggugagggaacaggcacccugaaccugauuacgccugucagcccccugugccacaugacguggugucugcucagaguuggaccucacucuucuucuccaggacagaagcaguacaacauccacgugggaacugcuggaucaaaggacaaaagaccaaaaaucagcgggcugaggauggagcacagccaugaaccugcucacgacaagacgcacccaugcuucucagggucaaggcuuuauguuaaagcuuccugucggggcugcuaggucagcauuaaaguaaggcaaccaacaguguc

SEQ ID NO: 191834 - RNA, 103154 nt, Homo sapiens
ugugggaagcgcccgcgcuuucggcggguuccguuaaaauggcgcccugguggccggcggcgcccgcgccuuagccugucaggagcagggagcuugcggggcgcaggaagggcgcgggccgcggucccugcgcgugcggcggcaguggcggcucugcccggaccaccgugcacggcuccgggcgaggauggcgaccccggaccagaagucgccgaacguucugcugcagaaccugugcugcaggauccugggcaggagcgaagguagaguggccgggcgacgcgaagcccgcagacccgucccgggggcugcucccugcgcgugcagcccuaauacguuccggggcuggaggaacgaggaugcagggccgggcagagggcugggggacgggccgaggacguggggcccggacgagggagcggagggcugggguucgagggucagggagccggggaggacagcggagggcugggggccaggaccggggcggagggaguggagaggccaaggccggggcgagaacgccggggcgggaggcgggagggcggagccgagccggagcgggcugagucaccgcucacuccgcucgcggguccgucagugaggacgggaggaaugccagcucgccaauuuaucccccuucucuggugucacgcgccgugggagggcgccucugcgcgccuuuggguucauccugugggguggagagagcggcugcgccgcggagguggaugcggggugcuggagugucacaucaucgucccuuuucguuaggaaaguuuaacaggcuugaguauuaugggaagaggguguuaacgacuguaacugccguguuuuccuacuguuuaaaggguugaagguuggauuugauauaaaacuauucugggaaaguucacauggcgaauauuguuacuaauaagcaaaacuaauccuauacgguagguaaaaccauuuuguagucgagguacuuugaaagaaaugguacaggaugccauuucuugcuccuuguuuuggccagguugguggggcagagagugaggaugcaccaugagggaauuuucugaguaauggaagcaacugaguuacaucuuaagcaccaaaauguggaaaagaaguuacucaauuuuugaaggaagacuucaaaguuacauuuaaaguacugagaaugcauuuugaccuuucaugcuucaugacaauuacuguacauaauucauuggauguucuaugauaaucuuggggcaaucaugaauaauuuugugucgcuauuaaaugagugacuucacacaguucuugcugcaucuuguaaaguuugauucuaucacuuuauuuaucuaagaaaucuuugaggacaaccccguccucaaaguuccccccgggaacugugcuaagugcuggugaugcagaugcacaagucauuccucccacagaucugacagacacucuacuggaagagacagaugauaaaccagccauguuaauuagcaauaaguacuguggcgaaaaaguaggguaaaggaauagagagggaagaggcaggugagggaaagccucugagauauuuaaagagaccugaauggaguaagggagggccauuugaacaucuggggaagguucugaguagagagaaccaguggaaaggucuugagguaugagcauggccugccaucguuuguuuuugucauuagcagacugaguuuccuuucacauguuucauguuccucgucauagggggaaucagauaaaacuaagauuguuaggacuuacccaccuuaaugucaguguuuuccuuauaccagugguuccagaguuuuuuuuucuagggauaaaccacacauucauacauucccauuguuauaauuggauuuugaaauucauucaucaugagcuagaaugauauuucucaaccuaagaacuuuuuuuuuuuuuugagacagagucucacucuggucgcccaggcuggagugcaguggugugaucucggcucacugccaagcucuaccuuccggguucaugccauucuccugccucagccucccgaguagcugggacuacaggcgcccgccaccacgccuggcucauuuuuuguauuuuuaguagagacgggguuucacuguguuagccaggaugguuucgaucuccugaccucgugaugcacccgccucggccucccgaagugcugggauuagaggugugagccaccgcgcccagccaaaaacuuuuuuuuuuuuacauugaagauucuuugauauaaaaguuuugucccuucuaagagacugaaaagcuucuuuucagcaaaauucuguauccuacuaucuucccauuuagaacugugucuaaaagugggcucucagauccugacaggguccucucugaauaaauaauuuauuuauuuauuuauuugagauggagucuugcucugucaccuaggcuggagugcaguggcaugaucugggcucacugcaaccucugccuccuucaagugauucuccugcaucagccccccaaguaguugggauuacagguguaugccagcacuccuggcuaauuuuuguguuuuuaguagagaugggguuucaccauguggccaggcuggucuccaacuccugaccucaagugaucugcaccccaccccccugccgcuuggccucccaaagugcugggauuacaggcacgagccacugcgcccggcccucucugaauaaauuaugucaugaaguccauuaaaggugaugcucuuuuugcuauguucuagauagcuaggauugucaagcauuuaugauauaauuuuaaauuaugcugcuauuuacugaagaauuuauaaauaguagcuuaccuuguucuuucauuuguuauaccuuagugagcaaaggagcaauauuaauuacuaccuuuacaauauuugguguuaaaaauuugauuagugagcauuuuaucugguaacuccauagaauauuugauuaauuaccuuauucuuugaugacauauuacaauuggccuuaugcuuuuguaauacauuuuuuuuaguacuaugaaaucaaggcauaauagguacuuguuacuuuuaaugagaauuucauaugaaucacauuuuuauaagguaucuuuuaaaaaauuauacaguugacuucaagggaccuucagaagcaaagcaccuacauauaauggugcuugacaguuuuacaaaguuagcaugaccaugauuuaccaccuuuuccaacuuauaacaucugugaauuugcuugaaacacauacugccagccagucauagucaaauccugucuccauaucccugccccuccugggagcacauuuauuuauuaugucuuugcguaauuauucuuaucauuggaaacagugugcuugauguuaauguucaaaucugucagagguaacacuucuuuucauagcuacuuuguaauccuuuuucuaacuaugagguaaagaauacauaaagaggaauuuauauuagauaaguauuucaucauaaauguucagguaugacuacaguacacagcauauucgaagaugauugccauaauaugcaagaccucuaugaguguccuacaagccacuaucagaagauaaaggauuauuguuuuggugauucaguaccacaagugguguugcuauugguuucaugauuuuccaaaaugguaaagagcuuuugaugaaguuccaaauaccaugugaucuuccuuugguuauauaauuacauucuugggaagaucaauguguauuacauguauauuaagauauacauuagauguguauuaaaacuucagaguuucaggcuuuguuucaaguuguacuugauggauuuacuauuuuucaauaaguuaaaauuuaaaaauuguuuuggcuuaaauuucuaauaugguaacuguggauagauauaaccuacauaaacaaaagcuuuuuggaguucucaaucguaauaguguaaagaagcccugagaccaaagaguuugagaaccacgcaucuagaguaauguuuuuguuguuuuagagcauugcuuuucaacuagagccaugcauuggaaucgccugugauuucacaagaaccugauaacguugauugccugugggaaggggagcugguggccagugguugagaacaggacuuuuuaugguaucuaacuucaugccuuuucauuuuaaacucucuaaaugugggacuuacucagaauuaauauugugggcuucaucucuagggcuucugauccuguaggugucuguuggagcuuggcauccgaaacauuaaaaugcgugauaaguuacucugacuugcaucuggagucaaggguggcuaguguaugugcucuguuccucuacuaagcacuguggcuuacucccaacgcccuccugaccccucccccauccuucagaaaagcagaaguguggaacauauaguccacgcugucgacaagaaacaggaaggcagaaacuugggucuccccaaacaguucaacuuuuccgcaguuguuuuuugaaucuugagaaacacacaacuguggaguuucuguauucacuugagucgaauuuauuuuugugcaucuugaaguucaguugucaucuuuaaccugaguguauauagaaucuuuuggggauacaaagggcaacuuuuuuguuuaaaagcucuugggcccacauccaggugucucuggagccuucacauuugggacugaacgcaauuccagcugagggucuugccuuggcuuuguaucuccucuaguuccucuucuccucuucagucagaggguccuuucuagaaaaccaaucucaucgaaucuguugaaggcuuaauuuguucucuauuuguagucuucaagaugaagaccaaauuaucuugcucaagguuaaaaauugggugcauuuuuugaguugugauucuaauggcuguagcagauauaguauguauuuaauauuuucagguuaauaacaauacgaauagcuaacauuuauauaaaacuuaaaauaugcuggauguugugcuuauacugugguagaauuauggugaaccucauuuucuagaugagaaaacugagacuuugagagauuaaguaguuugcucacuaucaucgagcuaguaaauugcggggccaagguuggaacccaaguucugauucuacagcuugauauuuugaauuaauucaccccggcuuuuaaguguugaauuugauggcgaauuucucugugugcucgauagagacaauaagucauggcccagcuugugggauggcuucucaccucuauccgcucuuguguuuagaguguacaacucagcagcacugcucucuggucaggcagugugcccuugcauucauugaaauaauuucagaggaucaucagaggaguguucacuccccuuccaggaaccugagaacugcccaccccucacacacccagagcagauuagaggugggagaacuagaccucuccuuaggugauuuguggccaaaaaaauggaguacucuauuuuucacucuugcauuaagcagaaucaucagagaucuacaucuggaccuugucaccuggggcucucgauggagugacugacugaguggcauuuagagcccuguggcacggccucccugcagcagcaguguccagugccgcccuucccuguggguuccccucucuggucccugggcuccucacguggcagccuuggcugccaggcuaacgguguuuccugcaaggccuucccucagcaucuacuucacgagguccuccuggucaugagcugucauagugcccucauuuucuuugacgcucuuaucacagucugccuuggguacuuaugugccacauuuguuauguucuacgucugucucauuaaccacuguacaucauauuguuagggccugacguguuuggccuguaguaaguauuuaggaguuauucauugaauuacugauugaguuuaguuauacuuuaaacacugaacaguauuuugggaguauuuaaaccagaagcguguaguggacauugcuugauuuuuucccagcuuauucuuugauugcagguucacuaaacaaggaaugauugcuaugucuaauuucuuuaguagucuggauucugugcuuuucccucugaagcacagauuaaguagauuugguuuaagagguaacaguuggauuuuuaaaaauauuuuauaaucagcaagaaggauaaacuggaaauuugguugguaagaggacagggagacucagguguggcugaagagguaagugggggugaaaugaugacauccaucugaggugcagagaaagugaggaggugaagaggagaguguuucuggcauugaagaguuccuaacuuuuugguaugagaaaguugaaaaguauauaaaacauuuggauuggggauauuuaugugauguacuugagugugaaaaugguaaccuaaaaauaauuuuuacuggcuggguacgguggcucacaccuguaaucccagcacuuugggaggccaaggcgggaggauugcuugaucccaggaguucgagaccagccugggcaacaugguaagacccugucuguacagaaaauauaaaaauuagcuggauguggugacacauaccuguagucccagcuacuugggaggcugaggugggggaaucacuugagcccaggaggcagagguugcagggagccgagaucuuaccacugcacuccagccugggcgacagagugagaccuugucugggaaaaaaaaaauucuuaaauagugacacaacuuuuaaaggaaacuuuucaaugauacuuuuaauauuuguaaaauuaauauauacgcaguguaaaaauucagaaaguggaaaaauauaaggagaaaaaaacuaccccgacccugugaccccacaaaacauuuuagauuucauuuuguuccuuuccccacuaugcaggcauucacuggauccuugcugacacagugcgcuugugucugcuuuagcuagaauagggacagaaagaugggggggugugaguccuuagaggauguggagaagagagagcugggugccgagcuggaggugagcuugguguguuccaggaauagcaggagugcaauguggggagcaaggggccggcucccugggcuggggccaggagguuggguucuguugugagugugaugggugugugagcagagugaugauaauauuuauauuuuaagaggaucacuuugacugcuggguggauaauucacucuaagggggcaaagguggaagcaagugagcagcuccucaggagacuuccuguaaugggaugguagcuguggagugaucauauuugggauaugcuuuuagaaauagaaucaacaggauuugcugaucuaaauaauuacuuaauagucugaaaaugucuuuauuucucuuacgcuucuauuccugaacucuuggaucaucagucagauauagauauucuggucugaaguguuuuuccucugcccacuuugaagguauucuuucauuauugaugagaagucugauguuaauccauuucuuacuccuuugaagaugugucugguagcuuuuagaauuuuaaaaaauccugcauguucugaaauuuugcaauaaugugucuagguguggaacuuaaaaauuuaccuggauuaacacuugaugauccuucaaucugaggacuuuuccuuuuuuuaaaauuuauuauuuuuuucaaagcuagugacagacuuagaauuuuuuuuuugagaaggaucuugcuguauuguccaggcuggucgcaaacuccugggcucaagugauccaccucagccccugaaaguguugcaauuacaggugugagccaccacgcagggcugacuuuuuuuuaaugauagaaaaauuuuacuauuuuuucuucauaauuucuaacuguucuuuuguuguguuugauuuucuagcuugcauuuaaauuguccuuuaguaucuccauucugcuauuuagcccauuuaaaaaaauucucaguguuuagguucacagugauuuccucugugcuaccauuuugccuuugugcuggccgccaccauccugugucuguguaugucuccgcuucuagaauuucacguaaaugcagucauacaguguucagucaaaaguuuugagacuuguuucuuucacuuaguauaacgcguuugagaugcauuuacagugccauaucaauaguucaccuuuucauugcagaguaguguuccauuguaugaugaaccaguuuauccauuuuaccacugagggacauuuggagugcuuccguuuuuggcaguuauggauaaugcugcuaugaacauucauggacagguuuuuuaugugaacuuaaguuaguuuucuagaauaaacaccugcaagugggguuguugggccucagggcaggugcaugcucauuguuuucagaaguugccagacucuuuuccaguauggcuguggcugcuuugccgcugcaccagcagugugggagagcuccagggaugccauggcuccacccgcacacagcagugugggagagcuccagggaugccauggcuccacccccacucagcagugugggagagcuccagggaugccauggcuccacccgcacacagcagugugggagagcuccagggaugccguggccccccggcacucagcagugugggagagcuccagggaugccguggcccccugacacucagcagugugcgagagcuccggggaugccguggccccgcgggcacucagcagugugggagagcugcagggaugccguggccccgcuggcacucagcagugugcgagagccccagggaugccguggccccgcgggcauucagcagugugggagagcuccagggaugccguggccccacugucacucagcagugugggagagcuccagggaugccguggccccaccugcacucagcaguguuagugguuuuuaaucuuagcuauucuagcaaguguguugugauaucucagugugguuuuaauuuuaauuuuccuagugauguugaacaucuuuguguguguguguguguuugccauucauaugucuucuuggugaauuaucuguucaaaacuuuugcuuaugucuuuguguuuugcacauauuuuuucucaguauuuucauucucuuaacagugucuuuugcagagcaaaaguuuuuaaucuugaugaaggccaauguaugaauuucuaaaaaaaugggucaucauuuuggugucauguaggaacucugccaaacucaaaguugcaaagauuucuuuguuuuguuuuauuucuaagaggggcuuauguuuuacucuucuauuuaauuuuugcuggggugaucagacccaacaccaggucgugggggugacgaagucugguggagucgaaggaaugagaaaagacaguuugagagcgaaaguggguccagggggccaucgcuaaguauggaggcugugaaggcccugagcucuggaagcccagacuauuuauuggugaucaaacaaagaaacagguggugagaaugugggggucgaaaggucgcguugcauuaagcacaugauuuacaggugugaugauuuagcaucugcucugcuacuugagauaauggagagcagguucuuuuuuuuuuuuuuuuuuuuuuuuuuuugagacggagucucacucuuucgcccaagcuggacugcaguggcgcuaucccggcucacugcaagcuccgccucuuggguucaugccauucuccugccucagccucccgaguagcugggauuacaggcgcccaccaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccgagagcagguucuuuuaacucaagauacaaucgauccugggagagcaaggagcaaggagccagcaagucuagacacauuccagagccacgaguccuggauuccauccaagccacgagggguuuuaugcccugggcugagauuauggugcgucaggguagccuuccgcccuuuagcacagauuggcguuccaaaggccucaagggauuuuagacccuggaccccggacauguuccaagacucuuuuacguuagucagacaugcaagcccugccucagcuucucccaacacucagcuuuucccaacaaauuuucauauguggcaugugauauagguugaaauucauuuuugaguuuaccaaagaaagcuuuuuccccccucacauuuuaguugcuuucuuaucuugaagacuaaaaguuugaaaacggagcuuuaaaaaauauugaugccauggcuccccacuccagacugauaaaaucagaauuugugaaaagugagucuuggcauuaauauauuuuaaaaaaauguuuuauuuuagaaugaugauagacuuacagaaaaauugcaaauauagaguuccuguaagcccaguaccauuuugucuuacauaaccgugguacacuuguuagaauuaauuaauuaauaaugauacacuaguauuaaucaagcuccauaguuauuuagauuuccucacuuagcacucgguggccuuuugcugucucuaggcucccucuaggaauguuacauucauuugucuugucucuuugggcuucucuugacauugacaauuucucggacuuuuuuuuucaugaucuugagaauuuugaggauuaaagguuauuaguagacugucucaacugagucugauauuuuuaucaugacuagacuggggcuacauauuuuugggaggaagacccccagggugaagugacauuuucaucacaucauauggaggauaccugccaccagggugauucaucauucuugaaagugaccuugaucgcuuggcuaaggugugugugccagguuucucugcugugagugacucuuuuuuucugccuguauugugcucuuuggaagaaagugugcccagcccacacuuaugauauggaguuguuuuagcuaccuccuugagagugaagugucuacauaaauuacuuagcccuuauuaucuuuuaaauuuuuauaagaucaguggcaguaucccuuccugauucugugucuugucuuguuuuucuuggucagucuggcaaagguuuaucaauucugugauuuuuuuuucuuuuuuuuuuuuaagaauuuuuuuuuucccuccaccccaccauuuuuuguuguaaauuucauugacugcugggguuuuuuuuuuuuuguuuguuuguuuuaccauuuccuaauguguacuuugaguuuuguuuguucuuuuuccagauuuuaucauauaaacugagauuauugauuugaggucuaucuuccuuuuuaaagaaagcauuuuaugcuauaaauuuuccucuaaggacuguuuuagccacaucucacauauuuugauauguuguguuuuuauuuucauucaauucauuuucugauuuucuuugacaguuuuuauugcccauguauuuuuuucagcuuuguugagguauaauugauaaauccaaaauauauauuuaagguaugcaaugugaugcuuugauguauguauggauugugaaaugauuaccacagugaagcuaaucaauauguucgucagcucaccucaguacccguuuuuuuguguguguuuguguguguggugagaaaaccugugauuuacucucagcagauuucaaguacacaaucuauugucauuaacuaccguccccaugcuguguguuaggucuccagaacucauucacccaugacugcaaguuugaagugcuugcucuuggaguaagaaguugcauugcuuucuucuacugcaaccccuugaaagugcauuuacuguaguuugaggcuuuuccccgagagauuucuaggaccuuuauagagaaagagaaaggaguagcaguuuuuccaauuugaggccuguucugaccuuucuuuugacagcucagccuugcuucuguuaaauuuuuuagcuguucagaauuacguucauuccaugaauuuuuaagucuuguaguuguuacugugaagauguaauauagugauauaaaacaaccuuuuaaauaagguuuaauuuaaguaaugaaaggcacguacguaauuuuccuaugacugcuguaacaaauuauuacaaauuaguucguuuauuccccuguguuucuggagaccagagccaaaggcaguguccuggggcugacugcagguugcagggcugggcuaccccuggaggcucuggggggugcugcgucgccuuuuccagcuccagugacuguggugcuccuuggcucauuggcuccuuggcccauguguguguugacugacugccagauguuuggagauuuuucagauaccauucuguuaaggauuacuaguuuaauucuguuaguguuagaggacauacuuugaauaauuuuauuguuuucuauuuaaucagacugcuuugugacccacaauucagucuguccugaauguuccacgugcauuugaaaagagcguguguuguuuuguuguggggugggcuguugugugaauaccgauuagguuuaguugguuguugguguucaaguugauauccuugcucauuuucucuucacuugcccuuuggauuacugagaaaugccccuugaugucuccagauguauuugugaaugucuguuuuuccuuucaguucuauuagaguuugcuucaugugccuuacagcucugcuguuuagaguguucacauuuagaauugcuaugucaucuuggugaauugcccuuuuaucauuuugugaucccuacuuuauccuuguuaauuuuucuuagucuaaaguuuacuuugucugauagaaauguagccaguucacguucuuugaauaguguuuucauggaauaucuuucuucuuccuuucauuuuuaaggauaucuuucaucaugucucaguugggcuccuucucgauaguacacagcuuuaaggggugacuuuuuccagcuuccucuucugugcugcugcccucacucugguucccaacacauuuccucauguucuggcuaaaauccgaacccccagccugccagccuugugauggaguuuuggggccauuauugguucuugucaaguguggaauggggcagcccacugcgggggugccccugaagguagaaggggcugguagccuggcgcagggcugggagagcuguggugcuuccucccucccuccccaccugggcccuggcuggggagacugggccuggcucggagguuuuucugucuuugccuguuugugguuuggguuuuggaguguuacccagccccagcuggugcaguaaacagcaaacagauaaagaaaauaucaaaaagcaaaaaugggggaagucauuccaggauuuccuuugauucaucaguuucauacccagucugcuucucuuacccauuguucagagucugauuggagguguuuuauguauuuuugccagaguuuuacauugucaucaguaguggagugugcuuacucugucuugacggagaugacuucugucucuaguuucuucuuucaagucaauccuguuuguuuucuuuacaucuuucagggauucuucaguuucuguuucaccaagagugcucuucuuagauccacuuuucugguuuuguuuauaucuuccuuaaauccuuuguuacauuucuggggauuuuggauugucuauggauugggcaggggaagucacacugugagcucagagugcccacuugaagauucucuguggauugggcaggggaagccacacugagcucagagugcccacuugaagauucucuguggauugggcagggggaagccacacugagcucagagugcucacuugaagauucucuguggauugggcaggggaagccacacugugagcguggagugcccacuugaagauucuuuguggauugggcagggggaagccacacugugagcucagagugcccacuugaagauucucuguggauugggcagggggaagccacacugugagcucagagugcccacuugaagauucucuguggauugggcaggggaagccacacugagcucagagugcccacuugaagauucucuguggauugggcaggggaagccacacugugagcucagagugcucacuuaaagauucucugcggauugggcagaggaagccauacugagcucagagugcccacuugaauuuccaggugccacucauaguuccacuuccuuccuaggauggagaacaguguuggcuuuugcuggcagaugcagcugggcacugcccuguugggcugcuccucugcaucccggguugaacugggcccagcacucagugguggggguggggggaucuggagguaucuacugguaacuugacuucuagagucauagaaguugggcagacaggcaggcuaucccacccuggcaccagcuccaauccacuuauugaagugauugcuuucggaagguggaggcuuucugaaagauuucuuccugacccuugacguucuuuugcugcugagauuguaguggggaacauucuucucccagaucccuuguacugagggugggaguuccucagauugggaguuugccucugcagagaugagagccuggauuuuuuccuggggcuaaggcaguugcugugaaccauguaacuuccaaggcccuucccuucucauccuuucugucuuguaugacuucuuuggacauuuauuccacuccagguuucucccuccccacuucugccugggcugaucuggugauuuccuugucuuggcugucguaauuuccaucuuuuugccuuuuuguuuuaguuuuugagagacuucuucaacuuuaaauacaagcuuucuacuuauuuuaaaaaacaucugccuucauacuuuuaauauucaagagcuugucuucucugaauuuauggcauacuguuuuguuucauggauguguuaugucuaaucucguaggccauuauagcuuguuuuuguacaucuugcccccauuuucuuauucccuacguuguuacuuuuucuuagaguuuccuuuuuuccuucuuguguuugucuccuuuuuguuuuagaugaugcccucagguaucuggcgauaccuguucuuuucaucuuuaagaguggaguugucggaaggucuuggcuagggcagcauuugcccagugcugagcuuccuuguggaggacaggcacacgucaucuuauuguccuuuacagauacugcguuauuugacaauuggaaguuuuuggcacccugcguugggcaagucuuuagguaccauuuuuccaacagcaugugcucacuuuguaucucugugucauauuuggaaauucucacaguauuucagacuuuuucaugauuauuacaucuguuacguugauguguaacuugugaucuuugaugcugcuguuguaauuguuuuggggugccaugaagugcgcaaacuuaaucaaaaaguguuguguauguucugacuacucugccgaccagcuguucccugucucacccucucuccucaggccucccuauuuccugagucacaacaauauugaaauuaggccaguuaauagccuuacagugaccucuuacuguuuaagugaaauuagugaucaacagaaaaccaaacaugaccuucucacucauaagugggaguugaacagugagaacacauggacacagagaggggaacaacacacaccagagccuguuggaggguggggggugaggggcgggaacuuagaggacgggucauuaggugccgcaaaccagcacagcacacguauaccuauguaacaaaccugccacacguguaccuguguaacaaaccugcacguucugcacauguaucccgcuuuuuguuuuuuagaagaaauaauaauaaaagaaauuaguguucaagugaaaugaagagucacaugccucucacuuuaaaucaaaagcuagaaaugguuaagcuuggugaggaaggcaugccaaaagcugagauacgcgagaagcuaggccucuuaugccaguuagucaaguugugauugaauaggaaaaguucuugaaggaaauuacaaaugcuauuccagugaacacaagaguaauaaauugaaacagccuuauugcuaauauggagaaaguuugaguggucuggauagaagaucaaaccagccacagcauuccuuuaagccaaaaccuaaucuugagcaagaccuuaauucugugaaggcugagagaggugaggaagcugcagaagaaaaguuagaagcuagcagggguuuuuaguucaugagacugaaggaaagaagcugucuccauaacauaaaaaugcaaggugaagcagcaccugcuaauggagaagcugcagcaagucauccagaacuagcugagaucauuggggaagguggcuacacuaacaacagauuuucaguguaagugaaacacccuucuauuggaauaagaugccaucuuauuggcgucuaauaagaugccaacuuucauuccuagagaggagaaguuagugccuuccuucagagcuacaaagaauaagccgacucuugucuggggcuaaugcagcaggugacugaaguuguugaagccagugcucguugaccauuccaaaaauccuggggcccuuaggaguuaugcuaaaucuacucuuccugugcucuagaaaugaaacgacaaagccuagaugacagcacaucuuuuuauagcaugguuuacugaauauuuuaagccuccuauuaaggucugcugcucagaaaaagauuccuuacugcucguugagaaugcaccuggaguuguuuucaugccugcuaacaugcaucuguucugcagaacauggaccaaagaguaauuucaacuuucaaaucuuaucacuugagaaacacauuuuauaaggcuauaguugccauagauagugauuccucugauggaucugggcaaaguaaauugaaaaccuucuggaaaggauucaucauucuagaugccauuaagaucauuugugauucaugggaggucaaauugucaacauuaacaggaguuuggaagaaagugauuccagccaugauggaugacuuugaggguucaagccuucaguggaggaaggaacugcagaugugguggcaauagcaggagaaguagaagaggaucuugaagagguaacugaacugccacaaucucaugauaaaaugugaagggaugaggaguugcuuuuuaucgaugagcagagaaagugguuucuugagguggaaucuacuccugcugaagugcugugaacauuguugaaaugacaacaaagaauuuagaauauuacauaaacuuaguugauaaaacaguggcaggguuuaagaggacuggcuucuguuucgaaagaaguucuacuguggguaaaaugcuaucaaacaacaucacaugcuauagagaagaagcaugaaaggaagggucaaucgaugugguaaacuucauuguugucuuauuuuaagaaauugccacagccuucagcaaccaccgcccuggucagucaguagucgucaacaucaaggugagacccuccaccagcaaaaagauuucgacuugcugaaggcucagaugauuguuagcauuuuuuagcaauaaaguauuuuugaauuaaggcuguguauauguuuuuuucuuuuuagacauaaugcuguuccacacuuaacagaccacaguauauuaaaccuaacuuuuauaugcacugggaaaacaaaaaguuucaugugacucacuuuuugugauauuuucuuuaauauggugguuggaaccagaucugcacuaucucuguggucugucugaauuugacaaagacccgugugcuuguuggggauccccacucaucaccaucugucucucuuuucucuugggcugaucaguuuucucauagacaaauugugcauccuggaguucugggaaggacuggggaucccugaguugucuguuaacuuuacuuagugaccggggccacccuaguguccauccagaccaggcuugcugggcgggucucggugguugucuggcagcgugggauuggguggaggacccaggagucuguuuccguccaaacuugcagccaggucucccccuucagcccugcuugcuucugcauccugagaguauccaguuccuuccuuuccugagccugccugggcucugcagugggaacuguuauuucuucuugacauuuauuccucccacuccccucuccccauucuuaacuugacggacauuuaguguuccgguuucauuguccucuugaaucaguuaccacacaucuaucugcaguccagcuucucacauuuuuugacuucucucugauuccuuucugccuuguuuucuuuguccuuguugguuuaugcuuuuaguuuuaaaaacuccuuuauccucaauuuuaugguguuuuugaagggaguagaggcacaugcguuuaagcugucaucuucaucuagaggugaaaaugcaaauuaacugucuauuuugacuguugagugaccugcuucuggcuuuuuguguguguugacccuggaguuacucagaggcucucuugacccggccuccucuucuuguucauguguugggaugugacccuuucuguuccuuuucuuuucgugauuacugagccaguuuguuuuuugucaucuaggauuuuucagacucucugguguguuacuguucucauucuuauuuuauugaacucuuauuucauucauucauucuguuuugauaucuuaauagcuuuucuguccucucaguuaagaccuuggggagguggaagauagauguuauuacuaguucacugucuugaacuggaagcuucaggugaccagaacguaaccugguugguaacaauccgcauccuuuuguuugucuuucagcugauguagcccagcaguuccaguaugcugugcgggugauuggcagcaacuucgccccaacuguugaaagagaugaauuuuuaguagcugaaaaaaucaagaaagagcguacguauuuuucuuaaaugucauguguuggauucuuaaacucgucagagcuuaagcagauguauguaugcauguguguagguguguauguaguucccaagcgcauuuuaauauugguacaaaauaaggacaagucaauucuguuguagagucagaacuauuagaacauaauacuuuagaauguuuaauucugggauggugcauaaagcuuuugcaaauccuggcaccuuagagaagaaagcuuuccauuuguuagcuuuugguuggugaguagguuaucugauuaucccuggcagggcucugccacccugcuucaccucugaagagucugaggggaagcucagcucugaguaaugagccgccacacaugagcuguccuguuugaaaggugguuuuuccagguggccagcucuucauccuuauaguucucugggcuguauaagccaaacgcaguggugcuuuucaguuggccuagaaaagaggccugcgcgaaggucagugcauuucccugcuggggccuccccguuaaacuguccaaguggaguagauguuggccuugggucucaguaauaacaucuucuggaaguccauuuggccuugggucucaguaguaacaccuucuagaaguccauuuggcugugggucucaguaauaacaccuuuuagaaguccauuuggccuugggucucaguaauaacacguucuagaagcccauuuggccuugggucucaguaauaacaccuucuagaagcccauuuggccuugggucucaguaauaacacguucuagaagcccauuuggccuugggucucaguaguaacaccuucuagaaacccauuuggccuugggucucaauaauaacauguucuagaagcccauuuggccuugggucucaguaauaacaccuucuagaaguccauuuggccuugggucuuagugauaacaccuucuagaaguccauuuggcugugggucuuagugauaacaccuucuagaaguccauuuggcuuugggucuuagugauaacaccuuccagaaguccauuuggccuugggucucaguaauaacaccuucuagaaguccauuuggccgugggucuuagugauaacaccuucuagaaguccauuuggccuugggucucaguaguaacaucuuuuagaaguccauuuggccuuaggucuuagugauaacaccuucuagaagcccauuuggcugugggucucaguaauaacacuuucuagaaguccauuuggccuugggucuuagugauaacaccuucuagaaguccugcguggcacaguuuuccaccccuggcuguugcauuaugaacuguguuuggcccauggucuguggaggucccacuuuagaccugugugacugcacuggauggcgagucaguucuggguagaguugagggugugacccagaguacuucaccuagacauagugcuuuugccuguucagggcuggacgagcagugggagucugaaaugauccaucugcuguuaugaugcagagcuuugguguugcugagugugcauguauuauuuaagacggggaauaaaaaugggguauuuauacugcuguuaacauacuaaaaauuuauuuuccucaaugucuauauaacaacauaagaacacuauacucuccucuugaacccuaaaccauuuuacacauuuuagaugauuacugaagacuccagcaauuagguacugugauaaacagaccauuuccuuuacaaaguuacauuucauggccucguggugagcauauuacacauauuuaaacauacuacuauaagugugucauaguagcuaaaaauaaaguuuguuuaaacucaaagaacugacagcuacuuuguugcaguggauauucgagggaaucugggauuuuccuuuuaaagaagaaaacugcagcaauguagaguuuguguuuccuguggguguuguguuuugagauuaaggcauguuguguauugacugacucaggugccucugggguguccccagcagguguccccaacucuucuugggacccuccagugagcaccaccuccuucagcaccuauaguccuuuccugugauaggcacuguuaauuugucauguuuuaugaaugcuuagacauuugaaauuugauuacaguuguugauagaucaguugaguuaugguagcucugcucuuuggaauaauauggagaaguuaauuuuccauucgauauaaccgaccucaaauauaaagugcuaguauguuuuauauugaaacaaauugcaaaagucaucaugugugacaaaacauuuuccacacuggcaggugggguacauuguaacuggagaugugcuaaaauuuaauagagaaucaauuuaauagagaaacaucacuuauuuuguaaauacuaugcguucauuuuuauucuuauuuuauugugcugugacuguagugcauguaugaauuagugccaaucucauucuauagaaagagcgucacuugcuugauuucaugguuguauuuugagucuauuuauauguuguaaauacaguaaauuauauuaaauuuuaauugcauucauuuuguguaaugcacuuuacauaguauguuuuaagauagcuuuccuuuuccauauaggaagaguugcauguacaguuaugauuagauuauguaaucucugguaugugcuucauaccaagauccuuuuuuagcugaagaauaugggguuggcuguaaagucagucauuaucuuuguacagaugaauuagaacauuuaaugcuaaaugugauuggcugaugagcuuuuuauaaagucauacuacuaaaaugggauacauacaaagguucauuagagaguauugaaguuauaaguuagccuuugaaaguggcaccuuucuagugggugugacagcuucuuugagaggcaucugugcacaggugauguuugcaguguuguaaaugugagcaaaguagguucucuucccccagggaacccaauacgaccgcagcuucuccuccuucauggaacagaacauagaaugaacuucucauucgcugcaacugcuuucagauaauuuguaaguguagcuggaacagccaaagacauuuguuaaucaaaugaauugguggaugaaaauuaauaagcuauuuugaauuuuauuuugaaacagugaguaugacauuuaauacuaaaacaagaugacacauugcuguguaucuuuuuuuuuuuuuuuugagacagagucucgcucugucggccaggcuggagugcaguggugugaucuuggcucacugcaagcucugccuccuggguucaugccauucaccugccucagccucccagguggcugggacuacaggugcccgcuaacacacccagcuaauuuuuuguauuuuuuaguagagacucgguuucaccguguuagccaggauggucucgaucuccugaccuugugauccaccugccucggucucccaaagugcugggauuacaggcgugagccaccgcgcccagccugcuguguaucuuaacaaaaauguuuaggauauguaguuuccaaguggaaugaaugaccaugaauauuguacuuaacuuacugcccuuggauucaggauuccuaauauuuucacuuuccaucccuaccuccaggugaccacuguuaacugguuacagugaucauaguuugccuuacuguuuauuaauauuuguagauggacuguaaguaaucccauuauuucuauuacuuuaccuaauuuucacauaaacucuuugaucccagccuaauauuuuccguacuuuacaaaugucagggagguuagaugaauugaucagauucauagagcuuaaaaguugcucaucaucuaauuugacagugacuuuugacucugaauucaucacuugcgaguuaugguguuguaggugaaauaguaucauaagaaugaauuuugguguuuguaguuaccacacuuauuuuuuuucugucuuuucaguuauucgacaacgaagagaagcagaugcugcauuauuuucagaacuccacagaaaacuucauucacagguacagugcagaauucuggaggucauugcacucauuguugaggauaugaugagugguauaggaaccuuugaauguuuuuugugguaucauauuaaacuuuucuauaauugguaauugcuuuuaauuauagauagcauuugcuuuuuuugugugagcuucaguauuagaaguuuuagcuggauuuaaugcuaaauugcuuauaaagaugaaugaagcugcacagggaaagucaacagaauuugugaguuuuuauuguagucgcuuaauuacacugcugggaggaagcacauugguagaagucuuaucuucauauaauagcuaaacuuuaucugacugauaaacuuuauucauugggucauaauuuguacugccauagugaauaacgaaaaaauugauuuugaacgugguuggauauugauacuugaaaaugaaugauuuuucuaaccuuuuuuuuuucuuuugagacgcagcuucgcuguguuccccaggcuggucucaaacuccugggcucaagcaauccuccugccugggccucccaaguagcugggacuacaggugcaugccaccaagcccagccuuguauuuugauaaaagauuuuggcagccuguauaccaauacauuaauugaaucauagggugagauuuuucugauuucugacuauaaaggaacuuaguucaucccgcuuucuuuccuuuuauggagaagaaagugaaucuagagagguuuagugcuuugcgcaacaaauacuguuaguguuacacagugaaaaugauugagucaggccuaaugcugcuaguaauuaaacucuuuuauuuugagucuuccucuguuguuauauugugcucuggaaacaagcuuaguucauuugcugcccauuuugauuccuuaauuguuugacuuggauucacuguuuuaagcaugcuuuuuuccauaauauuugcgauauuaucuuuguaauguuuacagaguaagaaauaggaaccuuuuuuguccauucauuuccaggcaaauuauuucaaacugcuguaucauuugcuuucuuaaaucuuucuccauuuuuaaaaccauuuucuacacacuguauguuaaaaagauuugcuuauuggauaccauauuucuccagauucuuagccuuaccaagaugcccaaagggagauuucaucuaguaaaagcuguuguauuuguuaauauuagccauuggaugaaaacauauuuagacacuuuuuuuuuuuuuugaggcgaagucuugcucugugccccaggcuggagugcaguggcgcaaucugggcucacugcaagcucugccuucuggguucacgccauucuccugccucagccucccagguagcugggacuacaggcgcccgccaacacgcccggcuaauuuuuuuuuuuuuuuuugguauuuuuaguagagaugggguuucacgguguuagccaggauggucucgaucuccugacuucgugaucuguccgucucggccucccaaaguggugggauuacaggcgugagccaccgcgccuggcccuauuuagacacuuugugacuuaaaaugguuguuuuccaaaauuuuguuuggagcucugaauguuuauuccuaaauaucaaugucuuaaauaguggcccgcucccuagggcucguccccaaaacugacuugcuuggcuuuuucauugcaugacugaaacaugaugaaaaauacuaggaaauaauaguauaagaccaacgauuaaaccaaguagaauaggagauucagguuaguagccauuccaucauuuugcuaaaaauggcuccgcagaagugugaagguuguugauccuaauuuuuuaucuugucuuaguuagggccccguaugugggugugcugugcagaccauggggacgaaaggucaaaggugcagucgaauguuugcucuuguuguugguagaccuagaggaaggaguccggaguggaaggaggguccagguugacguggagacgggaguagagugcugugcuguuccugagcuggguuugaagcauggcugagcaggaaaguccgaagggggaggguggcuuaugaggggaguagaacuagaacauugugcaucugcacugcccgggcaggacucuggccucgagggcagggaacagcgugcaggugcuguggcggcaugguagguggugcccuguugaugacggguguucugguguggcagugccgggaaagcugagaucagcucuugugcugggcacuaaacggcugcuuugcgaagauguuuauuugguguuccucuagaucuuaccaugucccgauaagacuuucuucacguacaauucaguuugugcacaguuuuaaaaguuuuguaucugaacuugcgguccuguaguucagagucugagguggcaggucugaagugauuucgggugguuaaaagcaucuguacugccagaguggugggaaugaucugguuuccucugccagaucucuccucuacccacuccugcccacucugugcucuccaggccuggcagauuauacuccuggccucucgcugugugucucccgguuggcuucagcuggagcuggcuuaagcuccagggugagucuggaguugggagaggggugacacuaaacucaucuccccugcugcugggcagcuguuugucaguggcguagcugugaccacagcuccugagggcagucccugcccuguguugggcccuccuggacccugcagcugcugucuccagccugaucucucuggucucagggucauuaguggcuucuggcuggugguguuccccuaguggccccuggcuggugguguucccuaguagguccuggcuggugguguucccuaguagguccuggcuggugguauucccuaguaggcccuggcuggugguggucccuaguggguccuggcuggugguguucccuaguggguccuggcuggugguguucccuaguggguccuggcuggugguguucccuauuggguccuggcuggugguguucccuaguggguccuggcuggugguauucccauaguugcuccuggcugguaguguugcuggugguguuuccagacugccucacugucuccugugguuucccuguuuccguccacaccuucguaucaaaugguuuucagcagacugaagagauccuggguguuuuauacuugcucuuuuuauaguuaaaaaaugcugccuccuccuuuaugucacuugcuaaguuuuuggugcauaauuuuguucauuuuugaaauuucuccacccuucacccucagauacaucuuugcuaaaauauaaucugagauuuuuaaccuagcgguuucuuagugcaaagguagaacauuuccugccgucuuucccuucaccuaccggucauuucacucagagacuuccuggaaacucccacagggacuuacaacuuggcauccucugagcugaaggaaguguugcgucuuguuccaccccucugggcguccauuugcauccacccgcacgcugccugcucuuucuucugucuucucucuuuuggugaaugacagcaccauugaucuugccccccaugagaaccugagugucaucuugacuccccagcuauaucucucguuuguccguuuuggagucgggcagaccuggguuugaacccugcauguagcucugugauuugggugaguuauucagauuugcuguccuuuguucucucauuuauggcaugaagagaauaagcccugucauagugugguugugacgaugacaggauuuaauguguggaaagagcuaaagguuggcagcagcuuggcuccuugguccugggccugagugccugagccucacgggccccuguugcuggcuugcagggacucaccggggacacaugccugagcacacacucggcucacugcauugcauucagcugcuugcaucucccuccagauaacagcggucuuccucucauguuguccccuccagcauguucgucacuugugcagugauggugccucugccuaggacguccuucgcaggcuuccugcuguugucuuuaccuccaaauccaaguuucuuggugcagcguggaggccucauuccgaugucagcuucccuccugacuccuggccuuugccagguugcuguguucacuguuccugucccucccucuacacgguccaucuuucuaggagacucgagucuccuccagaagcccuuuugugagcugugaagugccauuugucacguugcaucugcccacuugucuguugccugugaugagacacacuccaucagggcugggucuguuucuuauccucguggcccuggcuggggauuaguugaguuucugaaaaagccuaugucaaccaauuuuuuaaaguuaguaauuuaaauaccugggaugagcuuacuuuuaaaagaaacuuccagagaauguuuuauauaauggagaguuuacauaauauaagcaaucaucccauaauuuguuauguaaauaaagguacuuacaugugcaugcaaaagguaaggcugucugaauagaguauacugagguuuggcugcuguuauguuugcgaaucagacuggugugauacacaauuggaaauuaaugaaaucuguaugauaacccuugcauagaaaccuguggguugguuaucuugacagcuaagugcuucagacccacuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccagcuaauuuuuuguauuuuuaguagagacgggguuucaccguuuuagccgggauggucucgaucuccugaccucgugauccgcccgccucggccucccaaagugcugggauuacaggcgugagccaccgcgcccggccuuuuuuuuuuuuuuuugagacggagucuugcucugucucccagcuggauugcagugguguaaucucagcucacugcaaccucugcuucccagguucaagugauucucgugucucagccucccgaguagcugggacuacaggugcgugauaccacgccuggcuaauuuuguguuuuuaguagagaugggguuucgccauguuggccaggcuggucucgaacuccuaaccucaagugguccaccugcuuuggccuuccaaagugcugggauuacaggcgugagccccuguucccggcccagaccugcaucuugacuuuagguacacaugaugcugagacuaacuugugcuuguggcuuaaaugggauguugauaaaggaaaaaauaauucacauauuuuuaugauggcuuugucucauaauuacgguuuuggggacauuauaagaauuauuucaggggagacgauacuguuauucaggaauaggguaacuuaaaaaaacuuuucuucuuggggacuuuagagcuaguuaauaagggaaggaaagauccaagguuguugguugcaugaggacauuugcuuccgccuucggauggguggcacuguugaaaauacuuaugaauuguuagauuugacguuacuaugugaauuuuaaaaugcauuucuaguuuggaaauauaguucaggaaagaggaaaauaaggcuggagaguaguauaaaaucguucuuuuaauauuaacuuuuuuccaaacagggaguuuugaaaaauaaauggucaauacucuaccucuugcugagccucagugaggacccacgcaggcagccaagcaagguaaguggcuuugccuuugcagcgucguguccgucgggacacccuggcugacuuugauaggaaacggcuucugcagcuaagaaaauaaugcuaggaaagcaacaagcuugucugucauggaaggucaagagauuucuuuuccuuuuucuuuuuaaggacauuuuuagucagugugguuuccugauaauguuuuucagaauuuuguuauucagacauaacaaugggugauuaaauagagaauaaaugguuaguuuucaaaauguuuacuuugugaaguuacuaauaucagcacugauagguaauucuuuaugaacuagaagacccuuuaggaguuuuucaugcucucaguuaugagcauucuuuacuuuugugccagugaaacccugucaucaccgggcucagugucuguccccugcaguaugucagagugauuccagugcucugugccccagagucugguauaauaaaguacucaccagagacgugggagugcaaagagguugaagcgugugggugaaagaguucugucuauugcuaaaggcuucgucugagcaaucauuauauauuaauauacauguaaaccauauagaugugaauauauagagggcaaucauucuuuaauaaugccuaacuuuaaaaaauuauucaaguuucaguuugcuuggaucagagugaguguuuaguuaucagaugauguagugguuguuggaguucagaaaauuuucuaaaacuuuaucaguuuaggcauauuucaaaagcauaacaucuaauuuauuguuuaauaaaguauggaacccaaauccaguuacagaaauagaaggaaaaucugaauauaaaugaccuuuuuagguuugggaagacuguucuguaauuuccugucucugcucuuaguguguuucucuuuucagguuucuagcuaugcuacguuauuugcucaggccuuaccaagagaugcccacucaaccccuuacuacuaugccaggccucagacccuuccccugagcuaccaagaucggagugcccagucagcccagagcuccggcagcgugggcagcaguggcaucagcagcauuggccugugugcccucaguggccccgcgccugcgccacaaucucuccucccaggguaaggccacacugacguguauagauucucuauguguuagaaacagagacgccugcaggcuguuaaccagacauugauguucacccacaguaucaguggggccucauacgugccagacaguguucugggcacuguguccgaugcacuccaucucugaacguuacuccucuucagagcuaugcuacagcaggaguuccuuccacuuuguaauccacaagcucuggccagcucucaccugucacugaagugcccaucacgaaggagcuugaaguacccugugcaaagcccuucaucuggaggcucucugacugugugcucagauuuuuccuuagggaauaguggccucuucauugauguauguuuuucuccucauuggauucuuuaguaaauuguuaaguaaaauaaaauaagguugaacuuuccuugagugcugaggucuuuaaggaucgugacauuuuagugcauaugaauuaagaugaugaaaugcaggaaugcacaacgaagguuuuauguaugugguccaagcauguuuucaagaaauacaggauuuacagcugagaaucaagcaggcgccauugucauucauggauggaacuuuguuuuucuuuguuuuuaauuacacauucuuccuauauguagauaaacggguggcuuugcuuuuugccauaguugguucccggaaaucgcauuaaaguggauuaucauaaaguagauauuuuuccagaaaaacagugaccaaggauuuagcaucaaauaaaugguguuuuccaugugaguguaauagaauuauaaaucauuuugugauuuauucaauuauguucaagauacucgaaaacagaauguguguucuauacauauggauuaccaauggggucuaguguucuaugaagaaaacgcaaagcauuuaaaaacagaacuugacacauuuaaucuagaauuuaaguuccagcuaaaagaaucaauugacauucucauuuauaccucagaauuugaauuauuauccuauuaaaaaucuguauagagaacuuugaacugaaagucuuuuagaaucauccucuuaaauuuagaacuaugcccagagacauaguuuuagugaauguuguugacuucucuccugaugaaaauggaauaaaauaagaacuguuucaguucuuuccuguucuccuuacuucacgaguggauuauggauaaacccccccaguauugcaccaguacuaaauccaagcucuggcaccuggaaacuguagagcagcugagguucucauuuuuguguuuuguagucccaggaagugauauuuuuguugcaccugucaaaacugacgcuauuagaaaucagcuaugagguucuuacauuuuucaaaaaacaacuuugacauagucucaaaauugcugacaagccaucuugaccuugaauaugcauuugccuuagauuuuauacguuuguauacuuuagcaguuaauugaaaauugcaguuucuuuucauagugagcacucugaaggcugaagacaggugaggccaggcgccuggggcagugucacagugacucgauuccucugcucaguacauggggagugaacgagaguuguggauuuugaaguuaaaauaaguagagaauuucaaagugguuaugggguggguaagguauguuauauguuuauaaagaaaagccaaauagauuuugauauuaaugguaagaaauauauauuguaagguagcaguaagaugauuuuuccacugcuguguuggguccgaaugcuaggccaagggucgcaaggaggcuugaccaaguucaagggacuugggacugucuguuauugauauauucgguuaggguaaagucaugguaucagcuauaccagauuuauaaauuuauguaauucacgauaguaauacaagagaaauuucuagggacacuuuugucucuucagcgaauagccuauuagaagauaauacauguuucuuuuuuuagacagucuaaucaagcuccaggaguaggagauugccuucgacagcaguuggggucacgacucgcauggacuuuaacugcaaaucagccuucuucacaagccacuaccucaaaagguguccccagugcugugucucgcaacaugacaagguccaggagagaaggggauacggguggugaguaaggaucuauguuaauacagcuuuucugugaacacuuggaauucagccucuccuuauuuuaaaguacagcccaggagccccaccucaaaccuuuuagugguuucuucuuguucuuaugaugaaguccagagucccugguggucugcggcgccuuggggaguuuggcuuuucaccccaggccaccugggcuuuuuccucccagcacagucugcuuuuuggcugcuuuuccauguggccuccucccuccacaucucucgucuuugcuguuccucaucacauucucccugucuguuuucauccugccguuucccugggaaagucuuuaaggcuggguuaggcccccaguaaaagucaccuucuucuaccaaagucuuaaggccacagaggggcuaugucuuuucauuuauggugccagugcucagcacagugccuggcacgucgaagagagucauugaggaauuacugaauggugagaugaauaccucauggaggguuuuaaagcccugcuagauuccaaaaggaagcuugaguuucuuuauugagaacacuacaguuagcagcauuugaaacaugaguguccugaaaacagaggauuggguuucccuguuggcucguaaucugcugauuacgaaauggcucuggauguuaccuguaccuguccuugcguagaaugcaaaggugaggagcaucugagagcuggaggacauccuggcacaguauuagcccccgcaguagucuccaccaucugccccacuccgccugucccuguguguggcucccgcguccagccucuguccacagcugcagauucaugucguguuugacagcugugcguucauggcacagcaggccaaccucuagacugagacucgccuuguuucuuucuaaucucauacucuuuuucaucuugagcuuauuuauugaguuaguaaauuucaucgggguggcaaauaucuaaucugaagcuaauugcaccauaauaucuauugucuguuaaaauauugucuaguaauuacugucuuuaaaaaaugauuuugcagguacuauggaaauuacagaagcagcucugguaagggacauuuuguacgucuuucagggcauagauggcaaaaacaucaaaaugaacaacacugaaaauuguuacaaaguagaaggaaagguacaguaacauaaaaucuaaguuaaaauauucagaaagaaaaaacaugucaugaaguccagauaguggcuguugauugauaaggugguacugggguuuugcgaaucgguugugaggugaaauugcacuguggaauucugguuucuauuucuguccauuguggcucguucaguuuuguuauggggacccuuugugauuaaugugugccuccuuuccucacgucuacugauggggcugccccauagcugauuucugcauccugcugugugauggcugaggcacccaggggacagaggucccuuggcaccuucggcauugaugcaggauuccaggucaggggucuucacccacuuuuguuuccuuuuuccauaaucugccuuuaccaugcccauuucuuguggugugggucacacuguggcucuuagcccuuucacagcguggcugagaucacagaccuucucugccacaccgcaggccaacugcaggguggugugaaaugagcucaccaugcccuuugaggugcuuuccaucaugcugucacuuaaugugcuuuccuucccuuuagugaugggaucuuaguuuuaacuuuuaugucuugaagccuaaggauuauaguauuaaaaguagaagugcuugagaaaaauacuaauuaaagcucuaguauugcuuuuuaauguuuaacauuugauguauuuacuuuuuaggcaaaucuaaguaggucuuugagagacacagcagucaggcuuucugaguugggaugguugcauaauaaaaucagaagauacacggaccagaggagccuggaccgcucauucggacucgucgggcaggugcguucaugguuccuaggaugcugggaugcugcgcacuuugggaaacgcuuacucuaguugaaaucuuacugugaaauagcuccuucuaaggcucuuuccaaguaaagcagcuuugagagucaacuuucaggguccacucaagacaguagaaaccacaguaggugcugaugaggacacugaauacagcagguuggcucaggaacugcuggaggacuguaaaauacagagaaaauggugagacagagcuggccauggggagcuggcauugcccgauuccaaacgcucgaagggggcccugcccagcugcugcugccuccuccagaagguugaggaggggcccugcugggacggggccugccaacaggggacacucccagcugcgugauuccccaggcagcacggugaggcaggauuugggaacacugccgaagcuggagaugggaauccuggcuauggcugucuggacagcccugggugggcacugccgauggcacagugcaugguugggagggagcugcugcugcuucuccuccuguuggagccugacagggggcagcuaauaggagccguggcaucuccacuguccagcccuucuuuguggcuaagcagcauguggucuuguccauagguugauuauugggcaguaauuacugccaaugaaaucuccaaaaauuauugaaucacagaacaacuguguacuauaagcucagcguagcacaggacuuauggcagcguagcugguggguaggaggguggcuggugaguaggagcgugacugauggagaagagcauggcugguggggaggaguguggugcuguaguguggcuggugggcaggaacguggccgguggguaagaauguggcuggugaguaggcacuugguguggcaguguggcuaguggguaagaacauggcuggugauuaggcaugugguguggcaguguggcugguggggaggagcauggcugguggguaagaacguggcugggaguaggagcauggccggugguugggaauguggcuagugaggaggagugugggugguggguaagaauguguggcuggugaguaggcgaguaguguggcaguguggcuggugaguaggagcauggcugguggggaggagugugcuguggcagcguggcugcugaguaggagcauggcugauggggaagagcguggcugguggggaggagcguggcugguggggaggagugugcuguggcaguguggcugcugaguaggagcauggcugauggggaagagcguggcugguggggaggagcguggcugguggggaggagugugcuguggcagcguggcugcugaguaggcaucacacuuugagcuuugaagcgaggcagcccaggguucugguuugggcuucuccuguaauggucacgucaucuugcccagguuaucuucuguuggccacaaguuucuuccugcauagagugggguagugauuaccucuaggauugugaagguggggagagaaugcguauaaagaugcugcuucccagucuaguacuguuuucuguucuguuugccagucuagugaauugcucgaugaccagccaccacucucccucauugcaagggcagauaggagugagcuggcucuuucucgaggcagguaggacuggugggccguccccucaggagccagcuguaauuuuagagucccugucccuuuucccgaagggaguguuuuaucaugucuggguuuauaucaucaucuuaugcaagugucacugauaggucccagucaacuugauagacaugaagcaaaacacacacacaaaaucaauacaggauaacuaaaccauuauguagauauuuuauuccaggagauggauugaucaucacuauaguaguaucauauuauguuuuauagcagggguccccaguuccuggacuguggaccgguacugguucauggccuguuaggaacugggccgcacggcaggaggugaguggagggcgagcaggcaugaccgccugagcucugccuccugucagaucagugauggcauuaguuucauaggagugugaucccuguugugaaccgugcauucaagggaucuagguugcaugcuucguaugagaaucuaaugucugauuaucugaggugggaacaguuuuaucccaaaaccacucugcccccccaucccacccugguccguggaaaaaaugucuuccacaaaaccagucccuggugccaaaaaggucggggacugcuguuuauaguacuggacuuuagaggcucuucuuuuaucuucuuucuccuuaucgauuaucauagcagccuucuaaaaugaucagggcaagcauuaauuguccccauuuugcagaugugagaauugaaccucagcaaguuugauugauuugaccaaguugcccugacuaguagauggcagguauggacuagggugugacgugucacucuguuccaaagcugucucuguucuuccauuuccugcuguuuggagucauugcuuggugccauccaguugcugaaggagugaugguuuauuuaucuuauuugaagagccagcgugugcucucaguggggugaccgugugcccuaauuuaugccuugcauaauuuauguccugugucaguauuaccagugcccacaauuagccuuggagguguccuggcucuagacauaccaaauggagcaaaaucauauaugaaugaagauacuguuuuguaagugugaaacuuacaugugcauuuaaugaaccaagguggaaacagccucugcuaaccacaggccuuuucccucugaguguguguggcgcugccgcgcucugccugcacuuccacucuuuugguuguagacuucucagaagcugacucacauacaccuguauauaaauacuuagauucuacacguuggauaaugauuugauuauuucagcagguuuuguuuuuguuuuuuuuuugagacggagucgucucgcucugucacccaggcuggagugcaguggcgcgaucucggcucacugcaagcuccgccucccauguucacgccauucuccuuccucagccucccgaguagccggaaccacaggcacccaccaccacgcccggcuaauuuuuuuguauuuuuaauagagacgggguuucacuguguuagccaggauggucuuaaucuccugaccucaugaucugcccgccuuggccucccaaagugaugagauuacaggcgugagccaccgcaccuggccgcauauuucagcagguuuuucaaagcuuugauguguuuaugugucugcucuccugcccuggggcugggauggaguuuugguaaagagugaugcugugccugagcagauuccaugucguuuucucuguaaauauuaccuaagaaaacugaccuaugguuuaguaagcaccuuugugcccacacugugccaggcgcuugcccuacguuaccgcauuuauucuuccucccuuuguagaugagccuagagguucauaccgucaggggcugacacguggcgguaccuccagcgggagcccuggauuuuuacccccuggucugucucauuccagacucuaggacguuucuucuugcacaccucacuuuugacguguccuuuugugucuacaaaauuaguauguuuuauguucauuuucauacuugaaaauguucacauuugucuuaguccacaaaccauaaaugcaguaaaauacaccuauaggugacugcugauauauuuuaaaaauauacagaaagguaugcaaccuacauauuuacuuaaagaaaacaaguuuaaaaaacaauuaaaaaaaauuuuuugauggaguuuugcuggauaaaacugaaugagaaagaacacagguuuaucccuugcaggcugcuucugcugugggcuccuugaacagcagagcugcccccaggcauccuggaguuacaucccacagcucaucccugaaggcucuugccacaggacuggaugcagguguaucagggugccucuucuagcuucugauuccuguuguuuugaccugacuccuuucaguauuuuuuuuuuuuuuuuuuuuuuuuuuugagauggagucucacccugucgcccaggcugaagugcaguguugugaucuuggcucacugcaagccccgccuccuguguucaagccauucuccugccucagccuccugaguagcugggaccacaggcacccgccaacacgcccggcuaauuuuugguauuuuuaguagagacaggggucucaccauguuagccaggauggucucgaucuccuggccucgugauccgcccgccuuggccucccaaagugcuaggauuacaggcgugagccacugcacccggccuccuaucaguuuuuaagauuggagauguguggaaaaguucuuacuacuaauaggggucagaagaacaagcagugcaaacagaacaaaaauuaggaggauuggcauugagcugccaauuuuaaaauuuuguuaauuaagagcaugaaagaaaauuacauuuuaacccugaauauuuacaggggauauaaucuuuuuuaauuaauuaauuaauuaauuuuuuuauuauuauaccuuaaguuuuaggguacaugugcacaacgugcagguuuguuacauauguauacaugugccguguuggugugcugcacccuuuaacuugucauuuacauuagguaaaucuccuaaugccaucccuccccgcuccccccaccccacaacaggccccgguauccaaguuccccacccuguguccaaguguucucauuguucaauucccaccugugagugagaacaugcgguguuuuguuuucuguccuucugauaguuugcucagaaugaugguuuccagcuucauccacgucccuacaaaggacaugaacucaucauuuuuuauggcugcauaguauuccaugguguauaugugccacauuuucuuaauccagucuaucauugauggacauuuggguugguuccaagucuuugcuauugugaauagugcugcaguaaacauacgugugcaugugucuuuauagcagcaugauuuauaguccuuuggguauauacccacuaaugggauggcugggucaaaugguauuucuagcucuagauccuugaggaaucgccacacugucuuccacaaugguugaacuaguuuacagucccaccaacaguguaaaaguguuccuauuucuccacauccucuccagcaccuguuguuuccugacuuuuuaaugaucaccauucuaacuggugugagaugguaucucauugugguuugauuugcaugucucugauggccagugaugaugagcauuuuuucaugugucuguuggcugcauaaaugucuucuuuugagaagugucuguucauaugcuuugcccacuuuuugaugggauuguuugauuuuuucuuguaaauuuguuuaaguucuuuguagauucuggauauuagcccuuugucagaaggguagauuguaaaaauuuucucccauucugcagguuaccuguugacucugaugguaguuucuuuugcugugcagaagcucuuuaguuuaauuagaucuacaggggauaucaucuuaaaggaucauucucuaaagucacuacacuucaugaaaacuauaccauauauauuuuuuccauuccucuucugcaaaguucaugcuuuuuguacuaaggaacaacacuuuuuucauauuauuaaaauauauauuguggugauuaagaugauuagaagauuauugacaaaaccugaauuuaaaucuuguagcaccccaccugaacuuuaucuaaacgcauuauaccuuuccacuuaaaaucagucaauguguaaugagugugucgugcuuuaauuauauuucuccuccaaacagagcuuuugugcugccuugcaccaggaacucagagaauacuaucgauugcucucuguuuuacauucucagguaaauauuuuauuuuuauuuuuauuucuuuaugauuugaaguguuacaaaauugaagcuauauagaauguuuuaaguuccuucauacauuacuuuuaaaauacagcaauauuuuucauaauauuauuuguaagguuugaauaucaaguuucaguguauccuagagccaguuaauugccaauuuucgggguucuaccgguuaaagguagcuuuaaaauacuauuuuuuuuuaaaggggacuuuggcuucauuuuuaugaguauaaucauuuucuuauguucacuugauauagauuaagaagugugaucuaugugguuauuuguacuuaaacauuucuaucuuuauuguuuuuuagcuacaacuagaggaugaccagggugugaauuugggacuugagaguaguuuaacacuucggcgccuccugguuuggaccuaugaucccaaaauacgacugaagacccuugcggcccuaguggaccacugccaaggucccacgcgcgucuuucccacgcacgucuuucccacgcgcgacuuucccacgcgcgacuuucccacgcgcgacuuucccaugcacgucuuucccacgcgcgucuuucccacgcgcgucuggcacucgcuuuguuucagaacucguuuguagggugcgccauccaggcuugcuuuuguguccugcccguuuuuguccuuaauggccguguugauucgauaggaaucgacagaugggagccaagaggggacguaaccacuugccaguguggcccaguauuuauaugguagaagcucgggcuggcauugagauggaggugggaaagaggagggugucucguguuuaaagauuucucucuugugugguccuugguuauggcuccccauggugcuugcugcucccuuggucgccuuuccuugcauuuugcuuuuugccuuuaguccuucugcagucagggaccauguuggugacucucggucagauguucccauauuugcaugucuugcuuuggccucucuggcucuagguucuguauugcuaguugcuuucugacauuuuuucucauuguuugugcuaccuuggccaagaaccucuuugccuucucccucguuuguaacauugagauccuaguagcaguuacuucuuaggguuguuaggaugacaugagaugggcgaguuggccaucugccacacaagaguucccuucucacugccauccucugcccaggguguuccccagaaucugcagggccccauuggucaucuugcugucugcacaccuuccucucucaccucuuggcacuucccucaaaaaagagagaaguggagcacaguaaauaaacgccagcguuuucuccaguucccagcaccucuccggaacuggaucccccaaacuccucugucacuuucuguguccagcgggccccugggguccuucacugucuucacucugcucagccugugcgcuuggccuuggugcuguagggacuguuauaagagcugcuguccgauccccauauucaaucucacagccccacuuuguguacacacaccagagccaucuucuuaaaaucagauccugucacuccucucccuaaaaucuaccaguggucuaauaaaaucuugaauuuuuagcauaacauaagaacucuucaugugcuucuauuuccagaccggauuuuugccacucccaguccuucauacuguguaguucuggccaaggcccggggggccucuucucucuacauagagcgguguuucucacacugucuguuguagccaguuaauggguuaugaaaccaguuaaugggcuggggcuagcauaccauaccaaaaaaaaaguacaaggauggauucacaggacuucugcuuuucauacauguuugugcccuccuuugcaccaugaagcgugaaucuuaguaugucucaaguagaaaaggcaugaaaagucaugugaacuuuagauuguguagccggcaauuuuuugcuacuuuuuguuucugaaaaauuccucagcaguccuaaagagaagagugacucacacacuuguguaaagccaggguuggagucuggaccuccugguuucugaaucaugacauguuacugcugcuucuagguccaaagugguauuaacuguaagaaaacaaaugcucuuuaucucaauuacuugggcgucuuugguuggugagaagugacugguguguacuaugaguguaaauguggauguuuuuguguauuuuccuccauuucucccaggaaggaaaggaggugagcuggccucagcuguccacgccuacacaaaaacaggagacccguacaugcggucucuggugcagcacauccucagccucgugucucauccuguuuugagcuuccuguaccgcuggauauaugauggggagcuugaggacacuuaccacgaaguaaggaucgguguucgguucugagacuuggauuuaaaaagcaugggcacgcaguuaugcuguuucauuuuuccccucaugauuaccauguucuccuaacaggaaugcaacugcacuuccauugaauaccauauacauuuuacacagugccucgacagcugguuaucucacugaacagcagauaaguucacgaguucuuugguuaguggagaauugucccaguuuauuccucagcaagguggaaucacucguccgaguuuacuagcacguggauggcaaaacaggacgaggccuccugagucuuggggcagucaucaucgcagauucugcugcuuugccaugauuacuuugcaaacucacuuuggugcuaacagcuuaaugaaacaaguuaguuguguauguagcuauugaaauagggucaguucuguaacgcagcaugugcugcuuaaaaaucacuguuguguaaaucacaugauagaaaugauagggcuuuugguggaagguagggugaggggcaccacacucaaaaccuuugucaguaagacaggaaucuaacaaaaguuguagugcaguuuaacacguuaaaguuuaagaaauacauaagcacugccauaaauaucacauuggccuuggaaaaacccuggcgcuuucuugugggagugggccgucggggccgcagacuguguguggcgggaaguggcggaggccuggccaucugaaacaggugugccuugugugggcgcugcuggcugcaguggccuguguucuccugccguuucucauggaugaaauugcaaauaagcaagcgugagguuuguauuacauucaauuuguuuucuaauuuauuguuugugcuguuacaaguuguuuuuaaagcaagcguuugggcagaauggagucucuggugcucugugugcuuuugaaacacaugggcggcauggcgugugugcaucugcguugggcgaguugcuuagccugucuuguagcacuuucccgaugguguguguaguuuuucuuuauuacugcauauuauuucacaguagggacagauauguuuuuaucuagcuacuguccuguugauggagaugauguuuucuuuguaguuuuuaaucuuaugaacaguauuaaaaugaacauccuuuuaugugucucccugcacguauuuaugaguuucucuaacguggguucugggaggugggauugcuggguuguggggaugcauuuuuuuuuuuuuuuuuuuuuuuuugagacagagucucgcucuuuugcccaggcuggagugcaguggcucaaucucggcucacugcaggcucugccucccauguucacgccauucuccugccucagccucccagguagcuugggacuacaggugcccgccaccaugccuggcuaauuuuuguauuuuuaguagagacgggguuucacuguguuagccaggauggucucgaucuccugaccuugugaucugcccgccuuggccucccaaagugcugggauuacaggcgugagccacugcgcccggccuguggggaugcauauuuuaaacugcuucugccacguugcacucaggagugccuauccagguugacgcagcuaucagcuuccuguuaugguccucauucccgcguccuugucaacacuuugucuuacccaauguuaauaagaauauuuucaccuaaugcacgaaaugugccaucucacugggguguuuauuugcauuucccugauuacuagugagacugaccagcuuuucgugcuuauagguuauuuuuuuauuucuucuucugauuaccuguuaguuuccuuugcccauuuuucuuauggauuuguuuuucuuuuuaggagugaaucauggaugguuuuauauuuucaaauuuuuauauauggaauugcucuuuuaaaaaauuauaucuuuuaacuuuuuuucacauucuuccaaacuuauaaaaaaguugcaaaaauaguacgaagaaucauuguacuguugacugagccuuaacugagacuccacacaaguuuuacuacguuuuaucauaaacuaaauuucucuauauacuugaaucuguuucuggauuguauuuuuucuguuugcuuuucaucugucaauaugauuuaaaugacucuaugguuugaaauuugguagaggcaguacuuaccuuuuguucuuuucacaauuucucuguuuuugcacauuuauacuuagauaugaauuuagaaucagccugucaauuccguuaaaaguucuuuuaaaaauuuuuauagggauugcauauuggauuuggagauuaaaaaggauuuucaggcuucuuauguuccuuuuguuguaugaacuuucuuuuaaaauaaaaacugaagcuuuguaagguguguuuuauuuuacuaaugguuaccucaaguuuuucagagcuuuugugagccuguaucuuucuaaauguuaaaaucacuaguaaacuuucuuuuuuaaccccuuccuccauuaagaugaagaauuguguccauuucccagguucugcauaccugcauggaccgccacacucuuuuuuuuugagauggagucucgcuuuguuguccaggcuggagugcaguggcgcgaucucagcucacugcaaccuccaccucugggguucaagcaguucuccugccucagccucccaaguagcuggaacuacaggcgcacgcugcuacgcccagcuaaguuuuuuuguauuuuaguagagacgggguuucacuuuguugcccaggcuggucuugaacuccugagcucaggcaauccgcccaccuuggccucucaaagugcugggauuacaggcgugagccaccgugccuggcccuacacucuuaagcucuguaccuuuuguuuaaaucuagguuauuuuauauuuuuaauuuuuuauaugcaauuuguauuaagucacuaucgaagucaagaaguagcacuuaucaguaccccuauuguguacccaucauuguccccuucuccuuaaagguaaacuuuauacugaccucugacacuguagguagcucaauucuuaguuuaaauuuuauauaauguucaauguuaaaauacauauacaugccaucuauagagguauauuugguauucaucauuuaaauuugaauccuuauuuuuaggucuguuucuggaaaguaucauaaaauuauugaauugacuuaaaguucuagacuuaauuuuucaagauuaaauggagacuuaaauucuuguacuauuuaguuuuuaucuaucacaaugguaaggugcuaaggacauguagguaaugggcguuuccuuugauagagugaggcuugccauuuuuaaugcauuuauguucaguuauuccauaauuacaggaugaggugaguuuugauagcuguuuaaaaaccugugcaauugauuauuuagaaugcauauuaaaucuccugaccauuaucacaauaagccaaguuauuugaguuuaaaaaauuuguuauuuaauuaguuuaugggagucuaagugaucuugugguuaagaaaaugaaaaaucaauguuuuauuuucagaacguauguucuuuuuauauuacuaugauuuguuuacucucagccaugcuuagugguguagauuuaugagaaauacuuugaccagcauguacaccagaaauaaaaaguucuguguguuacuguucucaguuuugagguguaucuucuuaucauccauuauaauuguacccuucagaaguaaaagaugauauuuuaaggcaaucuuuaaaaauuaggauuauaaaaaggagaaaguuuaccuuuuuauuuaauuaaagaaucuguauccucuucguucaauaauuagugugugaguuauaguaugaauuugggcgauuucaacuuuucuaaugauugcugaucaauugauaaaccugguuuucuucagagauuggagugggaauugucugaguuuucauacuauuaggauauauauugcuaauaauuagaacaaaagucaaagccacaagcuggcuaauugucuuuuuugacuuuaguaccuaauuuguaauuugcaauacuucugucuugagauuaauuuaguuugcauauuuuucacaaccaggcuuuuaaaguacuccuuaguugaaccaccaauucauuauauuugucugugguauuuuuuuuuuuuuuuuuuugagacggagucuugcucugccgccgaggcuggaaugcagugguaucaucuuggugcacuguaacuucugccuccuggguucaagcaauucuccuuccucagccugcugaguagcugggauuacaggcacgugccaccucgcccagcuaauuuucauauuuuuaguagaggcgggauuucaccauguuggccaggcuggucuugaacuccugaccucaggugauccacccgccucggccucccaaaguguugggauuacaggcgagagccaccacgccuggccauuugucuguguuuuuaaaggaguccuuaaagguaccgcgaguucuuuauugauucucugccuuauguguuauucaggcuuguguauucauuuccuuucgugauaguaaugaugggacuggagaguugauagggaaugcagagggaauugggcaaaaacugauaaaucgauuuucuucuguacuuuuuucuuuaauauguuuaaacuuugauucauugaggugagacaaaagcagacccuuaggacuagugugguuuaaauuugggaaacuuuuuugaagcacucuuguugcuuagaauauguauaaggcuaauguucauguuuuauuuauuuaaaaauaaaauaaugcaugucuauugaguauaauauucaaaucagcaucucaaauuauuaaugaacuuaccucaggucuugccucauuggcaaagauuuucacuuuuaaauguuuuccuuuugauuuaauuuuagacuuagaaaaguugcaagaauuaaugcaaaacauucccagguguccuuucccaagaccaccugaaugcucacaggcuacuacauugaugucaucauucccagguguccuuucccaagaccaucugaaugcucauagggcuacuacauugacguccucauucccagguguccuuucccaagaccaccugaaugcucauaggcuacuacauugacguccucauucccagguguccuuucccaagaccaccugaaugcucauaggcuacuacauugaugucaucauucccagguguccuuucccaagaucaccugaaugcucauagggcuacuacauugacguccucauucccagguguccuuucccaagaccaccugaaugcucauaggcuacuacauugacgucaucacucccagguauccuuucccaagaccaccugaaugcucauagggcuacuacauugacguccucauucccagguguccuuucccaagaccaccugaaugcucauaggcuacuacauugacgucaucacucccagguauccuuucccaagaccaccugaaugcucauaggcuacuacauugacgucaucacucccagguauccuuucccaagaccaccugaaugcucauaggcuacuauauugacauccucauucccagguguccuuucccaagaucaucugaaugcucauagggcuacuacauugacguccucauucccagguguccuuucccaagaccaccugaaugcucauaggcuacuacauugacguccucauucccagguguccuuucccaagaccaccugaaggcucauaggcuacuacauugacgucaucacucccagguauccuuucccaagaccaccugaaugcucauaggcuacuacauugacgucaucacucccagguauccuuucccaagaccaccugaaugcucauaggcuacuacauugacguccucauucccagguauccuuucccaagaccaccugaaugcucauaggcuacuacauugaugucgucauucccagguauccuuucccaagaccacccaaaugccgauaggcuacuacaaugaugucaugaucccugucuuuuuuuuauuuuaaagguucuguauuuacugaugcacguaccuagggucugagauuagauagagcucuaggaaguucaugauuuguaauuuuuaaauuugcuagucauuuuguccaaauagcucuuuacaccugagauacucuuguuugcuucacuaauuuugcuuguagguuuuuucagaaaugcauugugauugauggagcuaaaauuaaucuuucuugacauaaaguauauuguguucuuugccaugggucugcuauguuuaguacugcaauaccagugggcauauaccaccuaccgguuuaucucauuguaacucaucugacuacuuuaucucuguggguuugagcucaagagcuuagguucugaagucugauuugggucuggcuguuggcuucagguucugaugacucuguauccugggcaaauaccuucaccucucugggccuucccuuccccaucuuccagauguguguaugauagugcuugucuggugugauuuuguguaugugugaagauuacaucagaccaauaggaaguguauagcguaucugcugcuacuuuaaggagaacauuggauaaaauuugaauaucuucugucccuaagaugucugugggcuuugucugauuuguuuguaguucucggacaucuguuuuuucuguuagacccuacauuuauaaauauccauuuaagucuuugauuaguuuuggugagguucucuuuaauuuacucuaaguauuaauaacaucuuuacccuaagaauuugguaauuuagacaauuacauuguguguuugaucacuauguaauuaaaauguggaaauuuugucucuuuguuucuucuauagguuaauuuuuccuuaguuucccuaaugggaauuauaacuuuguuguaaaauugcauuuuuuucaagugugugguuaacucuaaauaguuauaagugagcuuuauaaucuuucaucucauaguaauuuauuguauaucuauauaagaaaaugcuucuuuuuauaauaaaagugcaaaauaucaauaaagagauagaaauuguaaaaaagagccaaauagaaauucuggaguuaaaaaggacaauuacugaaaugaaugaacucacuaguggggcacuacagcagauuugaacagggagaagaaagucagcaacuugaguuuaggucaauugagaccauccagucugagaacagaaaguuaaaagagggaaggaaaaugaacagagcaaagagacccaaauuugaugagaaacauuaaucuacacauucaaggagcucagcaaacucucaaaaguaggauaaacucaccacagcaagacacauuuagguugaauaucucuuaucuaaaaugcuugggaccggaaguuuuggagucuggauuuuggaaugcuugcauuauacuuauguucagcauccccagucagagaaucugauaucagaaauacugcaaugaacauuuccugucagugucaugcugguguccaagaugcuuggauuuuuugagcauucuggauuucagauuuugagauuagggauacucaaccuauauaaccaaacuguagagagacagagcaaaucuucaaaguggcaggugggaaaacccaucacacagaagggauccucaauaagaugaauagccgauuucucaucagaaacuguggaggccacaaggugggggagaauacauucaaaaggcggaaagcaaaaccaugaugauucaagaauucuguauccaacagaauucccauucaaaaaugaugucaaaaucaagacauuucuagauagauaaaacuugagagaguuccuagaagcauacggacuaccaaaauugauucacaaagaaauagaaaaccugaauagaccuguaacagguaaagagauugaaucauuaaucaggaaacuuuagcaaagaaaagugcaggagccgauggcuucucuggugagugcuaccaaauauuuaaagaauuaacagcaauccuauuuaaagaauuaacagcaacccuucucagauuccuuaaaaaaauagaauaggauggaauacuacuuaacucauuuuaugaagucaacaugauacaacacacaaaaacuacauaccaguaguucuuaggaauauagaugcaaaaauccucaguaaaauacuggaaaacagaauucaucagcauaguagaaggauuguacacaauggccaaguggaauuaaucccaagaaugcaaggguaguucaauauaaucaaagucaaucaauguaagacaucuuacuaaggcagugaaagaaaaaaugaucaacucaacuggugcugaaaaagcauuugaugagauucaguacccuuuuaugauaaaacagucaaacuuggaauagaaaggaacauaacuaauaaagggcaucugugaaacaccaacagcuaacaucauacuuaaagauuccaugcuuucuucauaaggucaggaacaagacaaggguguucacucuuaccacuuccuuuuagcauuguugagaaaguuauggccaggauaauuagucaagguuuuuuuuuuuuuuaaaaaaaaaaaaaaaaaaaaaggaaaaagguaaaagcauccagauagccagauuggaaaagaaaaaguaaaaccagcugggugcaguggcucacagcuguaaucccagcauuuugggaggccaaggcaggagcacggcuugcggucagaguuugagaccagucugggcaacauagcaagaccuuccucucuacaaaagauuaagaaaaaaugagccagguguaguggugcacaccuguaguccuagcuucuugggaggcugaggucagaggaucacuugagcccaagagguugaggcugcagugaacuaugauuguaccacugcacucugggugacagagugagaccaugucuccaaaaaaaaguaaagccauuucuguucacagauacuugaucugauuuauagaaaacuaaagaauccacacauacuuuauaauaaagauuauauauagguagagagguguauguauagcugucuaauguauaaguucaccacauuggcaggauacaagcucaauaacaaaaaucauuuauauuuccauauacuuucaaugaauaauccaaauaugaaauuaagaaaauaacuccauuuaaaauaucaucuaaauaaguuaaauacauaguaaaaaauuuaaccaaggaagugcaagacuuguacucugaaaagaauagaucauuguugagaggaaugaaaaaggccuaaauaaauggaaagacauucugugcuuauggauggaagauuugauauugcuaagauggcagugcuuccccaacaugagacacacuuucaauguuugauauuguuaagauggcaguacucccccaacacgagccacacuuucaaugcaaugucuaucaaaauuccaacagccuuugcagaaauggaaaagcugaucuucaaauucacagggaaguacaaggggcccugaggccaaacaaucuuguaaaagaacaaaguugaacaaauuuucugauuuuaaaacaugcuacaaugcaagguaaucaaaacaaugugauacuggcauaaugauagaccucugggucaauggacuagaagcgagagcccagaaguacaucuucauuuuuauugauuuucaauaaaggugccaagauuacucaauggagauaaaaagcguauucagcaaaugauaacaggacaacuggaugcauguagaagaaugcauugggaucucugucauacaccauauguaaagauuaacucaaaauggaucagacaccuaaauuuaagggccaaaguuauaaaacuuagaagaagauauagugguaaaucuuugggaccauggauuuggcagcaguuucuuagauaugucaucaaaagcaccagcagugagaacaaguauaucaggcuuuaucaaaauaaaaacuauguauauuaaagggcacuuuugagaaagugaaaaaaacacagagugggagaaaaguauuuccaaaucacuuaccugauaauggucuaguaucccaucccaaauacauaaagaacuaucacaacucaacaagaaaaaucacccaguuuaaaaaggguuugagaagauauuucuccaaagaagauacaaaaauggacaauaagcacaggaaaagauuauuauuauagcgaaaugcaaaucaaaacuacaauuaaauaccacuucacagccauuagguuuguuaacaaaaacaaaccagcagccagaaaauaacagguguuggcaaggauuuggagaaauugggaacugcaucguugcugguuagaaacacagaauggugcagccccucuggaaagcaguuugacaguuucuaaaaaaauuaaauauggauuuaccaugugacccaacaguucuacuccuagguauauacccaaagaaaugaaaacacgcauucgucuaaaaacuugucuaugaacauucauagcagcaucauuuauaauagucaaaagugaaaacagguccaguguccaucaacugaugaacugauaaauaaaaugacguauauccauacaauggaauauuauucagccuuaacaaaaaaaugaaaaucugauacuugcuacagugugggugaaucuugagaacauugugcucugugaaguaagccagacacagaaggccauauauuguaugauuccauucguaugaaauguccagaauuggcaaaugcguagagauagaaaguaguuaauguugucagggacuggggcuggggaggcagagaggaaugagugacugcuuaauggguacggaguuucucuccaggcugaugaaaaucuucuggaguuagaucauaggaauggucgcacgaccauauugugaauauacuagaagccacuaaguugcacacuuuaaaauggugacuuuuauauuaugugaauuuccucuaaaaaaaaauguagaaguuccgaaaacacaaacgcuuggugagggaugccggcuacgguagcuccuguggcuccuuucccgggucuucuuccucccugcuagguugaggugcuccuguucaccauggcgucgccgagcgcaaguagggcucuguagcucucaggcugcacaucuguuugccacacauggggccuugcaggaguuuuuucuguuuuguuuuguuuuguuuuugagacggaguuucccucugucgcccaggcuggagugcaguggugcgaucucgacucacugcaagcuccaccucccggguucacgccauucuccugccucagucuccugauuagcugggaccacaggcgccuugccaccacgcccggcuaauuuuuuguacuuuuaguagagaugggguuucaccguguuagccaggauggucucgaucuccugaccucgugauccaccccucucggccucccagagugcugggauuacaggcgugagccgccgcgcccggccgcaguaguuuuaauguggauugauaugggcaugaggauuuccaaagccccgcgguguuucugcugugcacugaaacuugaggaccccuggucuauccacccuccgauucccugcagcagcccccggagucgggcggggaccugcaaaguuuguucuaaacuugaggugaugggagguggcugaguucagagugccaccuccuuccacaccagcucugcauacucaucucccuuccacacucgcaauccucugugcaguagugcaggcuccaagaaauucccuuggagggaaagggugggaagggagugagggauaaaagacuacaaauugggugcaguguacacugcucgggugaugggugcaccaaaaucucacagaucaccacuaaagaacuuacucgugcaaccaaacaccacuuguuucccaaaaccuauggaaauagaaaauuaaaaaaaaaaaaaaaaagaaauucucuuagaaagaacucugcuuuaucuaguguguccaaacugaauaucaagucagugaugugguaauaugcgggcuuauuuuuuaaauaaauaaauaaaauuuagcacauuaaggguuagugccuauuucaaagcaccugcaacagcucaacaugugaugugaacugugugguuccuguugacgacaaaggcacgggugcugugguuuguuagucacauuuauaauugaaggaagagauaaauuucagauagagguuagugagguuagugagguuagugaaaauaaagaugagauuauuuuuccucccaaguccacagaccccugcugugcugucugucuguggcccugguuaagggaggcccaaguuggaacaggacccagggcuuuccuuugaccugugcuuuugcaaacaugagagaugcaugggcugggcauggcgcuggugugagagcugcaccuucuguagugacccgaagccugaauucaccuugaccuccaguuccuccugccugggagucgguggaugccugcugaauggugacgcggugcgucucccucuuggcugugucugcccagagccuacugcuauuccucggggacuuccuugcguugggcuccugccagucucagggaccucucggucucucuguugauggcccagcagagcucauuccacgugugaaggcuuucuccugucuuccuuccuggaagcucuuugagugccaaucauggcugaacacugcacugccucucugcccagcugccucugggcuuggcugauuugcaacugcaagaugacagaaaaacuuccagaugacaucugggcuuugcuaugucugcugugguaucauugaaagcugccucuaagucuaacaucugggauuuuacuuuuuaacaauaaaaaggauauagaccuuuagcccacuagugcuaagaaugguaucuaaauuuuguuuuuauuuuauuuauaucuuguauauuugcaaaggcagacaaaaguagaaggcuauaagaguuuggaagguauuccgaaugauuaaguuggaaagcacuuucagcauuuggggaaaaguuuauauuuuuugcucuuaaauguaaguacuguaaaaguaaaccaacuuuuuccauuguguuacuacuaucuagagaagcugcauggugaguccuuucuguagcuaaccuggcuucuucccccauaaacuuaagguaaacaaguuaugccaauauauucaaguuagaggcagaaccacucaguuuccauuugcccuuuggauaguaaagauuaggugcuucaacuagcagcaagaaaagaugggucaaguuaaaauuaaacuugcuuucaaaauuagauuuccagacuugauucaaauguuuacuuaaaugcugugauaauauucuaaaacucuacguucuugaauuugaagauccacaaaguauggauaagauagaauaucucuggaucuauuuagcacuguugcuguguuacugaaauuuaaaaguuuaccauguaaaauaucuuaauguuuuggaauuuuuaugccauaccucuugaaauauuguaauuauaaguuuacccuguaaauuauccuuuguuguacagagaaucugaccaauuuacccauuccccugguccgguugccauuuuauuguaucuaaguguggccuuaggagaaaucucuugguagcugccugcgugauuggcaaguugaaguuggaauuuuuuauggucuguauuaauggaucugauucucagaaguugcuugcuaagaaaauuacccucuucauuucuguuuuuaguagggaggccuuggcauuuguccagcaauuaaugagaaaucaugguacaauuauguuuuauuuuuuuucuuaauucuuucugcguuugacauaauggugaaaauuaaagaaccuugaguggaaaaugccuuaguaaaauaaaagcguaucgcaauuauauucugaccuugguuuuuuucccucuauaacucuauauuuuucacagaauuaauuauauucuaaagcguacccaagcugugugcuugcuacgagauguuugcugcuggagugauugcaugcuccuuugcccuuagaugaagcagugcuuucauaacuucuaaacaugccugaauugccugagguuuuuuauggcuuacauuuucuuuauuguucauacugauaaaaauccggcuguacuccaacuauuaggauaaauuaguguguugucuguagaaacgagcucuucugucuaacugaauaacagacauacaauuuauaugcaguuaaucuaaucuguagcauggcaagcuacagagcagucccagcaugagcgcggugacuucgucacugccgagauuacucaacgggggcuuauuucugucauggacaauugaagucuagguuaagucgaugacgccuccgugauaguacugcuguuuaccccugaagggcaauauagaucucaaaaggcuaaaauagaucagugaaugcuucagucauuuacauugauacuuaaagauaagacauuuuaguugaaaauaaacguagcagccucuucccuauggucauaaaaauguuggcacuuauucaugugccuacuuaccaggagauuggcuguacauaauugauagugucuggcccuuaaaaggaucaaauagaagauuuugacaucauuaaaauuuuguuuccugaaauacuuacucuuggaaguagauuucugugaaagaaaaaaauucauuuuugguugguugcccugggaaaaugacguuauuuaaaaaacaacaauuuacugguagcauguguucaguauuuggcuagaauuacuugauucuuuuauuaaacaguguuuuuuuucuaauagaaaaauauuugcaguuuaaacaauguugaucacauaagcacauacagaggauaaaguuaaaauucuccaguaacccugucaggaccagacacauucuguuaauauuuguauauacugauuuuuucuguguauuuguguguaucguaugcguaguauauugucaacuuguucaaguaaauaaugaacauuauuuuaugccauuaaauuuuuuuuugacaccaaggcuuauuaaaaugaucucugaaacucuauuuugugaauauaaucgucccauggauuacgaggggaauugguucuaggaccccuguggaucccaaaauccacacauacucauguccugcagucggccgguggaagcuguggguugagaaagcgggccucccgcacaagugcguuucacaccccgaggaugcuaaguuucugugugcgccguugguuggaaaacauccaccuauaaguggaccugcacaguucaaauuggugugauucaagggucaguuguauaugcgauuuuuuccugggaagaacuauacuuuucaucagauuguuggaaagggcugugguaguuaagaacaaucuauuuuuaaugacuacaugguaauauuuuguaauucauuuauauauucccuuauuuuuaagacauuuagcauagcauauuagaaguauaauauaugcugacgaagaauauuuuauuccaguaaugcaaguauaacauuuuauuuagaguuuauucauauucacaaaugagacuguccuguaauauuuuugguauuuuucuaaucacaugugcuaguguuaugccaguuucaugaaaucaacugaggccauccuauguguauuucuguggccuagaauacguuaagcaaccugagaauuaugucuuaaaaaguguuaguaacccugugccuuagugguagcauuuuauauuuccaguuucuucugaagauaccguuuucagggucuucucucucuugcuucuuggguuacuuuugaccauuacauuuugcuaagagaucguuaauuuuguauugcuauguaauuuuuaaagauauuuggaauuuauggaaagaucaccaaaaaggcacuuugggugugauacgacugaaauguguuuuacagucugacuggagaacucagcugccaugcaucacagggcagugcugagucuuaggccuucuggcuuuuaauugaaaauacugccaagugcugaggucauggucccgguaccauuucucccucaaaggaaguagggcuccuuggagaaguggcugauucuagguauugggagagacagagcuaagccuagagcaccaucuauagcagaaaaguagggcagaccacugggguccagggugaaggacgcaggagcggcuugaagaggcucccccuccccacauaggagauggggagccccaggaagagcauaacugugauggaggaagcacuggacacgcuuaaauccacgcucucaugaucauaaaaaacgaauuggucaucauuggagaauguaaauagaggcauuaucagaugcuuccucagcauuuuuugauauagucaaaugauuuccucuuuuaaucuguugauauaauuaauucuggugauauuaacaauuccugaugaggcauccuuagcucagaggaaaggaugguguauucauuaaauggggccggcucggccaguaaagaaaaaaaugccauccaggagaagacguagacuucccccuuauaacauacugugugccaggauuauaccaaguuccagaggaauuaaagaucuagguaauaggccaggcaugguggcuccuaccuguaaucccagcacuuugggaggcugaggcaggcagaucgcuugagcucaggaguuugagaccagccugggcaacauggugaaacccugucucuaccaaaaaugcaaaaaauuagccaggcaugguggugugcuccuguggucccaguuacuugggaggcugaggugggaggauggcuugagcuggggaggcagacguugcagugagccaagaucaugccaguguacuccagccugggccacagagugagacccugucucaaaaagaaaaaaaaacagaucuagguaauaaaaauaacucaauagaaauacugaaagaacaugauggacaauauuuucauaaucuaggaaugggaagaucuuaggaagacaggaaacucagaaaccauaaaggaagacugacauuuaucuacauauaacaaaaaaauagaucagaacuaaaauauggaccauacuauaaacaauggcaaaugauuaacuuggaaaaauuaaaucucuaauauuuaaugauucacaaauggucacuauuccuaauguacaaagaauuuuuguauauugaugagagaacaaaaugaauagcaagaugggucaagggcaugaaaagaccauucacaggagaagaaaagcaaauggcaauuagaacuaugaaaauaugcucggcuucauuuuugguuaaugacagcaauauaggauaaccaugauuccaccugacuggcaaaaucuaaaaugagccaggaugcaaaaacaggacaucuugcccgugggagcgucagucuacacagcuguguggaaaggaaaccuggcauugucuauaaaaacuaaaagcuacuuuaauucagcaguugugcuuuuauaaaacaaguuuauagaaauaaaagugcaauucuauuaggguguaugauugaaaaaugagaauggcugcauuguuguaguggcaaauaaacuggaagcaacagcaauugaauuuucuccuuacugcucaguuuccuuucuaacggcagugauguaggugcccgucagggucagggcaggggagcugcaugccagugaggaagaaagcuccugagcacagaugguuccugggggagccacacaggggucacuucuacagugccaccuggcuggugcuggccccuuguacacauggguacauguacagcaaggucugcccauagagcuugggacuugucugugaacagaggacgccggccugggcaccucuguguuccaggcuuuggggcuuugcaaaagagagacugcaagggcaggcagacugaugggaggagacacacagcugcugccugugagggaggggaaccccaaaagccugcaccguuacugaggaagagcuccguguggcccaggaagccucaguauuaugcugcagaggcacuaauggacauucugaaucuccaaggaagacauaacuuguuuuuguuauacuuuaguuuuaaaaguuuaggaaauacauaguucaauuuagagagauuucuguguuucauacaaguuuuauuguauaaauagguaagacucccugugucuggagaacuuggcuuucuagaauaacuuacucuuugauguugcuguugguuaauauuuugccauaaauaucacucuugaacauuuccaugccccuuugcuuucaguuuuuuguagcaucagauccaacaguuaaaacagaucgacuguggcacgacaaguauacuuugaggaaaucgaugauuccuucguuuaugacgauggaucagucuaggaagguaggauuagaagagauuuuugugauuuugauguuuuauggcuauguauacuuagauuaugugacaaaaccaauuuucaguuaaaauuucaugcguuuugagauuguuaacguucuggagaugaaguaagugcauguuaauugaauacaucaguauaguauguguucaauauaucuuugaguuacuagaauucgcuccauacuguagcagaugcucuuguuaguuuucaaucaauagccaauuuguagcuuacgaauauuuguagauuugggcagucguuuuaaauuuacauaaaaguaaucauagaauguuuuucuuuuuagguccuuuugauaggaaaaucaauaaauuucuugcaccaaguuugucaugaucagacucccacuacaaagaugauagcugugaccaagucugcagagucaccccaggacgguaugaugaugcuggugggguggugaugauggcaauggugugauguugaugaugaugugaggauggugauacucaugguaacagugauguugaugacguagugauugugauggugugaugauggggaugauggugaugugaugauaaugauguuggggauggguggugaugauggcgaugaugaaugcguggugguggcagugaugguggugaugauguugauggugaugaugauggggguaaugaugguggugugaugauggugaugugaugauguuggggauggaugauggggaugugaugauggugugcuggugguagugaugauggugaugaugaugauggugaugauguggugauggugugauuauggugaugugaugauguuggggauggguggugaugauggcauggugguggcagugaugguggugauguugauggugaugauggugauggugugaugauagugauaaugauggggauggguggcgacggugaugauggcgugguagcggcagugaugguggugaugauguugauggugaugauggugguaaugauggugauggugugaugauagugaugauggggauggguggugaugacagcgaugaugauggcauggugguggcagugaugguguugaugauguugauggugaugaugguggugaugauggugaugguguaaugauagugauaaugauggggauggguggugaugaugguggugaugauggcguggugguggcagugaugguggugaugauagugauggugaugauggugguaaugaugauggugaugugaugauaguaaugacaaugauaauugugauggauggugauaguaaugauaugaugauggugauagcggugaugauaguggaggugaugaugaugugcugauauuacagauuacuuaaaaguauuuuuuguaccauaggauuuauagauuauuagaauuacucucugauacaccuuaauacauaguauuauguauguauauauauaguacuguguaaauuuuuaauuuccuuuuuauacaguuauacaguaaguguuggaauagguauagcuguuuuaaaaugauaaaguggcagugugccaaaauaagaaauaacagaaaaaauauugcuaaugguagccuauucuuugggaugcaaaggcuuuguuuggagaagagccaggacuuauugcacuuauuguguuuauugcauucagaaugucgcaugagcguucagccugugggaagugcugaggcuuucccucguucucuuccuuuuccccauuugccgccugccccacccucaguaauuucaugauguuuuguguauggcuaacuuauauuuauagcucuccaguuuuggcuguauuugcuauuuauauugucaugguucauucaaaagauuuacuuugcguaggacacugugguagcuacaggaaagagacaaugacuucaccaugacuguuccuuucaugagcuuauuagucuggucuuggagaggagauguguaguaaaauaaccaguagucaguaauaaaggugaaagugaucagggacgugagaugugcaggugaagcgcuuuggguauuuucaggcaaggcucaacaggaaggcuuuggaaagaggcaggaauugcacuggccauggagaaggaggagaauuugguuguggguuauugcgcagcccaggacaaaggaauaaugugcauggaagugcagaagagaaauaggacgaauuagacuuaucuaaagauuguagugaaaauaaaaaguuauuauuuaauaaugugacagacuaaagagagacagacuaggaccucauguaggaagcaggauagguuacuggguaugguuuuagcuacagguguuacuggaaugacagauguucucuuaacaggacuuggcucucuggacaggagggcuggggaucaggaagagucagugauggcacuagaacucugagcucgugaggccaagucggaagggcagcaggggauuucgggagagcauagcacugagagaggaaugucauuucgggcaauuugguuuucaguagcugagaggacuuacuaguggaagcuuccagcauguauuggaaaugcuauacugaaacucugguuaaaagucagggccgaauauagagauuuuggaagcacuuaucucaccaugguaacucaggacaaggcaggaugguguagcaagagcucccgugugguccaggggagacacccuuuccaggcaugugagagccaugggcccucucacccuaaagcauucagacauaauuuuacauguauuuuuuuguggggggguacauagaccccagauuguuccuggaauagagauagaugugauccaauauagauuuuggggaaaugcuucuacacugaagagguggaaggaagaagaaccaggagagcaguuguguucgaguugugaccuuucauaguuccuagagaaggcggcgcacacaugggcugugccugggacagggcguccccaugcgccugcugugccggaggcucuccaugaagguugcugcugcuugugugagcaccgcgucugcugugcugcuggcggccccuguacccaccgccccacaucugcagauucaaucaacugaggaucaaaaacacuuaaaaaaaggcagccacuaaaaaaauacacaaaaaaccaagacaauuuaacagcuauuugcauagcauguacauugcgcuagauauuauaaguaauuuagagaugauuuaccguauaugggaagauguguguagguuaggugcaaauauugcuucauuuuguagaagagacuugagcaucagggaauuuuggugucugugggggucgugggauugguccccugcagaugcugagggugacggggcgcugcugcugcugacgcugcugcuucucugugacgacuccugugguccccgucguccuguccauggcugccagggucugcggagagcaaaguuucugcuguugaguauuuauaguauaacugggaagacagaagaugcaaauccuaaaagacuccuaguaauggucaaaaaacaggagaacaugucaaauucauuuuuaucugugaaaaaguuaugaagauuuaaaagugugaauaaagaauaaauagugaaaauuuaaaaacugagcacgagagaugccucaacccugaaggagcaaagagaguuccgaggaggcucuggguucugugucuucauaggcugcuuugggcuaagacugauucaaaccuucucuuuggaaugaaaauuuuuaaugacucaaacaaggguguaaugaaaacauuucuagagaaaaaucuuuaugucauuaaaacuacguagaucaauggaaauagaaccccaugcccuuaaaacaggacuguggugagcucaucaagggguuccguggugucgugacuccaggcagaccucacucauccucagauaacuacaguuucuucacugggagcaucuuaguuguuugcuacuagugugaaauuggaauaauagcaacacuaaaauaggccugucuuaacugcuuucuuauucggaaggacaaacaaaucuuaagagucuucugguauauuuaaacuggguaacucagauaguggaaagagacuuaaacucugaaucagaagaucucgccuuucuuguccuugcuuagucuucagcuagcguuuugccuccuucucucagucugagguuguuccucccacugggguuauugucuagcuuaaguauuauuguggguuuaaugaaaugaaguauucauauaaguuuuaaaaaugguuuugugcuuugcagauguaaaucagcacuguaagaagcucuguuauguguauagucuccaccugcaauuucuucucaauagaaagcuauggaaaugcuuucuuccgcuauguuacugcuuagagucaggcgucuuuauuggugacaaucugguuuuguccccuagacaucuccaccaaucuccguagaguucacucuauggugcaugauacuacuacucaacuuuugcgaguuguacaauucacaaagcuuauuugcaugugcuguuuuggucuuaagacuaauuuauggaaacaucuuauggguauggacgggugacucagcacugacuugcccuauuaccaguguguuuuggugagauuuacgguuaguuacaguguauuaagggauuuggaaaucaugaagacacacauguaggugucugcugugaacccagcuggcagaauuguuuucauguguguggucuuagggcucuggucuccuuuguggaauguccagcugucugugccugcggucagucuguuacugaugccacaggcagugguuggcccugagucuggauguaugugccuucauuucuccucuguggaaauacaaauuacauaugcaugugugcucuucccuguuguucuuuacagcugcagaccuauucacagacuuggaaaaugcauuucaggggaagauugaugcugcuuauuuugagaccagcaaauaccuguuggauguucucaauaaaaaguacagcuugcuggaccacaugcaggcaaugaggcgguaccugcuucuuggucaaggagacuuuauaaggcacuuaauggacuugcuaaaguaaggcacuauuuugauuucuauaaauaaguaauauauuugacaugauaaggaaucuuguauuuaaaagaauaaauuauauuaaaagaaaaugaguugaauucuucgagcauacuuuuuaaaauaaaaucugaaaagaauguaaaauuuucaaaagguaaagccccuucauuuuucucugguuaucagcagagcaucauugucauguucugugcuuuauucauaagagaaacuggcauuucuuuccaaaacuguggggcuuacagucuucauguaugaggaguuggucaaaucacacuuaacuuuagcuugaguuugaaauaaagcugaaaaauaaaauauauauuuuaaaguugaauuuuacuuuuauauuuguaguuaauguucaccuaaaaaugaaacuaugaccuuuucauuuugcucccugacauuucucauggcaucuucccuuccagaguuaaauguauguccuucuccacaaguucuggaccagagccugcugugcuucuaggucuagagacagugcagaccccggcccaggcagcgugagccugggcaugagcaucccagggguccacagccugggccuggagauuuucacccaaguguuuagaagaaugaaacuucuuuucugguguuccuuuuaggacacuuaaaguaagauaaauguucccuuuaagacacaaaauaguaacuuaccuuuaaacccugccagugcuccccaagcaauuguuuuaggccucagguccucaaguuucaguguaucacagacuagaaagcuugcugcaguagcuugugggcccacuucagagaaugagauucucaggugugggguagaggauuugcauuuccagccaguuccagcugcuggugaugcugcguuuguggggacuacacauugagaagcacuguuugagacaugcaggcucuuacauccuaccuucuagccagaagccagucucccgugugaaaacucauguggcuuuuugaggcguacacagccauagcuggcuugugacaugcucaugccuuagucauagcugaugccugcuaacacauuuguaagaaaagaaaguucacuaguacaguaaaugcugguugugaugaggucaacaccuguuugaaguaugaguggugaugagcuuuuaaaggggaaauguucucuaaugccaugggggcaugggguguguaugugggucaguuggugcagauggagaugaggagccaaagugagguuuggaggacacugauggugucauaggucacaucauagagccggcugaacgcauucgccuugugcccaaucuuaauguugaaaguaucacaugcgugcuauaaaaugaaaaauucauuucuccucaaugucguauuuuaaguuccuaguuuuuagguuuauuugacguugugugucuuuuucaccuugucucugcccuguguuuuguagagcuuacacgucuaccugaguugauuagugguguuccuaacuuggucacccccgauuagagacguguuagcuucauauuuauaaaagcagauaucaguaacccucaagaaaugcuugcugaaaguguaguguuucuuggcccuuuagaaucaugacauccauguaccuaauugcuuugauuugauggaggccucuccucuucccauugggucuaaaaggaaauuauaucagcucaugcuacucauaggccagucugaaguuugaaaacuuuguuaacauguauagcacauuuaaguacuuucaauuuaagcugaaucaaaaucaguucuuuuuuuuucuuuuuuuugagauggagucucgcucugucugucacccaggcaguguaguggcacgaucuuggcucacugcaaccucugcuuccuggguucaagcgauucuccugccucagccuccaaaguagcugggauuacaggugcccgccaccaugcugggcuaauuuuuguauuuuuaguagagauaggauuucacuauguuggccaggcuggucucaaacuccugaccucaggugauccucccaccuuggccucccaaagugcugggauuacaagcuugagcaaauguuccuggccaaaaucaguauuuuucagauuuuaaagaaauguaacuccacaauaauuaguaagcccuguuugcaguuaaugcucugaagcuuuuguugccgcauuauuguauuggucccauuugucuuuugaguuuuuauaauuugaacucuuacuuuuaauaguuuauacguuuuuuaaaguucauuaagaauugaaguaauauuuucuuuaauuuuuaaaaaauuuguuaagaccagaacuuguccguccagcuacgacuuuguaucagcauaacuugacuggaauucuagaaaccgcugucagagccaccaacgcacaguuugacaguccugagauccugcgaaggcuggacgugcggcugcuggagguacugcggcucugcguguugggaacgccgccccggcaccgaggacccacugggccgggguguucuagcgaguguuuuccauguuguuucaggcacagcuagccguuaucuuucuggaaacugggcagccugaguaggaacuccacucuguggcuuguuacugccuggucagcacaucugcucccucuccaccaucuggguuuccguuugcccaucuugcagcggggagccuugcagggcugcuaggcuuaagcuggagaaaacgcaugacacccuugcccugugcugggcagcauaucacagaugcuuagaaaauggugcuuucuucucauaguaaauccaacaggagcacaagacaugguguacgaugguauuuaucagaaaauggaugcuuuuaguugcaguuugguaggacaugacuuuucuuaagggugugguuauuaugaacauaaacccacuauuuacuuaguugugauggaagaucauuagcagaacgguugguuuucuuaaaauauugcaagagucaucuuggaauaaaaagauuuggaacauauuuagaggcaguggguuuucgucguaagcaaauggugaugaauuuuaaacgcauagucacaauauucauucagaaauacaccaugcauugccagauguuugcagagcaccuacugugugcucauuauugccuaauuggugagguuguagaaguuaacaagaagaugcacucagaacuguugagcaguuuuuaacaauugggcauuauuuuacugcuuuuucuuugcguuaacaaguucuucagcaagaagcuuaaggucuugcaauuauguguuuguuucuguuguuaggucucuccaggugacacuggaugggaugucuucagccucgauuaucauguugacggaccaauugcaacuguaagauuauccugcaucauuuuauaguauuuacaacuauuaagauuguuaaacauuuuguuugaaauuggcuuucuucucuggggacuucuaauucaagugaucacucgacaucuaagaucuacucauugaaugaauacuuaagccaaaauuguguguguguuuuaaaugauuauuaaugaguacugaaaugcucuauuauuuuaaaaauucuuaaaaauaucauuuguucuaucauagguuucagcaacuccuuaauaaauggacuguucauuuucuuccauuauucuuauacuguggcaacuaguuaaggauaaugugaaaggaacuauaaaguguauuuuaggggaaucauauuuuuacuacuuagauaaaauuugguauuuaguauucauuuaaaccgaugaggaagcagcuguacuuuguucauagugcuuuuaccuacauaacaguuaccacauuauaaaaggcugaccaggaaagcugucuuuuuacaugucugcaauuaaaaugccucuuuuuagugcgcauuuuuaaaguauucagacuugaauaaauuuccuugaccaagauacccucuaaacuuacuucagucauuuuuauaucugaaauacugaagaaggacauugcauuucuuugagguauugggaaaaguauucuguugagaaggaauauaguugggcucuaaaauuucuucucagugguucugguagagccugcuucgugcuguuuucccgccucucagggugcauaucacgcugcugcaauaauugcaucagggcacacucacccucuuuccucuuggggguaagaaaccugccacugguaagugugucucuccugucuacagugagaugggaacugcuggugcaauuuccuuuuuacacauaaauuccugguguguaaccuuuauugaucaaagcuacuauauuuuaaguguauaacuucucuuaaauuuaauuucucaucauauucaaauuagcuuuuucucuuuugacuuauauccuaaacaauuuaaaauaguuacaaugcaaaaagcagugugauauuuuaacaaauuauuuauuuauuuaauuuauuuuugacacagagucucacucugucaccaaggcugggagugcagugguacaaucuugggucacugcaaccuucaccucugagauucaagcgauucuccugccucacccucccaaguagcuaggauuacaggcacaagccaccaugucuggcuaauuuuuguauuuuuaguagagaugggguuucaccauauuggccaggcuggucucaaacuccugaccucaggugauccaccugccucccucccaaagugcugggauuauaggcaugagccaccgugcccggccuuaacaaauuauuuaaauuagcaacuuucauaucuccugccuuguuaauuugcauacauuacguauuauuuucauagcauaaaagauaccauaguacagauaauugcaucgauuauuucacagagucugagugccuugacaaauagguaaacugaacauugccuagauaagagauaauuaauuauuucguaguauuacagaucucauuaagagugucaaaguugucaugccauguacauaaacaauugcuaaugcaauaauguugaauguuuaggucuguaaagcucuacuuuaguagaaggacucgaggaaaaaaguuuauaucauagauuuauuuaaaaaaggcaaaucuaucacucgaggccaggaguucgagaccagccuggcuaacauggcaaaaacacaccucuccuaaaaaauauaaaaauuagcugggcaugguggcacacaccuguaauuauggcuacucaggaggcugaggcaugagaaucccuucagcccaggaggcggagguugcagugagcugaguucucaccacuacacuccagccugggugacggagugagacucuuaucucaaaacaaacaaacaaacaaaaaaacaaaauaaaaguaaaugggugaaaauaaccugaaggauucuuuucagacgggagauucuucuaggccuaccuuccaugagauucaccacccuuaggagcuacuguuacagaagaaagugcaccccugccucacggaucccucaggcggguuggggggaguuguagugaagaguccacauuuuagacuagguuuagacuagucuaaaauggauugaaaauccuaauaaacugcaagcuguguaacauuaggccucuguuuccccaucuguacaacuggcauaaaaaugccugccuucuguuacugugacuuuacuuagcaugcugccuauuaugauaguuugcuaaaauguaccuuuuuaaaaaaagauugagaccuguacugagaggauucuuacgugggaauacuaucaacuugucuucugcuguuaucccagguguuuacucgagaauguaugagccacuaccuaagaguauuuaacuuccucuggagggcgaagcggauggaauacauccucacugacauacggaagggacacaugugcaaugcaaagcuccugagaaacaugccaggugagcccccagcacggucacggguccgcacacacucccagcggccuccagcccccacugggugcgguuuccagcaacuccgcagaaguuaagguagacucacggugacagcuauauauuuuuuucagauggcgaacuuucuuuuaaaaucacauuuauuuuuuauucuaauguucauauauauacuuuuuaaaaauugccuauuuuuaaggaaaacaguuuaauaaaucacugacucauuuaaaauccauacaguguuuuaacuaaauuguuuuugagaauuucuuuaauguuuuguuuuguccauaaaccagaacaugagaauauauuauuuaaaacaaucuaaaacuauaguaaaaauucuuagguaucagauagucaagauuauuuuaauguuauaaacauugaaugacuuaaauuacaaguaauuuugaagucuuuauauaaaauugauuuggucagaaccuuugagaaaguauuucaguagguaugucucuaaggaagaacuaaaugguauaugccuuuaauccuuuggugaaaaguaauuguuaagaauaaaaagagagcaguuguuuggagaaagcaguucaugaucucugcuucuuuaccagcucacaggcuggucccugagcagcuaccagagauccagaauagugaccccugccgaaggcuguggggcagggaguucccugucugagccaacacugacauguagaauugucgguuuuuauuggguguugauauuugacuauagugggaagugaaugguaggaauccucugaauuagcugagagggaagcaaaggggagauuuucuuuuaaaggcagugauggcugcgggcaggguacccuucuuaugaaugugcugccacuggacgggaggcgggaggagggccgugcugagagggcugcaugcacgccuggggcucugcgggucuccuuucuccaugguuucacaccguccuucucgccacuguugcggauucccuugcucacaguugcuuuaacuggauguguacuugccugcacuucuccuucccccuguguucuuaugaauaccaccagguagaucgguuccuggcugcccccuucacgaggcagcaucuuucuuguaguggauuuagaccaauucaaggccaaaccgaugcugucauugucacacgucaaaauaagccucugugaaggcugagcuccauuaucaacuugaaauaugggcugguugcgauauaguuuucugaucugauuaucaguuuagcaacgucuguaucaauuugcucuucucuuauuguauugaauaucaauaaugaguuuuguuuucuaguuggagauaacuaauaaauuuuuugaucaguuuucuauguaugggaaaaugcauauuuuauuauuuauaaaauuuauuuauaucgcuaggauccugcuucacagaguuugacuccagcuucuucugcugauccuucccccucgcuauugaaacuuuuucugaaccauuuuuaauagcacgauauuaccucauguacauaugauuucaucauuucucuuugccuggacauguaguuuuuuccuccaauuuuuugccgauauaaauaaugccaugcauguuuuuauaaauacaacuuuauaugccucugaauauuucuugagaauagauagaaguggaacugcuugcuuaacaguuugaauuuuaguuugacuguuuacuuacuaaguauucauauuuuaacucuauugauauuaucagaucacuuuuugggaaaaguguaccaauuuagcucauaucucaguaagcccagauuguauuguugauaguugucuguaucacuguuuuuguuaacauuggcuauuaauucaaauaaauugucaauucauaggugaaaauggaaguucauuucaacuuuuaugcuuuuuaaauguuaugcuuuuaaaaugauugaugagggugaacacuuuuuauuuuuaagauggggucccccuuuguugcccaggcuagccucaaauuccugggcucaagugauccucccaccuuggccuuccagagugcugggauuacaggcauaagccaccaugccuggccucuuuuuucuuuguuuugcuguauuauauaguauucccuuuaucuacaggggauauauucuaagacccucccccccaccccauggaugccugaaaccucagauaguaucaaaccuuacguauacugcuuuuccccauauguaccuaccuaugauaaaguuuaacuuauagguuaggcacaguaagugauuaacagcaauaacuaauggcaaaauaggauuauuuuaacaucauacuauuacaaacauuauguggguguuaugucucucucaaaagaucucaccguacugugcucaccuguuuuucucgugaucuguugaccugauaacugagacagcuacugagugacuaaccgggggguuggauacgccaugaauuugcuggacaaaggguugauuaacuuccuggcuagguuggagcaggauggugugagauuucaucacuacucagaacggugcucaauugaaaacuuaugaauuguuuauuucugggauuuuccaugugcuauuucuggacugccguugacagcaggugacaaacagcauaaagagaaacugugugggggacuaccauauuuccuuuuucaggaauuguuuuaccuguguuucuguuggggugucaguguucuuaccuuuaauaaagaaguauuuuaaaguaguucauggccaagcagcuucaugagcagaaaucaacuagcugauuuugcuaauccagcgcguuagaaauguccugcuaaugauaaaucugaagcagaguacagacagacccuguagagagcucccaucaacagcugccacggggccuuguaugggcgugguaugcagaggacagcuuagucuuacuuaaaguaucaacaguuaucacccuaguguuuuagcaauauucaucaaaguaguaacuugcuucauggugugcagaaaguaguuacaugugaaagugcuuugcugggggcaagaguuuuugaucaugaucuaccaagcagaucccacccauuccucauguaagaugaucugcuuuucacgccucuaccaauccuggaugguagcagcuuuuuauguauuugccagucagcuggacaaaacacagcggcuaauacuaaaaugguuuguuagagucaauuaaucuaaaaaacauuucuacuacuggaaacuaaauucauguuucagauaacauuucacaaaaugaaauggaccaauacagguaacugagccuguauucuuucucagccuuugugugggguggggagggaacgaauggaggcuuuuucuuucucccucagcuucccucccuuuccucuuucaaaacaguggcauugaaauaauuugcuuuuggucuuuauuagaaauaaaaucgaucucuuauguucuugagggaaaacaaggaugcguucaucguucaugaagaaucaagaugaaauuuacguagucagguucuaauagaagucugauucagaaguaacacuuucuuaguuuuccucugguuuuuaagacauuaacuuacucaucugagacaaaaauuaaaaauuaauguuuagacagcuuuuagagggcucuuaagagaauguuaauucucugaaauggucccugaaguucucagggaacagugguuaguggagauuuacguuuaccuuuuuuuugagauggagucucacuccgucacccaggcuggagugcaauggugcgauuuuggcucacugcaaccuccacuucccagauucaagcuacucuccugccucauccucaugaguagcuggaauuacaggugcccgccacaacgccuggcuaauuuuuuguaguuuuaguagaggugggguuucaccauguuggccaggcuggucucaagcuccuggccuaaggugaucugcccaccuuggccucccccagugcugggauuacaggcgugagccacugugucugggccuuuuuuuuuuuuuuuuuuuuuuugagacagagucuugcucugucgcccaggcuggaguacaguggugugaucucagcucacugcaaccuccgccucccaggaucaagcgauucucauuccucagccuccugaguagcugggauuacaggcauguacaccaugcccagcuaauuuuuuguguuaauauuuguagcagagaugggguuuucacuauguuggccagacuggccucgaacuccuggccucaagugaucugcccgccuuggccucccaaaguauugggguuaugggcgugagcuacugugcucagccacuguuuaagaugauggaacuccacuagcuuaaaaugagauguaaauaauacuacauuuuaaaauuagagcuuguacacuagacacucaauuauuucuugucuaaaauguaaugauaauaaguuacagguuuuccuuuaucuuuucuaaucccacugaaugaaaugugcuuucgagagaacgagugucugaguaagugcuuccuuguguagguauuggagagcagugucuggcuguggaaauagcuugguggggccacaucugaaccagcaggucccuuauaauuagaaagcuuucaaguagaaggcacuucggagauaccacagucaaaccucccuaguguauaguggagagcagccugagacccagaaucugaaaagguuggauuggcccaaauuugguuuuggcccaauauaucgaauaauaagguaaaugaagguuuaauagcucauacuacauuuuuuuuuugguuuuccuuuuaaccauauuguaucacuucuaagauacacauugcuuucauguucucaaugugucuuaaagucuguggagcugcaggcuccuguggccugcagcugcguaaaccuggccccagcuccucuuggauccuggagcugggcucugugcuccggcagcacagccuuuaguaccggcccagcugcgguucauugccuucaaaaagauuacacccuggauccacccuggcucuauuuugaaaugaaaaguugcuguguuugcagaaagguguagaaauagcaguggagcauaaauuugaaauccaugaagcacauaauuauuauugagagaagaaccaaaaugccacuuuuccauguaaagcagcaccgcagauuuuaucuuaccaggaaaggcaggugcccgcgggccagcagugcccugugaggggcccaucugagcgguggguucagaggguguuucccgcacaggacuguggucagggugucugucagugugacuggcaacuguuuuacuuucuugaugauucauauaauaacgauucaucuuacaaaugacagugucuuagacucagugaaugauaaaggaugaguugaaguuuuucucuuuaaaaauuucuuuguguaucuaucuguguuuuuguauccuguguuuuguauccuuaauguguaucaacuguccaguguggccuuggcccugcaggaggugugcuugcuguuuucauuguauguuucacucaucauucauauguuucacuaaggagccaaaagauccuuaacaaaagucuuuuggauccuuagugaaacauacaaauacagauuggaggugccuggcuccaauugauggaaacuuuaagcugagccguuggugcuagagcuacauugccugggggaguccccaccccaucaccugucucugaggcuguguggccucagcugauuucuugaucuucugccucaguuuccucaucugggggaugagguggcgacggcacuuacuuccuaguguugcaggauuaagucugagugaaaguacuuggaacagcaccugccuguggugagugcccccaaguucacuguugccgugauuacuugccugggagagcaggaaugccgaugauguaaggaugagauccucaaaggugguuagagacuuugaaaacaauccuaggucuuaacaaaugucaucuggauccuuagucuugagaaaaauagaucagauggguacuuugauaaggucacuuuuaaauacaguaaggucacuuuuaaauacauaaauacggguugaggaggugauuuugaaauugugaacaaauuguuuuaaggucuuuucuaaaaaaaacaaauaucauguuuagcaguacucgaugcuaucuauaggggcaucuccgcaugugaggggguucuggcggaaggugccugaacaaguccuuaagagccgguguuugagucaaacuugaaguucuuucgacagccuuuaggggucaguggagaauuacagaagagccuggcacuuagcugcugcccaagcgggaggagauaguggcugcccaguuuuguguaucggccguccaguguggcgucggcccugcaggagaugugcauccuguauucauuggaccuuauugccaauguugcuuugcuuuugggauucuuauaauuauauaguuacuugugggucagccauaaaaacacauuuaaaacaugugccuaaaauauauuuucagagugcuggguaaagagauccuaggcauguuggcagguguaaauggaauuuuuuaggaacuaaaggacuaauugugccuugugaauugaguucauagucauuacagccuuagaguaguuagaaguucagaaauacuauugccuguaguguuuaauuucucauuugggaaagaaaaauaauugugauauuguagggauuucagacuucugucauguggaugguuuuacgagguuucuuuucaguagcagcguccucagcagcaaccauaugucucucacugucaaggggcuuugucucaaaagaagaccauugaagauacuguccuccguacucauuguagacacaauaaaagaugauuuuucuagaaggaaaacuguauucgcugguaguacuuuaagacuguaaaaggaaagaacaccuauauucacauuguugcuaaauugaccuugcuuauagaaaccuuuugaaaggugugaguuugaguacucaagaucuggaggaaugcagacugccugcucugacguccagugucaacaucacgcauucuuucaggaaaucaucauugagggcccacuuagugcucccuguugcuggcucccagugacaaggugacaaaccagcucccuguggccaagcagcucauggccuauuagggcagaacagauguuuacacaggaucuuacagucaaucgauacgggaaaauccaaguggcaugggaauguuuaaaugaggcaucugacagacgugggugauuccagaaggcuccagaggugaugguguccaggcuggccccugacaggugaggaugagcuguucgggucaguggggaggagagcagcauguucagcuaagcuguggagggggacugugcugcaacauggggcuggagagcccagccacgagcacguccugaaggucuggauucagguaguugagaauaaugaaccuggggcgcgaccguggugauuagcagggcagccaguuguaauaauccgugugcggugacguuggccuuuaugguuacagcagccgcggggcuggagggaagggaauggauuugagggaggcuugggcuguggcgccagcaggaccaggugaugcguguacggaggccaggaggugguuggagucucaguggcaccugggucucugacuugaggaccuggugggugguggcaucuuuuaccacccagggagcacuggaggaagagcuucuuugggggggauagugauuccauucaaauacgcuaauuugaguauuuuuuaggauaccuugugaggccauuaaucagacugaucuuaaacuuaagauagaucuagacuagagguaaagauuuuagaugucaucagccuggaugauacuugaaguuguggaguggaauguggaagggacaucagugcgugggaacugcagucucacagggugccguggcuaggaggaagaugggguuggggugggggcuguagaccugucugucguggugcacgauaccuuuucaacuaacaggccccuucugggcugccauauggcaucugaaaauuuaaagauauacuacagaagaguugggcaaaaucaaagucaaaacuucuaacgaaguuagacgcuuuguuuguuggaaggcuguuugagaugccgauauggagaaggagggggaggcugaaaaucacagaggaggaauagauggauucagagugaggggauacggguuggccuuuuaagugugugcuaggagggagaggcgggcuuggagugacuagggggcacgagggauacaggcagagccaaagccaugacagcgaagcaaugcaaaccugguggggccagggcugcgggaugcugaggcugggagugagggagagaaggggaaggccccaggcagcacugggaugggcuggagugggaugucaggaguuuaggcugacacugagcauugcaugacaguguuguuugguagauggguuuguuuuguuuuguggccauucaguagcauuuuuauuucccagugugacauuaaagaaucuagaacauuaaucagagaaauuguacacucaagaaaaucaagagauucugaaauagaauuagugauuuaaucacuaaucacuguguaucuacuuucagacugauuugaagccggagaaaaaaauuccugguuucauaaauagcgcaacagugaaaaguagaagacguuagcaaaagcauauucgugccaugaaaaaucggcauguuacucagaugcugcuggcuugacugacccugagaagaauucuggaggaagccucagaaaugcaggcggagcagagcagcacagaccugagcuuucaugggacugagccgcuucugucacccacagagcacccagcaggagcuagaaaauggagaauagccacaaaaaauuuguaugcuucuguaacaaaucuagagucccucagaggaagugcugauaguagccugcuucgcauuuuuaggugacgguaaacuuucaggugaaguuuccccuuucauuuuuagaugaaaucuaguuuugucauucagcuucaaccuucucugaaggaggucaggaugaauaaguauaaccuggguaguugcuugaaaaggcuagaaaauaaaacagauugugcucacugugcacaagugcacagcagugcuaaauuuuaggaucacacugagcauguaccuggggaagggucgauggagacaucggaugucagggugagacccgcgagucguggcaugugacuuguagaauuuguccauuuguuuucccaugaaaagauccaccagaguucugugauaauauuaacauaaaaauacaaaaaccuuccacaagugguuucuaaacuauuucauauaacuuugcugcacuggaaagaaaucaaaucacaucugagaaauagcuugaggacaaauauauguacacucugugcaccuguagaauguuuuaaauacucaccauucuccagggaagacuggcuauagauuuuccauuacaguccagugacuucagugggguaagacacaguccucucauuugagcucugcguuaaaaccuaaaguugagugcaaguggugguuacuguccuuagaaucucaccgaaaccauaacacggcugaacaucacuuaaaacaacacuuuauuaugccccuuuacauugaaaaggaauuguaguuugagggguuuugaguauuauuugauuugaaaucuuagaccguauuuauaguuuuaguagggaaaaguacacucauaauucuaggauuucagaugaaccucaaagcugaacccauucuucggaugcacauugaccauaucuguguguuguagauuccuaauggcaagaaagauacuugggguauguggagugcacgcugugcuacaggagccccaugagacagaugcucggcagaugucacaggucugagggcagcugggucucuucugagggucuuagagcugagagugcaucucaugacuguggacgcuauaguucacuguguuuaacugucugcggagccauguaaggagcgcugaggauucuuugcagaguuguaaacuuuguaaguaaaucuuagauaugccucugauacaucagucauagccauuggcaggggaggcgcuugagcccuugagugggugugcucccuugcgagucgcugggcggugcauggauguggacgagggcccuuuggagcucugguugguuagguugccaccuccugccuguuuauugccugagggacagugugucaucccucucuuuaacaaaugaauuuucuccaucugaaaggugcauugucuaagucugccaucaaugaucccuaacuaaaaauucuucugccuccuugaaagcaaguucuuuuuuugucuuuugaaauuuauuuuuuuaaacaucguuuguuacuggcugccauauauuucauuuaggugagugcugguauauaauguauaucacugucugcuuuacaacucucuggcucucccucaccugagccucuguguucgagaauucuagccccuucccgagacccaggcaccgggcaggugaggguguccuucucuguaguacguccuccuccuuucccaagugcacggcgcgucccuggagaccgggugccagggucggauggcgaugcugccuguuaguggaaucugugccuucagacagcguucauacaauucacauauguauuucaugcuuguauaaguugaucgucuguuuaagaauuuacauuuuuauaaggcuuagaauucuaucuccuccucucccacuuuucuuuacugacgaagcugucauguguuaaaccaagagagcaaaacugcaaggugucaguugaucuuuaacuuacagaaagaguauuuuuuaaaaaguaugcauugccacuguuauuuuuacacaccucuauaaagaggcuuaaguuccacuucuuuacugucuugagaggaggcaagacugaugucucacacaacugcaugcguagcaagucuugaucucguuaucgagguaacucauugagggcguuugaagcaguaacaaaacauguccaagcugacccguguuauaaagccuuuuuguaaucaccucacugaugggccuagcucugauuuagccaucacauacauuaguguaacaauaugcugccauagucuuugaacaaaaaaauuaaaagugcgagcagagaacugugcucuguggugaccuuccagccuggugauggcugugugaucuccuaaaggauaaaaggagagucugagcucgucgcugaccucccucgaggcuccucuuucucacaggcgguaaggccacagucgguuccuuaaagaaaugucaccuuuaucuccagagagccagggaauaguaaauguuucaugcacagcaggcaaacuaauuguaaagccaugaaguagagcuucuauuuauucagugcacugcguuauuauaaaauaaauguuuuguauuuaauuuuuaaauacaauuauauuuuguuucauauauuuguuguuaggcccuuauuagguaaaguaguauaguacuacuugguuagauagcuaaguucuuguuuagcuugaccugcacagaaauugguucuggagagguuguuuccuguuaaggggucaagaauuuaaaugacugauuuuuuguuuuaagauagcuugcagguggguaagggagaacagcgcguugucgguaaguguacuugcauugcaccucugacgucaacucuucccuugcagaguucuccggggugcugcaccagugucacauuuuggccucugagaugguccauuucauucaucagaugcaguauuacaucacauuugagguacacuucagucauuguguugauuuuaguuuaaauaagucaugucuuggcuuuuacaugguauauauauauauauauguguauguauguguguauauauauguguauauauacauaauuuuuucuuuuuuuuuuuuuuugagauggagucuugcugucgccuaggcuggagugcaauggugugaucucaccucacugcaaccucugccuccuggguucaagcgauucuccugccucagacuccugaguagcugggauuacaggggcccaccaucacucccagcugauuuuuguauuuuuaguagagacgggguuuugccauguuggccaggcugguuucuaacuccugaucucaggugaucugcccgccucggccucccauaggugguauauauuuuaugagugaugcuacacuaggaaggacaugagcuuaucuagcgucuuuaaauuguuguuucccaggugcuugaauguucuugggaugagcuuuggaacaaaguccagcaggcccaggauuuggaucacaucauugcugcacacgagguguucuuagacaccaucaucucccgcugccugcuggacagugacuccaggguaagacuccgaccugcuuagaaacaagaaaccaaaagaaucaucuucuuuucuuggguuccugucaaaugggggaaucuuagaaaugcccugaugcagccacauugguaauaauucagauaauuuuauuaaaaguuuacuguugaagguacaguuucugaagagaauuggaacaguagugcaguagugcugaaacaagaauauacucuaaacuggauguaaaaaugguagaaaauaauaauaccuuuucauuuucuagauauaaugguauccuauugugguauucaaaagagaaaaccaugacuuuugaguuguugagguuaauaucugagcaaaauaagcaacacgauauaagaacaaaacaggccgggcgcaguggcucaugcuuguaaucccagcacuuugggaggccgaggcggguggaucaccugaggucgggaguucgagacuagccugaccaacauggugaaacccugucucuacuaaaaauacacacuagccggucgugguggugugugccuguaaucccagcuacuugggaggcagagacaggagaaucacuucaacccggguggcagagguugcagugagccgagaucacgccacugcacugcagccugggcaacagaucgagacacugucucaaaacaacaaaacaacaacaacaacaacaaaaaaccauggugacauguaugacauuuuucgcgaacauucuuuucccuuaggguccauguucugaaaguugcacguuccauguggcaaaucuuccuggaguucuccuuuuauucugaggucugggacaagaaggaaccacauugcuuucacuugaagcaaauauauugugaaguagggggcaaauuucaaaugcauuuuucaccugaacuccgagacuucacggauguuuccgacuggcaggggcugccuccagcugggccugcacucuccucagggccugucaguggaaaacacgccacuucagggccuuuacuucaucuaaauuuuaguauauguagguuagccagccaugaauuucauuauuaaagaacuaucaaucaugucaaaaaaugguuaagaucaaagcugcuucuauauggaguguuuuacauguuuuuauaaauauguggaaauuaugucagaaaaauaguuuaaaauacuuugaggauaauuaauaauuaaagaaauauacaggccgggggcaguggcucaugccuguaaucccagcacuuugggaggcugagguggguggaucacgagguuaggagcuugagaccauccuggguaagacugugaaaccccgucucuacuaaaaauacaaaaaauuagccagguguggugguggacaccuguacucccagcuacuggggaggcugaggcaggagaauggcgugaacccgggaggcggagcuugcagugagccaagauugcgccauugcacuccagccugggcaacagagcgagacucugucucaaaaaaaaaaaaaaaaaaaaagaagaaauguacuucuugagguuugaggcccuugaaaccucuauuacuaacccuggucuuguuaucggaguaaaaccacagacgguuucaugcugccugccagccguugccucucuguauucagcagaugccgacaagcauuguccgcacacguuuaggaagucaguguaacaaauagcucucuguuccuagacccgugugcuguuggccagcacggccugucucacggugcagucgcauggcaagacagacacaggcucugcagccagguagaccgaggguggaguuucacuucauagcuuuugacuccaguguucuguuuuaaaagggcaugguccuagucucuucaacagauuuguaagaauuguauaauucaaguauaauguugaccauaguggcuggcagauagguguuaguugcuauuuugugccgguguguguguuuuacagagguguuuacagucauuagauuucaugcauuucagaaaauguuugaacuacugaggacuauacccauacugauaucaguccaguuguggcaaauaaguaacacuccacacagcuuacggagaauguaggagacuuaguccacuuacagaugugaaccuucuguacgagauaaauugucauagcuuuugccccuagaugauuuccacugguaagaacccuauccgggggagaaaaucuucccaccuguagcacagugcccuugugaaagugggaagcggggucuucacgugugcguuggucccaccugacgucguugaaggugucaugccggaggcuucauggucauuucugaacuugccuuugcugauggcuuuacucuuuaauuugaugauuuguuuaaaaugagcuuuaaaaaaaaauaaauaaacccaguauguaaagcagauuaaaacaaucuauuauugacauaagcaauuuuaaguauaacauuuuuauuaugucacucacuaagaaaaccaaggcgguucugauacauauaaucuugaagcuggaggcugugcauguuuuuguguuuuuuuguuugcacauuguugagagaaauugugaauugcagagugaauugguaccacugauguugccaaagaauggccuccugcaggugcccuguguggacagauugccagcagagcccugccuggcagccugagcuugaagucaaugucagugggucaccuuguagauggauuaacucuuccaaacauaauaaauuauucuuuauuagacuacauaaagaaacaaauuagauaaaucuuuacuaaaaacaacagauuaaaccgucuguaucuuuuauguugcuuauuuaagacccugucaaaaggacagaacagcucuaagaugagaacuuguaagauggaagauguguuugccgcauuaaucacguggugguuuuauguuaggaacagcauccccugaucacauccuucuaucauuugccaaaucaguccacauuguuuuuguugccauguaaucugaagaccugguugcauaagugcauuguaguaagugaaagagagcaugggcuguucacugccgaauaccaaguucuccugcaucaguuuguuccaaaacccauucagcaaauacucauuucagcuuugucucacuugagaucagacaucaguucaacucugaacggugcugcugugacuuagcaaaugaauuuugaaccgaagcaucgccaugcuuucauaacggaaaauauuuuugcagaauaguauuaguccauuagacaaugggugaugagaaguggcuuugcaaaugucuucauuaacuguaaaguuguguuaaaaauagaguuaacucaacaucuuaguuucuccccaaaucaacuguauugugucuucccaaccacaggcuuggaaccucuccuguuaucucgguuucuuuuaugcuucucaaguacaguugugucauuuuucuccuauaaacuugcaaaucuuuuguuacauuauugcuacauuugagaaauuuggcuggucugaaaugguauugauuuuguuauuucgaucucuaauuuuucuagucuaauauuuucuuggcgcauauuuuuuaucaguaaaaccaguuuuguuucuuucauuucacacagucugccuuugcuucuuuuucacgcuucggaguguuagcuaggcugacucuaagcacaaagggaaucccagucuuauuccugacguuaaaaugaugcuuuguugcuucauuguuggcuguuuuguuugcaaagacaucugauaggacccuugucaagcuaagaggguucugcccuaguccuaguuugcuuagaugccuuauuuaaauuaugaguggguguugaauuuuaucacaauuuucuucugcacuauugaaauuaacccccgcucagcccucagacuguuaguguguuuuuucaaaccuaagauggcagaggguagaguuaaccuuucucuucagucauagcacacugccaucagugguccgugaaaagccucucauauuuuguuggguuuaauuuuauccccuucccugccaauaccccaauuccacccuccucugccuguacccccuucccugcuguuugcaucagcuuuaauguauuugcucuauggccuuggguauauagaugguauuuucuguguauacauuuuuaauuuauguaaaugauuuugugcuguagauuucauuguguccuuccaugccacaauaggagaaagauuaaugagguacaguaguuguuuacugaagauuacugggcaguaguuauaagcaaugaacggaagauaccugcugugacacugauauuuguuuaaaacauuaggaguuuuuuccucauguuaagguauccuuuuauuucugguauaaacuaugauacauuuuuuaaaaaccuugcugaauuugcuuuuuauauuuuacuaaguauuuccuuucucauauuuuugauuaccugcuuuugcuauaucuaaaaaaaaaaauggagaugcuuuccuauucuuuuuucaaucuuggaauaguucuacucauuacuaccugcuaucuagcuuugaaauuugggcagaacuucauuuuuguaaacuugugaggauuggaggugauuugcagagagcuccuggcccgccgugggacuugggcagucacgauugcucuuguuacgggugcaggugcaggauggucacguuuugcuggugcccagcacagcgcugcucagcaggaggguucaggaaauguguggugagggaaugaaugaacagcuaaugaacacuuugggaauuucaguugauaucuuguuuucuaauaucuuuucacuaaauaucaauguuuuguuuaagaaacuuagcugguugaggcucuauucauaaaacauugucaucucuuucaggcacuuuuaaaucaacuuagagcuguguuugaucaaauuauugaacuucagaaugcucaagaugcaauauacagagcugcucuggaagaauugcagagacgauuacaguuugaagagaaaaagaaacagcgugaaauugagguauggucuuuacacuugugaauuuaucuauuugaauaaugaacuccuugccacacacgauaaucucaaaugccaacaaauaacuuucuugccaaaauugucagacagguugagaugugccuauacugcguuugaagucccgagaaaucacugacaguuguaaagagggaggggccacccucacuggcaucaucauccuguuucacaaaauaaauaaaaacagcagcauucaugagaauuacaaaucuccugcccguuuucauuacugagugccacaaugccgaugucacccgucggaaucuccacagcugccuccgcucugcaucacucuguguuugaagcuuguggaucgugcaccaugcugcauuuugcaaacgugugcaucuacaggugcuccucaacuuagagcagucuuaugucccaaugagcacauucuacacugaaagugcauuuaauauaauauagauggagcaucccuaaucugaaauacaaaauacgaaaugcuccuaaacccgaaacuuuuucaucacugacaugacgucacaagugggaaauuccacaccugacuccuuugcuuucugauggcuuauuguacacaaacuuuguuuccugcagaaaauuauaaaaaauauauaaaauuaccuucaggcuacuauguauuuaagguguguaugaagcauaaaugaauuucauguguagacuugcauccccucuccgagauaccucguuauguauaugcaaauacugcaaaaucugaaauucaaaauacuucuggucccaagcauuucagauaaaggauacucaaccuguaccccaauaaacccaucguuaaaguagaaaaaaucuuaagucaaacgaucuuaaguuggagaccuuauauguauguuuauauaccuguaaugcaaguauauauguauauauaauauguauagguauauaugcauguguauguguuugugugugugcuuugcauauauguguguuuacagguacaugcauguguguguguguguacauguauauguacaugaaccaaauuucuguacuuaacgguuauuuucagauuuauuaagcaaguuuggcuguuuaugggauuucuuuuauuuacuauaaucuguuuaaucuuuuacuuuuucaggauacagucauguaccacaugauguuuuggucaaugacagacugcauauaugacaguagucccauaaaauuauaaugccauauuuucacuguaccuuuucuauguuagauauguuagauacacaauacuuaccauuguguuacaguugccuacagcauuuaauacagucacacgcugcccagauuuguagccuaggagcauaggcugugccauauagccaggguguagucagcuguaccacugagguuucuguaaggcacucagcgauguucacauagggacaaaaucaccuaacgaugcguuucucagcaugugucugucuuuaaugucauaugaugguacuaacucuugggauugucaaagacauuauucagucaauacaguuugguuaguuuuacuuuugaguauuguuucucuuaaaaccuguguuagaggaccauauguagcuuagagaguccucaaccacugggugcacaaguuauuucuuugguauuuuuuggaaacauuuguaucgcuaagggcucucaucauucaaagcgaauuuugguaauucugaaguguuguagaguuggcacacagaagcuccugggccuuguccaggcaacccuauggauaacuuaaagucggauauacucacgauucuaccuaacucuauaacuuacuggcuuugcgccuuuggguggcucaccccuccaagaugucguuuccuuauuuguaaaaugggugauaaggaauaugaccucacagagucacuuaucuaugugugaugauauaugacgcuuauuuaguaggcauucaagugcaugcuggccacugccauuuguaaaacugcccacgugccccaagaagcuucccuucuagagaauuacuaaacugucucaaaaucgaccaaaaucacuccgauuuuuuuuuuuuuuuuuugagagggagucucacuuugucgcccaggcuggagugcaguggcgcgaucucggcucacugcaggcuccgccuccuggguucacgccauucuccugccucagccucccaaguagcugggacuacaggugccugccaccaugcccggcuaauuuuuuguauuuuuaguauagacaggguuucacuguguuagccaggauggucucgaucuccugaccucaugauccgcccgccucggccucccaaagugcugggauuacaagcaugagccaccgcgcccggccacuccuucggauuuuaagccugugcuaauggcguguccgcuggccgugugggaguggaagguucucuugggcaguuagccgucacagugagugggacagaugcauaggccaaguccacgcugauucaggauauuccauucagacuugcuuaaggaugcaggaagagacacaaaagcuaaaaccauaucugagaaguuauuuaaguuuaaaaggcaagauaaucuucaaagccaucauuucgaccugagguccccugaaaguucugaagagaucaugcaagucgccuccuggaaagaugacagagcccugggugugugcugggaccgaagcggcgcccgccugcugcacccccuggugccaccauguucuuaugcugccauugugugggggacuccaaagggcccuucucuuccuccucauggcucuucuguuucuuuccacuuuucuucucacacgcuauaaauaucaauuuauagugauauuuccaauucaaauguaggauuaaaggacuuuuacuuguuucauuuuuuaucaauauaucuccaguguugaaaacauugguuucuaacaugaucguacuuaauuauuugccaucuuacgauaaugcauccaugcaugcacccauacacgugacugucucagaauaagaaucucaaugcugcugcugauaugggaacaguauaguuuugaaaauaguuuuacuuuuuuugcaguuuuuuuugagggaaaaaauauuucuucuuuuauucuaauaauuuuuaaaaauuuuuugccaaaaauuuuuccacuaaauagaugcauucaaauucuaugugguaauguccuugaaauaagugcucccguaaggcucucccaccaacucacugcacaguuagguuaagugguuucauuuuggcuuuuaauuuuuagggauugcuuuuacuuauaaaacagaauugaauauaguuaucuaagauaguaaccugaugccaaaacaaagcauuuggguaguuuagcuuuuguugcucucuguguccuagucucccuuguaaacguggauugggaaauccacaguauuaucacacugauagaucaacaugauaauguguuacaaacaaguuucagcuuauuccaagaauagaacccucccuguuaucauucuaauaaagauauuguaauucauguuuauaaacugaaggggaaaaauuauaugaucaucucaauagauggaaaauaucauuuaauaccaaguaaaacccauuaaaaagguuugcaugaauaauuuuauaauaagacaucauucuugggggugaaauauuggaagcacaucccugagacagagugagacauacacgcuccugcacugauggucccagccagggcuacgagcugagaggaaguacagagagaaggaaggaaagcuggcauuuuguuguuguuacaaaagucugguuguguagaaacuagaccccugucucuugccauguacaaaaaucaaaucaaaauggauuaaagacuuaaaucuaagaccucacauuauggaaauacuaauggaaaacacuggggggaaacucuaggacauuggucugggcaaaaugucuugaguaauacucugcaagcacuggcagccaaagcaaaaauggacaaauggggucaaaucaaguuuaacaagcacccaaaggaaacaaucaacaaagugaagaggcagcccagagaacgggagaaaauaucugcaaacuacccauuggcgagggauugauaaccagaauauauaaggagcccaaacagcucaacaggaaaaaacucuaguaauucaguuaagaaaggaaaaggaucugaaucgacauuucucgaaagaagacaaugcaaauggcaaaaaggcuuaugaaaaggugcucaacaucauggguuaucaaagaaaugcagaucaaaacuacagugagcuaucaucccaccccaguuaaaauggcuuuuauccaaaagucaggcaagaacaaaugcuggcgaggaugugaagaaaagggaacccucacacacugcggagggaacauggauuaguccagccaccauggauauaaguuuauagucgaguacauguauguccuuaaguuaucgaauaagaucauaguaguuaaaagagugguguggcucaaggaaagacaaguaauuggaacaggguaagguccagaagcccacagguagagacuguugcuccguggccuguggugcugagagccguggggccugggccuaaguaggcagcacuggcuaauuuuaaacagcucaaaauauacuauuuuacuauacuaaguuuagauguuuaauguuaaaauuuuaaaggcauacaccaacaaaugcuggugaggaugugagaagacucuuacgcugcugguucuggauaaacuggaauaaccacuuuggaauacuguuaggcaggaaccagugccgaacucaggacuacucugacccagcauucucucuccuagguguagugcccaauggaagugugucucaggcacaccaggccucguucccauagcuagagcgucucaggcacaccaggccccguucccauaccuagagcgucucaggcacaccaggcccuguucccaaagcuagagugucucaggcacaccaggccccguucccauagcuagagugucucagggacaccaggccccauucccaaagcuagagugucucagggacaccaggcccuguucccaaagcuagagugucucaggcacaccaggccauguuuccauagccagagcaucucagggacaccaggccauguucccauagccagaacgucucagggacaccaggccccauuccuauagccagagugucucaggcacaccaggccauguuccuauagcuagagcgucugagggauaccaggcccuguucccauagcuagagcaucucaggcacaccaggcccuguucccaaagcuagagugucucaggcacaccaggccauguucccauagccagagugucucagggacaccaggccacguucccauagccagagugucucagggacaccaggccacguucccauagccagagcaucucagggacaccaggcccuguucccauagccagagcaucucaggcacaccaggccauguuccuauagcuagagcguuucagggacaccaggcccuguucccaaagguagagugucucaggcacaccaggucccauucccauagcuagagcgucucagggacaccaggcccuguucccaaagcuagagugucucaggcacaccaggccauguucccauagccagagugucucagggacaccaggccacguucccauagccagagcgucucagggacaccaggcccuguucccauagccagagcgucucaggcauaccaggccauguuccuauagcuagagcguuucagggacaccaggccucguucccauagcuagagcgucucaggcacaccaggcccuguucccaaagcuagagugucucaggccaccagcccccguucccagagcuagagcgucucagggacaccaggccccguucccaaagcuagagugucucaggcacaccaggccccguucccaaagccagagugucucaggcacaccaggccccguucccaaagccagagcgucucagggauaccaggcccuguucccaaagcuagagugucucaggcacaccaggccccguucccauagcuagagagucucaaggacaccaggccccguucccaaagcuagagugucucaggcacaccaggccccguucccauagcuagagugucucagggacaucaggccccguucccaaagcuagagugucucagggacaccaggccuguucccaaagcuagaguguuucaggcacaccaggccauguucccauagccagagcgucucaggcacaccaggccauguucccauagcuagagcgucucagggacaccaggccauguucccauagcuagagcgucuuagggauaccaggccccauucccauagccagggugucucaggcauaccaggccccguucccauagccagagcaucucagggacaccaggccccguucccauagccagagcgucucaggcacaccaggccccguucccauagccagggugucucagacacaccaggcccuguucccauagccagggcuccucuggggggagagguggucauuggaaggggccacaggaacaucugggugcugagaugcccucgcuugcaucugcaugggggugacaugcgcauauucaucuugugauaacuuauuaagcuguucauguaugaguuuuuauacuuuuuuauauguguuacacgacaguaaaauaguauauuuuaaaaauuuguguaaagaaauaaaagacaaaaguugguggggaaaagaugggaaguaguguaaauauuguuauuuaucuuuuguaaccaagcaucaaaagauauuguuuaaagcucauaaaugaaguaaaacagguauacauagguugaaagauguuagagauaugaauagaauguuucuaaaaucagauggcaaaaggaaggaggacaauaauuauuauugcccagauuagaguauugauaccauccaaagaagaagaugauauguuuuaugaagugaagguauaaagguaaccacugggacacagugucacugccuggcuguuagaagaaauacaggugauauaguagaagauuaucacccucaaaccggaaagcaugguauaaauaugaagacagaacuaagagcagauguacaucacaucaaucaggggacuuggguuaaacccacauaaugaaagaaaaagcuccucaguagaggaugguguuugcuugaugccccugggugggggugcuggauggcuuguagcugagggcugaaggucauuauccgggcagaccuacaaauugggaaguucuggccgggcgugguggcucaugccuguaaucccagcucuuagggaggcagaggugggagcauagcuugagcccaggaguuggagagcugccugggcaauauagcaagaccccguucuccacaaaaggguuguugguggggagaaaagaagacaaauugggaaguucugguguagaacgagugauguagauaguuuauaaagaaaacaguggacacgaacaaagcauauaaagcaaauauucuucaaaggaaagcagguuguaguucagagcacaaaacaguaaacauggcaggaagggcacauuggagugaugggaggugcagggcacagugaggaccacgcagugugggcuuccuguaaggcccagcuugugccauaucaguacucacuuagaaaaccacaagcaaacaagcagaaaugggucaaagcacauggauuuuagaagaauauuucaguuucuuacagacuaugaaagauaaaaugcacauaaauaaggaaauaugaaaauucauaacugccuauauuaauaaauuggagagaaugaaaguaaauaaacaucccacucaaaaaguuggaaaagcaggaaugaaaccuaaagaaaaagccaaaggacauaauuaguaaagaugagagcgaaaaucagugaaucggaaacaaagaaguuaauaaaguccaagagcugggccuuuuggggggccaaggaguggagggaaauuaagccaugaaugaaucugagagguagcgggaggagaaggcacaaacauacaaaacaagugagaaagaacuuacucuuucgcucagcucuguggaaaaaaaucuacuugaaggaaaucauuuuccauagguuuccgaaauuggccccaugagagaaaggaaauuguaagcagagcaaauacuaaagaagaaacaaagccaucgaagggcucccaccaaaaagcgucaggucagcugugcugagaaagacucccaaacgcaccgauggucagcuuugugcucugugaacuguuccaaguuucuaaauuguguaagaagaaucacgaagcugauacccuaucugagaaaaaacaaaucuggguuguaaauauugauggagaaaucucacaugaaauauaauugaaaaaaggcuagauuuaaaagcauaauuuaugaagacuaggauuuauuucaggaaugcauagguuugggaaauccaguaauauaauucaccauauuugacaagugaauuaaaucauggccaggagcgguggcucccgccuguaaucccagcacuuugggaggcugaggcaggcagaucaccugagaucaggaguucgagacaagccuggccaacauggugaaacccugucucuacuaaaaauacaaaauuagccagguguggugguucaugccuguaaucccggcuaccugggaggcugaggcagaagaaucacuugaacccaggaggccgagguugcagugagcugagaucaugccauuguacuccagcaugggagagcgaaacuccaucucaaaaaacaaacaaacaaacaaacauaauuccuauauaugcuaucugagaagacauuuaaucaaauucaucauugauugaaaaugaucuuaaaaauagaaauaaacggguauaucuccaguaccaaaaaguacaucaugguuagggaacuagaagcauucucacuaaagucaagauaauaguuuaaagggugcugacgccuugggccagcugguuccacuuucacacauacugucuuuguuauauaaaaacguguacagcacgagggaaggauagaaggcuguucaucccaugaaaugagaugaauuauauaccuuguuacauguuauacaaugugauauuaaaaacaacagaggcagucucaaauguguucauaugaaauauuuucaacacacauuguuaacuggaaaaaguaagcuggagagcagucuggcaucagaaaauuauugugaaaguguugaacaguacagagaggcauaaaaagcagacaccuccugcuccucacauaccuguuuucagcccuacucuguaaucuguuuuccaucgugauuuuacugacauuugguacuuuugauuguucagggccaguggggagugacggcagcagaggaagaggaggaaaauaagaggauuggagaauuuaaagaaucuauaccaaaaaugugcucacaguugcgaauauugacccauuucuaccagguguguaugaggauacagaguggcucuucacaccacucugcccauguucuguaccugacaguugcuuucacagugaugagagcagagucagcccugucagucugacacuuauuuguguaggugugaguagcacccaugguggacccugugacccucugggggacucggguaugccugggcuccgggcagugccagugugccaucagugagaacccuggccaaaggguggccccuguggugggaugcgggcacccggggguggccccagugcuccccuguguugggguguggggaccugggcguggccccugugcuccccuguguugggguguggggaccugggcguggccccugugcuccccugugguggguguggggacccggggguggccccugugcuccccugugguggguguggggaccuggggguggccccugugcuccacuguggugggauguggggaccuggggguggccccugugcuccacugugguggguguggggaccuggggguggccccugugcuccacuguggugggauguggggaccuggggguggccccugugcuccacugugguggguguggggaccugggggugaccccuuugcuccccugugguggguguggggaccugggggugaccccugugcuccccugugguggguguggggaccuggggguggccccugugcuccccugugguggguguggggaccuggggguggcuccugugcuccccugugguggguguggggaccugggggugaccccuuugcuccccugugguggguguggggaccugggggugaccccugugcuccccugugguggguguggagaccuggggguggcuccugugcuccccugugguggguguggggaccugggggugaccccugugcuccccuguggugggauguggggaccugggggugaccccugugcuccccugugguggguguggggaccuggggguggccccugcgcucccccguggugggauuguggggaccugcaggcgucucuguagccuucauuuggguuuuucagugacucccgauggggacugucccugagacagcugcccagccugggugaggggccggcagccagcagacaugguguagaccccggaaggcuggggacggcugcucugcaugucugucccucugcuuuugccuccauguauggguccaguuucucauuuccuccauuucucaaugugaucuuagugauaguagagaugaaaagauuucaugaaaaauauuucuguucagucgcugaucacuaaucauggagcaucaagccuccagcccuccaacaucguggguuugugugcuggugccuucaugugguucaaaauugaaagugagaccgcacucgcucuuucugugggcaucuaguuugcuucccagguccucaaacuuuuuuuuuuuuuuuuuuuuugagaccaagucuugcucugucacccaggcugcagugcaguggugugaucuuggcucacugcaauccccgucuccuggguucaaacgaugcuacugccucagccucccgaguagcugggauuacaggcacgcgccaccacacccggcuaauuguuguauuuuuaguagagacaggguuucaccauguuggccaggcuggucuugaacuccugaccucaagugauccacccgccucagcuucccaaagugcugggauuacaggcaugagccaccaugcccggcccucauacuuuuuaaauauuuauuuuucuucacgauaacuaaggaggaacguugucccuuuuacaaguggucuuagucugaccuuggccuacuuuugcauuuuuguugaaguuucauaaaaggggguagugacuggccagucauguuccgugaacaggcaucccuguuggaugguguuuugacacgaugccuucuugaacucauguuauuuguacaguauguauuccuguuucuuaaaaauggacaccuaaugguuagauccauaugauucacuaaaaucagacuuacaaauccuuuguauagcuacaaaggagcaauguguaauuuuaaagauuugucugugugcuuauuucugagacaacgauguucuuguuuaugguuacacauuucccugagggaguuaauacauuuuuaaaaaguaaucacuguaaucccaauuuuacucaaauuacagucuuaaaucugaaugguaaugauuuacaaagaagauucuuuucuguaacagcagaaauccgucucugcucucuguggcggugccagcgacggcaggcuguuaucgccauugacugugaaagaacauccagucucaaccuguggaagaaauauucuuagauuuccuuuuaguaguuccacagaccguuguauuucaguuucaucacaucaucacauaauaggaagucacugucuauauuuuggcaauauaacuucuuaggcguguucuucuucccucaccuaaaaaggcagugauacacacacacacacacacagacacacacacacacacacacacacacacauacacaguguuugccugcucagaggugaaguuacuuuaucaacacagcagagccugugcccaggccugccugugagcuucagcauucguguuucugaccagaagcugggaaggggcagugacagcuggugaagacuugggcggggcuuggugaggacgcagugccucagugaguuuucucugcagaugaggccuuuccaggccagcaguucugugaacagaucagcaccccguggcaugcagcaggcuccagcacugggcggggaugggccuguacucaguaugcaagucuuucagccugaaauagaagcagccaguccuuucgucuuaucagaguuaggggaaacuucugucacaucuuuaaaaacgcccucaguaacaggaugauggcgaugccagugcccaugaagagggcggcugcagccucacguccagcagcuagacccaaagacccgacugaugcucucaauuuguucuccagcaagggcucuaggaugaaauccucuuucaugagucauaugaaagaugaaauauguggcacugaguuuuguauucaaaauagaauguucuaacaucuguuacuuugcuguuuugcuuauucuuguggaacuuaagaacaaagugaaaaaaccuguugguuaguuguuuucaaaucaaauguauucuucacuaauuuguccuuguaaaagggcgcccauuccuaaugcaggugcacuggccgugugcacuccagggucccagcagcucuugcucccuggacaccugcccuggugggcauuuacuaagggccuguugaucuggaaggaaaaacagacccaacccaaaggagauuaagguccggggaauacguuuguggguuguucuuuucugaaacaauauuuuacuccuuuugcuucuuuuuaggguaucgugcagcaguuuuugguguuacugacgaccagcucugacgagagucuucgguuucuuagcuucaggcuggacuucaacgagcauuacaaagccagggagcccaggcuccgugugucucuggguaccagggggcggcgcagcucccacacgugaagcucgcgguccucccagggagcugcgggugauguucguugcacugcuagacacgaaauucccauugacguccugcaggaacugcaugcugcagguguccugcccuuccgcccacgagugcgccauguuucagcggagcggcgugugggagaagccacgucguguuucacaugucggagucgaaugcauuuguaaaucccuaagucaaguaggcuggcugcacuguucacauuugucucuaaaagucuucaucgcuaaaagauaccauaauuugcugaggcuucuuaagcuuucuauguuauaauuuauauuugucacuuuaaaaaauccauuucuuuuagaaaaaauuagggugauaggauauucauuaguuaagaugguaacgucauugcuauuuuuuuaacauccucuuuagagguaauuuuuguuaacauaaccaaaaauuaaauugaaacaaaaugucccaacuaagaaaauauauagagcauuuuauuuuuuuuuaguguuguaaaauauuaaccucugugagauccuuuguaucuuaaugcauuaccuuuacacauauuuauucuuauuuucucuccuuucagaguuuacauuuuuauauuuaauuuacuauuucagauuuuuaaaauaguauagaaaaaaguaggagugauagagaacaaaaauacucuuauacagugcaacccaaauaccgcgaaugcaucagcuaaagcagcguguaaauaggagugacgagaaaguuaauggaguauuuuauuuucaaaguuccugauaagcauuggaaagaaaucgacauggauaaugaagauuuccuuuuuccuugccuauuuuuucauuguaaauauuuauauacuacugaccaagauguuggggugggggggauuguuuuuuguaaaaaugucauuaucaggucacauaaaucugccuuuauguugcauaagugaaaauuuagaaaauuaaaagcaauuaucuu

SEQ ID NO: 191835 - RNA, 31105 nt, Homo sapiens
agacggaccgagggccggaagugacgccagcuggcccgcuugaggcguaggggguggcgcucuccguucggcggcgcucccauggcgcacauuaccauuaaccaguaccugcagcagguggguccuagccggggagcgcgcggcggcgugguuggcccucggcguguuccguguguccccuccugccuuggacccucaggccuuuuccuuucccgccucgccacccuucuuccguucggguccccggcgggcagccgcgcgagccgaacagcggcggccgggacucgggaaggcggcccgaguucuccccugcagggccgccgugggggccgggcgguguccguggaucgcggagucgucgcgguguaaguagacgcggcggucccaggucgcugcccucacuugcuggcacguguggccgcgcucccaggcgguccgaagggccugcgggccacgccgagggcccgcugugggcggugcugugucggauggacgcuguuucccagcaggaugcgggaugaauucggggacuccaggaggcgauggaggaguaagcgcgaggcuguggccgugcugcaggccgggcucgugccccucguccucgcugucguuuaacgcccuucacucuccgagcacaaugcacacuucauaucgcucgguacaugcgucugacagauguuguucaacagcuuguaaguagcagaagcacaguuaaaagauggacacuuguaaagauucaacgcauauucuuuccacuaaacuaugccugucuucagaaccagcacugugguaacagggauaggaaauauagggaauggauuuuuaaaauauuugaaggaaacauuaccaagacguggugaauaagaaugggugggcugagggacacggaggaguuaagaaugauucccaggcuuguaaucugggaaaaagaugaauagaguggauuuggagggagaaauaaaguuuugggcauguugaguuugaggugucuguugacaacuggguaaagauacguacuugauagcugaaaagucugacaugauugggcccagcaguugcuugguuaauugagaaaacugguuaaaacaggaaucacgaagaaauggauguauguuuuuaacuuaaaacaugaaaguauacauucacuugccaauuuuuuuuuuacaccacuuaccucaaguucuauacuugccaaucuuuugauguaagcccagggccuuuucuuuaggcugugucuguuuuggccuaaucuuagcagacuuaacauuuuccaauaucaguuuauuuaaaguuaaacaaggauauaggcauuuaagaaccaauuugauacgauuaucuuuagaauuuucuuaaucuuuuacaauuuuucccccauaccuaauuauuuuuuuaacaaacucaagugagccuuuuaaaaacauacaacuuagcuuauagagaaacaacuguuuccuuuugcauucauauuucauugaugagcuuaaaaguacauaacuaccauaacagguucggguagcaaaaauagauuugagaacaaacacaucuggauaugagaacacauacaacuuagcuggcaaaagcuugcgauguauuagagugaagccuacuugcugaaagucgucaucauaccuugggcaucagcucguguauuucagggagggauuggagagagucauuuuuccaauucaagucaguuaaagugagacugauaagcgagcuucuacucuauguguguaaacugaaguuuaaacagacagauuuggguuaaagauacaaaccugagacuccuucguagucacaugaugggaaagacugagaagggaaggggugacccagggaacaaguagagagaguagacaggggcugggcccaggauggacuucuauggagaugugcaugccuacaucuccgcaaagggcaguguagccacuggggugagacagcaaaaaguccgcuuccuccuaauucugauggauaaaaauauuucugguugaacuggcauguuaccuaaguuuuauguauuaacagauucuugaauauuuuaagaaaauaggugccucuucgauacagaauggcaaccgguuauacaugguaacacauguuugauuuguuguauaggaacauaagugccaaugucacuguaucucuuugggaauaaaaccaucauuugcacauucaucaaagcuaggaaguugggggaaaucauugacuccuccuuuagucucagcaaauaguccuuuaccuaauuggauguaucuccgaagucucucagauccaucccuucuuuaucuguugccacaugcuccccagccaggacgcccugcugcagguacugguugaugguuuccuuuacuuugcccuuuccaagugagacacagcaaagagaccauagacuuuaaagacaauaagacuucagcccaaauccuggcauuuuuacuaauucugggaccaugacaaguuaucuaacuucugugacucuccaucucuaaacaggcuucacauaaguugugagaauuaaaaagaccaugaauucacaguaaaugcauuuacuuaguaaaugauaguucugguauuuuauugaagaagaguugagcaucugccucuguuacuaaaacuucauugacucucuguuuccuccagggaaaguuccaaaugcuuuagcacaucaucugguccauguuuaccuguuaacuuggcaucaccagucugaagguuuauuucacuuaugcugaaugcaccauugccccaccgaaguacucauaacuuaaaauauaccauuuaaccauuuuaaaguacacaauuaaguacauucacaauauugcacaaccaucaccauuauccagaauuuuuugucaccccaaauggaaaugucauaagcauuaagcagucacucccugguccucccucccgagcgcuugucaaccgcuaaugugcucucugucuguauggauuugcugacucuggugauuucaguauguggcuuuugugugucuuucccuugcaucauguuuucaggguucaucuguguuggaacaugugucagugugucguucuuuuuuauggcuaaugauauuccauuguauggaguauuuuguuuauccauucaucaguugauggaccacuucaguuguuuccucuuuuuggcuguugugcugcugcugugaacauucuugcgcagguuuuguauucuuuuuggcauauaccuaagaguggaauugcugagucauaugguaauucuguguuuaacuuguuaaagaaaugccaaagcagcuagcugcaucauuuuacauuuucaccagcaauguaugaggguugcaauuucuucacuuucuugucaaugcuuguuuuuuuccauucuuuuuauuauggccauccugcugggugcggagugguaucuucuuguggcaccccaugaucuuucuugucccaaagauuuucuucauuauguuccuuuugccaagaacaccucucuuuuuuacagguguagugaacaucuuuauuuagggaaucagcuuugaguuagauacuuuacuccuuaaucuucaguaguucuucauauugucuuucaagaguuuauggaauuggaaaguuugacuauucagaagugacuucagagguucaugaccuguaaugauuuugaauuuuuaaaagaguuaugaguuccaagaguagauggugccuccuguggaccagacuggagggcgugaggggcaugcagcaaccacaaggaagucuuccuggggccagagccagggagcauccccuggugagccaggccugggggugccgcucagaaggugcucacuuggagucugguuguguggucccauugagggcugaaggcucugcagcaugagcuguuaagaguuggccagguggcugggcugcuagggguccuguguccacugcggcgccagucgcaccuuuagggcuugcaaguaccguccguugccaucccugcuuuuccucuucacauccccagucuucucacaguuuagucauugaggcaggggcauugauaggaccaccccugggacacauucaugccugccaagcaagcuggggcccuccuugggcucaaggcccuguggcacugagcccuccucuggucaggucacccgugggacacugggugcagcccagguagguguggccaagcagagcccaggauguggcgacaucacccugcauaugugcagggaccacccugggaggucacaggcaaaggagggcuaccagugagugcccccagcaggggucuccgccucuccuuggagggccccggugucuguacuccaggguuugaucccuucgugaccacuguguccccaguguguuuagucauugaaguaugcuuccauuccacagugcuugcuccaagucugggacucucagcuuucagucacucauagguuccuucugcagagagcucuggaggccuuggcaacaucagaacaucaugcucaagugugaccugucaccagaguacugauguuaaccagaacacuccucuucucaggcuccuggggcugggcccagugcaaggcccuggguggugcgagagaucgcacagugcggggccuggagugccuggaaccauaagcagggguggcuguggggaacucuuagcuugaaccuccuguuuguguggaaccaaagagagcacggcuuggccagcaggcuccagaaccgcuuucuagccagaagccccuuaguugagcaagguuggagucuguuggggcuccuguggcuaggccugcccacauggcacagggagggccacuuuggaaggcauauccucucuggggcuaaacugacuaauacugguuuucuugggggacuugcagaccaagaccugggugggaucgguuguuuugccuuccaucccagggccaacuacugaugggagggcaaacggggaagacgcagugugccugccuggccaaggcaguugccacccucauccuugagggcgcuguuccauugcaccuggucagauggucucgagggagccagaggaggccccuuuggagcugggcaccagugaguucuugcagggcgugggcaggggacaccggaaagccuccugcagaggaugggcagauaccaguguugucuucuuggggccaucuucagcuucuugaugaugauuggcaaaugcaguguuguaaauugcaaaauacugaucuguagcauggugauuuuaaagaggaaaccuaacccuuuccccuaaacagcugaggaucuuaguaucugucugucuaccuuuuagaugaaaucccuaaaccuguggccagggcuaugaagagaaacuuaguuuccauaauacuugggcccaaaucgucuugcacccauuugugacuuugaaaaugucaggagcuaggcuaugaugugacguugagcagcagcuugugaccuugcauggacuggggcaggagggcugccucugaauggcuguaguuuuccuaugaaggcagaaaaccugcaagucuucagauggcuucagcugaagauaaaguuaaguuccugcuuacaccuccaacccaaaucccaugggacucucccuucuccugcucugugccagugcugcucuuucucacugacgacuguggucccggcgacaccgcccuacccacugcacucacaagcaguucaggauuagggcccuagugccaccaacaacauucuacucagugauguugaaauucaggauuuuuuuuguuuuguuuuuggcagucuuuuuguccuuagaauaaggacagucaaauuccacaaacuacuguuuucaaagguuacucauauagguauguauuuucuauuuguuucaauuuuaagguuugucuuucuauuuuauuucuugaaugggguuguaaguaacuuauauuuaaaggugugcucagaaacuuuccuucucucucucaccucauuccaccccccucucuagaaagauaaucauuugcauuagauucugccuucuccauccuguauuuccuuuugggauguacaugugacacacacacagacauaaacacacauauuuuucuuguuucccuucauucuuauacaagacgcagcauucuauacauacucuuuuacaacuugcuuuuuucacuuaacuguaucuuccuagaaauuauugcauguaaauuccuagagaucuuccucauuuucaaaaaaugguugcauagugugccuuaaaauagauguuucacagaguauucagccugucucuauggauggauauuuaguuuguguccaauauuuugugauuacauguagccgaguacaaauaccuucuguuucuaguuguaaguuccuggcagugugauuacuguuucaaaauguaaaugcauguguaguuguauggaauagucaggggggaaauuccuuaucauggaaguuagucuucaggaagguggugucagccucccugucauacccugaguugaacaaugggguaguaggaguugggcuccaguguguugaacugguggcaugugccucccuuucuucuggguauggacaccugggcacaggauuacugggucagagaguaggcguuugcuugcuuuaguagaauaccaauuuucuucuaaaaauuuaccccaaguuaccccaucaccaaugugugagccuucuaguugcuucaggcuccuggcaacacuuggugucaucagccuuccuaguuguaaguacucuuguggguguguagagggaucucaucugcuugugcuuuuuugccauuugcacaugcauguuaugacauccccggucagucuuguguuagcauaaaauguaaauauuuaauuuuaucauaguuaaauuauacuguaucuaaagcuuugugcuugccuuuuuucuuaguuagaauuuuuauguccuuuuuuuuuuuuuuuuuuugagacggagucuugcucugucgcccaggcuggagugcaguggcgcgauuucugcucacugcaugcaagcuccgccuccuggguucgcgccauucuccucccucagccucccgaguaccugggacuacggaugcccaccaccacacccggcuaauuuuuuuguauuuuuaguacagaugggguuucauugcguuagccaggagggucucgaucuucugaccucaugaucugcccgccucggccucccaaagugcugggauuacaggcgugagccaccgugaccggcaauuuuuuuguaaauauaauuuaaaagcauauuugguuuucuaguuauaaaaugucuguuguggcaggcgcuagauagggcaaaaggcucccgggucuccuagucuccacccgacguucugcgcagucagcuggugugguaugguacaggcccugcauucuuuccugugccugcauguuguacguaauuuuucucuucuuuuuucucccaaaucaaguuauacaguuuuccugcaguuaacuuuuuuuuucauuuaaucaucauauuguggacauuuucucaucuuacuacauacagaucuauuuuauucuuuuuaacagcagccgaguaucgcauuguaugaaugugacaucuauuuagcuauuuccauuuuccuuuuauuuuauauuaagguugaguggaagcuuuuugaauuuuggauauaugugguuuuuaaacugauuucuuuuucauaagcuguauauuuggauuuucaaacauauauuagugugauugaguaaaauuagaauaauucaucuucaugaagagcuacaugauaaaccacugacuuauuuuuauuugcuuaaccuguuuuuuugcuucaggaacaucuguuuuuguuuuuuuggucuguuuuaaagagacgggucuugcuauguuguccaggauggucucgaacuccuggcucaagcaguccuuccucagccucacaaagugcugggauuacaggccugagccagccaggaacaaccuauuuugaaaugaaauuauuguuuacgauugcgccacugcaguccgcaguccgaccugggcgacagagcgagacuccgucucaaaaaaaaaaaaaaaaaaaaagaaauuauuguuuacccacugcagagaguagugaccaucuguuacauuuugauuguucugucuucuuucaaaguaggggaaaaugaauuuuccccuguguggcauucaguguauuguuguagguucuauucgaacagaauauuuuauuuucuacuuagguuucccuuucaaauguuucagguguacgaagccaucgacagcagagauggagcaucuugugcagaguuggugucuuuuaaacauccucauguugcaaacccacgacuucaaguaggugaaagagcugugcacacaggugucugcagacaauuacaggguaaccacuuuccuaagagaagcguagaguuugaguaagaagaaaacuaauauugucacucuuauuugaaaauuuuaaaguuucuuuaugauuuauguaauuucaauccauuuguggagcacugacuauguacgcacacuguggugauguggaccuccugcccuuguguuugauuccuagacagcucucugagguuuagagaaguuagaugguggagaggcgguggagcuuagauucugucuaggccugugcguccccaaagccccauagacgucauguaccacaggugucucccauuuaaguuguuagucagaaaggcuggcaagccaaggcccagccugggguuguacauggaguuuccaugucaucuguggcguagaugauguugaggcaguauuuucuauagaaaaucuuguggacauuugguaaagcccuguuuccucauugacacccuuuaucauauuggaguguguuccuacuggaagcagcauuuuucuuuuggaagaaaaaugggcuuaucuauuggugauuauguuuggcgguguacagacuugcaacucagaccagguaaaucagucucugaaguagcagcaggccuguuuuuguuuuucuaauaaaguuaccuaggugauucuauguguagacaguguugaaaaccauugcucuaaguaggaguuagugcuagagacucgaugagacucaggcuugccuuggccagaacaccccauggcuggugcccugugcuuuguauuguaugacaugagaggacacacacuguccuguuugcaaucugagacagaucccuucauuguaaaauuccccaguaaacuuucuuucggugguuucauucaccagggacuguagaauggugauuuuucugauacugucauucuucucucucaccauaucagcaugggcucauugcuuuuguaaacaaaaccaaacaaaacaaaaaaacgcagugugcuuauaauccauuguguguuagucuggguucuccagagaaacagagccagugggauauaucaauauuuauagagauuuaguaugaggaacuggguccugugauuguagaggucaagaaaucccacacaaggagugaauucuuucuuccucgaccucuuguucuauucaagcccucaucagauuggccauugcccguccacacugaggagggccaucuacuuuccugagucuacuagugcaacugccagucucauccagaaacacccucacagacacucccagaaauaacauugucuggggacuccacagcuagucaaguuggcaaaauuaaccaucaccuguugagauguucagauuaucuaaaauuugacuguuaggaggaaaggaaaacuuagaaagaaaugucagcuagacuagcccaggagaugagacugguggucucagcaggaagccgagaagaacgaguccuaacauagcaccaucuguaacucauuagaccucacuuacuaaaccuaugacaguuacuuaacaaguauuucuugacugacuggucaagaauacuaauauacugaaauguauaugaaagugccuagaauauuuucugacuugcagaaggcgagaccaaauuauauucaugggcuucuuuuuccccugaaauauugauaaauauuuguugaaguaaugaaccauuuauuuauuuauuuauuuaugagacagagucucccucugucacccaggcuguagugcaguggcacgaucuuggcuuacuacaaccucccccacccauguucaagcgauucucaugccucagccuccugaguagcugggauuaccagcguguaccaccacauccagcuaauuuuuguaauuuuuuuuguagagacgggcuuucaccauguuggccaggcuggucuugaacuucuagccucaagugaucugcccaccucgcccucccaaagugcugggauuacaggcaugagccacugugcucacggccugaaccuuuuauuuagagugguaaauauaaaguguuacugugaacuguaaagcauaaauucucuugaaacagagguuuaaaucucuuucuauauguugcauucuuucugugccuauuaauuuuacuuuugcuauuuuucuuuuuuaaaaucagauggccucuccagaggagaagugucaacaagucuuggaacccccuuaugaugaaauguuugcagcucauuuaagguaaucuguuggggaggaagaaaaacacacacaucuggaaauugcugaauuaacuggggauuuuaucuugcauuaucuugugcuugaagcagugaauaacugacuuugaaaaagugggaaaaugcauuuguaacuucaguuugguaaagccuguggaaauuguaaacaucaguuauauaauacuauuuuuaacaucacacaguauuuagcagagugccugcuuaguggucuuuuuaguagaguuuggagccgaacuguucacuuacccuuuucguggaaauaugucuguuuuugaagcucuuuacguuacugggaaagaaauuagaguugagcaaagcaaacaaugcuacuuuuuauguacacuucauaucuacuguuuuaucucuaaaggaucaguucaggcagaagauuguguccuuauagccaugugagauuugauuacugucuuucagagcagccugggcuacaggaccaguguggggucugugagcaggaauguucugugaaccccacagggucuuuggaagaguuggggcaccaccguguuccuuguaguacaaagcaccugugauuuccuagcucugugcagugugcgauagguuccagauuuggcgaugaacuaacacugacauuacccagcugggaaucuaguuugaaugucauugucagccccugcuagaguggaagggucauacuauguuaucaacauguguuacucauaaaccugcuggugcuagguccuucugggacuugaaagaguagucuccaagcuuacugugggacuuccucuuauccucaccuguuuguguucagccauuuguguguuucuuccuucacuccuuucaucccaggaccacugggaccugugcaaugaagugagcugugugggcugcauaacuagugcuagguuuuuauugugugacagcauguuucuguuucuccuccaggugcacuuaugcaguggggaaucaugacuucauagaggcauacaagugccagaccgugauaguccaauauccuuugucguucauggcagcugucccgcauagaacacaugcaguggauuacuugggacuugagacccggaaacacugggccaguugcucauuucugcaguuagaaaggaaugacaguguuuuggaacagaagcucguuucagcucuuucacuuggguacuuaaauuuagcauggaucugaagacucgugcaguacuuaguaaggaagaacacugguuaggaagaaggaucuuacucugcugagaagaagaaugcuuuguugccuuuaguaagguaguaaguauauuuacagggacugguuaaguccuguuggugaaauaccagaaauccagaauucaggcagagauggacaagaguggccucagauguacaucggcauugaauuguggcagcugaagaccuuaaaucaaaccaauucauacuucagucauuuaaaggguaucuuuaguuacggccugagucagugagugugcuaaggauuuguauguaucucuagauuuugucuuuucguuuuaaccaccuuguuuaaauauacacagaagagaguugggcuauuugcucacagccuccuuagaauucaagaauucuagaguugauaaaaucagccuuaugcuacagauucuaaagcacuuaaauauaacucaugaucaucugggcucagagaaaccaaauaaaaugucagaaagggcugauuuuaaaaaaucuuguaagucuuuuuuauuuaggagacaguguguaugaaauaaguguauuuaguauacuugagccuaaugagauacagauauuuguaaugugagcuuauaccuuuuuuccuucaagaacuuacuauuguugcaacauaaaucugcucaagggugaucuacauuccuuaaaauuuagauucuuauucuuuacuuuuaucguacguagcauuauuugaacuuuguaugccauaucuuccuuaauacaguacaucauucuugcgagcauuccaggcccacaaagaagaaaacugguaagugugaacagaaacagcugaauuagcaaauggcaauuuuuuuagcagaaucuuuuuacaaauuugcuuuaaauaaauguguauuguauuuuccauguggauauuugguaaucaguguguugacauaugguaauaucuacacagaugaguggagucacaaaucuaguaaacugaaaugguagaucagccacauuguuugcagugugucuaugucaauauaguauuauuuuuauuucagauguccauuucccuagauauuuauuaaauacuguuuuuuccuucaguugucaauuuugaacuuuugguuuuaaaccuuagauaaaagagguagaccaacuacgguucauuugggguguucuaauacauaauaauggugguauuuuuaaaugccuugccaaacuaaauuuuaugauuuauuaacaaacuauagguuaauacugaaauuuguuuauacugaaauaaccaaaggccuuuugcaaacaaacccgcccuuuuaucuuuuuuuuuuuuugagaaggagucuugcucagucgccgaggcuggagugcaguggcgcagucuuggcucacugcagccucugccucccgccacccuuuuaucuuuuaacgugaaaacuugcacaugaaaacaguccaguuuugccaguuggcuguaaaaguuguuuugugacauuuuguguauuacauauucugguuccuguuaggaaaucugaucaaaccacuucuuuuuuaguggugcuguuuggauacuggugggaagcugaggggaggaggauauccugggagcccagaacugaagcagggcugaggucucugacaggguuggggacagggguguggagcaccgcauuguggggccccaggaugaucaggaagucugaggccugcagccugccuggacagaaggugaggaagcagacaacugucagaguuuuggauaagugcggacuccauucuggauaguagcccuggguguccguguucuucccaccucuggggauggaaucuuggcccacguagccccucacacuuguuuacuuuuuugcccugcagggcucugccugucauguaugcaguagcgcuugaccuucgaguguuugccaauaauguaaguuuaauuugcugucauuauuauuuuaaaacuaaaacuuggugacuaucuguuguuuaauuucaugucauucuucccagaaguuuugaggagcaaauuggaguugagaugugucugguauagggagcaaaagaaagauauugacuauucuuucuggguuaacaccaacagauuuauauaaacauuugcucagauuuccacacuguucauauagagggagagguuccauuuugugguuaaccauuuaugguauguguuauuuuuaugaagugaguggaacaacaacaaaugagcuuauucugcaucucuucuaccuuuaagauguggccugcucccccaccaaaaagaauucagcuucauauagauuugggcaguaggagggggcuucccuggggugaagggagauccuggguuuuauggaggcgacguccccauggggacccacggaaguccccauuauggagcagcauuugucaaccuuuugguuuuaggacgaccccuuuacaguuuuagaaaugauuguugacuucaguuccagucaggaugcaauggauuucacccuauugugccugcuagaaacaguuaaaacccugggaguugucaggccggcauggcuaugggagguggagagaagagggggauggggcucagagucacguguagggagucuccagguuuccuuuuugucuccugucuguccuggacugggcgcguuagaaaccugaagccuuucaccaucaggcagagacaaaaagccccaaggaaaccaggaggcugggaagacaguccaauccagcaagacagaacucugaccgucacugccucacuccagugccaggcgcaaagaagucagcagguccgucccaccccaucugcaaaguggugcggacuggggguggcccaggaccuccacccugggcuagcaguaaugaggagcuagucccccuccccaccagguggaugucagaggcuaagcaggggaccuagaccuccccgacucaguggcuaaggggaugcaccuguuucucugcuugcauggugaggccugcuaaacaagauaaauaaaguccauagucucgucagguagugccucaaauguccgggaucuaaucgacacugauuaccaggaaaaucucaacuuucagagauuucaaaugagaaaaaacauucagcagaagacaccaaggcugagauuguacaaauguuggaauuaugugacaagaguuuuaaacagcccucuugauucagcaagcaauuuagaacaugcuugaaacaaaugaaaacauuuaaagucucaacaaggaaauaggcgauauaaagaagaaccaaauggaaauuuuagaacugaaaaguauacugaagaccucagaaagcuuuuauuuuuguuauaucuauuuauauuuacuguauuagaaauuuuaauuagaaaagauuuuaaaauauucauuuuaaagcaacaauaauaaaccuuuuacauguaacauaacugacuuuuuaaauaaaaaauaacuauauuuccaaaacaaaauacuaagaaaaguagugucacaucacuuuugaccucuuugaugucuaguucagcagaggcaaucugguccccuugccugcuucugcacuuacucuguugcaguacacuguuuugaguaaaguguuucucugccugauggugaaaggcuacaucacaaaguuguagauggaaaagagaggaauauucucauaggcuuuccagaccauugagauaauucuuugacucuauauaggaaaacuccaagaggcaguuuuuuuuuuuuaaaaagguuaguuacaauguggcuucugaaguguaccaauaaacuuuuucuaccuuuacacugaaauccacuggucugccuaaagcacugaauggauuucguaauaucuuguguuagucaugucuuaguccauuugggcugcuauaagaaaauacuauaaacuggguuggcuuguaaccaacaagcauuuaugucucauaguucuggaggcagggagguccagaucaagucagggagguccagaucaagucaggcagggagguccagaucaaguugaguuucugaugaagagggccgcuuccuggcucauagcaucuugcugugucugcacaugguagauggggcaagggaucucucuuucccauucaugacagcuucaccuucaugaccucaucaccuuccaaaggccucucuuccaaacaccgucacuuugaggguuaggauuucagcaugaguuuuggaggggacacaagcauucagaccauagcagaccauuuggaguauauuagcuuacugagccaugcagcaccucccaagugcugauauaccacuguuaaaaacccaacccccaaaccccuaccuuccuuaacaucuccaggggccucaucagaaaagccuuggaguaaggaaaagcugcuaagcucacaguaguucauaaaaguuuuccagaauucugguuuuucuugaaagcacaaauguugucauuggcaacgaguaccaucaguuguuugccuggaagugacagauuuguucuauucguuuuggagaauauggucagccagaugcccaagccuggguagcugugucugccugucuucuguucugcaagaagcagcuaguucagcucacagcucagacagcugcccagagcuuuucuguaaacagccaugagacacccgugugcaacagaagugcuguaugcuucucauuucaucacaaagaauauaaaaaacgugugcucaaggaccaagauuuaagaaaauucauauuuacugcauuaucaaggacauuuuauuuauuuauuuagagauggucuugcucugucacccaagcugaagugcaauggugcagucauagcucacugcagccuugaguuccugggcugaagccucccaccucagccuccugaguagcugggacuacaggucuacgccaugauaccgggcuaauuuaaaauuuuuuaauuaagacagagucuugccauauugcccaggcuggucucaaacuccugggcucaagugauucucccaccucagccucccgaaagugcugggauuacaggugugaaccacugugcuuggcucaucgaggacauuuuuuaaaggaaacuaauuuuacugguuuguugauugacugauugauugcagagugucugguguuuaagaacguggugauuacuugcguaguuuggugccggugggagcacuccagcauuuuaccuauugcuguuuuugcaccaucagugcaaacguuaauacaguaaaaaaagaccauaauggcuuaguguuguugugaauauaguuugagcugugggucaucugcaagccuguugcaggccucggguuuguggagaacacaaguggcagaaacagacucuuucuucuuuaaccaaggccauccucccaaaugcgagggaaaagucaaacucagugaugacuuuaauauuuguuaaacguuuuuauuucaaguguuuugacuagccaacuucagggacugaagagagagcuuaguugcuuaguaacauaugcagugcagguuugaaaaauuggugacugacuuaacuugaaauaauugaagaaagauuugguuugugaaagaauuggaguaauacagacuucucaauuuuuaaaaauauuauaguacaugcuagcugauuucuccaggaucuuucgggacuuugagucuuaauuguacccauuuuuugcuucaagaaauaaauguuuuggcugggcacaauggcucaugccuguaaucccaacacuuccggaggccaggaugggaggauuacuuggagucagaaguucaggaccagccagagcaacaaagugagacccugucucuacaaaaaaaaaagaaaaaaauauuaaaauaaauuuuaaaaaaacaaaacccaaaacuagccaggcaugguaguaccugguuccaugguuccagcuccucaggaggcugagaugggaagaucaguggagcccaggagguugaggcugcagugaggugugauugugccacugcaguccagccuggacgacacagcaagaucuugcuucggaaaaaugaaauaaaaguucuuauauuuuauuaggcagaucaacaguugguaaagaaaggaaaaagcaaaguuggggacauguuggaaaaagcagcagaguuacugaugagcuguuuccgggucugugccagcgacacgugaguaaggacuugaggaccgaccaccagacgcuguuggugguguuuucauugcagcguucacccuuucuggccuguguuuauuguugacacauauuucauuucuacacaugcuauaaucccacaaccauuguuauuuuugcuuuaaaaaguugauuguuuuguaaaggaaauaagagcugagggaaaaaagagucuucauuugcccacauuugaccaugccuggagcuccucucugcaggaaccaguuuccgucuagugccauuucccuuuccugaggcacuuucuuccacauuugcguuuggugagggucugagggcagugaaucuuuuaagcuuucauuuuucugaaacucucguuauuuuuuuuaagaaauguucucucuuuaccagugaagaagcagcacugaucaccuucauuuuuaaggcuccauuugcuacauggagucucguggguugacaguuuuuuccuuuuggcacuuuaaaaaugucauuccaucugguuuccuuugcuucugaugaguccuugccaucguucccuguauagaaugggucuuuuuccucuggcuaugauuuucucuuuaucauuggcauucaguaauuuggcucugaugugcauaguugguuuuuuuuuuuuuuuuuaauuucuucuguuuaggguucauugggcuuccuguauuuguaaguugauguuuuuaaaaauuuaauguuuuacauucuuuaacuacuuuuggccccauuuuuucucuucucuuucugggauuucaacugcauguguguuaagugcaugauauuaucccucacaggccgcuguuagucuuuguuuauuuuuuaaucuuuuuuuuuuuugagacaagacucuugcucugucgcccaggcuggagugcaguggugccaucucagcucacugcaaccuccgccuccuggguucaagccauucuccugccucagccuccugaauagcugggauuacaggcgcaugccaccacguccggcuacuuuuuguauuuuuaguagagaugggguuucaccauguuggccaggcuugucuugaauuucugaccucaggugauccacccuccucggccucccaaagugcugggauuauaggcgugagccacugcaccugaccucaauccuuuuuuuuuuuuuuccucuccuucauuuuagguaauuuguauugaccugcuuacaaguugacugaucuuuucugccauuauuuauuuuuaaauucucaacuuuccgucugauucugcuuuagaauuuccauuuuuucuucuaaaacucccaucucuucaccaauuauauaaucacauuuauuuaugagauuuaggaaauuuuaaagcaaagaaagauuaucaaagguauccauauauaaauaaacaaaaaacuauuguucccagagaguaguuguuuuaguccucuuguguugcuauaaaggaauaccugaggcuggggaauguaagaaaaggggaauaccugaggcuggggaauguaagaaaagaggggaauaccugaggcuggggaauguaagaaaagaggggaauaccugaggcuggggaauguaagaaaagagguuuauuuggcucacaguucugcagguugcacaagaagcauggugcucguaucugcuucuggugaggccucaggcugcuuccacucaugcuggaagacaaagaggagcccacuacauggcaagagaggaggcaggagauagaaggggaggcgccaggcucuuccacaaccagcugucugggaacgcucacaggagcucagagcgagaacucauucauuauggcaaggacagcaccaagccauucaugagggguccacccccaugacccaaaaaccucccauuagguuccuccuccaacaacggggaucagguuuuaacaugaggcuugauguggccaaaaaaccacauccaaaccauagcaguagcccagcuucucuuuucacucauuguguuuguugccaauaaacucuguagccucaaaagaugggaacuuuuccuuuuggguguuguggaucccauccaugaaaccgaaaguaaguguugagcagagcaagcuguauguaaaggccaaggaaugaagaagcaggaguguggcucacaaaucaacuucucuacuccugaggggugaggggauugaaauagaggguuucuugaaugaagggguuggacauugaaagcaaggggaagaauauucauggcuuuucuggaaauggacggugaacuucugggagcugaagcacugccaucuuuuuguccuuuuacggcgucuucccgucauugucauggugauugucagccgcuguggcacuggugggagugucacggagcaugcaaaugagguuguaaugaaguuggaggcccugcaaaggccagguggacuuccacuuagcauccugcuggucuuagcugguuuaaccaagaggggagccucugaccucaggcauccuauugcugaagauaggcagaguuugaguugugcaacuguucagccaagccuacaagauguauagugcuguggggguaacauggccucccuacccagccucgcuucagaacuuucguaccaaggcuggacuguagaaaaguccuuccuaugccauggcacuuucccacugaggccucccaugggugccguuuccuuugcuggaagguucuccucgacuccuggcagucuauacucauuuaaagguuuccgccuucucuaaagccucucacugcuggacuucacgguggaucagauuucccuuuuauaaacauucauagcagacuguacauuucuuucacugcguuuaccaaacgauuugauggcgaagugcgucagggcgugggccuucuccaucacuagcguuccuugcaccccaggagcucaauccguguuuccuaaaugaauacuugacauuucgcuugaucguauauuuuugcacagcagugaucuucacgaccuuugauuaggcaguggcuucucagauacgacaacaaaagcauaagcaaccaaaggaaaaaauuaauuggacuucaucaaaauuaaaaacuuuagacuucaaaggacauucucaaaaaaguaaaaaacaaccauaaccuagcaaauaauacaucugauaagggccuaauauccagaauauauaaagaauuauuacaauucaacaguaaaaagacaauccaauucaaauucuuuaaaauguuuaaagaauuugaaaaaucuuccaaacaaaauacgcaagugaccaguaagugcaugaaaagaugcucaaggucauuaaucaccagugacuuagucaccaaugacuaaugcaucagucacuugaaaugcacaucagaaccucugagagcugccaggccacacccagugggaugacuguaaucagaaagacgggcggcgccagugaggaugcagggagacuggagccucguacacaucgccaggggaacaaaaacagugcagcugcugugcggaaaugggaaggcaguuccugaaagugggacguagagcuaccaugugacccagcauuuccacccugaggggacacucagaagacagggcagauccccagugacaucucuuucccguugggguuugcuuuugucacagucuccaauagaggucaucauuccuggugccagaccagcuacgauauuaccaugcguguagcguuuuacgugaguuacggaguacuuguguguuuuguuugguuuuuccauagcucuuugaagucauagaacaguauuauuauuugucuccguuuucagaugaggaaaacgagaccuugagagacuuuuguuugaggucaugcacguagggaaugauaaaagucauagaccugcuuagagcagcucacaggcaguuauaaaacaggguuugauauuuuaaaauuguauuuuuacauuauuuuaaguguuucuauauggacacauuuuggucuuuaagaguaauuuuauguucuguggcuuguaaaccaccugcuuguuuucuguacugggcacuuuuguauuuuugugccuugacuuugagugauuuuaucauuuuguuaacaccacagaguguacuucguaaaccgagauggcguggccugcuacacacccccgcuguguggcgcagccuguggguccuaggcugcgaggagcaagagcugcacuaaaugcuguaggcagcuggaacacagugggaauuauuugugugucuaaacagaucuaaacacagaaaagaugcaguaaaaauacagugugagacuccguagggccccaucucacauguggucaagugugagacuccguagggccccaucucacauguggucaagugugagacuccguagggccccaucucacauguggucaagugugagacuccguagggccccaucucacauguggucaagugugagacucuguagggccccaucucacauguggucaucuguaguugaccgaaauguuguguaacaugugacuguuuccagguuaauugcagacaguggcacacccuccccuagguucuucaguuucuguuuuuucagucuuuugagguaaaauuugcaugcagugaacuaccuacaguauuaucugucugcuugcugcugagguauaggacaugauugccaccccagaaacuucccucaucccucauguggggcaggcccuuucagcugucuggauuuguuccacuguggguugcuuccugccuguucggugacuucauguaaauggaccaccacaguguguacuuuuugugucugccuuggugggacucauccucuuuguguguuuuacugguuuguuuugucguacugaugagaaguauuuuuccauuuuucuuuucuuuuuuuguuuuuguuuuuugagacggagucacgcugugucacccaggcugaagugcauuggcccggguuugagugauucuccugccucagccuccugaguggcugggauuacaggcacacaccaccaugcccuauuuuuccauuuuucaaaaacgguuuauaacaauuaacuuuuacgcauuguugcugcaaaugaggcaguuuuuagcuggugccgcggaggaaggauguuacucaaguaguuaauugggauuuuccugguuuguuuucucuuuuauuuuuacccaucagguaagacaucuuuuuucauaauguuauuuuguuugaugaauaugacuugauaugaauaaguugauaugaauaugacuugagcuuugggacuuaccucaagauauuaauuuguuuaggcaguuuauuuugugauuuauaaauaaaauuuuuauuuccuauguaacuuaaaaaaaauuauuuccccauagccgugcugguauagaggacucuaagaaguggggcaugcuguuucuggugaaccagcuguuuaaaaucuacuucaaggugugcuucuguuugaauccuuucugucuuuacaauuuucgauuguccugggcuucccacauaucauauauauaucagcuagccucccuggcguugcuugugaaaugaucauaaccguauuccuaguccuaauagcaaacauuuguugaaugccuacuaggugcaaggcacuauucugaaugcuuuacaaaugucuuccuguugacaaucagcccucugagguuagcgcucccagccccagaggaaacgaaggccccugugugugaagcagcugucccagugugguggaauugggcuuucagugcaggcgguuucacuccagagcguuuugucuucuguggucauaauuaacuauggaaaagcaggcacguagauggauagauggauaaagaaaccauugccacauaaagucagucaggugaagagcagcccaucacgugucagcagcugggacuugugccuucuguccagugccuuccacuccuguagagcaccccaccuuccugccggugcugcauaagcacaggcuccugcagggcugcgcccccuggaacggcuucccagagccuccacaagcacgggcuccugcagggcugcgcccccugaaacggcuucgcagagccuccacuagcacaggcuccugcagggcugugcccccuggaacggcuucgcagagccuccacuagcacaggcuccugcagggcugugcccccuggaacggcuucccacugcagggcugcgcccccuggaacagcuucccagagccuccaccagcaugggcuccugcagggcugcgcccccggaacggcuuugcagagccucccagggugaaugccaucuaugcuggcugcucucuguuuugguuuuauuauauaaauaauuguuaugauauaauagguuuuguaauuugcauuuuaaggagacaugcuuaguaauuuguuuugccaccuguuuuuguuguuuuuaaauauuuuaaauggauuguuauucauuauagaucaacaaacuccauuuauguaaaccccuaauuagagcaauugacagcucaaaccugaaagacgauuacagcacugcacagagaguaacauacaaauacuacguuggacgcaaggcuauguuugacagcgauuuuaagcaagguauguugcuaaucuuuuuuucccaguauuuuaaauaagacauugcauucugaacaacuuugaauaauauaguuucagagaacacaauuacuguauuuuauuuuuaaauguggaccaaguuauauauacauauuugacacuaaagcugauuaaagggaaauuauauugaagauucuuaauccauacugggucucugaagugcaugcuggagucucacaggcauuacagacaucguuucugaguucacugagcaugacuguucucagaauagaauguaaaucauuguuuucuuuauuugcuuuuugacccuguaauagaugcugguuauguugacauaggaaauggagauuaggacaacauuuaguucagcgacugacuucaugaccuacacaucccgcauggagaugacuuagaagcaggggauaugcccuuggaccuggugucaaagcucucguuuaaacagccucgugcagugugucgcuaccacagagcuccuguuuaaacagccucgcacggcgugucgcugccacaccugacacuauuguauuaguuuacguugguaacuuucucaagaacaggaaacuagucuucuuuuuguaauuuuuaucggcugucacggcaucauucuuggugaucucuucucuugugcucaaaccagacuuuaaacucuucuucagcuguuuguggagcacacagucccaaguacaugaagcaacauaacuuuaggcaaugcaagauaaauaauagcccuuucauaaggacgcucuggcuuuuuauucuauaggcuuguauagaccauuuccuuucacaguuuuuacucugugggcuuguauggacugaccauuuccuuucaguuuuuaguagaucuagggcuuuuaaagaagggcuuuucuuaucugucucuuuuuuuuucucuuaauaugaagcauaaagguagagaagcuuuuaaauucuauccuauuggauuuuauuaagauacugauuuuuuuucuucugaggauucaguaagugguauuuuugaauaccuaacauagccagaaauuguuauuaauauugaugcgacauagucauaguuucugacaucuuuagagcuaaaaaguuuguuuaagucuguaucauccaacccuuucguuugacuauaaaagaaauaggaagccauugagagugugaugcucugagauuacugaguaauucuguguccccaaaaagccagcgcuggccauagaucuucugccuuguagcucgcagagauuuuguuuuccauuuuacugcuaggaauuccuagagcccugauuguauuuaaguggauaaaaugucugcagagauuguggugauuuucuuuccugugauuuuauauuauuuauguaagaaagaguauuuggaguaucucaguuguuguauguauacuuuuauuaauuuauuaauuucagagauuuauaccccucuacauauuuuugacuccaaccgaaauauauuauuugaugcaaaaugacuuagguucccucaaagacagcagaaaaaucucagcuugcauuaacuauuagaaaaugcauuuuuuggccgggcgcgguggcucacgccuguaaucccagcauuuugggaggcugagguggguggaucacgaggucaggagaucgagaccacggugaaaccccgucucuacuaaaaauacaaaaaauuagcugggcaacgguggugggugccuguagucccagcuacucgggaggcugaggcaggagaaugacgugaacccgggaggcggagcuugcagugagcugagaucgcgccacugcacuccagcuuggcgacagagcaagacuccaucucaaaaaagaaaaagaaaaaaugcauuuuuuguacauccaggagaauuugagauuaccuugggcaguagcaaagguacacuuuuuagaggcuaguuugcaaaagucaaacuggcagcuggugggauauugcagacucucagugaauccuuguucuuuggucucagccccacagggcuccucgugggucauggcuuugugguuuggaagagacgcuggccccacagcauucacgcucacugugcaagacuggauguuuuuugugccaauguggccacauaguuuaggagcagaggcaguguguggucucaguguggguucccuaggccucgacccagaccccagggccugcugcuucuggugacccauucugcauaagggagggccucugcagcucugagcaucucuguucucuuauauuugggacuuaauaucacuguucaggaagaacuuacauaaacaggaacaucucacuuuccuaauucuugacccaaacucagccuuagugaagccucuucucuucaccuagggagaauguggaaucauuguccagaaaccccugacccuucagcuuuccagccucaggacaaggcucagcuccugccugccuguucugagaguuccuuguuagcaugugcugaacucuuugcaggccugucgugcaguuugugggauuaaucuugacaaauagaauuacuuuuguauuuugaaaucuauuaaauucaaaucuguuuuuuaauauugcucucaggacagaauuaauauguuguguguuaguaauaauaaguuaauuuuuuaaagcauguggucauuuaaaauggaagauauaugaucacuaauuauauguuaagcuggaggaugguguuuuacuaaguuauuuucauuguuuaauuaugggugauuaaaauguauuguggagguacauuuuuaaauaugucuuuauauuuuucaugaauguagaaaucaucugagcagggucagacuuuuaaaauguuaucauaaugguuugccagcugaccuuaggcaaaucagaaucucugugaaaguuauuuucuucaguuuuccucuguuaaguaggacuucccaggcaguuccuguugaauuuggggguauggauuuuacuuaaggaaagucauugaucacagaaaugaaacugggaugauauuuuuugagauaauaaagggagggggcuuuugccuuuuaaaucaggagacagugguagaaaauggagcaggaaggggccugaagcaggugcguuggucucaugcgugcuggcucugccuucuuugcagcugaggaguaccugucauuugccuuugagcauugucaccguucuagucagaagaacaaaaggaugauucugaucuauuugcuuccaguaaaaaugcuauuggugagugauuauuacuccauguuuauagauccuggugcuuucacaaaguugacagcugauagguuuuuuuaaaaccuagcagacagucuguaguugaucacagccugagcuguguaugagcacaccccaaaauaaagaaggcgcaugcauuguguguggcccaaacccagagcuucaugccuuacgccuccagguccuucuagaaaagcucucccugugucuuguuucccuuaaaaguauuuaacucaagaguuuaacguucaugugacaaaauaaguacguaucauuuguauuccucccuuaaaaccuaaguuaaaagcaguggauucaccaagaaagaaaaaugucauuucacccucucuguggguauuucauuuaguuacuaaaauguauuuuugauacuugaaauaacugguaaguuaauugacuaaugagaaaagcauugcacacagguggcuaaagcuucuguagcucugaauggauugugauggagaagcgcugcuguggccuugcccuccucacuucucaccccauuuaacugacagccaguuucaaaugcuuagcugauucuucuggaagcuacuuccguaugccuacaucucaugcuuauacuagcauuucuucaguuaucacucuccuguuauagaaauucgaagaaaugugagaaggucaagaucaaggucacgugucauggaaugacaaaaguguguuguacccagguguucugauuucuagaccuguguuguuuuccuaguguacuaugauguguuuaauccauggacauucuaagaaacucagguugcaauuuucuuaaaacuuaauuccuugauaugaauauuuaucaaggacaauuuugucaaaaaugaaagcauuuucauucuggaaaauugacucuuagggucacaugcccacuguggagcuccugaaaaaguaucaccugaugcaguuugcggaaguaaccagagcugugagguagaguaugccauccuuccuguuugggguuuuaaaaaugcaagccugaugagaguugacgugcacgcucugugagaaacucacccuccuucugacgcgccuccccccucaccagcgagggcaaccugcugcugcugcacgaggcgcuggcgaagcacgaggccuucuucauucgcugcggaaucuuccucauccuggagaagcugaagaucaucaccuacaggaaccucuuuaagaaaguguaagcauuuccccggcacauugggcucccaguguggcucucggcagagcagucagacauccagggcuguugcagucuaagagagaaggccaccguguggguggggucguuaucuuccuuccauugugugggauaaaaugaagccuccgcccacugccuccuggggacccugcgcgagacacgugaguagcacaagcugugccuggacuugugggggagguaagcagguucuaugugagaagacaacuugagaacaucagcccugagagccgcgguaccacauuucaucagagcacacaggacucgccacucacuccccucccuuagugcugaccaaguagcccucccagccacuucugccugucacaaaggcagaugcagagaucgucauuccuuuccucacacgucuucugaggccucgucccagcaggaucucaguuguguaaacuucaggcaaaggccaacuuuguauagagcuguggguagcacgucacaaacaguagggacccuauuucgcugagucugugagacacagcccauugucaggugcuuccugauuucagggagauuaaaaugugaaaaaaaaaaccgaaccuuaaugaaauacuuagaaaauaauuaaaaauuguguuuguacuagugacuuuuuaaagauugaaaagucaaauuagauuuaauagcucugagaguguaguuuagaguuuaucuaauaggugggaauuuuuuuacuccuuuagaacaccggcuuauuaagaggugccuuuucuuggcuguggaguauugcauccugucgguaaccacagugcccuucuccuccccucuuccagguauuuguuacugaaaacacaccagcugucucuggaugcuuuucugguugccuugaaguucaugcagguggaggacguggacauugacgaaguucaguguauucuggcuaacuugauauacauggugugugaguccugguuuuaauuuaagcagcuacucacagcaagauucagcccagaauuugaagcuucaguguggugguguuaaaauuguuaaaaggccuucugcuuuuuuuuugauagaacuaauuuuagcccaggaaauaccauucaccagggccuuaggagcaugaggggacggauacucuuguauguuugcauauucuuuacuggcgguacaucccucgguaucugucgauucuccaaccccccucggauaccaaaauccacaggugcuucagucacugauaggacguaguauuugcauaugagcuaugcacguccuccuguauacuuuaaauuaucucuagguuacuuaaaauacucagugcacuguagauagcuguuguacuguauuguuuagggaaucacggcaagggaagagcgucuguacguguucauuacagaugcauuuuuuuuccccaaauauuuucaguccacaguugguuagauucauggauaugaaacccaccguggauauagaggguugauuguauuuauuuuuacucauugucuucccgcugaacugaacugugccgcucuuggggaagaaugcuaaugccaaauuaauuagaucacccagcaucuuugacaugacucagauccaaaaauguaaacgcauuccucccuuucugccccgcagggacacgucaaaggcuacauaucgcaucagcaucagaagcugguggucagcaagcagaacccauuuccuccccuguccacgguguguugaaaguacacggagccccgaggacgggugagcaguuguuucuuuccacuuugguugugcugaugagaccgguccgguacugcaacaaggcucccugaagccggaacucuuggaggcgcuuuucccagggaugcugaggcugagauuuucagcacacccgaguuaaucuccuucauuuguaacuaauuucagccugaugaaaaccuggaauuccuuuuucacagacucggcugguucuggagucuuugugagacuucuuugaaggaggcuuugcgugaaggcugcucggcucacuuuuccuaagugugguuccugaaggcugucuuuguaacuuuuuguaguucuuuguguaaaaagcguauucugaauuuauacacauggcauguucuucauuauaucuuccaggauacaucuauuuuuauauauuaaauuugaauguguuaucaaaaugcuugguuaacuuaaggcaccuuuuuaaaagcagaauuuaauuugauuuaaauuuuccagauuuuauagcuugccuguauggaugcuccucaauuuaugauaggguuacaucccaauaaacuuauuuuauuugccuuugc

SEQ ID NO: 191836 - RNA, 55462 nt, Homo sapiens
ccggcccagccauggcggacgaggccccgcggaagggcagcuucucggcgcucgugggccgcaccaacggccucaccaagcccgcggcccuggccgccgcgcccgccaagccggggggcgcgggcggcuccaagaagcuggucaucaagaacuuccgaggugggugcggcggccgggucgagggccaggcgccccgggcggggaccccacgagaccccgcccgacuuggggggaaggccccgagauccgugcgggccccgggagcgggggcgccggggcgccggccgggucggggguggcuacgcggggcgcuucgcggcgcgcccugagccgcccgcucucccuccgcccugcagacagaccucggcugcccgacaacuacacgcaggacacguggcggaagcugcacgaggcggugcgggccgugcagagcagcaccuccaucagguacaaccucgaggagcucuaccaggugaggcggcggccggggcuggggacgccgcuccugccccgcgugacgcagacgcggccgggcggccgcuccgggugccucgcaggcucucgccggggagcggaaaggcagggcguuugccuccacugcagggccgggagccccagaggcaacaagugguuuuguuuauugccgugguggaauuuuuguuuucaggcuuaagcugcuuagaaccauauuuaaaguuaucccauuacggaagagaaggagguguguuucuaggagccacgugacucauauuuugcaaguauacggcaaauuauuuucucguuauauguaaaacucaugacugugucacuugccacaguaauaagagggucuuuucucuguuguguuuugugauuaaugguugccuuuaagauauucaaacagauuuugaaaaaauucaaaauucagaaaaagugguuuuguucucuguuguguuuugugauuagugguugccuuuaagguauucaaacagauuugguagcauuuaauucaaagugaugguguuccguuucugaaguaacaaaaaaguacauuuuaccauacuuggauauuuuauuuauaagcgacuuuuuuucuggugucuucuuuuuguaaaguaacauucauucaguagucuaauaucuauauuuuaggucacgaugugucauacaauuauuucuauuaaaaggcuugaauuaaaaaaacuuuuuuucuggauaugcaagugacugcauuguaaaaauuauaaaaaauacaaaaaagaagacuucaaucaccuauacuccuaccacccaaagaaaacuacuguugacaguuugguguacauacauccauucuuugucugaaguguaaguggaugauguuuucuuaccagcuuugagauagagucuacauauaaugugcacuucaggaaguuuuaacagaugcaugcaguuacguaaccggcaccacggucaagauggaaucuuucuugguagaaugguagaauauugcuaccacccccgaaauugccaugaccacuuuugcagucagcccucuccccugacuccuagcccuuggcggucccccauuugcuuucuguuacuauauuuugcgauuucuagaaccuuaucuaaaugcagucauguauuucauagucuuuuguaucuggcuuucacuuaggacagugcuuuugagauucaugcacaacgcagugugauuguaauuuauuaccuaguagaauggguauaccacaguuguuuuauccauucaccaguuaauggacauuuggguguccauguuugggguuuuuuguuuguuuguucuuugagacggaguuucacucuuguggcccaggcuggagugccauggcacgaucuuggcucacugcaaccuccaccucgcagguucaagcgauucuccugccucagccucccgagucgcugggauuacaggcaccugccaccacgccuggcuaauuuuuguauuuuuaguagagucgggguuucgccauguugggcaggcuggucucaaacuccugaccucaggugauccacccaccucggucucucaaagugcuggguuuaccagcauaagccaccgcgccuggccuuggguuguuuuaaauaaagcugcuguaaacauuugugaauaacccuuuguuuggacauauauucuuacuccucucaggugaguucugcuuacuucuuuaucuagaaguaaguucucagggucauauggaaaauguauguuuaacuuuguacggaauuucuuguuuuugcaagugacugccccuuuugcgucucucccagcaguguaugggagcuccgguuccacuccgccaccagcgugugcgucucucccagcaguguaugggagcuccaguuccacuccgccaccagcgugugguguccucagucuguaacuuuagcugugcuugugggugugugguggagugucauuguaguuuuaguuugcauuucccucugaugcuaagcaucuuuguauuuacuugccauucuauguaucuucguugacgaagugucuauuuaaauauuuugcucauuuuuauuggguugguuauuuucuuauuauugaguauuugaguuuauuauguauucuggauacaaguccuguaucagauauucgccuugcaaauacuuucugccuagucuucaacuugucuuuugauucucuuaacugugccauuugaagaguaauuguuuuaaguuuucaagucacauguaucaguuuguucuucuauggauugugcuuuuaguauccaagaaaucuugcuuaaucugaggucacaaaguuuucucuuauacuuucuuccagacauuuuagaguuuuagguuuuacaucuaggucuacgaucuauguagagugaauuuuuguauauauugugaaauacaaaucuagagucagagucgggugcaguggcucaugccuguaaucccagcacuuugggaggccaagguggguagaucgccugagcgucaggauuuugagaccagccuggccaacauggugaaaccccaucucuacuaaaaguacaaaaaauuagccgggcgugguggcaggcaccuguaaucccagcuacuugggaggcugaggccggagaaucgcuugaacccgggaggcggagguugcagugagccgagguugugccacuguacuccagccugagcaacagagugagacuccauuucaaaaaaauacaaagaaaagucuagagucaguguuuucccugcaaauguccaguuuuucagucucuuuuccccuacugaauugccuuugcuccuuugucaaaaaccacguaggaguaggaggagugaguugugaaaucaggguguguuggccccccagcuucauacauuugcacagguuucuggcuauucuuggucccuuguguuuccaugugaauuuuagaaucggccaauuuguauaagaaagugugcuaagauuuugauugacgguauauagaaucuacagaucaauguaggagaauuaaauucuuaacaguauugagagucugggcucaguggcucacaccuguaaucccagcacuuuggggggcugagguggccugaucgcuugagcccaggaguucgagaccagccuaggcaacauggugaaaccccaucucuacaaaaaauuuaaaaauuagccuagugggguguugcaugccuguagucccagcuacucagggcccccacaccacaaccuggaagcucuucacacaggaagcugagcaguuggggccuguuugucucccaucuuucugagauucacugucuuucauagcccaguacucagugcuucgaaaacuguugcuucguauauuuugccugauuuugugguuauuucaggcagaaaguuaauacaguucuuguacugugucuugacuagaaacgagucccaccugaacucucagaggucuuugguuuaauaaaauaugauaccuuacagcuaaagcuucuuacuacucuuuuccuggagauuuggcugucugauaucugcugccucauuauuuuuacuuaaaaaggcggaauuacuuugcaacaccuuguacacagugauaugucuuauaaaacaaucacuagauauuaugaacaauguuuguaggugccuuaggugucugucuugaaacccugagaacuaggagugcuuaccccaaaaugacagucacugguuccuccuuggaaugagacaucgcaaauuccaggggcaucucuggaggugcugccccaccaggggauauguggaaucaguugauucacuuacuugugaucaucucuccacgcacaggugggcuucuggccucucacagagucugaagcaugagcugccucagaucuauuggaagcaaaugggauagaaaucuaagaaaagcaaaugugaaauuacugaugucugaucaagcaggcaauacauuugacuugguguuucaaaauaaagucucaguuuuuguauagguggggugguguauacuuugccaaagaaucuuaugugaaaggaccaauucucacccaaguuugaaagguuugguuucguguuugguuuuugguuuugcucacucucccucuacgucuaaacaccuuaggaguccugucacuuacacuuuuugggccucagcuggccuguuguuucuguuuguuacuuuguuuuuaucauuuuccuccuguaguguguagaggagaauguugugaaggcauggaucuuuuccauugaacgaccugaauuucggucuguaauaacuaacuccugaagaaagugcaucuucugugucuugugucucuauguuuuaguccugcuuguugcuaaaugagacaacagaaaacugaagacugcauuucuagaaagguuucagagaaaggcuguguuuugauuuagaacugguuuuuuuguuuuuuguugcacaaaaacaaaccucucaggcccuuuaaaaaaaaagagagagagagguguggccucccuauguuguccaggcuccuugggaacuccuggacucaaacaguccuccugccuuggccucccgaagugcugggauuccaggcgugagccauugcacccggcugacaugcaaguucugaggaaagccaggcugucuuucuugagucacggaguaguugucuucaugacauguugauaccaggugauaauggucagugaaagagagagguuaguccuuuguauuagguggcauccuucccucacacccaagcugcaggcccagcguaggaaugggaccuccacagccacacaggucucauccuguguggcugugaaggucgcuauaugacucuggagguagcuaugugacuauggaggucucgucccguguggcuguggaggucgcugugugacuguggaggucacgucccauguggcuguggacaucuugucuguguggcuguggagguugcugugugacuauggaggucucguccuuuguggcuguggacgucuugucuaugugacuguggagguugcugugugacuguggaggucgcgucccguguggcuguggaggucacugugugaccauggaagucgcguuccguguggcuguggaggucgcugugugacuauggaggucucucucguccguguggcuauggaggucugugugggaguauggaggucacaucccguguggcuguggaggucgcugugugacuguggagguugcugugugacuauggaggucgcuaugugacuauggaggucgcugugugacuauggaggucucauccauguggcuguggaggucucugugaccauggaggucacgucgcauguggccguggaggucgcugugugacuauggaggucacgucccauguggcuguggaggucgcugugugaccauggagguuacugugugccuauggaggucgcuaugugacuauggagguuguugugugacuauggaggucucguccauguggcuguggaggucucuuugugacuauggaggucacgucccauguggccguggaggucucugcgugacuguggaggucacgucccguguggcuguggagaucucugugugacuauggagguuucauccauguggcucugaaggucucugugugacuauggaggucgcgucccauguggcuguggaggucgcuguguggcuauggaggucgcgucccguguggcuguagaggucgcugugugacuauggaggucucgucuguguggcuguggaggucgcugugugacuauggaggucgcgucccauguggcuguggaggucgcugugugacuauggaggucucguccguguggcuguggaggucgcgugugugacuauggaggucucguccauguggcuguggcggucucugugugacuauggaggucucgucuguguggcuguggaggucuuugggugacuaugguggucacgucccauggucccauguggcuguggaggucgugugugacuauggaggucucguccacguggcuguggaggucuuugugugacuauggaggucacgucccauguggcuguggaggucgcugugugacuauggaggucucaucuguguggcuguggaggucuuugugugacuauggaggucacgucccauguggcuguggaggucucugugugacuauggaggucaugucccacagcuccauggccuuccuuguucugucuuccacaucugagagcagggauugcccuuauccgcagugagcauuuuguuuaaguagcagugaguucacuccaggcaaugcuuugacacuauaaauagacguguauuugacauucacacacgugucuguugagcuaauacagacaaucauuugaugaaccugcuaguuaggaaguagcugugaugugagaagagacagugcuggcuguagauauacaccaaauuuccucacuuggcuguugauacaaggaaagcaucuugauacuaauaggaguagaaugcaaaugauacuucucuaccuccgaucauuggauuacauuccuuuucucuggggugaaucuuuaaaaugcuaauggccugagugcaccaacaugaagcacacaguaccaucugauuaguugcuuuaugcauccagagaggguauuucuaaaucucaaaguaugauugagugucaaaaauccauuugggggaggggcaacuccuguguugugcugcuucuauaacagcacaaaaaagucuuccaguauguuccugccagcaaggaguuggcagggcggggagaaacaaaggcugucgccuuuccagugaugagugccuguaauaugaagccgggaguccugacucagcaccuacagcaaaccuggguuacccagggcuugccacuuguuuugagagguucuuaaauucuuaauuuuaaaaacaaaguaaauugcaguaugacucauaugaauaguaaaugugcaccaaauaggacacauaggaggcagaguggguuauaaaauauuuagucauuugccacaaccaggaaaagaugguuuuaaggauauugguucuuggucuaggaauuaaaacauccagaaaaugguccuaaguuacuguugauuuuugcugaagaaaauacauuuucuucauguguuauauaaaaaacuuacuuuguaauaauuauguuugugggauucacuaauguuuaacuacuggagcaaaaccuuugucguaaaguucucuugguuguuugaggagacaaaaggauggcagaucuuugaccaaauuaugaagauauggaauucaaagggauggaauugaagaguuugagaaaggaguuaaaguaaauacagaauguggguaggaauuccguuucuauaguaagacaaaauguagggggaaaguuuguauuucuuuguuauuaugcugauaauaagcuugcuagaaaacaggauuauaauuaaaaacaggauuauaauuauuccacauccucuuuugaucuuuguaaauaugcauguauuuuauaugguaguaaucacuguauguauuuaacuuugguuaauauguagcagcucuccgauauuuaguauuggaauuauuaauacuuguguaaguauuaguaaaaugaauagcuuuauaacuuuaauuuaccuuuuuuccuagggguauauuguauccuaauuaaauucagauuauuuaucuaaaguguuuuuauucuguauauccccacauuuuucgaaccccacauugguucaaaacuuguuagaaaaaccauauuucuguuuauaauauuucauauuggaauugaaugaguuuaaguuuuuguaccuaagauuggaaaggaaauuuuauuagaacugguaagaauguacaagcauuguuucuuugaggugaguaaaaauauugugagaaaaaauuuucugcuucaaaaaauggugucagcugggcacgguggcucaugccuguaaucccagcacugugggaggccgaggcggacaaaucaccugaggucaggcguuugagaccggccuggccaacauggcgaaaccccuccucuacugaaaauacaaaaauuaaccugugcgugguggcaggugccuauaaucccagcuacucgggaggcugaggcaggagaaucgcuugaacccgggagguggagguugcagugagccaagauccugccuuugcacuccagccugggugacagagcaagacuccaacucaaaaaaaaaagauuucuucuuguauuagggguguucacagaauaaaaaagaaaguuuauuaauuaaacaaacugaagugaauuacacaucuagccugcagaaaaauaaauaggaaacaauacagucuggccugugucacccagaaaaagcucaguuuggauugaaucacugcccuggggagugugaggggaaggcccagccuguuguucuccuuccugaugggaagguggucacugagggaaaagauuuucuugguucucuagcccugauuucacuuuguaaucaucaaggugaacuuaaacacaaacacacuccagugacccccaucucagacugaggaaucggagcacccggaaacaggccugugaggaucaaaccuguugagaagucccaagugacugggcaccauagaugcucaggaguggugcaggccagcugccugggacccgagguccagcaggugcaaugugcccacauuaacuguuguuaccucuacccccaugccaacuaugacuggacugcaguguuccaacgagaagugcccuaaacuuagccauaauaaguaauuuauuuguagauuccugaaguacugggguaggguguggggugccuuuuucuuaugauuacagcuauguuaacaauaggguuuuuuuaugaaccaaucuguuguucauacugaagaauugauguagcccuuuuguuugcaggcuguggaaaaucucuguucucacaaagucuccccaaugcucuacaagcaacugcgucaggccugugaagaccacguccaggcacagauccuuccguuuagagaauauccuuuuuuugguucauaaaguuucuauucauuaucuaagucuuuuaaaacugaacauuauuaugauaaagagcuaaugaguauccuuaauauuaaaacaacagcuuuuaaaguucucuuuuauuugauagguuuguaagcgaaauuuaccauuuaaauuauuuugcugauuugaauuaaagggaaaccguguucauuuauuggguaugguugaaguauuuaggaaauguucugaaaaaugucuucaaguuugaguauccuuuauucuaauaaacaccaucugcauuggcuuucugugauaggcaacaaagucccaucgacuuggcgacuuauggagacacccacuuaucagcgcacaguugugucugucaggaggccaggcaggauucaguggauucuaugcucagucucacgggcagagucaaggugucagccagguuggggccucaccugaggucuuugcuagcacgggcaggcaguuggcggaagccaguuccugugguagugggacugagggcccugccuucugucccguguugcuuggugucacucucagcuccacaugcacagguccuugccucuccucucacagcacgacucuuuucugcuucuagaccagcaggagaaucugccugucugaccugcugagauagggccuuauaugauguaacccguaacccagucaaggaaugaugaccuucguauucacagccucguucacaguugcgugugaggcauccuccacguggggacagggcaggagcaucucagaauucugcugccacaccagcugugacucagacgucuacaggggagucucugggcuccuuggcauccuauagaaaauccuuuaaucuggacucaaucucauuccccagccuccucccaguacuguagcuguccaugugucucauuggguaggaauuagaaaguagaguuuauaauugcagaaaaucuacuuguggcuguacuuuucuaggccuccguuucuucauguguaaaauuaggugguuuguguuugcuuauuucuaaguguucuucuaguucaaggaaacuucugcucccccaucucccugaucuugggaaacuaaaccauucugaguucauuggaaggguccucagggaaucugcagcaguuggugcugcugaaguugaagcacgugacagggaagcugaaaugcagggugagaggucucuguuuagacaaucuccacagcaccccgcacagaugugagugaagucgguuccagcucuguugugcuggcuucuguaaauacgccucugcaguguuuuccagcaaagcccuuuccuaaagaucaugaggucguucaagagaucagugaccgcacaccaccuuuuggaaccuggccaaagugcaccuuaucucaggaggcgccugugagggcgcacagaagcaggccccgccccagugccacggcucagcaaugcgcuuccaggaaccuacguuccagauguuuccauccaaaaagcggccugacuccuaggcuugggggaagucuuuagcagaugcccaagccuucucccaaagacuuaggcguuuaugagagucaguaggcggugauuguuccuacucuaguugcugucccaauuuacuugaaaacgacuaucugauuaccugaucaaaugaaucuuuugccaguuacuccuacucuguggguugacuaaugugccaucaguucacucacugcacaagcacuugcuuucuaccuacugcacuggcaccgcaaaauggaaagugacccccaugccugauuucuacccuccaagaagucgcaggcuuaugggagaggcaggggaauuacuguauuucccuggugcaguggcaaaacugugauuacaaaaauuaucauuugguucauuaaaggcaaaagaaaaaaacacuaccguauuaaaugcccuuauuagucaugagacaagaucuugaguugagaacugcgcgucaggccaggaaugguggcaugugaagcaucuggggcagagccucccagaggagacccuccugaagggauggggaggaugcgcccuccuguggcuguggcaccagaagcagagcguggagggugcucuggaaaccccgagcagcgggcacaacuagaacuccagagaccugguggcccuuaggcugugaugcuaaguugcagacugaauuugaaucuuuguggauacuaccaaggagucagacuucagucugugaguaucccagaguccucacagguuuuuuaagcaagaaaccagaauuagauuguucauggaggucacucuggcagaaugaugggauaaguuuacauauagaccagcacaccacagccuuccauugggucggcacauguuuuuaaguaucugucaugugcuagguaugaugccaggcccugggaaaauaaaucugagcagaaugggauucugucccuuuggagcuuaaacccgaauggcgguggcaaaagcaucaggauaagcauuuaugcagugcugugauaaggguuuuuuuuguuuuguuuuuuuguguuauuuauuuauuuauuuuugugagauggagucuugcucugucacccaggcuagagugcaguggcacgaucucggcucacugcaccucucccuccuggguucaagccauucuccugccucggccuuuccaguagcugggauuacaggcgcccaccaccaugcucggcuaauuuuuguauuuuuaguagagacgggguuucaccacauuggccaggcuggucucgaacuccugaccucgugauccaccugccucagccucccaaagugcugggauuacaggcgugagccaccgcgucuggccugugauaaggguuuucaaagguucagauaagcuccugggaccuaaagaaagagcagcuagcccaccuguguaggggagcauugcaggggcgaagcgaugucugggccauguccuaaaggauggaugaggaaguggcaggcgcugugggaugccaagguggcacaggccagggagcagcgugggcagcccuggcgcugaggaagcuuacugggcagaagagccagguaugcugcugggugugggagaguugaccacugacaggaucccuaaaggggaaaaugagaggaagguggaugcugaauuguggaggagccuuuguugaaccaagagguugagguuuaucugaagguggagauugagccaagguguucaggcacagcauggcuggguuauguugguaagaaguuagugugccugugugugugcacuguggugugaggggucacaccacaaugguuugacugggcagcaaaaccacaggguggaauggcagcauccugccagcaaaccucuuaugguuagagggaaaggaucugacugcuguggaaggaugaaccagacacggauugaggcggggagggucugucguggucacguugauuuggaaggaggagacacggauugaggcggggagggucugucguggucauguugauuuggaaggaggugaggaggcacucagguagagaugccuguugugcauuuggggcuggagacacagauccaguggcuccagacauggaugagaugcccaggaaaaaugagcagaguggccagacacaguggcucacgccucuaaccuuagcacugcauuuugggaggccaaguugggagggccaguugagcccaagaguucaagagcagccuagacgacaauuagccgggugugugguucacaccuguggucccagcuacucuggaggcugaggugggaggauugcacgagcccaggaggccgaggcugcagugagcugagauugcgccacugcacuccagccugagcagcagagcaagacccccaucucuaaaaagaaaaugagcagagccaugagaggagguggaugagggcugcugucaggaagaugagaggagaaccuggagagucaucuugugggaaucgaggggcgaguuuaauauggcaggcggcuuagugaccaguaaguagagucugaggggaugaugagaccaggaaguggcugguuacugugaugaaggcuuuuaggcuacauucguacguuaaccuaguaaacaugggguguuucuguccaacucagcacugugcguuggggaccagggacaggcaugaauggcacggguccugcucucaaaaagcuuguuuuugcuggaagagaguucugacccagcccagucucaccuggggaaauguuaaugugauggcagaugcugagauacuguguggcagggaguauuccaaggucugcauauucagauuucuuuugccucugggauauuccaguacuucaaguaacucuacuuucuaagauuuaaguaauuuguuguuguuguuguuguuuugagacggaguuucgcucuuaauugcccaggcuagugugcaauggcgcaaucuuggcucaccgcaacaaccuccacuccuggguucaagcgauucucuugucucagccucccgaguagcugggauuacaggaaugcgccaccacgccuggcuaauuuuguauuuuuaguagaaacgggguuucuccacauuggucaggcuggucucgaauuugcgaucuuggauuaucugccugcuucgaccucccaaaguguugggauuacaggcgugagccaccaugcccggccagauuuaaguaauguuauguaccgauuauauuuugauuguaugcugauauuagauuauagaugaaacccaucagaugugcagguagaaaaagggcuuuuguggaauugagucauucacuaccaucuucuucguuuaccacauccguuuucuugucucacauguuugauaaauucugcacuuagcuguccguuucaaaauagauagcugcucuuggugacgucccuuccucaaaauaaaggccauuuguacccuugcacucauacacaugcucagccacaggcagcugcugcagaacccacaccacaugcugcaggaccacgugccacccagccaagcuacgugggcaacaggagcucuucaaaaaugucaagcccgcagagugcgguggcucacgccuguaaucccaguacuuugggaggccaaggugggcggaucaugaggucaggagaucgagaccauccuggcuaacacggugaaaccccgucucuacugaaaauacaaaaaaauuagccgggcgugguggcgggcaccuguagucccagcuacucgggaggcugaggcaggagaauggcaugaacccgggaggcagaucuugcagugagccgagaucgcaccacugcacuccagccugggugacagagcgagacuccaucucaaaaaaaaaaaaaugucaagccaacuguccucagaaucuaaccuguagauaacuauagaugaaacucacauuuuccuuccccugguucaccuugacagcauugcagcucuggucagccacagaaugccaggcagugguggacaccaugauagccguguggucagaagggaagggcacgggagugagcugggaaccuuggcuguuggggaaguugcaaagcuccaguuuccucuaagugugccuuuaugauccgcacuggcgacagcaggcuuugucuuuccuuagaaagacuuugugccuguucucacuugaccagauaucguguacggagcacuugcuggcaguaggccaagcucugcacauucaugaauugcuuugucucacaacacccugagccguagguaucuuuauugaccauauuuuccagaugaagagacgaaagcccaagagaacccuguuaaugcucggccagaucagaggagacaaaacaagcaccccugccuucauggguuguguggaugaaugagggucggccuagggcuguccccucgcggucuguccggucugucgguacaggcagcagaugggccacuuguuccuggaauugcagaagcagauaaccaaguguagaaaauguauguaucccucuucuaccccaacagaagcaccgucuuuuugcuuuuucuuuuuuuuuuuaguuacagauaugauagguagguuuuuuucuaugguguaagcauuucugcuguuggauuuuguuugcuguuugaagaccugccuaacucgucucaguaggcuguauaaaucguuuaaugaagauuggcccuuuucugaagugagaaaaaggaugguugcugaagaaccuaucucgagaauacacuauugacagacucacggugucugugugucucacauccuggaauuacuugcacaccauuguggcuauguguuauaucccagaauauggaauugauuuugauguuuagaaggccaaagcuuacuuaguaaaugccacacugauuuuagcuuaccauuuuguaguuuuuuucugugggaaauaacaaaaaaauuauugauugaggaucuauauugauuuuacagagcuauuuuagaggaaguauuucucauuuaaugaacacuuuacauuggacuuuccaucuuaacaagacacugccccagguggaacucugucuucacaacaccugagcugcccaguggugucagauugacuggugucaguuuaaccccguuaaguuuaaaggaucugugcacccucaucuggaagcaaagcuccgccuucggcugcuguggcccgccugcccgcagagaggcuugcugggagguccaggccgcaguucccguccagcuccuggagucagagcugcaggauggcuguuggggguccuugaagccuguccagaugcacuugggauggguuuuuuuguuuuguccagacuguuucuguagauuccuaauauaaugagccauuauaauuuugaacaauuuguaaagaguacuuccagaggaaccuguuaaccauucaaccauuaggucuuugcuguaagugucuguuuuuaauuuucuggcagugcuucugagaauucugcaaagccucaagaaaaaauagaguaagcugucuuagccaggccccuguagcuuuggucacagcacuuccuggugugacaaggacucagaccccccgggagccccuuggcuauccucagcacuguuuauuccuccucaggcucugccuggcacccuacccucccuggcacucuuucuuugucaggccacucguugccacccugagacuccagcucaugucugauuugugcauccuacuuaacugauguguuuuuccuccucucugugugugaggauguugucaccaccucacauuggcucuugagugugaagugucuugcugcacggcagaaacagaccuagagaagucccuugguuuggccaguauuguguugcugacaggcgguggaucaagaguuaaaauguaggaaguccauguucuguccccuuugacaagccauuuucuuaaucuguacaaagggaacaaugucugcaccacgagguuggggagauuuucagugagaguggaugugaagaguguuucguaaaccauaaagcaguuuauugucauugaugauucucagcuuugcaugaaccugagggacaccagaccacuugcucuaggagcccauauucuggguucuuuguccuaaacuacuuuuugggccuuuuccuaaaaauacacauucuaagagucaagguaagaguguuccuaauuuggugcauggaugagaguucauguuaguuuucauugaggcuggaaguuaaaccugagccauuuuccuguccagcugcacuuugccacaggcugggcacacuggcucauaccuguaauccuagcacuuugggagacugaggaggauuacuuaagaccacguguucaagaccagccuaggaguauagugaggugccaucucuuuuaauuuuuaaaaaauaguccuagugacucuuaccaggccagucaccaucuccaggagccccccugugggaguauguucagugucugcccuuugugaaguggggccuuuugucccgccaccuacccccagggcacuuaaggccuggguguguuucugccggcagggacuugaaggugucuggcagugaaggaaggagaggaugaagggaggcuggagagggaguggcgagcggccagaggcaggcggggccgugggaagggaaagcagcacaggcaagcugagugcacauuggugaugagauacagagauccaugauugaacuucuaguguaucuuagcccacuggggcugccaugacaaaacaccauagaguguggcucaucaacagcaggagucuguugcucacagcucuggaggcuggagguccagggucaaggcacuggcagauugcaugucugguggggccccgcuuccugguccauagccagcaccuucucacugcauccuuaugugguggaagaggcaggggagcucucuggggucucuuuuguaaccccauucuugaggcuuguccacucucaugaccuaaucaccucccagaggcccugccuccuaacaccauuaccguagagugagagcuucagccuaugaauuuuggggggacaugaacauucaagacuaauauucuuucaguauuccaguuacugaaugguguguaguauucaguggagaagguagcugaaauuaagggguuaaaauuguaauaauggccgguugcgguggcucacgccuguaaucccggcacuuugggaggcugaggccaguggaucacaaggucaggaguucgagaucagccugaccaacauggugaaaccccgucucuacuaaaaauacaaaaaauuagcugggcgugguggcacacgccuguaaucccagcuacucaagaggcugaggcaggagaaucgcuugaaccugggaggcagaggcugcacugcugagcuaagaucgugccacugcacuccagccugggcgacagagcgagacuccaucucaaaaaaaaaaaaaaagguaauaauuaaauuggccagcauuuuuaaaguuuuccuuagcagaucuguacagacucacuagauaguguuuuauuuuuaaagaagauuaacacgugcuggcaggaccacugcagacaaaugguaagcuuguucacuuuuucaucaaaacacgaccucauccaucuucccucacccacaugauugagagcugagacauagaaguucuguugaggauucugucuguguucagugcugugguugaacagcacgaugagaaaagcagggaaggugaacuccucagcuccugugagagggcaccacugacccucuuggccuucagguccacagucacaguccgcaguggugacaggguucuuagaugccugcaugggucucuaaaugucucuuuaagcacaguuuacuccucagaaucuagccugaaucccaggucuuuccugcagcugcacaaccagcgucuuaggcuuuguagaugucuuggcuuugacuugacgucauguauacauuuuuagugugaccuggccguuaauuacuuaagugagagaacagaccguauuaauagcuuuccuaaguagguugaaaucuuccguuuucuaaaugauaucaguaggagacgauggguguauuucuuuucugggccagguagcuggcagcugcuagagcucgcugagggucuguugggaaggguuuggugagaugcguucacaagucuccccagccagguagugggcucgaugguaggagcacaggacaggaccagggaucauccugcaucccucacucugcucgcaacgcagagucagagacacacguccaagagccucaucauguaacaggaacucagguuuuaaaagcuaagugcaucucccuaaucuaguaagaaguagcacaucagucaaaaaaaugaccaaauuuaggccgggcgcgguggcucacgccuguaaucccagcucuuugggaggccgaggcgggcggaucacgaggucaggagaucgagaccauccuggcuaacacggugaaaccacgucucuacugaaaauacaaaaaaaaaaaaaauuaaccgggugggguggugggcgccuguagucccagcuacucgggaggcugaggcaggagaauggugugaacccaggaggcggagcuugcacaucacgccaccgcacuccagccugggcgacagagcgagacuccgucucaagacaaaaaaaagaaaaaugaccaaauuuaaaagauauccuuuaggccuuggcugaacacaggaucucuuuaaaaagaaaaaaaagauaccauuuuaggcuaagugcguuaaaauuccuacagucagauuuacaauauuaaagagauggaaaucacauaccaaggggacaaaauuaacuuuagaaaaaaaaaauaaaacaugagggcugugguggacaggaaacagcuguuggauuugagacagcuagcauggaguuaaaaggccugaucuuucauauuuugcuaguagaauucauaaguaaaugguucuccuuucugcuggucagaucaugaucagaagcaucuuccuguucuuggaccgcaccuaugugcugcagaacuccacgcugcccuccaucuggugaguguccucacagcgcagagcugcgucuucccugcagcugaugcuuuucgucccguuugugucuuccgcaggcuaagaugguaaagugugugugauuacuugugccuuccuuucuucagccaaaaucauuaacgugaacguaggaguccaggugggucuuagccuugaaacaccaggugucuagccagcagcaaggaguggagcaggaagcucggacaggcggcugacuuuggucaugagggugaagacagagggucuugguuucucucugacgacuggagguugagccuggagcggcucuuuccagcgcugcaguugaaacucggagaaagacugccugcugcccguggggucgcagcccugaggcugugcguccccuguggaauggcuugcucagccucccggccuccugagcacauagcacucaucguccgucaucuuucggggacuguauacaccagggguucuggggccuuuccucagcagcguucgcggccacggaccccacauguccucugcugaccccuguguguccucuguggccaccccauggcgcugaauccugccgccuccugcaagccgacuuuggacaaaagcuguguccggucucaccgucugauuugucuuguucucuguuaauguaguguuucauucuucucacauucauacauaaaagugaugucgugccuucucaugagcuuuaaacccaaguucuuuaaaaugugccugcuuuuccuaccccacccacugggcacgcugacccaaggcaaugugauuucugcuuucgccauguagagauugcucuugucugagaugucggugaccugccaguuaccaaauccagcaagcauuuuuguccuuauuuuauacaacaucuauacaauuuuggacacccuguccuuguugaagcucccauuaaugccauuugcccuucuaacuuccucauggaacucccaaacaucuccuaguaggcauccauguggucuacgagaaggcaaacgcugcacagaaaagacagccuguguuccaggaaagaauggagaugauaaaagugaucauagcagauuauuuagcauuugcucugugcaagggacuguuuccuacuaauguauuuaaucccuagagcagcucuguggcguggccauugucacuccuauuuuauacaaacuaaggcacauaaguuaaaauaacuugcccuaccucaguugucuggcccauagucuaaaugcuuuucaaaaauuauuauuauuauuauuauuauuuuuagagacagggucucacucuguuacccaggcuggagugcaguggcacaaucauaacucacugcagccucaaacuccugggcucaagugaucuuccugcguuggccuccccuguagcugggacuauaggcacgcaccaccacauucgacuaacuucuaaaaauuuuuuguagugccaggaucuugcuauguugcccaggcuggucucgaaccccuggccucaagcgauccucccaccucagccucccaaagugcuggaauuacaggugugaaccaccaugcccaacacuaaacucuuaauuuauaaacauaguuuauaccauaacugucauacaaacuauaaacauuguuuauaaaauagaauaaaugauaccaccuccagucuaccacaaguggcuaaaaaccugaacgugagcaucauuacaagaagaauccugguugaggugugugugggcaaugcauggugaggagauacuuuguccaucucugggauggggaggagggcugagggugaaccuuggccugugcuuugaagaaugagcaaagguggucaggcagcuaagaaagaaagaguagaaggaagcaguaaguucaaagccgaguaucuccugcuagugauggcuaggacggcagcaugaccagaagaagccuguguggggagugggagguggggagggauagagcugaugagggcccugaaggguuuuucagcugagguugauguuuuaaagagaagaucccaguggcaggguagagagucacacaaguggagaccuaagccuuccuaagcacuggcuaccugccuggcacugccccaagggcuucagaggcaggaacuaauaacauuugauccccauuuuaacaguucaggaaggaaaggcacagagacauuaagcuucucacccagggucacacagcuagcaaguaguagggccaggauucaaacccaggcagcugccucgagcccacaagucuggccacugcaccuuccugcuccaacuguggugaagugcacagaagaccuggugugcagcacacgcgggagcaacaggagaggcccauggugaugugggcagucaagggaggugcacgucuccaccauugagguggcucccagggcccucugcacaccuguguggcacccaccacugcggcugcugccaccacugccaccauaauauuauuaauaauacuaccaccaccacccgccuaccacuguuacuacugccaccaccaccaccaccauuacugcugccaccacuacccgcccaccaccauuacugucaccacuacccgcccaccaccauuacugucaccacuacccgcccaccaccauuacugucaccacuacccgcccaccaccauuacugcugccaccacuacccgcccaccaccauuacugcugccaccacuacccgcccaccaccauuacugcugccaccacuacccgcccaccaccauuacugcugccaccacuacccgcccaccacuauuacugcugccaccacuacccgcccaccacuauuacugcugcugccaccaccaguauuacugucaccgccaccaccgcuauuacuacugccaccaccaccuguccaccacuauauuacugcugccaccaccaccacuauuacuauuacugccaccaccagcaccacuccugcccugaugugccaauuccggauuucuggcuggagcccagcaucuguauuuuuggccccuccuuaauggcguacuuggccacuggggacaguaggaguguugaagcaaagcacagagcccacaagauggguuuuguggacagccacuggcagcugaaccaucuuccuaacauuccucaggccaugagcugaggacugcgaugaacucugaaagcugugcaucaccuucucuucucaggggaaagcagcaaacauuugguaggagagcucccagggcuuggagaagggaagcugcugggacgugcucagcagaggacacugggaagagaguguacccugagggcuguuggagacgguggcgggaggggcagguggggcaggcagggucguggugcccaacugccugagugucucccgucgcucagcaggaagguggcgaggaccccgggcuucugccagcagcuugugugauaccaguuuuacugucaguggcaugcaugaccuagcagcgucuccaggaacguggagcagcucuguuuaaggaaggaaauacaaggcgcgcuagacuggcugagaaacagaaguuuuuaaaaggaauucuuggcaccuagauguagagaauuagcaacuucacauuuuugggaugauauugaauagcauagcuggagauucacccauaacuucuaaaaagcgaaacuaaaauguaguccuguuucuuacugucuauacagggauaugggauuagaacuguuuagaacccauauuauuagugauaaaaugguucagaguaaaaccauugauggaauccuacugcugaucgagcgcgagaggagcggcgaggccguggaccggagccuguugcggagccuccugggcaugcugucugaccugcaggugagugcugccugugcggaagauaccuggguaccugcccagcuacuugcaccagaauaaaugguuguaccaaagauguuaaacaaugaaaucauaaaggcauuuguugaagauaggagagucuuuaaaaucccuagaaggggaauagcgcucaagcuaacaccacaccaggugccacaaaagagaagauagaucaauaucacuacauaaaaugcacggauagaucaauaucacuacauaaaaugcacguuuuucauggaaaauauaaacagagacaaagccagaugacacgcugggggaaaauauuagcaacacacacaaaagacaaagggcgaaguucuuuagagcaauaggaccccaaggcacuauaggaagagaacagaggagggccugcccggccguuuugggaaggacagugcagccggccggcuggguggccacaggcgccuccaaguucaggucauggcagccugccccgucagaaacugggauguguuagcacuugugaagauaguuuccuuuacugaaauuggucaguaacucugcuuguuucuuagguguauaaagauucauuugaacugaaauuuuuggaagagacuaauugcuuauaugcugccgaaggccaaagguuaaugcaggaaagagaggugagaugaugggauguuuccgaauccccuggcuucguuucugcagaugagcaccuaggaggacuuuccucauguuugccuuuucacacacaugcaaauguuucauugaaaaucuucugaaagcugcaaucuugccagaauccccaguaaugagcuucguucuuaguauacuaagaauuuaguuuaugugaacuuagaaacuauugcacuccccccacaaguaaaaagcuguaagaucauuucugaaauaauuaaaauaacucaaauuuaagcaagaugauaaaaacauacaugaaaacuuaaaaauauaaauguaaaugauaaaauuuuucauuugugugaagcacugcaaaaaauuuucccaaaaaaagcugugcgaaaaaacauguaguaguaauaggaacccaaaaaacuuaaucaccuuuccagauaccagagcaaaaucauaaaggaaccugccccauagacugucacccaaauggugcgugcuacugccagaauggaccuuagccauugguuccuucauucuggcuuugcagaggaaguuucaugucagauacugagcccagcugcagcuaccccagcagagccucaggccuuucccgcacugucuugggaaacaugggcguacuuugaggucuccugcaaccguguuguuuggugucccccaaaugaacaaccaccuuguugacuugcuuuugcugacccagcugugcggggcaggguugccauuuagcaccucauccuccuaccaagugaggcucagcucccugugggcccuggggaugggaggagggugugcacagaccccgaaacuugguggugcacagggacgaaagagaagugcagccugggcccuguuguaggauggauguuaauaucagcguccuuucuccaugucccccacacacauuuccguccuaccucucccucccuguuaaucuguguuaauauuuggcuugaauauguauucugcuuuuuaaaaaaauuacauguaaggaaaacaaaaucucaauuucuuggauagugucgacauucuuuuuguuacugauacauuuaauuguuuuguuuguaagguuccagaauaucuuaaccauguaaguaaacgcuuagaggaagagggagacagaguaaucacuuacuuggaccacagcacacaguaaguaccguuugcucgcugagcguucguaucuucaccauggcuggaagguucuccuggcugguuauugaaauaaagggugucuuugucaauucauucaguacuaagaguguuuuugcaccuagcauauuuuacuuuguuauuugucauuauuuggcauucacaaauuacaguuuuuacccagugccuugucaugaguuacgucuaaagagaguaaaucuugcugagauacuuggcaucuuugaguuuugagacggucuauuuauguuaauggaguaucacugaauauuagguuauuuugauugugcauucucuguuacacauuuuauaucgcuuuaauuuuauuuauggugcugucacacaauuuucucuuuucaucuuauguuuuuuuccugcaaaccugagguugaugaguagcuagggaaacaaaaagggagagauuaugugagcgugugugucaggcacaguguguccauaugaugggaggcaaggacagaggcagaggggacagcaagggagagaaaugaaaaugauacagugugcagcugggcgcgguggcucaggccuguaaucccagcacuuugggaggcugaggugggcagaucacaaagucaggagaucgagaccauccugaccaacauggugaaaccccgucucuacuaacaauacaaaaaaauuagccgggcgugguggcgggaaccuauagucccagcuacuugggaggcugaggcaggagaauggcaugagcccgggaggcagagcuugcagugagccgagaucacgccacugcacuccagccugggcgacagagcgagacuccgucucaaaaaaaaaaaaaaaagaaaaugauacagugugcagaacuggacccaguagggaaugauaaaauguacagaugugcagaacaggacuugguaggacucagcagagaaaacaggaggagagaugaaaaugauauggugugcagaacuggacucaguaaggugcggaaaggggaaggauucugacagaauccagcacaaaaacagagagggugcagaaaaagagauuuggucacuuagacguguggaguuggaggagccugugggaaauccaggaucucgaggcaggccaggguggcucgggggccauguugugcuuccuuccaacugggagcagaagagcagcccccgggagacugggaagcagcagccagggaaguccgggggaaauaguggagagagcggcagccacagcgaagccccacaaccagggugugcaggucacacacagcuucccugagcccuuucugccuguguaggaagcagaaggcggaaugucggcucugcccuucuccguaagauggugcauuaaaacguuccuuauaaacuggaaaugaaggcuugggaagauggcuaaaaucagcaauccuuggaauaacgcagaagcaucccugcuucccugggcccgcccgugggccugcuugugcuguucaguaggugguuuuuagaaagggcuuccuucagcgucauuagcaacaggagucgucguccguuugcaugaggaaauguucuuaaccuuccguuucugauugccucuagacugcaucugucauagacaaaugcccccaucuuuugcagagaaccagucucuucuuuaaacuuuacuucuaacgcuuauucuuuuuaccuuauauaggaaaccacugauugcuuguguggagaaacagcuauuaggagaacauuuaacagcaauucugcagaaagguagauuuccuaacucuugugcaaauuaaacugaacaauuauccuuaguucauuaggaaaguaaagggggcauuacaaauagcaguguuaggacguuuguuauuuucauaagacagucauuaaaaaucuuuucuaaugaacauguuagccauccacgggagaaaaaaaaaucaguaagagaaauaauggaaggcaccuaguggaacuacauucacugcuaaaaccccaguggcaggaaggcccggcagaccuucuguaccacacucaugcugaaacaugggugcagugagccuguugcagcucucugagcagacucauuuccuguguccggccguucuucaugcacacucggauguaggggacucggggagcuguucgggcuguuagauuuucgugaggcuucccucaccugcggacuucgugcaucuuagugucagaugaacuaccgacuagguggucugcuuaagcagaguauacuuuucuccugguuuucuggaagagaagagcauguguucuagugcugacggcgcggccuucacguccgcuucuccccaagugguggcaguaccuggccauaggaagguggcuucuagcagccugcaccuuuaaaauugaugcugaugucuuaccucgaucuuuguuuauugcuguuuuuucuaggcuucaaagugugcugaauucuaugaaaauuacaaugagcagucuaaccuuuguaacacuuuaguacuuacuggcacauuucacuguuaccauuugaaacaauguuaccuucugaaagucauuuuaaauguauuuggaaaauacgagacuuuuuucaagccauuggaaaccuuaaaguuuaauuuugagaaggcccuaaaugguauucaaauauauucugcuuuggguucuacauugucagauaauaguauuauggcuaaugagauacuuaagugaaaccagaauaaaaccaaaagggaggagaauuaacaugauugagcaucuccuguuacaaacaacuccacuugaugugaauaucuuuucaagcaauucugugaaaucauuauccccauucuacaaauaagaaaaccagggcuuaaaacagccagauguuggugccuggaaucacauugcuugugagcugagagucacggguccaaucugguuaugauguuucugcuuauuccacacugaaaccuacacaucaccuauccaccuaaaaacaaaugcauucagaauuugugucagguguuuuuaugaaaggagucacuuuauaagaaaaaaggccaggcauaguggcccauaccugugacaucagcacuuugggaggccaaaguaucacuuuggaucacuugagcccaagaauucacgaccagccugggcaacaaagagagacccugucucuaccaaaaaaauaaaaauaaaauuuuuuuuuaaagccacagguggugcaugccuaggguaccagcuacucaggagggugaggugggaggaucacuuuggcccaggggguuaaggcuacaaaacuacaaaaaccugggugacaaagcaagagaccugucucaaaaaaaaaagagaaaaaagauuucaaguaaauaguagaaauuugcauaaauuguuccagugcauacuuuguuaagcaaaauuauuuaaagaaaaugguaaauuauauauguaaaagcuuacccuaaauuuuauuagaaauauuuuaaaaauuaaaaagauacuuuugaauucuuaagacauggguuuuaguaaaauaaaguauaaaaaguuugugucaguagaucagaauguaauugagagaaauaaacauuuggagcucuaggugaggauuguaauuauagccccaccauguguuugcgcacagcuuuaaaccuccucguuugugugaacaucgugcccaguguaggcagaaucugagacuuugugaauuguaugacuguucaccauuuuaugcuuuaaccuggcugccucucaguaguuaucauaaagcaaguauuuagaaaaucuaugagaguuuuucucauugagguaugguuucagaaaaccguuauaaauauuaaaaaucuaaaacacugaaagcuuuuuuaaaugcuguguuaaacacuucaaaauauccgaugauguuuuucucuuauaguuuacuauaggugugaauaaauuuaauccacuauaaauuagauuugauagcuuguccuuuuacauugucuggccgauggacuaaaucagaaguagauugagaacaugaaccucccagguuaaauaguugguguaaacuggauuuucugacuugcuaacuuaagugaaauaagagggcuucaaugacauaaagaaguaaauaauacaucuuccaacauacucagagaaaaugagguucaccuaauaggauccaucucacauauuuaaccagaucaaccugcucauguagaggcagcgauguggagacccgcccaauuucuaagcgguguauugacguucuucuggugcacgcuguauucuaguugaguuguuguuaaugcugcccaugcuguacucugcugacguguacugcacaucucagggcucgaccacuuacuggaugagaacagagugccggaccucgcacagauguaccagcuguucagccgggugaggggcgggcagcaggcgcugcugcagcacuggagcgaguacaucaagguacuggcgggguuuugaggccgcgggcgugggcauucccugcagggagcagagccccuccugagaacgccuagugugcccuggcaaagggaacugggcugcuggagggcccgucugcauuuucaucacagaugauaggguggacaguaggcuuccaucugcuucccaaucaccagugugaauuugcuuuuuaggauaacaccagcagugauuagcaccaucaagguagaaaguauaacuuaaagaacaacuguuuugcucuucuucaucagcauaaauauugguuuaauucuaaaucaugauuuuuccuaaaguaaucauuuuuguaaaucugcuugucagacaugaucuccucaugcccuuuccucagggagaacuauuauauauuuggcauaucaguuugcuuuauaaacuuuauuucuuaacgguccaaauuuaggauuuauuacuuaaacuuucacuuucauguuucgaaagcauuucuuuggcaucccuaacaagcccaguccaacccgucguagaguggcuucuugggcaguacccugaguuuucacauguccugugcaggagaacggcccuuuggugcugacauaggaccucccugaagacuaggggcucucggcccagggcaccaccccaccaaggggacauuuguugaugucuggagacauuuguggcugucugaacagagagggugcggcuugcuuugcugggcagcaccaggggugcugcugaaugcacaaggcagcccucaccacaaagaaucaccugcccagagggccagaguugcccagcccaagaaaccugcugaagacccucuaaugagaagccauucuccagaugccccucacagaaacaggagaacugaggcagacaucagggccccuucacagauagcucguguuuucaggaugugccaguugccuagcaugaauuuuccagcuuaaauggugaacauuuagcaaaagucuguguuuuugcuugcuggugacuauucuuaaaucccauaaugaaaagauaaacaaaauuuccagagaauuacacuaagaggaaaaaaagaaaagccaaucacagauacuuaacguguuauugcauaacauuuuggaaaugacaaaauuuagaaauggaggauagaugaaaaguuaccaggguguagggauggggcagggugugugguuauaaaaggccccaggagguagccuucugcgggaacagucgggguuucggccgaggucuagaugugcacacccagaugaguuacgaguaaacugggccaugugaaaaagacgggugcgcugccaugucaguaccccagcugagacacuguuguguaguuucgcaaaccguugccauuggaggaaacuguggaaauaaagacacugggauugcuuugcuauuuuuacuauuaugcaaaucugucauuaucugaauaaagauuuccguuaaauaaaaaagauaaagcuuacaugcugcuuuauggaauaaucagaccugaagucauguaucaguccagcuguggaaagccagcacucacagcaccccuccccacaaggucucguacaaugauagaauuggaacuuauaacugagucacacuaaauuggccauaaagcuacugaagauuuagguuuuuugccagugagacagucuucaggggaugggaaugugugcuaaaaacuaggaaaaguucaccuuugcaguuuccagucuggguaauaaaaaucagugagugaccaucaccccugagugucagcaauaaguaguuauacuguaacaaaauaguaguuuauauucaacuccacaugccguuaucaaaauaaagcugggccuuguaguguaugugcauuauuucaaaaugcaguuagcaccaaaggguguagaguaagagguaagucccucccacaccugcuagccacacaccgccccucucugggagagucugugcccuuucuguuggcaucuuuuuuuuuuuuuuuuuuuuugagguggagucucacucugucauccaggcuggaguguaguggcgugaucucagcucacugcaaccucugccuccuggguucaagcaguucccugccucagccuccugaguagcugggauuacaggcucccgccaccacaccuggccaauuuuuguauuuuuaguagagaugggguuucaccauauuguccaagcuggucuuggaacuccagaccuugugauccacccgccuuagccucccaaagugcugggauuacaagcgugagccacugcgcccagccuucucuuggcaucuuuccaccagccagcuaccucgcgugugugugugaugugugagugcacaugugcauucuauugagacgaauuuuuuaaauccaaucauuguauucaguuccucuucggcauauauaguuuauaucaucaaauguuaacuguuuauuagugcccuacacagacuuuuaggaauguuuaauauaacaguuuuaaauuaaaaauacaaacuaggcuaggcacaguggcucacgcuuguaaucccaccacuuugggaggccaaggcaggcagaucaugaagucaagagaucaagaccauccuggccaacauggugaaaccccgucucuagcugggcgugguggugugcaccuguagucccagcuacaugggaggcggagguugcagugagccgagaucacgccacugcacuccagccuggugacaaagcgagaguccaucucaaaacaaaaaaaaaaaaguacaaacuaaaaaagugagcuuuucaugguuagaagugauggagaaggaaaacuagccaagaagucccaagagguauauugaauuaauaggaauuaacuugucuuggaggaacuuacacauaaacauucuuuaaaaagcaacggacauuuuccagucguuuguaaguucucucagaaacagaaucguaagaccaaugcauuaauuguguauuuaauuguauauucacaccaagcacaggggcucaugccuguaaacccagcacuuugggaaaucacagugggaggauugcuugaggccaggaguucgagaccagccugggcaacaugaccccgucucuacaaaacuuuaaaaagaugggccagaugugguggccugagccuguagcaccagcuacucaggaggcugaggugggaggauugcuugagcuugggagguugaggcugcagugaaccgugauugcaccaccgcacuccagccucggccgcagagugagggccugccucaaaaaaaaguguauucacuuaauuuuugaaaugugaauucaauuugugaaacuuuuaaaguuauugaguauuuacuacuaagaguaauuuauguuaaacuauccugauuauaugauagcaggagaagauacuguuugcuauuguaaacauguugcugaguugguauugauuugcuuuuguagacuuuuggaacagcgaucguaaucaauccugagaaagacaaagacaugguccaagaccuguuggacuucaaggacaagguggaccacgugaucgaggucugcuuccagaagaaugagcgguucgucaaccugaugaaggaguccuuugagacguucaucaacaagagacccaacaagccugcagaacugaucgguagaaaaauauuuguuuuuuuuguuuguuuguuuuugagacagucucacccauuucuagacaauuuuuuaauaugggaaaauaaggcaaaaucaaccaaaauguucaagcugcucaagggguguguggaaagcguuuuuaucaagucuuauuaggacacaaauuuaaaaaccgacacaccugcaugcauggguggaggagggcauuuccauaagggaagaugagguaagaauuuagaaaagaaaugaugcuugacuucgccaaagaagggaggggugaucaccaucuuuguauccucuaauccauauuaaaauaggauaaaaccagaugagaucucaaaugauaauacuauuuuuaagcuguacaauuuuuucacaauaauaucaaaauauauuucagaauucauaggcuuucucuagucaguaaaauuuuuuuuuuaauucgaaggagaaagggggcaaagagagcugaaauacgacgauacuagauugacuguugauuacugcugaagauguaagauggaacauggagcucauugugcaauugucugcuuuucuguguguucagaauauuccauuacaaaauguuuaaaagaaaaaaacuaacaaaaacagcaacagaaggaauucaggaggcaguuuacuuuggcuuuuguuccucuguaucauuugugguuucucuaaagcaaagggauguugagcucuugggaguuugggcuucuggaagucuuggguucucccaucacauggggacuuugguccucccucccaagccaccugacgauggcuugugcagccucagaaacaggaagcccgaguagaaaugcuuucacccugcguugccaccuuggaugcucugagaaagucuuucucuuugagaaugucuccucugcauucaugacaccagauccuagaaauaggcacuccagcguccggggcagucacguccugaaaccugagcauguauuugcugaagucauuuuauuuugaaauucagagauugcauuuaaagauaagaaagauauuuaaaccugcuuuaaacauucaguccuggcuucauuaaaauuuuggcaaguauuuacucucacuugacuugagaaguacuuaccuuagaaaaucagauauuuguuuuuuugucauauagucauuuugggaagguuccagaauguuccuguacaauguugcuaauagaaauugaagaugcucucuuuuucuaguuuagaguauuuacuauauguuuaugcucacagcaaagcauguggauucaaaguuaagagcaggcaacaaagaagccacagacgaggagcuggagcggacguuggacaagaucaugauccuguucagguuuauccacggugagacucgggcacucagaaaaugcugcauaaucaagagguguaaacaggcccugcuuucccagaggagguuuagcaugagaaugucaguaucaguagagccaguuugcauuagaaugaacacuuuucauccuugcuaacauggugaaaccccgucucuacuaaaaauacaaaacauuagccaggcgugguggcaggcgccuguagucccaccuacuugggaggcugaggcagagaauggcgugaacgcgggaggcggagcuugcagugagccgagaucgcgccacugcacuccagccugggcaacagagcaagacucugucucaaaaaaaaaaaaaaacacuuuuaaggguuuucagcaguugaaguuugaaguuuaacauuugcuuaucaacucucugaugucuugauuauucucgucugguuauaaauagguaaagaugucuuugaagcauuuuauaaaaaagauuuggcaaaaagacuccuuguugggaaaagugccucagucgaugcugaaaagucuauguugucaaagcucaagcaugguaaguauguggggccugggcuccuccccuguaacugaggguugcugccccguguguuaccccgaucucacucccuccuuugcuguguccagagugcggugcagccuucaccagcaagcuggaaggcauguucaaggacauggagcuuucgaaggacaucaugguucauuucaagcaggugaguuguguuucuuagguaaagcggcuuuuuaaaaaguaucuguuagugugguggcucaugccuguaaucccagcacuuugggaggcagaggcaagagacguucuugaggccagaaguucaaaacuacccugaucaacauagcaagacccagucucuacaaaagaaaaauuuuuuuaaugaacagguaguccuagcuacugggguagggcugaagugagaagaucacuugagcccaggaguuugaggcugcagugagccgugacugcaccacugcgcuccagccugggcaacagagugagaccuugucguggauggguggauagauagauaauacauagacagagauagcaguaccuugucauagauagauaaauagauaagguagguagauucaauagauuagauagaaugaaucucacucuauguaagaagaaaauuacacuauuaacguuucacaaguaaauuuuaaaagaagaaaaagaagaucuaaacguguggcaagaauuuuauuucagugagucugguggugacaccugaagaagggaaaaaggcaguccuagugaggcauuggguuucauggaauacauucuggggacugagauaaauucuaacacagaugaaacuuuauauugaaaauuacacgguuuauuuuguuuuagguuaauuauguuuuauuacuuucucaaaaugauugucuuggauuucucuguuuuagcauaugcagaaucagagugacucaggcccuauagaccucacagugaacauacucacaaugggcuacuggccaacauacacgcccauggaagugcacuuaaccccagaaguaagugugcagaaagcaugcuguccgcucccgcugucaugcccuuaccaggcacagauauguugccuucaagaauuguugaauggggaguuuuuaaaaauagcccacucaguccaaaaucaaagugcucuuauggucuuuggaaaugugcuugagaaagugaccacuuuugucaccuucuguggcuccucccagugcagccuguguccaccugcugaccugcagggggcccaugagcacaggcacuuguuuuggaaguuauggcuuauuaagcugcgguucuugucugguuguucuuucuuuccauuguagacagugcugaagucuugggaauggcauuauuuagggccuucuuugucagccacuacuuuagcuacacuaaacccuucaguggaggguuugcacgccggagguagaauucugugcucaaugaaguuaacaucagcaggagauacaauacaugcaccauucauuuaauaccaggcgaagggaaagggcugagaccagccugcaaucauggaagacuuccuggaaaaggcgucccuuaagccugauaucaaguaaagaugaaugaugauuucgucagcugagaagggaagaaagacacacagcuacagugguaggacagugugauuccuuuucuuauccaucaugagggucauggccaaugcuccuuuaacaaaagacaaauuaggaggagaaaaccuuaacaaauuuauuuaaucaaaguuuuauuuaacacaucaggcuucagaaaugaagaccaaagacccagggaagacuguccauuguuaugcuuagguuugauaaagaaugggcagccauguagaaauagguguguuagucuguuuugcauugcuguaaaggaauaccuggggcuggguaauuuguaaagaaaagaguuuucauuggcucaugguucugcaggcuauacaagcauggcaccugugucugugcaacuucugaugaggucccaggaagcuuuuacucaagguugaaggcaaagggggaguaggcgagagagagggcgcaacagguggugggggaaggucccagacuccuuaacaaucagaucucgugguaacucauuaccacagggagggcgccaggccauucaugagggauccacccccaugacccaaacaccucccaccaggccccaccuccagcacugcagaucacaguucaccgugagauuuagaggggacagacccccaaacucuuaucaaugugacuggacagaaggguaccaucuaacaguaguagaguagcggggaaaccaguaaggccugucuguucagauucuucuuggccucacugggcaauguucuuuccucccagguguagggcaggacaccucuggaacaagagucuuaugacuuaacuaucagcaagguaguucagagaacuucuuaauauccagauccuacacaaaagggcaugggaagcaucgaguaguaucuccaggcuuuauggcuggcuuugggcaagagggguuugaguuuucucuggccugccuuggggaagaagaguucucauuccaggagaacuuugggggagaaggugagugagagagcuugcuucugaggcguccuagccagacuuagagaacaugugcgggaugcucaaagaaagccaggcagccugcuuuccacgcuggccacguggugcugucccuuccugucuccacagauguuugugcuucugcaccauucccuuuccccuuaauauucuaguggcuauuucccaagaacauaagcaccugucaaaugagggcauucauucugauguaauacuuucaccccauuucuguugguugucucagauauguccuuugugguguuuuuccgguacccagcugagcccaggacccaggcggccuucgaugcucccugugaguagguucagguugggcagguccagccagaugccccguguccccaucaggauccuggcgggaggugcgcacuaucacgugccccagugucuuggugacauucgauaggauccuccugugaaggugcuggcugguuucuccaccguaucguuaguguuuuuccuuuuguaaucacuaaguaaucugugaggagacauuucaagacuacguaaaccucuuaauccucauccagcugucaccuguguggcgauuccuggcugaauugauuuuuaccuggugaauggggauuuuuuuccagcucuaucauuucucuauauuuagaaguuggcauucuaaggaagagcccuucuuuccacccccuuuauuuacuuauuuauuucucucucuuuauaucauuaugaacucagggauucuuaauuuauguacuuauuuugaugcuuaaauugucccauauguggucugugagccacccuuaacacugguuccuuugcucuuugauaugccuacaucauuuuuuuaguacuuuuuuguuuucuagcaaaaguuguuugaagcuuaccauacuguauuuuuuuauugugguaaaauauacuuuaacauucaaguuaccuuuuuaaagcgugugguucaguaacauccagugcaguuguuccucaguauccacgggcuguugguuccaggacucccacagauacuaaaauucacacucaaguccguuauuuuauauaagugugagaucuuagauaaccuaugcauacucucccauauacuguaaauaaucucuagaugauuuguaauaccuaacaaaugcuguguaaauaguuguuacacuguauuguuaacaguacaguaacagaccugucuguucagauucuuccuggccuuuuaggggaucacugacaaaaaaacuuagugcauguucaguacagacaaccauccuuuuuuugcuuucgaauauuuuugaccugagauugguugaauccauggcuguggaacccauggacacagaaggccagugguacauuuacaguguuacagagcugucaccccugucgauuccagaauuuuuccaucauuccauuagcagcuccuccccagccugcucugcuccggaccccggcagccacuaucugcuuccugucucuguggauuugucuacauuagauaguucacagaaauggaaucacaauaugugagcuuuugugucuggcuucuuucacuuagcgugcuguuuucaaaguccauccgugcugcaccauacaugagcgcuuuauuccauccaugcuguaccauacaugagcgcuuuauuccauccaugcuguaccauacaugagcgcuuuauuccauccaugcugugccauacaucagcgcuuuauuccauccgugcugugccauacaucagcgcuuuauuccauccaugcuguaccauacaugagcgcuuuauuccauccgugcugcaccauacaucagugcuuuauuccuuuucuggcugaauaacaucacauuguaucgauaggucacaucugguuucuccauucaccaaacauugggcauuuggguuauuuccaccuuuuggccgcugugaauaaugcugcuaugaacauggguguacaaguuuuaguuugaacaccugcggucacuuauuuugggguauauaccugggaguggaacugcugggucaugcaguaacuugaaguuuaaguuacugaggaauugccggacuguuucccacaguggcugcagcagcuuuuauuccaguuagcaaucacgagagcuucccaccuucucaccuacaccugugaucugccucuuucguuguagccaucccuguccauaugagcuggucucucaucuugccgugauuugcauuucccugaugacuguugauguugagcaucuuuucauguccugauugaccauuugcguaucuucuuuggagaaaugucuguucacgugcuuugccuaguuuuuaaccgggcuguuuaucuuuuguuauuaagcuauaagagcucuuuauauuccaaaugcuagacccuuaucagaucugugauuugcaaguauuuucucccauucugugggcuaucuuuuuacuuucuugauagugugcuucuacaaaaguuuuuaauuaugguaaaaucacauuuauuuucucuuuuguaacuuuuggugucaugucugagaaaccauugccaaaucaagaucacaaaaaauugacgaggccaggugcagugccucacaccuguaaucucagaacuuugggaagccaaagaucacuugagcccaggaguuaggaacagccuagacgacaugguaaagccccgucucuacaaaaaauagacagauuagccgcaugucguggugucugccuacagacccagccacucaggagguugagguggcaggauugccugagucugggagguuaaggcugcagugagcugugauggagccgcuguacuccauccugggcaacagagugagauccgagaccgugucucaaaaaaagaaaauaaaauagcacuauguauucucccaaaaguuuuauaguuuuagcucauauguuucagucuuugacccauuuugggccuggacugguagcuagcacauaguacccaaacgauagcauuaugaugauaauuauccucauuaauaccaauccaguccuaggaaugaaucccaaggagaugguuuuuaggaaagauaugcacuaagagguuuaucacaaaccaugguacuucucaaggcaaaaagaaagaagaggcuuaucacauuauugacuuuuauuuagguaugguaauggcauaguagauacauuuccuaaaagaguuccuguccuuuagagauacagaaauaccuacaaaugaaaugaaaucgaugauaucgugccugggauuuggugucauugaagauggggaguaggugcagcaggugauuuauacaugugguuucauagaaaggugacucuugggcugaguuuugaagcaugaagaggagauugccaagcagaugugaggucagcaggaauuucugacagggcacagcuuagacagaaacacagagaaacuaaaagggcacgucaagucuagagagcagcaggcauuuaugcagcaccugcuggugccauguacagugcugcaauggggagucagagagccagaggcccugcccugugagccccuguccggaguccacauucacacugugcuauagaugcugguagagcuaagagggugucagagaagaccucucugaggaggcgguucuggaaaugaguagguuucaugagggagaugggauaugggauccagcagaagaaaccacgugugugaaagucugaggggaugagaauguaugaaagacaguggaaugaucgacugaacugggccuggaggaugggaggggcacaggccaggucugugagaucagagguuagaauuucacgcuuucuuugucccaagaucuuuagaagccauccagagacacagggaauggugagcucgugggagaggagggauugguuuggauuuguguuccugcccaaaucucauauugaauuguaaucaccacugcugggggagggcccgggugggaagcgaccggaucaugggggcagauuucccccuugcugugcucaugguagugagugaguucucaugagaucugguuguuuaaaaguauguagcaccucccccuucucucucuucccugcucccgucaugugaagacgugccugcuuuuuuccccuuaccuucugccaugauuaaaaguuuccugaggccuccacagccaagcuacuuguacagccugcagaacugugagccaauuaaacuuuccuucuuuauaaauuacccagugucagguauuucuuuauagcagugaaagaauggacccauacaagacguauagguggaugcugagucccggagcauuggcauuuguggaguggacgagagcagggggaggccacgcccugggcugugcagagauggucuccugaggcgaaacuggugagcccuugcgugcgcagcacagacgugucggagaucccgggugcaguggacaccagacaggaucaagcugaagaguggaggguaugacggaccaggaagggcaugcagaagucagggaaagcaccgcgcaugggagagucacacacagccugccccugagaggcauccggaaaacacgagcaggauccgggcgaugggaaaggcuggugcacugaacgcugggaacuugaaaaugcagcaaccacaauuuuaaggaucaguagaaaguuuggaaaauguaagaaauucacucaaggccaggcacagucuaauuccagcguuuugggaggccgaggcaggaggagcgcuugggcccaggauuucaagaccagccugggcagcaugagaagacccaucucuacaacaacaacaacaacaaaaaucaacgggcuuggugucauguaccuguagucccagcugcucaggacacugaggcagguggaucacuugcaccugggagauccagccugcaguaagcuaggaucacaccacaaccuggcugacagagcaagccuguguuccaaaaaagaaaagaaauucacccagaaacuaaucauagaaacaacuaacucgugcugcacuuucugugcaggcccagauggagguguuugccaucagccccugcacagugcaacgcaagggguuguggugucacccuucacagaugaggaagcaggagccccgcucauugccgggaacaccagccgaggccagggcugggcauggccgggcugagacacaggaucuggccucagacaccuuuuucuugacgggcuccagucuucacucugugccacuggccccagcaagcccugguauguacagagaccacggaauacagcuggucuguaccaugaaacaccaguucaggcauuaucucguugacacugagaagccccaaaguucaaggauugaggacguuuuuacaaauaauggaauccagaaagugugagaauauagagcugaccuuuuaauucagccgugagaaauuguaaaacucugugcauugaauggggagcuauugagauggaugguguguggcauaauuuuguuguucuccuaugcuuaacagaugauuaaacuucaggaaguauuuaaggcauuuuaucuuggaaagcacaguggucgaaaacuucaguggcaaacuacuuugggacaugcuguuuuaaaagcggaguuuaaagaaguaaguugucuguuucauuuauuuuuuauuauuuguaaauauguuaauauaauuuuuuuauuguuacuggacuuuaguagcaaaaaaggaguguuucacuuuaauucacuagcuuuuauaagucaauaaaauuuguaacaguuaaaggguuauuauuccaaucaauaaaaauucuuaagaaaucaauccauagaaaaccauuuaccuauugaaaaaaagagcagagaaugugaagaggcaacucauaaaagcaaaauugaaaaaaauaucugugaagaugcauuacacuucucugcuaaacagagggcuucaaaguaaaauacaguaagaugccacuuuuugacuaagagauuugaugaagccuaaaaaauaaaaaaaaauuaaaaaaaacagacucuugcccacuacuggaagaagcauaaacuguagugagcuuuuggaagggcaguuuggcauugugaacuuuggcaacccugcugccgaguuguugccuuaguuucaacucuaggaacucaucuuaauaagacauuuucacggauuaaugaaugagaauagugguugcagugcuguuauuaugagcgauuauuuaagaggggagaaugcauacaaugcacugaucaaugaaaggcgcuuaugaaacggcaauuauauacacuaagcaaaaacauaaaauuccuauuuuguauagcuguuauauuaauaauaaacuuaucuguacauuaucaaauaaguuauacauaccuacuuuauuauuguagagagucauauacaugaaaccauauauucucuuccuuaagguauuaggaaaguuaauuucuauuauccccaguuuuuuaccuacuugcugacuuuaguugaacuugaccuccacagggucuguaccagcaccaccaacugcagcucucuccaggugugcaggaagggcuuguuaugggcuugugaugagucugggcuggguccgcagagggggccaccaacugucacccaaacucucaugugccucucgugggucugaccuggaggcauguggcaaguugcugcagcacuaacuccugaauagaaaaggagaucauccugggauauauaaggccaaauugcauucaccccuacguuacagucagucccguauaaaagaaagcuggacuguaaucccaguaccuggggaggccgagguggguggaucacaaggucaggagaucgagaccauccuggcuaacacaguggaacuccaucucuacuaaaaauacaaaaaauuagccgggcuugguaggcaccaguagucccagcuacucgggaggcugaggcaggagaauggcaugauuccgggagguggggcuugcagugagcugagauugugccacugcacuccagccugggugacagagcgagacuccuucucaaaaaaaaaaaaguuugagagcaaaaagaagcuucuuuuaauuuuucaaagauuguacaugcacagcuucagaggugugaugaggccuucucuuccaggggaagaaggaauuccaggugucccucuuccagacacuggugcuccucauguucaacgagggagauggcuucagcuuugaggagauaaaaauggccacggggauagguacgaaaacugcagagugcauagcuccaugaguuguucuuaaagcauguauuuguuuuaagauaagacauagacuugguagcaugauugguuuacuguuguugagucucauucguuuaacgccagccuuugccugcauuugcuucccauucagaggauagugaauugcgcagaacgcugcagucccuggccuguggcaaagcacgugugcugauuaaaagucccaaaggaaaggaaguggaagauggagacaaguucauuuuuaauggagaguucaagcacaaguuguuuagaauaaagaucaaucaaauucagaugaaggaaacuguauguauaaacuuucucuuuuuacuuauaggggguuuagcagggaaucauuuguuuuuguaguaauguuuuuggcuguuagaggccugaagcacauuucuacaauaauccaauuucacuauguaauguuuauaagaguacucauuuuccugucgcuuucauuaacuucacauucucaguaggaaagaaaaucagaaaaaaagccacuuaauguuauuccuauucacaaaaaaguugugugcuaagccagaacuccccauggucauaggguuucgaaaauuauccacacuuucuaugguaauagaaucugauaugguucacucuugguguuguacauucugugggucuggguaaauguauaauguuauguauccaccauuauaggaucauacaggacaguuucauugcccuaaaaauucucuuauguucugucgcuguaucccugucucccuccgagccccuggcaaccccugacccuguuacugucaccauaguuuugcccuuuccugaaugccguacaguuggagucauaguguauauagccuuuucagauuggcuucuuuauuuauuagaacguauuugagguucaccgugucuuuucaugacuggguaacucugcuuuuugcacugaaggauucuccguugucuggaugcaucacaacuuaucccuucaccuacugaaggacaucugguuguuuccaaguuuuggugaugaugacuaaagcugcuauaaacauuucugugcagguuuuuauguggacuuaaguuuuuaacuccuuugagggugcaccuuuuauagugggcaaaagugagaaggucuaucaguucuuucucccgaagguaaccacuacugcccuuuuuguuuguggucacagccuuuuucuguggugugaguguauguaaacuuuuuuuuuagugggaucacuaagccaggcacagugacaugcacccauagucucagcuacucgggagggucgcuugaucccgggaguuugaggccagccugagcaaugcagugagaccccaaacucuacaaaagaaaaaacaccugggaucacuguacauauggcaccugucagggccuuccuguagccaguuuucguugcugaucgcagucuucuccuggccaggacuuguugcaggagcacagugccgguuguguagacccaccagggcuggcagugcccucggccacaggcacuaacauuccuccacugccccuccugaaaauaagauuacguucaacacccuggcacagacauuucugugcacuuguuagauuguuucuuuagugugauucuugcucuggagcugcuggguaaaauaauguguacuugucuuaguuugcucuuuuccaaguugaagucuggcagauuucaccagagcacagugucugcccccaccuccaccuguccuucgcucacccuguucugagcagcccaaagauaguuuguugcaguuuucauuuugauuucugauucuuuacagcaucuuucuaccacucaguaguuuauacaaauuauauaaucuuucuaaugcucaguuucucauauuuaaaauagacauacuacuaccucaaguugugagaauuaaaugaaucguuuagaaagcucuuugccacacaccuguaagcacuucauacauguugaugcugcucuuuuuaugcuuagccauuuguauuuuucuuuuucuaauugcuuuucaagucauaugcauucauuauaauguuuuuucucuuacugauuaguagguuuucuuuauauauuaaggauauuaaugcuuugucccuuuuuuuuuuucguuuuuuuuuuuuuuuuuuuuuuugcauuucacucugucguccaggcuggagugcagugguacaaucucgcucacugcaaccuccguccuccggguucaagcgauucuccugucucagccucucgaguagcugggacuacaggcaugugccaccacacucaacuaaguuuucuauuuuuaguagagacgggguuucaccauguuggccaggcuggucucaaacuccugaccucaggugagucacccaucucggccucccaaaaugcugagauuacaggcgugagccaccaugcccagccugcuuugucauuuuugacagauaauuuuguuguuuuuauugguuuuuuuuucacauaacaguuuuuaaguucucaaauauagucuccuuuucuuuuaugguuucugacuuaacguguaaugcuguauuaggccauucuuguauuacuauaaggaaauaccugaaacuggguaauuuauaaagaagagaaguuuaauuggcucacgguucugcaggcuguacaggaagcauggugccagcaucaccucagcuucugacgaggccucaggaaguuuccagucaugguggaaggugcaaggggagcaggugucucacguggcaaaagcaugagcaagaacagggagggaggugccccacauguuuaaacgaccagaucucaucaccaaggggagggcccaagccauucaugagggaccugcccccacccacccggucccaucuccaacacuggagaccacauuucagcaugagauuuugaggggacacauauucaaaaccauaucauuggccuaagagagaaauucccuuaaccagaguuuuaaaaaacauuuauacuauguuauuuuucuagaaguuuuuacauuuaaaucuuucuuuucauguugcagaaauuauuuuaguaucugaaaacagucuaacugcccccauccuuuccaaaaccaaauuuaaaauaucauccuugaacaaguuauuugaauuaucaccuuauuauguaucaaauucauauaggucaguuucucaauucucuucuauaaauucugugucuauuucauagccagccauuuuuuuuguuuuguuuuguuuuguuuuuugagacagugucgcccaggcuggagugcaguggugugaucauagcucacugcagccucaaccucuugggcucaagcgauccucccaccucagccccaggcauaugccaccacgcccagcuaaauuuuuguauuuuuuguagagaugaggccuugccauguuacccaggcuggucuugaacuccugggcucaagcagucuuccuaccuugaccccccaaagugcugggauuacagccgugagccaccgugcccggcaccagguucuuuuaauuaauguagcuauuccuauaacuuuauucuuccaaugaacuugacaauaauuguaucacgccuuugcucccccaaauaagaacauugacauuuuuaauccauauugcauuaauuuacagagcuuuuaucuuuaucauauuaaaucuugugauucauacauauguguauauauguaaauacauacaaaucuuuuucucagagcuuucuaguuuucuucuguaagucuugcauauuucuugcuagucauaaauuuucauucauucaacaaauacuuauugagcaucugugguggcccagguccucugugaagcacugagaauucauccauuaacaauaaagaauaaguccuuguuucuaggaguguucagucuuuuccagcagagagguagcagaggaucacacacauugacuaacuuguaagaguggaggaaaauguuaggauagagaagugcaggagagucuaauuaaauacugucgucagccaacgcuuuccugaagaagugacuagcuuugcucaggaacugaaagaaggccucuggcugcagcaucguugccaaaaggggaagcugagccagacaggccugaucagggagccacagcuggacccucugaagauggcucagauccaugaagcauuuggaaaaccacuagaguuuuaagcaagacaggcuaaugaaaugcugauaucuuauaaaggggaccuuuuuucuuuacauuucugacgguuuuuaucagaauguauguauuaaugcuauuugucuuuguauauuuauuuuauuuccagccacuuuacaaaacucuuuagcuuugaaaguuuuucuguugauuuucuuggauuuuccagcucaucuacaaauaaugaucguuuugucugcaccuuuucaauauaccucuuuagucuguuccuguauugcauaguuagaaccucuaaaguaauguuuuuaaggaauagcagugcagcugagcuuccuaauuuuaucucuaguucagaggauguuaacuuuuugggggucauggauccuguugaaaaugugaugaaagcuuggagucucucccauccugaagcauacuugccucauauguaugcacagaccuucccccagcccucauuucaacugcagauccccaucagguuccuguuggacuaagguuaaguugucucuaguauuugcuguuuguuucugauaaccauguuuuaucauguucagaugcuuuuuuauucauccuuguaugcuaauguuuguuuuaaaucaaaaaaucaauuuuaucaugccuuuucagcaucuaucaagauggucauguaaucuaaccuuucaacugcuacagugcucucacuuauauucacagauuuccuaauguugaucaacacuuaacauuucuggaauauauccugauggucauuauguuuuguuuacugugcugcuaguuuuaaucuacaucacacauagaguuguugcagcuuucuuauaaggaaaauaacuuuuaaaaauauuuuuuaaguuuugguuuuggaguuuugcuauucugggaagguaccuuuuacuacaacaaguaaacaugcauaauaaaguaggauucauccaaugucugaccuuucuuugcaucaaaagaacauuuccggccaggcacgguggcucacgccuguaaucccagcacuuugggaggccgagccagguggaucacgaggucaggagaucgagaccagccuggcuaacauggugaaacccugucucuacuaaaaauacaaaaaugagccgggcauggugggggggcaccguagucccagcuacuugagaggcugagacaggagaauggcgugaacccggggggcggagcuuguagugagccgagaucgcgccacugcacuccagccugggugacagagugagacuccgucucaaaaaaaaaaaaaaaaccauuucccaucaaauucgguaacaucaggucauuaauauugaaauauaggccaggugugguagcucacaccuguaaucccagcacuuugggaggccaaggugggcggaucaucugaggucaggaguucaaaaccagccuggccaacauagugaaacccugccuguacaaaaauacaaaaaguagccgggcaugacagcaggugccugugaucccagcuacucgggaggcugaggcaagagaaucgcuugauccugggaggcggagguugcagugagccgagaucacaccauugcacucuagcccaggcaacugagugagacuccaucgcaaaaaauaaaaagaaaauacaguuuuacacuuaacuuuuuuuuucuuuuuuauacagguugaggaacagguuagcaccacugagagaguguuucaggauagacaauaucagauugaugcugcuaucgucagaauaaugaagaugagaaagacucuuggucauaaucuucuaguuucugaauuauauaaucagcugaaauuuccaguaaagguaaauguaacauuagcauaauuaaauuuguaguauuugcuaaacaauugacaaagcauguuuaauucuauguucagucauaucauuugaccugcauuauucauggugcuuuguguauacacugaauguagaaaaacuggcaaaugugaagcucuuuauuccagguguugcucauugccacugcagaaaugauagagcccuaaaacucuccuucccagggauggugcgcgcuuguucauauuuucaggaagggaagagguagaugggacauggaaagcugaacacuuuucucauaguaguagcggucaagguuacaucacaagauuuuaaggaaaugauaacaauaacuaacuuacucagcguuuacagccuacaccgcguuuuccaccacgguaauagucuacuguugcuguugcuuaugaaagucagcccaggccugucaacccgcguuguuuucagaacugagauuuacuguccugccacgugugggaugcaggauaagccgggaaaguauuaugaaacguuuuuuacauguauuuaucaacccaggaaauacugaacucugaugacgccuggccucucagggacaggaccggccacacgugcuuuggagggaaaguccccagauuccauguugugcaguuugagccucccauuccaucaagggaauaaaguugagaugcacuaaauagucgaacacuuaagagucugguggaagugccacuguccaucagcccacauuugcccccuucccugcagaggugaggugccguccucagggcccugggaagcuccaaaagcaccaucagguucacugccccuuccucccaccagcuggagcaagucuccuguugccacugcaaacaaucaggcccagcgcgaagcagaggugagcaagaguggaguguggcagaccagggcaccugcucugcucucggguagagaguggcagaccagggcgcccacucugcucucagggguagaguguggcagaccagggcgcccgcucugcucucggguaguuggguuuuuuuuuucuuugagauggagucuugcugucccccaggauggagugcaguggcacgaucucggcucacuguaaccucugccucucggguucaagcaguucuccugccucagccuccugaguagcugggcuuacaggcacgcgccaccacacccagcuaauuuuuguauuuuuaguagagacaggguuuuaccguguggucaggcuggucucaaacuccugaccucgugauccgccugccucaaccucccaaagugcugggauuacaggcgugagccaccgcgcccagccucagccacaucuuguaaaauguguggcuuaucacugaauagaaggugaaguuuguuuggaaaauagagggucucccuuguauagggagagccuugcacguaagugcucacacagauuuucuuccuaauacagcagagcuggaguggcuguucccucugggcagagacaggcuguggcuguggauucgucuccucagucaccuacucuuagugcaggaacacuggggauuguaguuucacuuacguggacauggcaugcaauaacuauguaaauacacgagaauaaaacuacaggccaggcgcacugccucacgccagcgaucccagcacuuugggagcugaggcaggcggauugauugagcccaggaauuugagaccagccugggcaacauagugagaccccuucucuacaaaaaauaaaauuagccaggcaugguggugugcagccugugaucccagcuacuggggaggcugaagcacgaagauugcuugaguccaggagguggaggcugcagugagcugagaucgcaccacugcacuccagccugggcgacaaaaugagaccccaucucaaaauaaauaaacaaaauaaaauacacuacuuaggcagaagcauccuuucaaaggauaaaaguugccccaguaagacauguugagauuuuccuuucaaauaaaaaugugucacgugaucgggucugccucacuuauacgugcccuugcugauggcagaugucggaucugccucgcuuauacgugcccuugcugauggcagaugucggaucugccucgcuuauacgugcccuugcugauggcagaugucggaucugccucgcuuauacgugcccuugcugauggcagaugucggaucugccucgcuuauacgugcccuugcugauggcagaugucgggucugccucgcuuauacgugcccuugcugauggcagaugucgggucugccucgcuuauacgugcccuugcugauggcagaugucgggucugccucgcuuauacgugcccuugcugauggcagaugucgggucugccucacuuauacgugcccuugcugauggcagaugucggaucugccucgcuuauacgugcccuuacugauggcagaugauguauguacauuucacaaguuucacguuucccucaggaaaccacacucugaccauaaacucacauggacgcuuuuuuuaucaagagauaacguuaacuuugucuuuaaaauagaaaguuuuguucauuucauaaauauguguauaauuauaaaugauuuucauauaaauaucuauuuguauauauauuucuauaaguauaguuacauacuucaugcauauaccccuuguauguaaauguuuguaaauuuaaugccauuguaauuagggggguuuuauucuucuuuuuuagccuggagauuugaaaaagagaauugaaucucugauagacagagacuauauggagagagacaaagacaauccgaaucaguaccacuacguggccugacgcaucugcagacgguuccccuucaugaaacacuagaauguacccucagagcaggaagcacaccugugccauuucugggacucugauugauccagcuguggacauuggaaggcgaaggaagggagguggcuccugggucaucuuucacaaggcucaagacuucaaccugcagauguaucuuuuucccuccaguuuuuccucuaguucuuuuaggcauuuaaauuguuucuguuacucugugcaaaauaacuuugagauuggacaagaagauguuacuaaagagaaguuccuuuaaaaggucuuguucuugugucaaaaagcugcaaguuugguuuguucucgugugugaucaugagugcacaaugaagaagacccuagaugcugcauuuuuuagcucugaagauuccuuagguaucccugaagacagcucgcucagaugaucagcauuuagagugaaaacaagggcccuucaugggugaacauuagaaagagccaggguucaaagcuggcgaauggaugacgcacccuagccacuggccccucucuguuucauguauuuccaaaaguuguaaacuuugauggcugauuuuucguaagucagguuucuaagugagcucccugaggugccaaggccaugguguccgcccugcugcgucuguucgucagcugaguuccuugugaaucucuguuuuaggguuuggggcuaguguguuuguguuuccauucuaagauugagucuggcagucccuguuuuuuugcauugggguaacugcucuuugauuuuuuuuaauugcaguauuugugugauugcaauaauaaaguuugguuugguuuuuacagucaugcgcagggacgauccuuguucucugcuguaaacuguaaaaaguuuauggagacuuaaagucuugauguugugaagcagagguuauuuuguggaaagauuaaaaggauuuuguugguaccugguuuuguguuguguauauauacaugagguugaacagugaaaggaaaguucaguagugauguuagaaggguaacuaugacaaagauacuuuugagauaacauuuaaaaguacuuuauauuuuacauaauagcauguuucauuuugauuaaaagcuaccaaaggaauuuugaucauggcauaaguguuuaaagcaauauuuucuggaauauaccaaguuuauauaauuugauuuugugcuaaauuauuaagagucucuuuuugaaacaugcggguuugaaauaugacaccuuguggguuuccauauuaaaauccucacucuuuaauugucauuucuaucuuugaaaauuuucauuuaugaguuccaugauauguggucuaagaaagaccaaacagauuucuauuuuuuuuuucuuauaaguucguugugucuagagauuguuaauauuguaauuuaauguagacuuacuuugaauaaaauuaguuuaauuggccuuaaaauuacauuaauaaaacuuugugauaugcaaauga

SEQ ID NO: 191837 - RNA, 26273 nt, Homo sapiens
aaaagaaagaggcuuuuuauuacauuguuacaggcaaugcauuacgugagcuggucccguguacaauccccaagccacggcaaaacaucaggagaacgcaccgaucucacauuguacacagcgcagaacaggaucaccccgaaugucaacagaagaccaaaaaucacuuuacaaauaaaaauaaaaauaacacccauuuuuauauuuaaaaaagugccagcccuugagcugcagacauuagagacgcccaaggacgugccgccacuggaacgaggccgccagccacguguggcccguccuggccuuuaaagcugaacugaagcgcuccagacacucaucucuggaguuccucugucuuaggauguucccucucuacuguuguaaugugugagcaugucagccucaccacgagugaccuucaugcguccuacgugugacggccagaggcuuucccuuuguaaggcuuaaaucugagugcaguaaagaaugaagaaaccaaacaccagaacccuaaacucaaaugauauggagccaauuuagagcggcacccccaccccucagagacagcggcauuccaccccucggagagagcagcacccccacccccucagagagagcggcacccccacccccucagagaaagcggcacccccacccccucagagagagcggcacccccaccccucagagacagcggcacccccaccccucagagacagcggcacccccacccccucagagagagcacccccacccucaaaauccuacuuugguaaauauuaauguuuaaccaguuagcaaaauauuuaacccaguuagcaaaauuaacaccgucauuucgauaguuacucuguugugcauaguaaaugcugcaagaugaacuucacauuggaugaagcagauuugagaaacguuugccagaaagugugccuccccuucgacaggacccuaagcccagagaaaggaacagaggccccugcagcugcugugccugcgugcaccaggcuagauagucugguagccugcgugacuccucuuccugccgacgagguaggcgaugaggacgaugaggaccagccccgccagggcaccacccacagcgauggggaucagcaugcuguucucguccagcagacacuccuccacugccaagacagacggauggugucagggcucugcucacacaggggccugcaaacaggccucucuccccaccacucccccacaucagccaaaaggcaaagaggaacccuggcggaagguuccagcucuagcuggaauugucacuuggggaagccgcugcagagacuggugcucucugcacggcgaggaaaccacacacgucucucccccgucuggaaucaggggcuguggccggacagcugugcugcguccagggccucugugcacaucagaugacaguguuguauucaacguucaugggagaagcgccaccacuguuucuuaaaaugauucccuuacucucaaaugguaccaggggcucccagcugagagacacgcugggccucucuaaagcagggggaguuaccucuagaaucucagaccggcaagaagaaacagcuccuugcagaggaacaggggcgucgccccagcccacacggaagcgacuaaacguccacaggcggagucugaagcacguccuccacaccccgcgacagcugcccucggugacacucaccagagccaaacuggccaccuuccaccuugaaagccuggacccacacuuugaauauauugacugaaaacgccuucgugacacggacgugcuccuccgcguugcacuuguaggaauugccgacuguggccugcagcgcucgcagggagccguuggcagcuuuaaaggcagggucugcaacacacacagaggucuaguggcuccagaauacccugggcgcgcgggcgggggcggggcucgcagagauuguggguucucaccucuggcgucaggaagaauuguauucaacuggauuccuuguaggaaaaaccggcuagaacuugcauucuuaaaaagaaaaaugaucuuuaaucacggagcagauucauagaaagaugaucuuuaaccccaguagauucacacauuuaucaucaaacgugaauggucauuggguaauaaaccugacuuccuacauuucuaguauuagaacaaaacugcaaaagaucuugucuauaaaaggcguuguguaucucuggggaaugaaaauuuugguuaguuccuuccagacccuucucugagagucuugcucugucacccaggcuggagugcaguggagugaucacggcucaucgcaaccuuaacuccugggcucaagugauccucccaccucagccucccaaguagcugggaccacaggugugcgccacuacgcccagcuaacucguuuuauuauuugcagaaauggagccucccugugcugcccaggcugguccuuccagaccucuugagagucagucucuggaaaacggggacugcaggagcuaucacagcacaggaaagcaugauuuggaaagcuaaaauuauaagaaacugaacuguuaauucauuugcacagcgauuuaaaaagacugacaagugacaauuauaugcuucaugucuuauguugcuaacugcacaggaguccucccaggcagaaaugccaccacggaaccacagggcagcagcaucugaagccagaaggccgcacggccugcaugcccuccccugcagccacuccaacugugggcacagcagccccgcccacaucaucugcugcaucuaugaauggaauggaaaggggggaggggaaccaaggaacuaaaaagcccaggauaaagggaaggcagaaaaaagugaggccgccuccuuccuaacgcugccucccaugagcagacccagggcacaaaaagaugugguggagacacagugggcgcccccagagaggugccgccccagccucaccaucccgaacuggaagagcaggacgguggugcccucgcugugcagcuccagagucaccaggugggcgccgcagcucccgcuggccgaggucuuguugggguugauguugagaagccuugucaccgucugcauaagacaagcaagcaagucaccacccuagcucagguccuccacacucucgaaaagacaaacaguccugaaaccgugaauucaaggccacauuuguuuuaaccaaaaccagaaggaaaacacugaaagaccacacuaguacagauuucgggaucccaagaugacucucccugaccccgugacagcugcucuuggagugcagcguccccgcguggagggcaaccagcagcaccaccucccccugcagcagucagcccugcaaacucaccccacggcacgcaagucgacccccacaaccccacagccugucacuacuaggggagaaaaacuauuucaaaagaaaacuauaaaaauguaacacuuaaauguuuccaugauaaauauguaaagaaaacuuagguucuaucaggggccaaguuguaggcucugugggccacacugcccaauaggccaugcugggacaccagccuuggaugauggaaccagcaggacggcugugauccuacaaaauggacucacugacacagacgccagcucuuguccucuagggucacguccugcaagcuaagcucccauccugacuuaacagcaugacgugcagagacgcguguucucagugcacagggagcagaggcuccagcccuaccgugccgucccccucucccaggugaggccccagcccuaccguguuguccuuccucucauaggugagguucagcugcagccccaugcuggccagcaggcaggucccguuggugccgcucacguuguacuuguccacagaggggcucuugggcacgggugagggcgaggggcuggguggcgcagggggcgcugugguuggggaaggccugucuuguucacagcgugucucugcaggugcaguggagggagauucaggucuggguuucucauaaccaucagcaguuacaguaagauccaaacucagaaacaaaacuacaucuguggacucuggcguccuuggugacuauuuucucagucucccaagguggcucucgcuaaugccuuucuagacgcgcaggaaagagcuggguccugcagacggcucagggcgguaggcacaggcccguggggcacccucagccuccaccucccacuacccaggacgguucugccugggcagcaggcaccgcccaccacaccccaagccccguggcuggacaggggccacugugccacccucuuccuaaagugagggugagaaagccuugaacgcugucacgaaggaguggacgcaggaagcugugcugcguggccggccaccucaccccaugggaaauggugacgacucagacacugcucccugagcugucgggugagcgccaggaucgugcuggaaacacuacccagagggaaacagagggucugcagcacacacagaccggccaggugggacgcagagcagccaaggaggcccucuggcaggacaggggucaggcagucuccaugaggaccccacgugugagcagagacucaaaggcgggcaaggcuagccagcuguguugggucuucauuuggggagggggcugugggggaugggcaagcauccucacgagggagaaggcagugagugugggugcgucugaaauccccagacaagagggcacaguucagggaauccgugggggugggggggcacauggcaccccuggggaaugcccagcagucugaaugugacucuguccuucagcaauucacccaccaagauguucacaacacaaauuuauauucaaagucaagacagacugaacccuagguagagcucuaccgagucuucuguggccaacacucucacuaacacaccaucaaccuugaaaucagguucuuucuuuuaccaccuuguuucuguggauacucaagaauaauauuuauauaauuuccacccaauucgauccuuuccacaucucugcuaggcugagucaccacgcgugagccccacauauccagggugggcaacccugcagggaaucugccacucauaacuccaucagucaccugcugcuuccgcuuccaucucaacauucaguggccaauucccaccuucauaucccaucuacucagggcaggaaagagacaggcaacgucgccuaugacugcaccccaacggguucugagacacacacaggagugcccccgcaccccgguguaaaagccccuucuggacagagcacaagauggcagagaggagcugcaguaaccacaccaaacucugaagugagaggcacugacggccacugggagccgucccaaccugggaugugcucagggacccuugcucacugcccuuggcgaagcugcagguugaccaguccuuuccaaaacagcuucacuugcugggcgcaguggcucaugccuguaauuccagggcuuugagaggccaaggaaggaggacugcuugagcccaggaguucaaggccagccugggcaacauagggagacccccaucuccacaaaguuuuuuuaaaaaaugagccaggcaugguggcaugcgccuuaguccuagcuacucagaaggcugacuagggagggucacuggagccugggaggcugaggcugcagugagcaguuauugugccacugcacuccagccugggagacccugucucaaaaaaaaaaaaaaaaaagcagcuucacgguuccuuuauaaaauguuacagaccaggguuaaacaggcaaaaguuaaaugugcaaaaccggccagucuuguccaaauucuagucuagauggccacacgacgcacagaaaaaguguaaccuacgcugcuuugacaauuguuuuucaccugugauccauguggcacauucauuucccacccuguuucuguagaguggucacaagaagcuggaaacacaaauaaaacaucaucaggucuaaccaccaguuuaaaaaacuggaacuugagaaauaaguguggauaaaaugcccucguccuucuaccugaauuacaaacgcaaacccacacucuccuucccugaaugcguacuaaauaccaaagucuuuccugcugagggcggaggacagugacggagagcucaucacggaacgcacuggagagugcccugcgcugcccggggggagaugguggcacaggagccucuggggagaccugaggguccacugucacaccuccuccagcacccuccggagagcagcacacagccgggccuuuccaaagcucaugugcucugaaggccccuccuccucucccggcaacagcagauacucacaucaaccugcaagcugcaauucagacccucaagggugucugugaggaugagauugguuugcacccagguucccgacucauagcucccacagccucucuuacaguuuuuugugacaauguugggugugucaggccucugaccuucuccugccccuuucaccuguccugagggacucucauccucuccgccuuucugaugguaguucuuuuuuuuuuuuuuugagacagagucucaguugcucugccacccaggcuagagugcagcggcgccaucucagcucacugcaaccuccaccuccaauguuuuaccaucgauuccuuccauuuaagcuaggagucagacucuguuccuaggaaugaaaaaaaaaugcugcagcugggcacgguggcucacgccuguaaucccagcacuuugggaggccgaggcgggcggaucacgaggucaggagaucaagaccauccugguuaacacggugaaaccccgucucuacuaaaaauacaaaaauuagccaggcgugguggcgggcgccuacagucccaccuacuugggaggcugaggcagaagaauggcgugaacccaggaggcggagcuugcagugagcagagaucacgccacugcacuccagccuggggugacagagcgggacucugccucaaaaaaaaaaaaaaaaaaucaugccaaauugggugggagaugagacacggugaccuucauuuucaacuccuaacaggagucaggcaguccucugauucauucaacaagcgugcaccuaucagacccugaggauaaaagacgaagacaccccacuccucccggugaacucauaaacccaaaagccuggcugagccucacuguagaucugcuaaccccauaugggccugggcuggaaauccgguuuggauggauaucuggcugacuccagccucaggcagagcugcacucagacccucuggagugacagucaucugcccuacuuuguuuuuuuguuuuugagauggaaucucacucugucagcugggcuggagugcaguagcaugaucucagcucacugcaaccuccaccucucggguucaagcaauucuccugccucagccuccugaguaggggggacuacaggcaccugccaccacgcccgacuaauuuuuauauuuuuaguagagacggguuuucgccauguuggccaggcuggucucgaauuccugaccugaggugauccacccaccucgaguucccaaagugcugggauuacaggacugagccaccgugcccagccacaugugcccuacuuugaagauacucaggaaggaagguacaaaaccaacaggaaaguccauucaaagguggcuugugcuucauuuccuuuuaaaauaaaaucuaugagguccccgagcuuuuuuagauaagaugauguauugaaaggcaagaugggccgggcacgguggcucacaccuauaaucccagcacuuugggaggucaggagcucaagaccagccuggccaacauggugcaacgccccccucuacuaaaaauauaaaaauuaaccagacguggugaugugcaccuguaaucccagcuacucaggaggcugagggaggagaaucgcuugaacccgggaggcagagguugcagugagccgagauggcaccaccgcacuccagccugggcaacagagcaagacucccucucaaaaaaaaaaaaaaaaaaaaaaaaagacaagauacaugaggcuuucuggugaagcgccacccaggcaggaagcccagccuccaggacgccgcgccccaggcacaccggcaucuccacgcugguucccuccaggaggccccgccccaggcacacuggcaucuccgcacuggcucccuccaggaggccacgccccaggcacacgggcaucuccacacugacucccuccgggaggccacgccccaggcacacgggcaucuccgcacugacucccuccaggaggccacgccccaggcacaccgacaucuccacacugguucccucuaggaggccacaccccagacacaccgacaucuccacacugguucccuccaggaggccacgccccaggcacacgggcaucuccacacugacucccucaggaggccacgccccaggcacacuggcaucuccacacugguucccuccaggaggccaugccccaggcacacgggcaucuccacacugacucccucuaggaggccacgccccaggcacacuggcaucuccacacuggcugccuccaggaggccacgccccaggcacaugggcaucuccacacugacucccucuaggaggccacgccccaggcacaccgacaucuccacacugguucccuccaggaggccacgccccaggcacacgggcaucuccacacugacucccucuaggaggccacgccccaggcacaccgacaucuccacacugguucccuccaggaggccacgccccaggcacacgggcaucuccacacugacucccucuaggaggccacgccccaggcacaccgacaucuccacacugguucccuccaggaggccacgccccaggcacacgggcaucuccacacugacucccucuaggaggccacgccccaggcacacuggcaucuccacacugguucccuccaggaggccacgccccaggcacacgggcaucuccacacugacucccucuaggaggccacgccccaggcacaugggcaucuccacgcugguucccuccaggaggccccgccccaggcacacgggcaucuccgcacuggcucccuccaggaggccacgccccaggcacaccgacaucuccacacugacucccuccgggaggccacgccccaggcacaccgacaucuccgcacugguucccuccaggaggccacgccccaggcacacgggcaucuccacacugacucccucuaguaggccacgccccaggcacacgggcaucuccacacugacucccuccgggaggccacgccccaggcacacgggcaucuccacacugguucccuccaggaggccacgccccaggcacacgggcaucuccacacugacucccucuaggaggccacgccccaggcacacgggcaucuccacacugguucccuccaggaggccacgccccaggcacacgggcaucuccacacugacucccucuaggaggccacgccccaggcacaccggcaucuccacgcugguucccuccaggaggccaugccccaggcacacgggcaucuccacacugacucccuccaggaggccacgccccaggcacacugacaucuccacacugguucccuccaggaggccaugccccaggcacacgggcaucuccacacugacucccuccaggaggccacaccccaggcacacugacaucuccacacugguucccuccaggaggccaugccccaggcacacgggcaucuccacacugacucccuccaggaggccacaccccaggcacaccgacaucuccacacugguucccuccaggaggccacgccccaggcacaccggcaucuccacacugacucccucuaggaggccacgccccaggcacacuggcaucuccacacuggcugccuccaggaggggcaaguggccagggcugggcugucgggccuuuuuccauuuggaaucacaugcguguucuccauuaaaaaaggaaccaacguccaggaucuggacacagaggaaggcuguacaugcgcagcggcagagaauacacagaaaccuaagacugcucuaaaaaauagucuaucuuaaaaguaauuauuaaccugaagaaacagguuucucaaaagaaccuagcaagcuucucuggaccugugaagccuuauuuuucaucuagagaauccugccacccgucucagggcacucaacauccuugcugaccuccaccuagcagcccuucacuuccaggcaggagugagugagcggucaugccaugcgcaccccucggucacagagcgacauggggaggagacacguucugcaaccguguccaggccuagccaguagggaguccccggacaaggucagcauccaauucucucucauuucccaagcucugacagagagugcgugcccuuccuuuuccucuucaagccacauugaugcagcccagagguagccagcuagguguggagcccagauaauuuggaaaucgauaaccgugaacacuagucacccccauguguuacgcuaacucccacuugguagggagcacugccccuagcugaaguuaucuuuagcucuggcugaggugugucugagagcaugaacacaccuagacaggcugccaggcguccguccucagacacacgcggcccaugugagaggacucuagcccgcucuuccugaugaagcagacacgacuccaggcuccgugugaacagaggcugcaccaggaaagcggcugucaccacggcccccggggcccuguguugaggauuaaaggcagcagcaccuacagaggacccagcuccuaaguguguuuccuuccaagccuccccuaugggagcccacguggccccaucaagucccagucacacccgggguuuccaaguugggcuccuuuucacccacucaccagggaaggcaaagucugccgcaaagcuacagacaguaaauauuucagacuuugugggccguggcucucugucaagacaacacagcccugccacuguuaauacaaaagcagccacagauaauguguaaauaaaugaguguggcuguguuccaagaaaauuuaacuuauggacacugaauuuuacauaaucuuuaugugucaagaaauauucguuuucugauuuuugguauguuacauuuauaaaucgaaaagccguucuuagcucaugggcuguauggaaauuggaggugggcaagaccggcccagcaccauggggugccgaccugcaagaguaccugcuccucggggaggagugagacggacgauccuccuguggagcccagcagucacuccucagccuuuaagcaagacugcugaggaauguugcaaaccaaaggucuccacaguagcucucaagauuagagaaggcugugaugucuccauauauuucuagcagccaggaaagcccacccuaagggaugucuccauacauauuucuaucagccgggaaagcucacccuaaggcaaaucacaggcccucacgcuucagcaaaaugacaacaaccuaugaccuggacugugaggcucgggagagaagcuccucaaaaguaacaggauuuaccaggugcuugcuacuuaacucugugccagaugcugagauacacauuuugcauacauuucucuuuuaauuccaacaaccuuugaagacaggcuuuuaaucucaugccacaugcaaagaaaaugagagguaaacuacccugcucaagaucacagggcuaggagguggccuggacccugccugaccccagagcccggcggcuggguuagcagguacaucaucgcagcccugaccuccucagagaggcagcguuggucuuucugcaccugucccuaagcuggccggccagagcuggauggagauaagacuaugucucugugugaaggcaacuggcucaaacugcaagagaucugugacccuggucccaucaucucugccccaguagaagcacaaagguuucaacugcuuugcccuucugacauuuucaaguaauaauuguauacguuuaccaugugugucaggauguuuugaaauacaccuacaugugugacagcuaaaaucaaacacuuacuuuuuuauggugagaagaguuaaaaucuacuuagcaauauucaagccagaauacauuauuaacugcagucacaugcuguacuaauuccuccugucuuccggaaacgcucuaucuucugaccaacuuaaccccagccccuggugaucaccucucucucuacccgccccccgccgacucccacugcuuuagcucccacgggagaccacacaacaucugucucugucccgggauauuucacuucaauauuccacccuuuuuaaucaacaugugucuacccucaucuacaagucaccugcccuaggaagaaggaugagaacguucugcagagacgucgccggcugugugcacacgcguuccaggcagagcccagcaccaggacacagagcagugaggucacccgcagccacugcagcccagcuacccaaccacuagcaccagagggccaagggucagcguccuaccuccccggcugaagcugcuguuggaaagguacgccuggaugguggcaucauggagcguuacggucacguuguucauguggaccugggugccacuaacacaucuguauuuuuuaucuauaucugcccugaugucaguuauagauuccacagucuugauuucuagauuaaaaaaaaaaaaaaucacaauugcaaacuacuugcaguacuuaguuuauguguuuuuuauuuuagcccugaugucaguuauagauuccagucuugauuucuagauuaaaaaaaaaaaaucacaauugcaaacuacuuauaguacuuaguuuacuuuauguguuuuuuauuuuuuuugagacagagucucgcccugucgcccaagcuggagcacaguggcgugaucucggcucacugcaaccuccgccuucuggguucaggcgauucucuugccucaaccuccugaguagcugggacuacaggcgcgcgccaccacgcccagcuaauuuuuguauuuuuaguagagaggggguuucaccauguugaucaggcuggucucgaacuccugaccucaugaucugcccgccucggccucccaaagugcugggauuacaggcgugagccaccgcgccuggcuguguguuuuuuauuuuuuagagacagucucacuuggucgccuaggcuggagugcaguggcaccaucucggcucacugcaaccucugccuccuggguucaagcgauucuccugccucagccucccgaguagcugggauuacaggugcccgccaccacaccuggcuaauuuuaguauuuuuaguagagacaguguuucgcaauguuggccaggcuggucucaaacuccugaccucaagugaucugucugccuuagccucccaaagugcuaggauuacaggugugagccaccacacccagccuguacuucuuagguaaaaguaacuuuagacaauccuccaacccaauuuucuaucacuucauaaucggcccauuuugguucuuaccuuuggagcucgcauuggggaaaaggugugugucugacaaguuauaaacaaaacucaugagcuggacgcuguaacguguugcauuucucgugaaauugagagugaguguauguccucuuccaaaagcaaucacgagacuggggucagaaguguucucuuuuccacaggagcugcgguugagcaccacuguggcaucugauggcaggucaaaggucauguucuagaauaaacacaauuaaauguaacccaauugggaugcagguuauuaaaaguucaaagaaagagauuuucuguaagucugauauaaacuuauacuucauuuccaacuaagauaucacuacugagguacucauuuuuaauauaaaccaaaaaaagguuaguauuacaugucaguaaaagacugaaaaguauuucagguguaagagaaaguuggcuuaauaauucauauaaucaaaaauuugcagcugggcaugguggcucacaccuguaaugcuaacacucugggaggcugagguggggggauugcuugagcccaggaguucaagaccagccugggcaacauagcaagaccccaucucuacaaaaacaaaauaaacuaaucagacaugguggugucugccugucgucccagcuacucaggaggcugaggcaggaggauugcuugagccuagguuugaggcugcagugaacuacgacugcaccacugcacuccagccugggcaacagagcaagacucugucuccaaacaaaacaaaacaaccccauaaauucauuuuauguuaauauaauuuauaacagaauuuaaagcgucuugaaauugaaacaauucacaccagcuucagggugagauauauauuugagaaaagcuaucacuacuuuuuuacuauagaaauguucauuuaaauaauguuucuuuaaacaaagaagguguuuauagcagaaauguuuaaauuuacuacuauaagcaaaacgagcaacuggaaaaccacuuaauguucaucaaaguaaacuagauaggucaaaugaacuacagugaagcaguauacuaacgugggccaaaaaacaacacgaaacuacacaaggugauaaagacauguucugugaaauaacaaagugcauaacagcauauaggugaccucacuugugaaacauaauuuauaauagaauauuuaaaaaauccaaccaccaaaaccaaacauuaaaaaagugauguagaaauuaaauaaaaagugcuuggagaccagguacgcugggccacgccuguaaucccagcacuuggggaggccgacgugggaagaucaccugaggucaggaguuugagaccagccugaccaacauggagaaucccugucucuacuaaaaauacaaaaauuagcugggcgcaugccuguaauccuagcuacuugggaggcugaggcagaagaauugcuugaacccaagaggcagagguugcagugagccaagaacgcgccauuguacuccagccugggugacaagagcaaaacucugccucaaaaaaaaaaaaaaaaaaaaaaaaagugcuuggaggccagguacgguagcucacaccuguaaucccagcacuuugggaggccaaggugggcagaucacuugaggccaguaguuuaagaccagccuggccaacauagcaaaaccccgucucuacuaaaaauacaaauaauuagcuggccaugguggcaugcaccugaugucccaccuacugaggaggcugaggcacgagacucacucaaaccugggagguggaagacacagugagccgagaucuuggcacuguacuccagccaccugggggacagagugcaacucugucucagaaaaaagaaaaaaggcuuugacaaguauuuauaauuugagacuggauuuuuuuuuuuuuuuuuuuuuuuuggagauggucucgcucugucacccaggcuggagugcaguggcaagaucauagcucacugcagccucgaccucacaggcucaagcaauccucccaccucagccucccaaguagcugggaccacaggcacacuccaccaugucuggcuuuuuuuuuuuuuuuuaaaaaagagauaagaucuuacuaugucuuggauuuuuaaaauauuuuguuauuccaaaaggcuuuagucaucccaaagaaacacaaagccauuucaacaaaaccacuaaggaacauuuuaaucaaacuaguacaguguuugcauugcaugucaaccaaccauuuauauacauuucuugcaguauaacucucuaaaucaaaaaagccacauucacagagcaugaaaaagauucaagacaacuuaccaauuacuaauaggggaguguguaacaaauuauggugaauuaacauaauaaaguauuacauuaugauuauaaaagacaaucacgaagaaaacuagagcugggagggguggcucaccccuguaauuccaacacuuugggaggccaaggcaggcagaucacuugaggucaggaguuugagaccacccuggccaacauggugaaaccccgucucuaccaaaaauacaaaaaucagccaggcgugguggugggcaccuguagucccagcuacucaggaggcuaaggcaggagaacugcuugaacccaggagacggagguuguggcgagcucagaucguaccacugcacuccagccugggcgacaaaccaagauuccaucucaaaaaaaaaaaagaaaacuagaaaaauguugaugauaggcugggcgcgguggcucacaccuguaaucccagcacuuugggaggccaaggcggguggaucacgaggucaggagacugagaccaucaaggcuaacacagugaaaccccaucucuacuaaaaauacaaaauauuagcugugcgugguggcgagcgccuguagccccagcuacuggggaggcugaggcaggagaauggcaugaacccaggaggcggagcuugcagugagcagagaucgcgccacugcacuccagccugggugacagagcgagacuccgucucaaaaaaaaaaaaaaaaaaaaaaaggaaaauguucaugaugaacagugaggugcagcacauauacagguuuguuacugugccuguggcuauggcacaugacagcgcagguuacugacaacaccagaaggagauaugcagauaggaaaagcaccauguucagauggggccauuuuucaaagacuugguugaaauguuaaaaaucaucuuuccacacacacaagggaagcaugaagugcccugguguuuccuaccuuagggccacucuuggugucguaguucacugagaaggcagcagagaaguuggccauuaugcacgcggucccguugccauuuuucaccauaaacauugcugcugacgcacaaugcaugaggccugucaauuccagggaagacggagaccaucaaaaacuguccagaaaauacgaccgaguauuuccauuuuccacagcuguagcagugauggcuuuuauuacaagauuccacuguuucucuuuuuuuuuuuuugagacggagucucacugucgccaggcuggggugcaguggcgugaucucagcucacugcaaccuccaccucccagguucaagcaauucuccugccucagccucccaaguagcuggaacugcaggcacgugccaccaaacccagcuaauuucuguuuuuaguagcgacgggguuuugccacuuuggccaggcuggucuugaacuccugaccucaggugauccacccaccuuggccucccaaggugcugggauuauaggugucagccacugcacccagccuccacuguguuucuuaaauucaaugaacaaccagacacauggauuacgcagccaguucaccuggugcccugucccuuucggauacuauucuggaauuguuaucucuaagcccaucugauugaguuugccaaccuagucuauugcuauuuagugcuuuauuccagaacacuuaucaggaaggcacaugucaauuucugcaucauccuaggcauacgcuguuccgccuuucucagaggaucucuguaagacguggugccuugaaggcacaacucacccaucugcagaaauccaugggagaggcugcaggaucuuucacugugguccucaccugcuacuuaacgucuggucaguuuuauuucucauggacucaaagugcugagcucuuugcccaauuucagaaagguccucacagcacuacacaucgguggaguggcuucccuuccccauccugaagcaaagggacagaauggaagcucuauaggucuuuccagcuggacaguggucacugcuaaauauuuccucucugacuuacucauacuccacuucccugaucaagauguuuggcaacaaauguaaucugaucacuacgguagagacacugguaauuguacaaauugcacguuauuacacaguucuuucauuacagauuggaaaacagguguuucugccuguucuaacgccaaacaccuaucugccaccacuggaauccgugcagaaaugacaugcuuucacuugucucugccacuacaaguucgugcaugccaguccagugagcacucaccacccaggggcugaucucacacugcgugagcacagccuuccaaccacacacacacccgagucucaucugucacucuaaguguaaaugcaacucaggcacacugugagggcagauauugaaagagaggaugcuuagcuuuucauuuaaaauccuauucccuggaaaaguaauggauuccaaugaauccgacucauuucaaccuugggucuuucacaaaauaaaaucuuuacagcaacuguucuucaagccuaaagcgaagcauauaaccagaaguagucccaccuaucuucccuuugguaaaggaaauaccaaaaucuauguccauaaagaaaaggugcugccgggcacaguggcucacgccuguaaucccagcacuuuggugggaagcugaggcagguggaucaugaagucaggaguucaagaccagccuacccaacauggugaaaccucgucucuacuaaaaauacaaaaauuaucugggcaugguggcaggcgccuguaaucccagguacuagggaggcugaggcaggagaaucacuugaaccagggaggccgagguugcagugagucgagauugcaccacugcccuccagccugggugacaagagcaaaacucugucucaaaaaaaaaaaaagaaaaagaaaaggugcuacacgacaaugaaacaaaguagggcgugcaaggaaaccuccaaucuacugucugcuuugcuugguuuuucaagccacacucugcaacacugaggcaggaucauacuaacggcauuuccaaugaaucuagagaaucuagggaagauucuaccacuuauuuuugacauaguaaagguuucuaaaaacagacaaaauauucucacucuugugaaagaucagaugaguguacagaagcuacagcagacgccagcaaggcagaagcagcggacaggcagacacagcagacgccagagacuuaacacuugacuggagcucagcguggacagggagacugcccaccccgcccucaggugaggagucacagggcccacagucaccacugacaacccggaugcccacaugggagcagccauaggcuggcuuuuauuaagcugcccuuuuauaaguuuccucaaacacuuuucacugacccgaagcacuucauuaggaaauauuucaaacuaagucauuuuucaauuauacaauuuuuuuuucacuuaguaaauaugcugaggguuucagcuuuuuuauuuuuauuuuuuagagacugagucucacucuugcccaggcuggagugcaguagcccuccaccucccagguucaagcgauucucgugccucagccuccugaguagcugggacuacagguuuguaccaccaugucuggcuacuuuuuguauuuuuaguagagacgggguagacaggguuuugccauguuggccaggcuggucuccaacuccucgccucaagugauccaccugccucagccucacaaagugcugggauuauggguguaagccaccaugcccagccaggucucagcuuucagaggaaaacaaagaaauaucauuuaaauaaauuuaaaguaagcuuuggcagcacaagaugccuguauuacucuggagagacccaggaauuuugaguuauuaaaauaaacuuacccucagaaggcaauuuugguauagaagaaaauaagagcaucagcacacagagcuugaggaggaaauguauguaugcuauaagggucagaaguuuuuuuaaaaaccuccacaacaguggcaacuggguagcaaaaaaaaaaaaagacaaaaaaccucaaguaaguuacaauguuuccaguaaccugacaggugucacagcccaacaggacagccguuggcagcaucuccaaggugggcacccuggccuacuggugacugcuaucuccggcaguccuguacucagacacgaacaggaccacuucuccagggaucacauaaaggaguaacuguggcuucaaaauacccccacuugggagaaauucuguucucugaaacaagugccgcugugggaagcaugcgugcuucugagucacagcccucaguucuuggagguucuugcagcacuuacuagcugugcaaccauggccaguagcagagcccaauccccagucucugcacccacgagcaggaggagagagugccaaggccucagggcugucggagcagcugagcauuuggugcccggcacugacgccagcuuugaugucagcuguuauuaaacaucugcacagguacagaggguucccaucaaguucaucauucaauccucaguaucugacacaaaacaucaaaaacuaucucauuuaacaagcacuuggaaugcacuuacuuugugccaggugcugcucuaagcacaucccaguuaucaugacaacucuucauagggagauuaaggcauagagaggucaacuaacccacccaggucacacagcuagugaguggcggagaccuagaucuagaaggggucuucugacucacaggacgugccacuucugagccacgcugccucuccagcacuugaugacugagggaacgggcuuccaaugaggaaacacuggcugggugcaguggcucaugccuguaaucucagcacuuugggaggcugaggaagcggaggacugcuugagguuaggaguuccagaccaggcuggucaacacagcaagaccuugucucuuaaaaaaaaaauuuaauuuuuuugaauuaaaauaaauaaaaauuaagaaauacucgcuuuugacauuaaagauuaccaucugaagaaaugaguaaaaaacuucauuuuaaaaaauuaggccgggcacagcccguaaucccagccuguaaucccagcacuuugggaggcugaggcaggcggaucaccugaggucaggaguuugagacuagccuagcuagcauggugaaaccccgucucuacuaaaaaauauauacaaaaauuagacgggcaugguggcgcaugccuguagucucagcuacucgggaggcugaggcagaagaaucacuugaacccgggagguggagguugcagugagcugagaucgugccacugcacuccagacuggacaacauaaagagacugucucaaaaaaagaagaaaaaacaauuuauuaagaaauuacaucuuaggcugggugugguggcuaccgccuguaaucccagcacuuugggaggccgaggugggcagaucaccugagguuaggcguuugagaccagccugaccaaacauggagaaacccugucaccacuaaaaauacaaaauuagccgggcaugguggcgcaugccuguaaucccugguacucgggaggcugaggcaggagaauggcgugaaccugggaggcggagcuugcagugagccgagaucgcaccacugcacuccagccugggcgacagagcgagacuccgucucaaaaaaaaaaaaaaaaaaaaaagaaaucacaucuuaguuuuucuuggcuugauucuuuuaaauaugguauuuuuauucuacuuaaccaaugaugcacaaucauuuaugaagaacuaaaggaaaaaaauaccaucccaggcacugaaucacaaccucuagaggcaagguauaaguguguguguguguaaauauauauauauauauauauauauauauauauauauauauauauauauuuuuuuuuuuuuuuuuuaaauggaaacagagucucacucugucacccaggcuggaguccaguagcaugaucuucgcucacugcaaccuccgccucccgggcucaagcaauucuccuaccucagccuuccaaguagcuaugacuacagggguacgccaccaugcccgacuaauuuuuuuuguauuuuaguagagaugggauuucaccauauugcccaggcuggucucgaacuccugagcucaggcaauccacccaccucggccucccaaaguguuaggauuacacgugacagccaccgugcccggccguauauuucuuuuuaauuuuuuuuguagagacacuggucucgccauguugcccaggcugaucucaagcaauccuccugccuuagccucaaagcacugagaugacaggcaugagccacugugccucgcugugguauguauauuucuaaaaagcugaucguguggauccgugcauauguuugguugagagccacugcuauaaaauugauccuuucuucauauauguacucagcacuuacuaccugucaguuaaggaagggagauacacaggcaaaaauaaucccagugcagccgaacagauguuaccauguagaagcacaugcaauaaaagucuuggguacagagaagaaaggguaacguugucugggauggggcuaaugcaauacaaauucaaaauuacagggcuacaaagacauucugaccucaaaucugcugacaaauucauucuuuccaccgcauaacugacaaucugcacaaucaaagguaacaucgguuaguagaaaaaaaauuuuuuucuuuguuuuuuugagauggagucucgcucuguugcccugaagagcaguggcacgaucucggcucacugcaaccuccaccuuccggguucaagcaguucuccugccucagccuccugaguaacugggacuacaggccugugccacuacgccuggcuaacuuuuuaaaaauauuuuuaaaaagaauagagauggaguuucaccauguuguggccaggauggucucgaucucuugaccuagugaucggccugccucagccucccaaagugcugggauuacaggcaugagccaccacacccagcuuuucuuucuuuucuuuuucuuuuuuuuuuuuuuuuuuugacauugaguuucgauuuuguugcccaggcuggagugcaauggcacgaucucagcucccugcaaccccugccucccagguucaagcaauucuccugccucagccucccacguagcuggaauuacaggcgccugccaccacaccacgccuggcuaauuuuuguauucuuaguagagacgggguuucaccacauuggccaggcuggucucaaaccccugacuucagcugauccgcccaccugggccucccaaagugcugagauuacaggcgugaaccacugcacccagccgaguauaaaauuguucaaaccuccuaagugacaguuguucaaguggaaaggguaaggcggucauccugcugacaucaaugguuuaaagggucacauuacgcaaucacagcuaauccuaucuaucaggacaaguuucaguucauguuugagcuuucuaaguauucaaacacaguagcuuuaaacaaugccuaauuauuaauauaguggaaauuuguaauugagcaguuucuuuuuuuaagaaaaaaggauuuuuggugaaaucgcacauuaaaauaaacauuuuaaauaucuuuaaaugcaaguuguuaaaaggccuuuuuuaaaaguuggauuuuggcuaggcacgguggcucauggcuguaaucccagcacuuugggagucugaggcagguggaucacgaggucaguucgagaccagccuggccagcauggugaaaccccaucucuacuaaaacuacaaaaauuagccaggcaugguggcgcgcaccuguagucccagcuacuagggaggcugaggcaggagaacugcuugaacacaagaggcggaggcugcagugaacggagaucacgccacugcacuccagccugggugacagagugagacucugccucaaaaaaaaaaaaaaaaaauucuugggccaaguacgguggcucaaacccguacucccagcacuuugggaggcagagggaggcggaucacgaggucgggagaucgagaccagucuaaccaacauaguuaaaccuagucucuaccaaaaauacauaaauuagccuagcauaguggcgggugccuguaaucccagcuacucaggaagcugaggcagaagaauugcucgaacccaggaggcagaaguuguagugagccgagguugugccacugcacuccagccugggcacagagcaacuccgccucaaaaaaaaaaaguuaagauuguaaacauaaaagauauaauggaacagaucuuagaagacugauuacacaagcaauauuccaaucacaauauuagggaguuauggauuuuuucucuucauuuuuaaaguuaauuuuuuuuuuguuuugagacggagucucccucaguugcccaggcuggagugcaguggcuugaucucagcucacugcaaccucugcuucccggguucaagcaauucuucugccucagccuaccaaguagcugggauuacaggcgugcgccaccaugcccagcuaauuuuuguauuuuuguagagaccggguuucgccauauuggccaggcuggucucgaacuccugacgccaugauccaucugccucggccacccaaaguguugggauuaaaggcgugagccacugcucccggccugaagugaguuuuuaaaacaugaaacaaaacaucaaaguuaugaggcuugugagcaucuguaacaaagaacaaugcaguugcugugacaugacaaaacuuguuucugcaacuccuuucauuaacuacaccugacccugucgcaggagcugagcaaggcuucaggcuuacuauuggaauaaguucaucucuguggcuauucaggcaguucaaagaauucauuuuacacaacaggcaaaacaaaaaagggaagccaagauccauucacucacaguaacagaguuuuacagcuggaugggacugagggauuuaaagaagucaaggcagauguguacaggaguguauuucuauaucuacuuaacucacacacacucccccagcuugauucuacaucaccuuucagauccuggcauuuaagauaaucuucucauauuacgggggagggcggcggggggaggaggugaaagaauaguguuggcggggggcaauccggacugucuuaaagagacagcacacauccucuuauuaagacaauaaaugagaacgaaauucacuagucaauacaauauugagcaccuacugcccaucugagcucuauaaacugacagaagagaagggugcuuccccacguguucccuggucccgcauuucggccuacaggaacggcgcucuuuaaacuacuuacuagacaugaacauugccaccgugagucugaggccagcuuucccucaucuugucuacuacggaaucuugugaaaucccaaagauaacuuuaaaaauuauuuuaacauacaugugaauucacaauaacauaaauacacucgcaucuccuccacaccgcugaaagaggagaaagguucaaguacaaagguggggaaugcucgcaccggcuucucccuguccugggugaaauccauguugggaagagcuugaucuaggucacccacccgggagcugagaccacagacgucccugccaccuucggcggcgcagccucgucuagaucucaccgccucaacuugccaggaaacuuaacgaccugaaagcaccagaccgccgagcaagccaucggaaguucccuuucgcacucaccaccacagaaaaacugaguucagugagacagaccuuagaggagccagguccugggaugagaccuccuggucccccaagcaccugccauugagcuccgcuccgacccuacgaccccgagagaaacacccgcccgcgggcagagccggccgggaccaggagcagugggugcggggcgacccgcgggacaacgacccggcagucccccgcccucaagacccagggaccucggcuccgcccggucccgccgcucccaggccccgccucgacccccucaccgagcagcagcaacagcaguagcagcagcaggggucgccgggcgcugccgggggccgccauggcgcgaggcggccggguacggugcggggagcgggggcgcgggcggcgguugggccgcggacugccgggcgcugcgguggcggggcgcgggcgccaagggcuggcguuagagacagcggcguuaccagacgcaagaggcccggccacugcgacgccggcacgaagaagacaccgcggccggcagcgcuugucacgugagcugcgccgcgcccgggcgucacgugaucccgcgggucucgcgagagcgcgcgcgucgagcgccggcggcucggcuccccgca

SEQ ID NO: 191838 - RNA, 43525 nt, Homo sapiens
uuacaaagcuuucuguaaauauuuuauuuuccauauuuuagagucagaaagaagcgcuugguaauaaaaauaauagagaauuauuuucuucgagcccgcucugcgcugcgccggccuccccgcgcccgggcccacggcugagugcgcggcgucagaggccccaaguccaucucacuauuuacagauauguuacaggccgggauggucacagaggaaagcccagcucucagcauggccccacguggugaggagcccccaggcuccucccggcugucucggacagagacugagaagccugccgcgucccgugggggccuaggcugcggcgggcuccacgggggggcaggagugggccgugaugucgcugugcuuguacgccgccucguccagguccagcagccuccgguugaccuccagugucaugcagccgcgguagaacgcggugacuggcgcugaagucaccggcacaucugggccgcagggagagaacaacauaucuuagcucaccacguggccggccccgccuggcccccccacccccggcagcgcuuguggccagccccggguucccuccgaaagggcaggguuucccuuucuucucuaacuucucgguccccguucguuuggccgcagacccggcagacaagcaggaggcaucugccagccugggcucugcagacgccagcccucccuuccccgcugggagcacagacagucccaucgguuaaacgugaucuucuucugugcccagugagucauucaggcugcaggccuccuggcucgcucucauccucuucaaagcucuguuuauuaaaacuaaguggagucugugucuggcagccaagagagaaauccugccguuugccgcaagugaaaaccugcgggcagccgaggacuugccggcucccacgugccuuuccgcugacccucccagcucauggcaaggacauccccggucccagccucugugcuguguagcccaugggacacggcaggacgcccugcuggacaugggaggggcuggcggucacucuguucgcugcuaacagcugcggugacagccgcgggucccaacugcagccuggcccgaggucugcccagcccucucccccggggcuggucugauggguguggacgaaugcucccugaagaugcagguucguggggccugacucaggccaaugccggcccccguacguguuucucagucucagccaaugaccugaccagcaccgagacaccauaauagccacuaacgacccaccuggacuucuccuuccucuuaaaacacaaguccucuuccgcauucacuaccagaaaccccagccuguccagguuagaucuggggugaccaagcugggccucccuggagcucuucacccggguugagcggagcagggagcaccuaccuggcaggccgccagcaaaggugagcacggggcuccgcaggugccucucgagcacggccagccucuccugcagcugcgcggcgcucaccucgcucuggccccuggugccguccaccuccaggguggccucaccgucccucagcgagacggugaccacgugcucuuggccgucgcagaccuugaucuccauuagggccaaggccguaugcuccacggccaggaccaccagcugcaggagaccgagguguggucagggccugccggccaccccuacgugagcuguuagguccaagcugguccucacagcugcuggccaccccuacgccgcacgccugucuccguccaggguucccugcagcccugggucuggaugcucgcugacuguggaugacacccccaccccaccuggggcucagcuucucugcacguaaagccaggggccagccugggaggcugugggggaacaaguguggcccccagguugggugugagagggucaaccccagccccaggcaccaggcacacacaagaccgaggcugcacuugaccaggaacugggguggcccugauggggacccaggacccagcccugcgguggcggccucccagcccggugggcacucacgcuggcaccacagcccagcagcccaggggucggcuguugcuacauaacagcagcuguuuauuccagaugcugagauugggucuggcccugguaacgagcauuugcaugaaccaagccugucugucguaucccagcaagcgggagggcucuguggccccggggugggcagacuuggagaacgugagccucucugguuugacccaugucucccuccuuagcacacgagcgagagaauaaaagcuguuucugucaccucuugauuguucuguggggaaaacagcaugagucccccagcccaggacagcugacuuauugugaggaccggggguggggggaccuuguccaaggggcagcugcacucagcuccacccggugucccccacggaaagacgcuguugggggaccggccaaggucacagauccgacuuuuccagggaaauuggaaaacugaguuuguugcugaaaucaucugacuuaaacaccagagacuaauucagauugcugugagccaccaucugcccaaccgaacaggggaaaagcucccacacugugagccgaguguggcucgcaggcgccggcccccucagcuguguggcggugaccugguguccaaacaacccccgcagcccgaagcguggcccacgccgggcuuggcucaucagaccucuggucagaggcuuugggggucccuggggaucccaccgcgggcccccuucguccccugccagggagugcagcccacguacccgugggucgagccggucaggacgcccuggguggcggaggcccuaccugcuucuugaguuucuucguggagugauagucuaccagugccacagagagaggcacggcacggaggucgggggcccagagcgcaaacagcacgccugugucugcggcugggcggaugugagccacgacuucuacuucccagguugauucagucccgacguccagagggguccgcacugcaaugaaagcggugcauuauagggugguaugcacgguggagaggccacagugaggucggagcagggccucgagagaugcagucccagccggggugggaagcugugcagacagccccggaucugggacgugauggaaaacucaacagacugguucagaucuuggcccggagcccagaggcaccggggacccccaggcuguuucucccuggccacaccaguaccccacuuccaaaugcccuguaggugaccaccaggccacacaggcccgucugaggggccacaggcugugcaccaugggacgcaggccugucccugccucccuccgauguccucuuguuucaggagcgccugacagcuccuuccucagagcgugcguggccucgugccucgcaucucaccugcagcuuucagguagcagcacagggcccagugggggcugagaguuuaagauagcaugcggacaggagcugucaugagcacgguggucuggggucugagcugucaggagcacgcgcggucuggggucugagcugucaggagcacccgcggucugaguucugagcugucaggagcaccguggucuggggucugagcugucgggagcacgcguggucuggggucugagcugucaggagcacccgcggucuggggucugagcugucgggagcacgcgcggucuggggucugagcugucaggagcacccgcggucuggggucugagcugucgggagcacgcgcggucuggggucugagcugucaggagcacccgcggucuggggucugagcugucgggagcaccugcggucuggggucugagcugucaggagcacgcgcggucuggggucugagcugucaggagcacaugcggucuggggucugagcugucgggaacauguguggucucccagggagaaugccacggcauauccucuccacgcugagcccuccguggacuaagaagccagaagaaaaaacuuccgcccuguuuucaguguuucuaucucacccagaauuccaaaguccugauaaagaagcuguuuuaggaaaaaggaccccaaaucacuguguguacacauuugugacugggcgccucgcacugcaggccaagguuggggucagagugaauugugcugguuucccugucucuuucccacggggcuguguacgccugaaacccacaucgccuguccugccugucccuagcugguacccgccacaucaguucucaacaaccauuuauggcaccgaaacacacaaaaucagaaaaaguaacaaaaauauugcaacagaaucaaaaaguaacaacaaaaagucuccuguuugccggucuucccauaaccugugaagggagagaugaugguguucuuuaaaauggaagcucccagucgggcgugguggcucacgccuguaauccuagcaauuugggaggcugagguggguggaucaccuaaggucgggaguucgagaccaaccugaccaacauggagaaaccccaucucuacuaaaaaugcaaaauuagcugggugugguggugcaugccuguaaucccaucuacucgggaggcugaggcaggagaaucgcuugaaccugggaggcggagguugugguaugaaccugggagguggagccaagaucgugccauuguacuccagugugggcaacaaaggcgaaacuccgucucaaaaaaaaaaaaaaaaaaaaaaaaggaagcuccugacaggaggcuaggcacauguuggccaucggggcuucacaagggcaccggccucugcucuccccgggaagguuucccggcuccacguggccccuugcauggaggcugcacagacccggagaucugcaagccugagcccagcagagucgcugcagagugagccaggccaguacuaccauucccagcaagucuccucugucuuguaagagacguuacugguauaguuugagauucacuggaaaugcauggagcuguaacugcuucuguccggauagaccaaaaagggccggcagacgcggccggcagucacuggaaauggccccugugaugccugcauaagguuaccccugagaaauguguaugauauuaaguggaaaaaggauuuaagcauuucauaugacaugauuucgugucaaacauuaugaugcucuagauuuggaaguccaaaaaucaagacugagggagaacgcgugugcacagucaguccagccaguggcagauggcgcuuuucucagaugccuuuccugacacggucacgcuuuugacacccggggggagacggugacacuggaucuggcucaggacggggcaggacccuccccuuugcuccgcguggauccccuugaaccugggguuccugcugggugcuugagggccggcagcccugagaucugacggagggggcgcugccugcccucugugcgugugggggcuucaccauaaacggcucgguguccaggaauagggcagggcuguggugccccaguggggcccacguggggugggaaugugaggcaggguggggccgagcaguaacacuauccucacagcagcacccccggagccugcacuggggagggcggcagcguggcgucacaggacugggccagcagcucacauccacccuguccucccuuuuucaggccuagguucacugucccccaggcagcuucacggcuguuuuuacacaccucccauuguagcugucucaccgggucaucggugaccacgguguccaccauguuaccgagagcuucucugugccccuggacgaguccuaaggcugugcugucuccggacuuucugcaaaggacccuguaaggcucccagccuccccggccucgcaggcaccuucucuccccggccucccggcgcuggccucgcaggcaccuucucuccccagccucccggcgccggccucgcaggcaccuucucuccccggccucccggcgccggccucgcaggcaccuucucuccccggccucccggcgccggccucgcaggcaccuucucuccccggccucccggcgcuggccucgcaggcaccuucucuccccggccucccggcgccggccucgcaggcaccuucucuccccggccuccuggcgccggccucgcaggcaccuucucucccccgccuccuggcgccggccucgcaggcaccuucucuccccggccuccuggcacuggcuucgcaggcaccuucucggcacaucucucucauuucuucuucacuggcugacucugaacugagugaccugcauggccauccugagaggugggccucugcccgcaccuccgcccaccccgcccacccaucccugccccggaaccggaggagccucagcuuguccugacgcugccaucugaggccgucugcuugcuuucagcguaugccugucugaaggugcagccacagccaccccaacgguaagagccaagacuuacuguaguccaggcuguagaaggcgaagccgcucccgggguagaaagagccucucuccgucaccgagaagcacugcauccucguguucacuuucaccguuuccuggaugguggugucuucuccguucagccaguuccagcuccucaugcagccauccagacgaggguuuaucuggaaaggcagagaaaucuccguggcuuccugggagcgagaagccccaugccggaugccccagucgguggguggcgccuucgcggcccugguaugugcagcucuacggcagaaacgggccagucccaucggugguggccauuucacagaagguuucuucacuuuacacaacgccucacugcagaauaccuauuuccacugguguaugcucaagaacuaaagguucauuuuaaagcuaggaaaggacugaaaaggccaugugggucuaaggucaaagaguauggauuguucaaccauccaacacucaugugaauuauucaauauucaauauggcugugggcaaaucagggcaacccccuuaucugugaaacgaggaggguccagccaggcaaagucccggcaccaggcugucugugggccugggaagcaggugccccucacaacaccgaaggucccggcaccaggcagucugugggccuggggagcaggugccccucacaacacugaagggguggcuucagcacaggcacugccgacacucagcacccaaagacgcgaagacaugcgugccuuucuccugccugguguggaagugaaaauacccaggaugacggcuuagacgucagcacgugggggcuggagacacaggucgggggcacgggcgugugcugugcugaaggggagagaaggcgggaccuggagcaauggcccacacugaccgcccaucauggcuguuuuccccuuaugagacucacggcagaguuacaaaacccaaaauguucuuggaaauuguccaaaaaaguuuacuguucuguuaaagaauaauuucggccgggcgcgguggcucacgccuguaaucccagcacuuugggaggccgaggugggcaguucacgaggucagaagaucgagaccacggcgaaaccccgucucuacuaaaaauacaaaaaaauuagccggacgugguggcgggcgccuguagucccagcugccugggaggcugaggcaggagaauggcgugaacccgggaggcggagcuugcagugagccgagaucgcgccacugcacuccagccugggcaacagagcaagacuccgucucaaaaaaaauaauaauaauuuaauugugucuuaucuccauugaaaaauagacaacuuuauuaucaauucagaugaaaacuuaggucucauaaaaagagaugguaaaauuaaugacauagcuguacggcgacuuugucaaacucuaggaaaccuuuccuuccucuagguccuccucacaccugguuaaugguaaacacagggcagggugugacugaggcuuccugacaccguucccgggaucccagcacacggcgcgucuacacagggacagguacaguacucacaggcugcacgagguccuucucauggaagggaauaccucccacggucagguucagaugauacaguccucgcuccgguuggaacaaguccccggccaccgcgauuuucaugacagcaucccuguugaccuugaugaccagauuccgcgccagcuccucaacagagaucugaagagaggcagcgccaugagaaaagaugggagugcacguucugaaggggcucccaacugagaaaaaccacacucauccucuccugagccaagagggucccgaccucggggaggccaccugauccucaccugggccaagagggucccaaccucagggagaccaccugauccuccccugagccaagagggucccgaucucagggagaccaccugauccuccccugagccaagagggucccgaccucagggagaccaccugauccuccccugagccaagagggucccgaucucagggagaccaccugauccucaccugggccaagagggucucaaucucaggcagaccacaugauccucaccugggccaagagggucccgaucucagggaggccaccugauccucaccugggccaagagggucccgaccucagggagaccaccugauccuccccugagccaagagggucccgaucucagggagaccaccugauccucaccugggccaagagggucucaaucucaggcagaccacaugauccucaccugggccaagagggucccaaucucagggaggccaccugauccucaccugggcgaagagggucccaaucucagggagaccaccugauccucaccuggccaagagggaccugaccucagggagaccaccugauccacaccugagccaagaaggucccaaucucagggacaccaccugauccucaccugggccaagagggucucaaucucagggagaccacaugauccucaccugggccaagagggaccugacccggggagaccaccugauccucaccugggccaagagggucccaacuucagagagaccaccugauccacaccugagccaagagggucccaaccucagagagaccaccugauccucaccugagccaugagggaccugaucucaaggagaccaucugauccucaccugggccaagagggaccugaccucagggaguccaccugauccucaccugggccaagagggaccugaccucagggaguccaccugauccucaccugggccaagagggucccaaucucagggaggccaccugauccucaccugggccaagagggaccugaccucggggagaccaccugauccucaccugagccaagagggucccaaucucagggagacccccugauccacaccugagccaagaaggucccaaucucagggagaccaccugauccucaccugagccaagagggaccugaccucaaggagaccaccugauccacaccugagccaagagggucccaaccucagagagucccugcucaucaucugggccaggagggcccucgaugcaucaauguggucaccaaaaccuuuccucauagaaaaccuguaaagucuaaugcuagauacacuauauuccugagcuucagaagaauauccuucuuccugugugaaaacaccuuucagguauuuggguuugaacugagucacaaaaacaugguacaaauucgggucagcuggguuugggcagcagcuagagaggguggaauuggggagggguccucaugagguaccccugcuggggaagggccugucuugguggggugcugcggccgcugugagucacugggcgggacuacacugcaacaccgcucccccaggugaccucgccucaggccaccugcccugggccccuccuccccguggcuccauccccugcaacaccgcucccccaggcgaccucgccucaggccaccugccccgggccccuccuccccguggcuccauccccugcaacaccacucccccaggugaccucgccucaggccaccugccccgggccccuccuccccguggcuccauccccugcaacaccgcucccccaggugaccucgccucaggccaccugccccgggccccuccuccccauggcuccauccccugcaacaccgcucccccaggcgaccucgccucaggccaccugccccgggccccuccuccccauggcuccauccccugcaacaccacucccuccaggcgaccucgccucaggccaccugccccgggccccuccuccccauggcuccauccccugcaacaccgcucccccaggcgaccucgccucaggccaccugcccuggggcccuccuccccggggcuccaucccugaaacugcuucugcuuccuuugcuuucuguagcuuugcugagaacagccuccugcucuuggagauacugcuccuuuaagagguugggaaaaauggagcgaggcauugcuuugcaggauggaaauacaagucuacaauguuucugaagggcaagacgugcuuuccaccuuucuucccaacguuuccuucugcaagcccaguauggugagggaggcccagcgcugugggcgggagccugguugcuuacaggcccucucgcuccacggauggggauguggggugggcacguuuuaccgcugcccacagcugcccaagugcaggucugaccaggaccccucagguugcccauggggcugggguccagguggucaggacgucucuggcaaggggcagcucccgugaggucaccuggacccuuggcaugcauggccgcacugaccagcaggcccugggagccagggcucagggaccgcagcguccacgccguccuacagggaagggugggcgggcggcgccuggccuggccacggcccgggagacacguacggcgggagcucugggcuguggugcggguucaguggcggccuccuccccugguggggcacccugcguguagcgucaagcagcccuggcuucuguuccccacucugcucgggauaaacagcauggccuccagacacagcccaggguccccuggggcugagaaccacggguucuaccugagccagggugaccaaacucagggagaccaaacugacagguugcacucaaggccccuuucugagggagccaggcugaaacgugaugaaauagcagagaggccuagagcaccacagugagcccccagagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucccccggagcaugaacuaaacggggcagggguccccgucucccggagcaugaacuaaacggggcagggguccccguccugccggcacgcagcagaugcaggccccagagcucaucuccuaacgguugcauaagcgagugacagcugagucuggcucagggagaaccccgugaggccuggaagggguggcugccgcacacucacugucugccacaugccaugguugaugaccgggccgcugcuggugacacggccgacaccguuguagcgcagcugcagcuccagccggccggcucucagggccagcacgauccaggugcuguccugguggccuccggcaaagaggaggaugcccucggggucaaagguccggaagucaaacucagcuaccagccugggcacccacaggagaaaugagucagcacugggcacaggcagaugcccggccccucccugcuggccgaacccuggcccgggcccugugaagccagugucuuggccauucuaaguuguguugccuccuguggacaccuccucaccuggugggcugcagccucuugaagcgcagucggaucacgggggucccacugaacauccggcccagguacaaggacuucacacucuuggccacgcugaagggcacgcacggcaagauguccugccacggacgggggccacgccggucggggauguggccuucacuccugcuccccugagccccacgccccggccgcgcagcggguccacugucccuccugugccucgggaguggccaccccgccucuagcugcugagaccccagaggcugucacaccugccccacugggacucccaggugaagggcgggcuugcagcagccgcuucccacagggcuucucggggguccccgucaucuccuucccugcucauuucccuugacccuuuauuuuuaaauuaugaaauauuucaagcauacaaaaauuacagagaaucauuaaaaaguauacacuauuaugaaauagauauggaugccuugaagauggcuguccuggaaaguucccuguucugggcugugguuucuccacgcugcccgaagggggacagaaccaaagccggugugagcugacaccccuggaagauggaggggcuggggcugagccaggccugcccugcccaccgugggcagccagggugagcuggacaucucgcagggguccgacacccucugcaugaguacaugaggcagcgaggcaaagaaccucaaggcgagggcuggcuggaagcccugaacgucgcagcccagacccaagagccccacggcugcaucccaggucugcgacuccgagaagcuguccuggugacucuuuccaccugugguuuugcuuuuuaaauaaaugcucacucucaucaacccccaggcacaggcccaggcugaagaggaaagacaagagccgcccugcccagaaacguccacauguggguacugcauuccuaccggugugacaggucagugugacaggucggugugacaggcaccggugugacaggucggugugacaggcaccagugugacaggcaccagugugacaggucggugugacagacaccggugacaagucagugugacaggcaguggugugacaggcaccggugugacaggucggugugacagguacuguugugacaggucggugugagacacuggugugacaagucagugugacaggcaguggugugacaggcaccggugugacaggucagugugacagguacuguugugacaggucggugugagacacuggugugacaagucagugugacaggcaguggugugacaggucggugugacaggcaccagugugacaggccccggugugacagguaggucaugcugugacaggccccggugugacaggucggugugacagacaccagugugacaggccccggugugacagguaggucaugcugugauaggccccggugugacaggucggugugacaggcaccagugugacagguaggucaugcugugauaggccccggugugacaggucggugugacaggcaccagugugacaggccccggugugacagguaggucaugcugugacaggcaccggugugacaggccccggugugacaggucggugugacaggcaccggugugacaggucggucacguuggcucccuggcacgcggcagaguggggaccgugcccccgugagugucacacugggguccacaccaggcugauccacugugagcugggaguugccauagagacucuauaaauacaaccaaacaucuuccagggaacagaagcguuucucaucccaaaccuccacauggcccuggagauccccaacaccuuagcaaaggccaggucuucacggaaguguuucucccgaaagcccccaccggcgagggcccccggaaccaccgugaagggcccgcggggccaggggccgccuaccucacagguguccauguccugggacagcuugaggcccccacgcccgucacaguggcagguguagcucccuggggaguucacgcagaccugcucacagcggcccugcagacacucguccacaucugccagccagagggaagcggcggugagccggggaggccucuacgcugucccgccgugggaucacaccgcgauugcucaaaccacacgcaaggugcgcucaaggaauuacaugcagauucuaacgggggcggcuugggggucgcguccccccccacuggaaagcuagguugcacccucggccugcuccugcccgggcucuuucuugagggaauaaaaaugucgcaggugucccaggagggugcucccaacgagccagacccacccccgcugccgggccgguguggaaggcaggucugggaagcacagggucugggcugugcagugaggugucccccggagcacagaggggccgacagcuguggugggaaauggaggucagugcaggcagccugggcuuccccacccucucugucugccuacucagccccacuguucccaucacugggggcacggccccucuuagaggcucuacggccaacagggcccuccccauggcggcuggaaagagagaacaguagagggaggcuugcugcuccccgucccuuuggggagaggccccgucuaugcagguggagaaggguacacacguguguacaugcgguguauaugcaugugugcgguucguucaugugcacaaggggcaugggugccugugugugcucacgugugugcgggcauggugguagcacaggccauuaccaggcugauagaaacagggagaaagagacuuucuuucaccagaagcacccgguuguuagcaaccggcucgggcagugacuggcacccgugucuagacuugggcgucagagaaagcgagggugaccgcguggcguggguaccucggcaagccuucuccugggagcuguacgcaaagcccucgucacagaggcaggaguaggagccgggcagguucuugcagcgcgccuccccgcaggccuccgagucugcgcacucgucuaugucugcaagcaaaaaaaaaccggccaaccgcagcacagcggcaucucagacggggcuggggcaggcggcugcagggacuggccagggcaccacccagaggucgcauccagacucuguggggccagcgcgcccuggccccauuucccugcccuccuccccugaccgggcagcucccgggguguuggugcacgcuucugaucaaggcccggcugggaaggcugacuucagcccagcagguggagagcugggaagggcccugcuugguggagggguggggggcggcggugcacgcugugcuguuccauuuaaaugacggugcuacaggacacggggccguaaaaaguaaccccccgggggcauuugaaacuaaaaccccaaccccaaagagaagcauuuacugguuucaaucaauuuucacuaccggguuaaaccacaauccuaagacuugagcaucuaaugugggacagaugcuguuuacggccaagcacccugggguaggaggggcaacccugaaaugaagagcccuuuagucaccagaggagagcaaaggcaggggcacggagaaaggugggggaggagaagggggaguaggagugggaggaggaaggggggaggggaaggaggaagaggaggaggaggagggggagaagggggagggggagaagggggagggggagaaggggagggggagaagaggagggggaggggaggaggggaggaggaggggguagggagaggauggagaggagggggaggagggggaggaggaggagggggaggaggagggggagggggaggagaauggggaagggaaggaggaggacggagggggaggaggacggagggggaggacgacggagggggaggaggaggagaagcagggaggaagaggagaaggugagggaggggugggggaggaggugagggaggggguggggaggggugagggaggggguggggaggggugagggaggggguggggaggggugggggaggaggaggagaggggaaauaaggaugggggaggaggagggggaaaaagaggagggggaaugaggaggaagaagaggggaaugaggaggaagaagaggggaaugaggaggaggagggggaggaagaagauggggaggaagagggggaguggggggaggaggagaagaaagaggaggaggaagaugaggaggaggaggaagauggggaggaggagggggagugggggggaggaggagggggaguggggagaggaggagggggaguggggaaaggaggagggggaaugguggggaggaagaggaagauggggaggaggaggagaggacgggaaugccucugucacugugggcaguaacugugagccuagacuuugccgggagugcccgacuggugcagggacccacgggagaugcuuuagacgucaucucucaggaucggccuagucuucaccucucuuuaaaccuggggugcugcugucuuccaggucagggauagagcagugaugggaggggcucuguccucggcggggaaauggguuuauguguuaagaugggaaucacgucaucugcacacagggcuaacuccuggguggucagggaagggaaccaccaaaguggacagaaauagcagcugccuuuugaaaucgggggaugggguguggccccuccugucuggucagauucacucuccagauccuggggcuguuucucccugagcaacugucuguccuguccacgcaguucgguguccuggacagucagcagcagcgcuaagaacuaugccagaaacucucagggacacgccugggcauguccagauacaacguggggagggaggaggaaggugcucccccugcaaaguggcaaagggccaguggcagcagcagcaccuggaacagcgucgggggcgcgcacauucacagugacuuucugggguguccuggggcuccccagcucuggcccugggcugagggaaccccagacugaaauaugaaaggaaguggggagggcagggcuauauuuaguggacagagggagaccaacaacggggugcuucuggggaugcuggggagaguggacggcggggggacccuagccuggagcccugacccacaagcucacuacacaagugccuggagcacuuccaggcucugugaggcucuggggaauggacgaggcccuacagccagcaguguggccucaugggcugggccggcccccugaguccuggcccucagaugccgggugagucauccugguguggugccgagcagcucccugugcugcggcuggccugggcuuguguagucucugcaggaugccccaucccauccagaaccacaggaacccagccagcagcagccgcuugcagaagagcagacaugaccgaaaauagaagguggggagaggagagaggagagaggccucaccccagggccuuaccuuggcagguccugccaucagaggagagcucgaagccgcuguggcaggaacaguggaagcuacccggcuuguuguggcagaucuggaggcagcccccguucuccuggcugcauucguugacaucugggaacaagcacaggccugaaggggagcccaagggugcacagccccuggcuacgguaggaagagaucccagaggugcacagcccagcccuggagcagggagggagcccagaggugcacagcccagcccuggagcagagagagaucccaaaggugcacagcccagcccuggagcagggagggagaccaggggucacagccuagccccggagcaggaggaagggaccccgggggugcacagcccagcccuggagcagggagggagcccaggggugcacagcccagccccggagcaggaggaggggaccccgggggugcacagcccagcccuggagcagggagggagcccgggggugcacagcccagccccggagcaggaggaagggaccccgggggugcacagcccagcccuggagcagggagggagcccgggggugcacagcccagccccgcagcaggaggaagggaccccgggggugcacagcccagcccuggagcagggagggagcccgggggugcacagcccagcacuggagcagggaaggagccgggggggugcacagcccagcacuggagcaggaggaagggaccgcgggugugcacagcccagcccuggagcagggagagagccugggagugcacagcccagcccccgagcagagagagauccuagaggugcacagcccagcccuggagcagagagggaccccagggcuuggaccucacaccccacucagcagcccuagcguuucauggccccugguccuggccuugcguguggagguagauggugggagggcaugggggauccccagcugcggucucagccuggggagcugcuggcagucacagcccacagggcucagcucccuggaugcccaugugcuugcaggaggaggcugcaggccaggagugaccucugggugccgaggacagacaaggccaggccagagcuggccacuccuuagcaaagcccucccaggccaccugugggguaggauuugccaaaggggacaggcuggccugcugggcucuccacuaugggucuccaccaggcccuggagcuauucuuccuccagggucuucacugacaccacaggucuacacugaaggacggucagaggugaaaucuccccccggccuuucaaucagugggugccacugacaccacaggucugcacucaaggacggucagaggugaaauuucccccccgccuuucaaucagugggugccacugacaccacaggucugcacucaaggacggucagaggugaaauuuccccccccgcccuucaaucagugggugcugaggcaucacuugguguuuccuuuccuuccagcccugcucccagaaaggagacugcagcuccucccaauucuccuggggcuccaggauaccucagggcugcagccuccuuggggcugucggagagcagccugaggauggccgugccccggagugggagugaggagcggggaucagggcagggucggagauggagggagaccccgccuuugucuucagccucacguaccuuugucgcagagccggcccccccagccagcuuuacacaggcagaagaaguugcccaugagguccuggcaggcuuggguccccuuccuaucgcagggguugggcgugcacuggucaggcaggucugauuggggacacaaaguggaaaaucauguucagcugccccaccccugcgcgcccaacgcagcugagaucggggcggcuguggggucucggguccagcccggaggagcucugaggggcgcaggcugaggcagccccugggcacccgagcccucugugcuggccuagggcugacagaauaggcuggcgggcccuggggccggcuccaggaaaacucagaucaacugggagggagugccagcaggccuggacgcaaggugggaagggcugagggcaaaggagcaggaacugccuggcgugaggccugggagcucagaccucccagggaguaggcacacagaacccccagcugaccugggggcuuccaggcagacucggaacauucugccuucccuggccagccccuagcccaucucuggugaacucucccugcuggguguggcggggaggaccccaggcccaggcugcacugccagagggguccuccaggaagccccccucuuucugcuuagcugcccccucuccacgugucuugauggcuuuaggccagguguguucugcccuuucucaggguggucaccugggcucagcuccugcagggccagaggucaggggaacgggugagggccugagggugggaacccgugccagugcagcugcuucccaagcagucccccauccgagaagcugcucacaaacacauucauacgaggagcugcucacaaacacgcuuccaggacacggacccaaaccacgucccagaggcaggcagggaagcccccgacagugcaguuacgcaagccugagccccgggaaguuggcagaaagaacgacaauuacacccggagcucaaagaauccuuucauggcugcuggcagagcagaagcagcucggggcugagcauggcagugcucaggggcgcgguccacacucagcucagccccacaugaggacucagccacgcucagcuuagccacacagggcuccguggggaacccuggguagggccccccugcuggcugagagagggcuccgguccauugauuccacacaaguucaauaaggaccagucccugggaaaagugcaggccgggccagcagggcccuagggcacugggccagcaucguccuaaggggucagcccuggugggggcacgucgagucuucagugcaugggcucucacugccagcgugucgcuucuguuccugaggcucccaaggugacguuucccaccaggucuguagaauguggcguuuccaccagagggucugggcucggcugucagugcaggagccgcuuccauccccaccuggccggggucaggggugcccggugccagggugagcggcgggcgggucugugguucacaaagcugaguuccuccagcucauccagggcuuacagucacugccuguggccggcacagacacagccccuguccuccuaggcggguccaggcaccgcgcucaccagaggcccuggcuacgagucccaggcuucuuggggaagcugcccaaccacacuggcuucuuucugcgacgcuucgccguaugccucacagcguuuccuccguaugccucacaguuugcuccguacacccgcguuuccuccguaugccccaguuuccuccauaugccucaauuuccuccauacgccccacaguuuccuccguaugccccaguuuccuccauacgccccgguuuccuccauacaccccacaguuuccuccauacgccccacaguuuccuccauaugcccaguuuccuccauacaccccacaguuuccuccauaugccucaauuuccuccauacgccccccaguuucuuccauacaccccacaguuuccuccauaugcccaguuuccuccauacaccccacaguuuccuccauaugcccaguuuccuccauacgccccccaguuuccuccauacgccccacaguuuccuccauacgccccacaguuuccuccauacgccccacaguuucuuccauacgccccacaguuuccuccauaugcccaguuuccuccauacaccccacaguuuccuccauaugccucaauuuccuccauacgccccccaguuucuuccauacaccccacaguuuccuccauacgccucaauuuucucuguacgccccacaguuuccuccauaugccucaguuuccuccauacgccccaguuuccuccauacgccucaauuuccuuuguacgccccaguuuccuccauacgccccaguuuccuccauacgccccaguuuccuccauacgccucaauuuccucuguaugcuucaguuuccuccauacaccucaguuuccuccgucugccucacaguuuccucuauaagccucaguuuccucaguacaccccacaguuuccucccuacaccuccguuugcuuguuuugcacaaaugacugacaacagaacacuuguggguguggacggagcucgcgucucgaaguguuucuaagaugcuauuuucagcaggucacuauaaacgcuuucuacucugaagcacacaggggcuggggcuggccuucggaguuacgaggaaacgaggaccaggaccagggauucugcaucagcacagccgccaggagccggccggggccccaucccugacacugcugucgcccggcuguaccugggugcuguguccgcggggcgucuggagacgucgauguggucauagcagggccuggaacggggaggucuggccugaacuagagaaaugaggggcguauccgcuucuccacccuggccucagaugaagaggcucugggggcaggagggagucagacacgugcagggcaggcggccugugcagggcccaacccuccggcaccagaaccugaccuccucagaggcccccaccauggagggaugucugggggaugcugugcgcugccgcuacgauguuugguuagagauuaaagccauuucagaaguggacaccugcccaugugaugcaaagggcugggaacccggucuugacuuugccuggaaugccuuucggaaagaccucugucccugaggcugagggacagugccugcuccugccaggugcccagcucuuaagcgguccccagacucaugccaccugccccggggccucccccaacucauuuguuuauuucccuguugggaauguauugauaccucuaggaugcaaggacggaaccacaccugagggguggacagucagccggugcccagcaaauaucuguggaauuuccuccacacaacagggaaagcgauggagacagaaaccucugcaggcccccgagggcacccacuucccugaccccguccaccucccugacccccgcccaccucccugauccccaucccgcaagcugggccuaggguaucgguggccuggcuggucaugcccugggcgccagcgccuguucaggaggugaaggguuuaucucagcuuggcccaugacugcguugaaggacaggagggagcggcuguggcuguggcuggaaucugaagccggugcgggcggccagggccuuucccuggguggugacgagcgaggaccagagcccugucugcccgagggaagggcgaggggacacuccccguggcgggggugggaucccgguagccggggcucagugaccgcugccugggccaccgccuguggggaccugaccuuccuggggaaacccaugggucaaaggagccgagaaauccaagcaccaaguggccgcuauggcaggacgggcgcguucgcaguggagaagcuggguguguccgugggaaaggaaagaaauggaagcagaggcucuucaggggcaccugggaacgcagccuacacucuucccaggccuccucccuccguccacugugccgccuggguccugggacagccugagggccgcaggcucccaugcaaggcccgcugggggccugcuugucuggggcugaauuuggacuuuauggggcuauggcuuuaauuucacaaugaccgauaaccagugaacugaagccaggacagcaccgugagcaccaagucagagaauuuucacgagggaaccaaugaacaggaacagagugugaggcugccccagcugcauccuccgggaggcgccuucccaagggagugcaaggcugccugcuguggccaggccaccaaagcaccuucuucaccgccaggcaucuuuugaggcacgcgaacaucagaggccccagccacgugcucuggaggagaagcugagagccccaggccacaggcagggcagccucugagggccggcucagggagaguggccggagcuucuggccuggggcagguggacccguuagaaacugcauguguugccucuggcaccagccacagcaagagauucucuuccuaucacacagggaacaaacucaaggaucuugaccuugcccuccucuccccagcuggccgcacuuggggacgcugaugccacaaaggaaauaaccaaaacaagauaacucuauugggcggcgggaacagaaaggaacauguagcaaucacuccucuucauccaugcaaggaagcgaggcgacgccuugaaaaggacggccuucuuugcugcaaauagccagaagugaacugagcaaaggaagcacgggacgcacaggaagaaaagugcuccaagggacggacaggacggugccgggguuaggaaagcgcaacacuguucagacacagucuccgauauaugaauggcaagcccaguuaaaaauaucuaaagggcuuuuuuagguuuuuaagaauauuuuuaagguuuaguuuuauuaaaaaauaagcaagacaaccagaaaaaagacugaggagggcauaggagacccacccgcgugcaugaggccgagucuaaagcuguggccacggccuguggaaacccggcagaaaaucucccaaauacccagcauaugaggacggcagcaggugaggcacuggggugagacagacucaaaugugugguguuggggcaggaacugagccugcagucuagauccccaccucauccaucacgucaaaagaaauuacgggcgggucacagaugaaaacaccuaacagcagguaacuguuuuguaaucuuggggagaagccuaaagcccaggaacuaagagaguauaacaagugugaauacagaauuuaaaagaagagacugguuuagcaaucacuaagauaaaacacgcgugacaggaucugcuugucuccucugagcacgcaggagccucugccccaaaugcagacauugggcccuacguggcaccuggcuacugugcaugguugcaggucagggcaggccgggccacagggcagggccacccucccauucccauguuuacacugagcauuuccucugccugugucucuugggcuggggucugugauacaaguccgggaggccagagacgcccacggacagugcguggggcuuggggagcgggacugagccaccucugacuccuucugcugacugggauccagcuccaaagccaugccugggaagagacuccugccucucccaggaugacuccgucccgccacgccucugcucucagcgcccacagggacucaccaagcuggacuuucaucuaaaacuagacacacgugacgccagcggaccacagacccagugcaaggggagcuguguggguugugcugaagguauguuaaaauucauacaggacacccaaaacaaucaaucuuauugcaugauaauuuuaaaauaauaaaaaagacuuguggcaagcugaaaaaauuuuugauaacuuuacuaccaauggcuaaugugcaaacuccuacaaauugagaaaaacaggcaaaaaauauaaacaacaguuuauaggaaaagaaauacacaguuuuuaaaccuaugaaggacagcuuuacucauuaguuaaaaaaaaaaaaaaaaaccugaaaugacugaugucauuucucgccuguuacauuggaagagaucaaaaguuuaaaaaaacaguucauucaccccugcaggggcggaggcuaaggcuggcucugggauaauuuggcaguaucuguauccaaaggaaacaugaggacugccucugcgauuccauccuugggaacgcaucccgcagacacucagacgugugggaggcaacaggugcaugaggaugucacgccaguuuuguuuaaaugauggaaauuggaaauaaccuggacaucagccaauaugcaugggcuaaguucauaugaugcaccggcuggaaaugccagcgugaaggugagacacgcuaagagagggucuccugugcagacagaguugcagaggcacgggacagaccgugugugcuaagccgccacgcgugugaagagcggaaggccgcucacacauguuuacaugucuaagcacaagauucuuggaacuguaacuacgguggugucugacuggacgacucagaggcggggaugggcuuucacaucacacucugugaaacauuuacauuuuguuccaugugcauuuauugccuauugcuaaaaacgucaaaauuuacuuguuuaaaaaagaaaguuuggcgaaaagggagcaggccucggcaagggaccacagcuccuuaaaaaacagaacuauucagggcccuccacaaaccacagccaagccuaaagccgcccaaacccacagugcucccaggaaggcgcaaaggaggccgacuuacuuugcacgcagguggcgaagccugaguuuuugguguacggagacccauacuuguugaugcagucugcaggaagaaagggaauggaugucagucauccuuacaagaccggauggacugcagagccucugcuucugagacgcucuggagaggcaguuacucugcuuaccuggggugcuaucauccuccagaaacaaugccgcuuagcuuguguuaauaaaaaacauguuagccccaacccugacaaacaggaaaccaccuccaccaacucagcggaguugugcacccacagucaagugcguaaagcaccgcccgccguuucgagggggcuccuccugccauacgggagaaucaccgggaaugcucaguaaguuccugacgguacucgaaaagcuaaacuucauuuuccaguggacccccauugggaaacgcugugcuuaacuggaaagccacucugcuuuggagaaagccccuccaugcucucuggcuggcugaacacagcuugacagcagacaucccgcuagggcggcggggggaggcgaggccuggcacaugcacauccagggauaacccgaagcgugagguugugcagaacggugcggggccucucgaccuggcccuucaguggguuacuguugcuuauccaggcgcagaacggcacggaugaacagcggaaggccuccugcaggugugcuguggaccgcuggccacccccugcuucagaacucaguccucgcuggugccugggcuuucugggccagugccagacccacuguguuuguuccagauauggacccagggaaggacccuuuaagaggacauuuacuaaaaugcacuuugcaacauuaaaaagaagacccuggaauacauuucucuccuucuaagugaaaugcucucaaagagcucuaagauggugucaguuaaacgggcugacccggggucucuggguuucacuuucuugcuguccucccuucccaaguguacagugggggucuccagaggccgccccacaugcaccagcugcucugauggcugagauaacgucuggcauucccguucuucaaauuaaacagaaacacuauucaguguuuucgguuuuaauuaagaauacgguaaauaucagucaauacagcccacaugaacauggaccccuuugggguccucaaugacuucagaagugauuagugcugaggucagaaaaccggaggacaaaaucaauuacacguccugacaaggagcugagccuggcaucaacucagagaagggguuugcagauaacagcauucaccugagguuccacuaacacggaauaaagcugugguauaaaauaaagagagaaacuuguguuucugaccugcauguuccggacaguuccacgugcaccaugugauuaagaaucuuccuuccaagaguuacguggugaggagauuccuccaacaugaaacacgcacccccaacuaugccucuacgacaaccagaguagagaaguaauugagacuuaccuaaguaucuuggguaaaaauaauccuguggaaaaagaaaaagaaaaggcaagcauugaccggcacacuacgagggucucugaacaacauaagcaucagcugguuaaucagaggcugcucucggggcagccagagggccgccccacccggggaacugaggggaagugaccggggcacgacugcugugagaccaacaagcaaaggcagggccauuuccagcugcguaggaagugcuaccagguguguccaggggagaggccugcccaggaggacaagaaugcuuccaaguaaaaccccacucuuaguucccuguugacauaagggucucuaaaacccaaagaccuuaguucccuguugacacaaaggucucucaaaaccccaaagaccuuucuuuuggcacacgggcauugauuugcacuuauaguauuggugaaacaaaauugguacugggugaggauggaggcuguaaugaagggucuucuuauccaugaaagcgcacugacgagguccacauucgacacaagugagcugucgaguccuggaaccaccugccugucacuuggccagcagaggccggccggaaacuucuucaggauccuuuugccauggcccacagauucuagggccacagccugguuaaagcagccuccaaucuccagcuuagggucaaccaugccagcaguuuggcccuaaaugcucuaaaccaagagaccacagucauggcagaauagucccagcggccucuccaugcuggguaugagucagcauuuuuacacuauuuuaugaaauccucacaaauaacacccaggaaggucuuuuuaaucccauuaucaggaaugaggaaacccggcuucaggaugguugugggauucaccugggggcaugaaggucaggauuagcaggcgcugguagcauuuugcagaguagcagacagaggcgguagguacccagcgccgucugcaacgcgccucuggcuucaugcgcuggcucugcauggccuuucugccuccuucccaccucucucccacacuugcuggccuugccacaccuuuugugggaagagccuggaggccccgccccagccuugccaacacccuccugaggccugcuuggauguguuuucacaaaguuguguucuaggaaagaugggaugcucuuaaacucuuacucccuuaagagaaaggaagggucagggugagcuggugugcagcucacgugucuguugggagggcggccgcccugaaggccaggagggcugcagaccuggaacacacacccucaugccugcccucauuucucucacuuccaauuuuagucauggguuggcaaacuccaagaaaaggcaagaacagccauaccaagugagcccugguggaguccuggagcaacacgaaguggcaccagguuucuaggcuuggaaggagaagggaagugauggggcuuugucucaaagcaggaggcucuggcucugaaauaaaagacuugcgagggaugcaaaagguguccuuucagguuuagaagccagggauugaaaacaacuaagaacuagugagcaaacggccuaacuauacacaaaugcuugcauuaccacagcuuuacagcaaguguguucuauuuuucaaaaucaagacuagucauacuacuuaauguguaaucuguauuaauaccaaguuuuauuguugcaaaaaggcauuauucauggaaaaacuaugccaaucuccugucaguucgccacaccuaugggaaugggguuucugaaaccacaggguuauagcccugggcacuguauccuaauuugcauguuugauuauuugagacaguaauggaggcagaaagcauaugcuaauuccaccggcaaacuaggggaaagaugguuaaaccaugagcaagagaaaagcuaagaugaauaaaccuaaaaacgcuauacacuccugagagaaagaaaaagagacauuucacauuuuccugagaacauucugguacacacucccaagaaagaaagacauuucacguuguccugagaacauucugguauacacuccugagauaaagacauuucacauuguccugagaacauucuagccaaagauguaagacccagaaauggcuuugaguaaaggcacccagauaagcucccugaccugcagaaccaaacacagagcacuuuguccucaaaacccucccaccccugucugcacuacugcuuguucagguccauaaaccuuggccugaagcccugcauuagccauaucuccagagcagcacccccaggaguccccauggagcagaggccaccacucaggaggccggaauuuagaaccaggagcuccuuauguacacacugacucucuuucuucuaaaccuaggaagagcaagaccuaugguaauggguuggcgugcugggguuaggugagggcaacagggggaagaagcugggauucccaggcuggaaauggcgccauuuggccccuggaaauccuuuccccggggaucugcuucuguuuuauuugaacagcuacagauaaaaauaagugagcaaaccccaagccacugcacuguuagcugaagcuucaagaggaaaaagacaacaucuaccugcccagcaccgagccuggugcugacugucccccagaggccucaugagccgucaccaaacacauggauggaugacagauggacaguggaugagugcgugaaagaauggaugggugaauaaaugaguggaugggcagauggaugcaugaaugaguggguggauggauggaugagugaauggaugaaugacugaacagauggauugauagauggauagauggauggauagaugcauguauggauaaaugcacagaugaaugaaugaauggauggaugagugaaucgguggauagauuagugaguaggauggaugagugagcagacagaugcauggauggauaagugaguggaugggugaauaaccagaugaaugaaugaaugaaucaguggaugaaugagugaaugggaaugaaugaauggaugaguggauagagauggaugaaugaacaaaugaaugaguggauggaugaguggguggaugaaagaaugaaugaguggguggaugaguaaaugaauggagauggauggauaaaugaaugaggauggacggaugacugaguggguaaaugaauaaaugcguagauagaugggugaguggauggauggauggaugaaugaauaaaacaaugagugaauagauggaugagugaguguaugaaugaaugagugaguggguggaugagugaguggccagaugagugaaugaaugaguggguggaugggugagugaauggaugaaugaaugaaagaaugagugaguggguagaugagugaguacaugaauggaugaguggguggauaggugaauggauggacagaugaaugaaugaaugggugaaugagagugaguagauagaugaauacaugaaugaaugaauaggugggugggugagugggugggugaauggaugagugaaugggugggugagugaguggauagaugagugagugggugaaugggugacuggauggauggagauggaugaauaaaugaaggaaugaguggauggauggaugagcgagugcauggauaguugaaugaaugaguggguggaugggugaaugaaugaaucagugggcaagugcaagggccugcaguuuucacucccacagagcacugaaugcucaguuucacuuaaaucauagauaaguacuuggaagaaaagucaaaaucaaugcucccagucuguuucuuuuaauaauauggaaguguuugugcuguaauuccucaaguuuacaaacccccacgugauuuuaaaacuuacauccuuguuauuaacugacaucugccaaacccacucuucuagguggcaagcguggugcccacugcacggaggaugcagccauuaggucucucggagguuugugugcuuugcuguucccggcagggacgacuuggagggcaacagccuccuggucagugcagggccccgucccugggugaagcagggcaggugcucggccugugcucccgaggcucuggcgcaacugugaguggcccaggauggccaugaaugcagcccaacauaaauucguaaacuuucuuaaaacaugagcuuuaggcacagaccuucuuuuuagcucaucagcuacuguuaguguuaauuuuauguguggcccaagacaguucuucuuccaauguggcccacggaagccaaaagauuggacguccccgugcuggggguuccggggcuggucgaggcugggagccccgucugcagaaggucccggugugaacaguggagccggugccuccucugacgccucccugacugugcccguugcccuucgguuucguaagcauggaggaaacugaaccugaagcagcuuggagggagcugagccccaggacaggagccuggucuggcuggggucuaacaugaggccccaaauuuguuauaaaacuacagaaagugucugaugaguagaugccaccuccggacccuggcauccgccucugcugccuuugcucugcucaggagggcagugggugccggcagaauccaugggaauuggugcagugucacaaagacccaaguccaccuccgccccugcccugcccaccaccagacccaggucucccccgcucaaagccacccacagggcaaaggucaagcauggcagggagcugcacacaggguucccaggaugggucggccucggggaccaggcuguagccuggccacccaugcggcaacccuaccagcagggcacugcgguucucacgccccaacccccaaaugaccuuuaaccuggugacaggcuuccucacccagagcugugguucagaacaagguggggugaccuccccaugccaccgcaggaaucaggcagcacccagcacgugaagagacccuccaaggggccggggggacucuuccccuaggccugcucuggggccccugccuaccugccugcagcuuggugaggguuuccaguggucucucgauccaacuagacccugggagggcccauucacuuuuuaaaaauggccaaaaccuccaugcggugauggcacacaacacagugcauuaacaagacaggaaacacuuuugggcccaaagugcacugaacuggaagcaccucacgcagccuaaagucaguuuggaagguuccagaacauuuccuaaacaccuucaucucugaauacacuuuaacuccuugggucccagcaaggucucugccugguggugaggggcagccaggggauuaagggcacggcccgaccugacgcucacucauccuugggccacaguccccgcagagcugcagugaggaucagaggucagugaacguggagaaccuucugcaaacacccgaugucaguccugcauaaaucuuuuugugugaguuucaucugcauucauacagcaaauagugguuauuuuucagagugugcuaagaauguauuacucucuuuagcaaauaacagccauaaauuuuguuuccaaaaaucuuuaucuuacuugacaaguggguggagacugcugagcacagggacucuguuuaucaacaccauaacuuucucugauauuuuccaugggaaauggucacaagaauucacuaacccuuugaccauagugcugucuuccaagaacuugacuucuaugagaaaacucagaguaacgcccacaggaacugcccuuggggagccuuccuuucucagcauuugcagacucucugaagagccgccgucuuacagacccuuggccuggcagcccggcucuauucauguucuucuagcuugggaagugcaaaauccuuuccuuccuuccgaauucguuuccuaagucuucacacccgcagcagccugcucuagcccugagcaaaguggaagugcugaucccacugcccacaggaggcagugcauggcccccagcccagaggaccccaggcugaccuggagggagacaggccccaggaaagcacagucaguauacccggcaugcccaucugcacccagggucagcggugacaggugccucugcccuccuccaagcucacacccaggugcgcccucccuugcugggagcccucuuccugggagcucauccuggugugacugcccggucagauguggaugcugggaaaggccucuguagcugacugcacagcugugagcacccuccaugccucacagcaccgacguggugccugacccgguggguaaccaagcucuucucacagaagccccgagacacacaucagugucucucaugggcuucauggcaaacgagacagaggagcucgaguggcuuccagcagcugcacggcgguaacgccgagacucgccccgcauggcagugacgccgagacucccccugcauggaagucaugcugagacucaacccugcacggcaguaaugcugagacucacucugcccgucucugccccaaacacagagcaugcucccgacagcccccagcaggguguccuguggugcacaacauucagcaugugagcguggacgcagggaaggaacagagcugcagcccccacaggcccugagccagcacaggcucucaucgaggaaggcccgcugucuuucagggcaagccccaccgagggcugccugcuuugaagugcagagcagugacugucucuggccauuuggcagcauccuugcgggcccugagagaagccagucaggaagccacacagcuguuggaugggagggaugcuggccacaagaaacacuacaaggagagaggcccaggacacgccacuguuugcacguggugggcagaagggagccugggaaagugcugacuaaagacaggccagucugugggggagcagagggcggggaggaggaaggaagaggguuccuccgugcccaccccagccccgguggcaucgcuguccugggagcagccucgugcccgcaacagcugccguggagaggaagugggaugucucacugcaaaugcuuugggaaaaacaagacaguguacuuugugaucauauaaaacagcaaaauaaaauagucgugggcacagggccagugauucugcaguuagagccguguggacucgguccccaucuccggugagggcgucuccugcacacggcacccaugcuucaggucgcacacacgugccuuggacccaaguucaccuuuggaggugucaauccccccaagaagaugugcuaaccuuggaguuuggggccuaggcuuccaucagagucuuccccacagaaagcgaacugggacuggucccucaauaagcuaccggccucuguucacagcagcacaggaugaggaugccugggucuugccagccaccacguucuaugaucccaggacaaacacgauugcaaaguucauguguguucccggcuuacaaauggggagguuuauuuacggccucuccggauccacggggagcugcuccaugggacgcuggacagcucaguucccuugaaaggauggcugcaccaucgagcaugacucaacccaaagauccaacgcgcaggggccuggcagggacagcugugcuugggacgccggugugccacugccgcuucugcgccgggagucacgccccggccucucccacugggcucccagccugagcucugcccagcugguguaaggacaguaaaggcaaccagaugcccugacugcgaccaccaccaauagucgccaagagugcacgcaagcagaaaucacagaugcccuggcagcugccugagggacaggcuucuccuccagcuuuauccaaguugagcuggucuucggccagacgaccaagcucaggccccaaauucaccuggguugcucugaggacuggugagacuuaaaggucacuuggacuccuccaguggccgggacacaugucucucuaguggacugguugccuuccguguugugaggaccggccaggccugcagguuggugccuuccucuggccucacugagcagcaacacucaaguucaaacacaaaaccaccauuuaugguggagccaugggcucuguagcccagcaugacgcaccuggcagaccauguucacgagacuaaugcuccgagccacugacacacacccagcuccccgcagccgcccugugcuuuaugcgcccacaccagcaccacucagcccucacaugggugccaguaugcucacagucgccugcacacagaggagcacacaguggggccgggggugcugccgcguccugcucucccccagucccagcgagcacaggaguuaaugacagaguguggggcucaaaugcccaggacacacuguagcccuccacagccucucagggccucaguuuccacaucuguaaaauggcucagugacagcuguuacacaguugucaugaggauguaacaacuucacacauggagaccccgagaacagcacucucaggaggacccgugcacgauucaucuuucagacuaacagacgagcugagcgacggacgagcuaagugauggaucugagaacgggagugaucgggaagugaacaguuucaucaucugcugcugcuauucaauugucaggguugaaauaaacggaaagccagccugcccguaaacacugucauguauuucccacaaguguaaaaaggaagugaacaguaucuuccaggugugguggagacaguccagacacacccaaagcccacugcgccucccugagagcucccgcguccgggcugcccucauuuggagugggcaggaaugccacaccgcagcccucucugcuucugcagggacggucaacuuagcaauucagaaaagaaacaauguugacucagagaguggccuuacuguacuguggacaguugguccuggaugggagccagucccagccuggccgaacguuuggccuuuuuaugcugagaauccagccacugcagugaccggcccaggcucucugagggcuggcugggucaagcuguguguuuuccauggagccccaaguuccaaggggagguagucacaaaacagggucuagcagguuuguggacagauguggagaaaauguauuuucuuaucauaggcacuaacacuggaaggaaaaaaauuucaccuauaauuugaaaacggagccccagaaaauuaguagaacauuaacaaggcccaaugcacuuuacuauuucuuuugaauauuauacuuuuaaucaacacccgucagucagagcagagagugccucugucagagugaaaggcaaaacugauacuguucuuaacuuauuccacuuccagcuccccuuuaaaauuuauuuuaaaacuuuuaaaaugaaccuuucacuuggccagggucaaaauuuacaaggcguacacaccagguuugcagugaaaucacuggaauauaaaaaccauggaagaguccagagcauuuccaacaucaaauacgaaacccuuaaacaagcagcuuugcauuggagaaacagcucucaguuuuaaccuuagaaaacaggggaaaaugaagcaugaggaaaccuggaugccugucaaucgcucugggguaaagccauaaccugggaagugcucagcaugccccagcuagcaagcuuaacgccccuuuacucagaaucucaagaaagaagccauaagcacuugcuuccuaaaagaguguuuuguuccuaaauaacaaagggagacguucagcguuucucaaaacgucuuuaauuagaguuuuccacagaugugaagcucuccggcucgggugagggugucgugugcagggccuggcacucggcugccucugagaaagccccggaggagccuggcaccaagugccugcagacgcccgggugaaaacaagcaucugcacaggugcgggcacaggagagggcugcggagccagcacggaagacggcccucagaggaggccgggccgggguccaccugcaggccucaggaugggcccaggaggaaaggccuuggccacagggcuccggccccucaggcagggggcucugggaguggagagacccugggggucugaggaagcuggggccacagagccccgugaccuugugucacuuuuuagugauccugcugcagcugucaguggucuucugaccccaaaguuguagaaagagaaaagugugugagagggugcacaugugucugugugugucugcaugcauguggcugggcauccaugugugccuguguguguauaugugucuauuuaugugacuguguguacaugugugcauauuaugcauguguguacaugucugucaguguaugacuguguacguaugucuaugugaaugugugcaugugugugcaugucugucagugugugugacuguguguuuacauaugucuaugugaaugugugcauguguacaugucugcuaguaugugccuuugugugugcaugucugugugccuauguaugcaugucugugugugacuauguacaucuaugugaaugugugcaugucuguguacgucugcuaguaugugccuuugugugugcaugucugugugugacuguguacguauguguacaugucugugugugccuauguaugcaugucuguguguuugugacuguauguguacaugucugugugugccuauguaugcaugucugugugugugacuguguauguacaucuaugugaaugugugcauguauguguacaugucuguuaguaugugugugcgugucauuaugcauguguguacaugucugugacuguauguaugucuaugugaaugugugcauguauguguacaugucuguuaguaugugugucauuaugcauguguguacaugacuauguaagucuaugugaaugugugcauguauguguacaugucuguuaguaugugugugcgugucaugcauguguguacaugucugugugacuguaugucuauaugaaugugugcauguauguauacaugucuguuaguaugugugccuuguaugugcaugucuggacagugugugacuguguguacguaugucuaugugaaugugugcauguaugugugugcaugucugucaguguguggcugugugcuuacauaugucuaugugaaugugugcauguauguguacaugucugcuaguaugugccuuugugugugcaugucugugugugugacuguguacguauguguacaugucugugugugccuauguaugcaugucugugugacuguguagguacaucuaugugaaugugugcauguauguguacaugucuguuaguaugugugugcaugucauuaugcauguguacaugucugugugacuguaugucuaugugaaugugugcauguauguauacaugucuguuaguaugugugugccuuguaugugcaugucuggacagugugugacuguguguacguaugucuaugugaaugugugcauguauguguacaugucuguuaguaugugugugugccuguuuaugugugugcaugucugucaguguguguguguacguauaucuaugugaaugugugcauacguauguacaugucuguuaguaugugugugccugugugugugcauguauaucugugucuaugggaacauauguacaugugugcaugugucuagguaggggugugugugucccugcacaccuguauccaugagucagcaccuaucugugcugguguccaugugugaaugugugugcaugugucugugugugggagugugcugcagccucugucaaggcagggcaggggaggucucagccuggccaucaccuuccccaccaggcgcccccacauuguacagcccuccccuccaacagggaccucccuuuaggccaucccaacaucugggccugugucccagccaaguggcuguucccaaguggggacucagagggguuuucauuuccauaaaggguaccccuuccccagcuguucccaaagaauccacaaggucagggaaaaggugcuuggagggcacaugcaguucaggaugagccagcaaguuugaaaacggaugcaccaacaucccaugcggagaauuccucaccaccagcaguggggagaagagagagacugggacagagagagaaacacagagggagacaaagaaagagaugggggaagggaaaccuggccucggagcacaggccuggccacaugucgugcaggugcggguacaggugcagguugcuaauccaggccaacccucagggaaggccaccagcccucggugaauauugugcuuuguaucucagauaaagccaggugaugggaucaggaaccacagccuggaugauuuuccggcaggcaggccggggaucaaagugcacaaacaggcucccaggcaggcaccggaggaccugggcaguagggcugggcugggauaagucucuagucucggaucauuucuggaaucaaggggugauuauggagaccucagcaggcccuggaaccugauggccuucgaggauuuaguaaaaagucacugggccugggaagcuuuagcagagacacuguggggaguuacccagucuucucugaauuagaaacucgggcaaggaacccagcagggagaggcaaggccagggagggagaacaacaauauaaaaaggaaaacaagauaaggagaaggucugggcgguggagagcaaggaggcauguggggguggcccagccuggaggaaugucgggggaggggcacggcuccagcagagagggcuggggaggugggaggagugucccuuccagcagaacagggcuugaaaccacagguguguggggagggccagagccugggaggggugcugggcuuaguauccgccugcuggaaggugggggucugcagagcaggcacuucccucacaaccaggaagcagccccagcuuggggcagugggacacgcuucaggcaggugagcagguggccaggugggcacagagguuagcacacaagugagccuggagccugggaggggugccgggcuuaguaucugccugcuggaagggcugcacagcgggugcuuccgggaagaaggcgcaaccaggaagaugccccagcaaggggcagugggacacacuucgggcagguuagcaguuuagcagguggacaugaaggugagcacacuggagagcuggcuccagcugucccuucccucccucguaggagccugcccaggggaaacagccagggcuggguaggugcguguuaacuaacggcggccaggcacuucccacauccuaaaauggcagggggcugggaccaccuucccuacaaccacccguggaggaccacacaucaggauccugggccuggggaggccagggacccaaggaugcucugacagucaccauggccagguccuggucaccucuugagcucaggccacagcccuuuuccucaaucagccgcacugcacaaaauguaaagugagcaacauuucaaagacaaggagccccuggccuuugacagggagaaguucauggaugauuuucaugcauuagcaggaaguugugcuuggacaguccccucgggccuggggucucccaagaguguggcagaggaugcaguggagacuaggguccugggaggggugggccuggugugcuggagccggcugggacucaagccagccucuggacccugccccugccccugccccaaccaggcuguccccagcauccaccugccggcaggaaccggaaacagaaacagaaacagacagcaagcuaauggccagauccaaaaaccagagggaaagcggguuguuaucauuuggcaugggggcugggaaggagggcagaacgcugggaacugagaugacgcugaaaagaagccgacagaggcugcuggggccaggcugugagaggaugggagggaugccucccgggcaccaaagccacucagccacaugcaggagggugaggagaugaacaugccagcacagaaaccaugugacgcaaccgcaguuguauuaaagugaugggguccugagugcuguuuucauuuucuuaucuucauuucacaccuuuguaaauaaaguuauuaaauuaaaauuggaaaaccagguaggggacugacuugggaagaacagcacaguacauccaggcagcguccagucugauugacaugggcccugcagguccuggaggacagcgaggaggggcugcggccaggccuugcagggcugcgcggagcggguacuguggggugggggugacccugcugcccucaacucccaucaccagcacgccccaugccacagucccugugcacgcagaauguuccgggugaggacgcuguuggaggacacugcaccagccacacgaccaaccccacagcugggcggcgacuccgagcgaccagggcacacaggcccaccugccucagccagcagcacaggccaggauucaucauuaaagaaacaggaaaacagagaggccggggagagcgaccaagcuaggcugagcugaaggagggcacgggccuguggggcugugggcagcccccgggcaacagccccaggugcgucaucucugcagggaugagcuauguccacaagugcacaguggccaucugacagccucagagcuuucagaaaggcagaucuaagaggggucaagucaaccacuagaaauguaagcggaaacaggccuccaugguucauccagaaccacucuuucaucccgggugacauuuauuccaccccaggagaauucuuuaaaaggaacauuccagcagaacggaaaacuucgcuaugaaaucacccugacuucagggcgggagggacgucaacgggaauccacaccuucucggacuuuccaaagucacccgcucccgagcccgcaggauagaguggccaggccguccucacacggcggcuccugcgggaggcggccccgggcgccccgccuucuccaaggacauuccuaaccgaggugccggggccagcaccgucgggcuccugaaagcacccgcugccuccaggagagcaccuggcagaacggggccgcggagccgcccuccccucccgcaugcggccccgcucgauuccuggaaucuuauuuuuggaccugcugccgcaagcaguucccgcccucggcccuuucaauuccucuuucgggaggggacugcucuccaccccucucaggaggacgaggcgcggcccggggguuccucaccuccagcccagcagagggagggccgcggggaagcgguuuggguuuuaaccauuguguuucucucgcacuuuggaaacggacucccggcuuccccgcggggaggcgucugacagcgagcguuucccggacagccccgcagcgucucaccggccugcgcggggaucccggggucgccgggggaugggcgugggggacgcggggcgggccggggcuccugggacccugaggccaggccucgccgcgcggagcuggggggcggcagcagcgcugccucucgggagcgguuggaggcgcgcgggcgccagggguucccccgcaucccgcccgccggcugcucaccgucucggggucguucucgaacaccucccgcgccuccucgcggcugcacagcuccuccacgcacucccucuccagguggcccugcuuggccuccucgaagaccugaaaggcgcggcgcugccugggccgcaggaacugcguggccucgcgcgccggcaacagcgcggcugcccggagggagagagggggacgcgucaagccgcgcccggagccuccucccgccgcccggggacggggucucgggcccgcgggacucaccaagcgcgcacuccgcggccagcagcagcagcagcagcugcggcgcgcggcgcagggcggcgggcccgggcgagagcgaaggggccauggcgggccggggacgcgcggucagagcgcccgggaggccgaggcgagccgcgggcgccgcggggcggaggcuccggucaucccguccuggcggcccugaaggucacaucgcggcggcggcggcggcggcggcugcggcaccucaagcgcucgg

SEQ ID NO: 191839 - RNA, 24233 nt, Homo sapiens
agcucucgcgagguuucgucgggggcuggcggcugcggcucggcggagagugcggcaugcgcucggaaaaggagggggccggaggccuucgggcggccguugccgcgcggggcccgagcgggagggagaagcugucggcccuagaagugcaguuccaccgcgacucgcagcagcaggaggcugagacgccgccaacuucguccuccgguugcgggggcggugcgggcaaaccucgcgaggagaagaggacggcccugagcaagguggggacgggggcggggcgcgcaaaccucgcgaggagaggacggcccugaguggagggaggggagggaggggagggaggggcgggggccgggccucccagcgcgguacgcggugccuuuugagcuccuuguccacgcuccgccccggugggaacggccgcgcgcuccccgcagguggucauccgccgccugccuccgggccucaccaaggagcagcuggaggagcagcugcgcccgcugccagcacacgacuacuucgaguucuucgccgccgaccugaggugaggcccgccccgaggggaggaagagagggcggaacccagagcucggcggcgguggccgucucguugccuuacguuccuuacccugauuucuccuauaugggagucgugugagcuuuuugaauaaauacauuucaguaaaacguguccguuccgucaaagaaaaauaccaccaacaaagaaacacagaugugguuuacaugaaaaaugcggaugauuuucagacggcuaacgcuuaggaaagcgggugccuuugaaaggaccagcguugcccgcccggcgccucccgggcuucccugcucguccgcggacggggcgcugcggggccggggggcgccggcucuuccuguggccuccacgcuggugccgcagccagugcgguuuuaaauaccggagaagguccccaagucaggagagucucucggcgccacggguuccucugggagugcgcccuggccuugccuuaggguuucagccucggaggaccgguucugggcaguggagaagggaccugaguucugccuuguaaaguuaacguuuugcguuuguuuuugcuaaagaauauccaaguuguuacaauuaacugagaugauuuggcacaaaaguuuuaucuaaaguaguuuguugugcccagaaaaggaaaaagaggcuaaauuaauggacuauuguauuuuucacugaccauuuucacuguuaucucuuauuucagucuuuauccucaucucuacucaagagcauacauuaauuuuaggaauccugaugacauccuucuuuuuagagaucguuuugauggauauaucuuccuugacagcaaagguuggauuauugguuuuuaaaaaucuauuauaaucuguagguauacuaaugaaguauugcuagaauauucgugcuuuuuaaauuauuauuauuuuuugagacagggucuugcucuguugcccaggcuggagugcagcagccgcaaucacggcucacugcagccucacacugcggcucaagcaauccuccagccuccuagguagcagggaccacaggcgugugccaccaugaucggcugauuuaaaaaaaaaauuguguagagacgggggucucacuguguugcccaggcuggucuugaacuccuggcuucaagugauccucccaccucagccucccaaagugcugggauuacaggcgugagccacagcauccggucuauuugugcauuuuaauuaaaaaguucucagacuaaaauaaguuuauaaauuuugauuauguuacuguaauuaugugcagauauuaaaaauugaaauuauuuaauuuuauuauuuaauccaaaaaaauuccagaaauucuguguaauagugacagccuauuuauguauuaucaucagagaaugaagguuuucaugagugaguuuguugcaugagagaacuugaucuuuuuagguucuaaagcuaaacuauuuuaccugauaggaauuuuccaaaauguacacugacuucuaucuuccuaaacagcauccuucaugacuguaccauuuaugauaaugucaccaggaagucacugcuguuaaacagcuuugccugcggagacagcagucuucaacucuacucucaauaguucccuuaucaguacuucuaggguucugcuuucaucuuuuuccuucucuucuccugucaggcugucugcuguuguguuccuggcugucaaguuuguauaccuuucacagcaaguuguuuucugcccuccccuccccagccacccucuuccgacuccacguguuuugacacugaugaguguuuucuuuuucuccaaugagggguaaggacuagaaagauuguuaaaaaaauaagcauuagccaagcuaguuccugugacuagaagcaaaugugaugcuugaacugaccuuuguguucauugcucauuuauucaguaacuuacugaguuucccuuuuucacuuaaaaaauauuggugggccgggcacaguggcucacaccuguaaucccagcacuuuaggaggccaaggcggguggaucacgaggucaggaguucgagaccggccugagcaacaacgugaaacccugucucuacuaaaaauacaaaaauuagccaggcaugguggcaggcgccuguagucccagcuacucggaagacugagacaggagaauugcuugaaccugggaggcggagguugcagugagccgagaucaugccacugcaucccagccggggcgacggagcaaaaaaauauguauguguauguacguguauguauauguguguguguguguaaaauauguguaacauggccaggugugauggcucacuccuguaaucccagcacuuugggaggccgaggaauguagaucaguugaggucagggguucgagaccagccuggccaagauggugaaacccugucucuacuaaaaaaaaaaaaaaauuagccaggcaucaugaggcaugccuguaaucucagauacuugggagacugaggcaugagacucacuugaacccgggaggcagagguugcagugagccaagaucguguuacuacacuguagccuuggugacagagugagacucugucucaaaaaaaaaaaaagucacaaaauuuauaccauacuguuuuccacagugacugcgccauuuuagguucccaccuguagugagcaaggggccagucguccuuguuuccgguuaucuuuguugucguuguuuuguuuuuuagagauggggucucacuauguugcccaggcuggugucaaacuccugagcucaagcgauuccccccacauuggccucccaaagugcugggcuacaggcgugagccgcugcccugccguuguuuuuauggucucuggccuaagccugugcuuuugaugucauaugcaacccauugccaaauccauugccauggagcuuuuccccuguguuuuuuuccaaguguuuuaugguuucaggucuuauauuuagguuugauccauaucgaguuacuuuuuguauaugguguuagguaaggguccagcuucauucuucuggcuguggauauccaguuuucccagcaccaguuguugaaaagacuuucuuuuccccauugaauggucugggcacccuuuucaaaaaucaguugaccaaguauuacaaagguuuauuucugugcucucuauuuuauucccuugguggaugugucugucuacauggcaguaccacacugauuacuuucagcuuuggaaucagggaguaugucaucugccauugaaugaguauccacugugugcuaggccuuguggguggagcggugacuuggacaucgucccugcugguccagugcccugccgucccccugagucuugacuuuauucuggauaguggagguuggcacaaaaauaucucccaguuaaaggaauuauaauucagucaccugacuauuacugacaagucaaaaaaaaaugacucaguggguuuaguaccaagguagcaguguuccauuugaugauucagcauauagcagguucucuuagugaacauuucucuuuguguauuuguuuuucccccacauagcaacgaaguuaguuucuaaugacuuccauucucuacuuuuaucagaagcagauuucaccuggaauauucuauaaacccuuugaaacccucuauuuuagccauggugucuucuaagcaaaguaauuuucuugaacuuaaauaacaaauugauaguugaauuaaccuuuuaaaauaaaauguaaaguguagcuaagaaaucauuauuuaaagguauuccaacgauaaauuauuugggauggggcuggggaggucagguauauugagguguaaguuacauaugguaaaagucacccuuuuaaagugaacaauuugaugaauuuugaacaacuucaguuaugcaaccaccacaacaugauggauuguuuuaguaaauguucuucuuaccaggaguucauccuuguuuaagucuggaguuugccguguuaagguugcaggugcuugaaaguguaauaaaauuguagguuuuuuaaucuuuuuuuuaaucucuuacuggaaggaugaauuauaguuuaaauaguaauaaugcauugucguuguuacacuuacucuuuaaguaaguuaggucauuauuuuccgaaaugaauguaguagaauuucagaauggcuucuggaacauguuuccuguuaaaaggccuagaauauccugcagugguagaguuugcuccauuccagaagauagccaaaaagaagcugagaaaaaaagaugccaagacuggaagcaucgaagauggugagcccuuuccaagugcuacguuaugaagcugccaaauuaagaacacugagcaaauguaauucucccguaguugggaaagauuauauuuauuuucuuccuacuuuuuaaugucuagauccagaauauaagaaguuuuuagaaaccuacuguguggaggaagagaagaccagugccaacccugagacucugcugggggagauggaggcgaagacaagagagcucauuggucuguuuugcucauuucuucucuuuucuuuauugagagauuuacucguagaggauauacguuuuuucucuuuuucuugacugugauaacaaguugaaacuuguuacaggcuugacagaaauguagagugauuuccaguuuugacaaaagaauggcaagauggcagcaugggaaaauauuucugagcguugguugauggagagcacgugauuuuuuuaguuaagaucauuuuaaguuaugaugcuuccgaaugagcagugcagaagacacaugaauggucuguuccugagcgucagggaaggcauguugugucacauaguugaagucaguggucacagacggaugccucaagagcccauaggaaugagauguuuugcuugcggugaggucaucuugcugcuucaacacaaaugccaggcuccccgagccaggccaacuuguggauaagcccagccagagcacagaaucgaguuuaaauccagccuuccaccccaugcccacaagugguguacuuuagaaauaguuacuucccaguagcaccaacauacuucccaguagcaccaacaugaaaaucaggcaaacuguuguuguuuagucccagacacaccugguaguguuucucuucucuguggaucuccuuuccucaaagcccugguucuucaccucucaucucucccgcccaggcugugcccugcccacccaucaagauggauguacuuugggaggccagggugggcggaucacaaggucaggacuucgagaucagccuggccgacauggugaaaccccaucucuacuaaagauacaaaaaauuagcagggcaugguggugcgugccuauaguuccagcuacugaggaggcugaggcaggagaaucgcuugaacccagaaggcggagguugcagugagcugagaucgcaccacugcacuccagccuggugacagagcgagacuccaucucaaaaaaccaauaaaauugaugugacaugacagccacauuguuuaucauuuauuuuccugucugucucccaccacauaaacucccuucuuguuuugucuccccaguggaacuauauuuucaucuucaugguuguagaaaaguucaggaauuuaguagauguugauugaauuaauaaaaaaagauuaauauuacugaaauaguccguucacuuucuucauuuaucuaguaauaaagcuuuuuuuccccccacucuguugcccaggcuggagugcgguggcacaaucucggcucacugcaaccucugccuucccaguucaggccauucuucugccucagccuccugaguagcugggauuacaggcacccgccaucaugcccagcuaauuuuuauauuuuuguggagauggguuucaccauguuggccaggcuggucuugaacuccugaucucagaugauccgccugccucagccucccaaaguacugggauuacaggcgugagccaccacaccuagccguaauaaggcuuuugaucacuaaaguaaacaaaauaugcugaggcugcaugcugccugggcacugacucugggccucagcauggggccaagugguaagcagguugcacaaggccucugccuaccaucgggaugacagguuggaagcaggagcaggaauaguccaaccagggcaccucaguguguaaucacugccacugaugugacaaaguggaauaugggagggaaagagguugggagacucccuccaagauagugguggagcuggagcugagacuggcugcgggagggaaagaggucaggagaugagcugagccuggccgugcugagcaguggaggaaggaagcgccaggggcagggccggcugcugucgcuuuucacugcaggcgcagagugcaggcuugugggguuggcacacaugggugagggcagcgugguuggagguucagggcacugcaagacauuuagauucauuccagggcaacuggaagccacugggggaguagcauggucugauuauuuguccccgucacuuugguggugucacaugggauagacuguggaugccaagagaugagcguguguuuuggaggugggcuggacaggaccgacagacggauagggugugggagguaaggggacaggaagaauuaagacuccagugcuuggcuugaacagauggguggauuguggcaccauuauacacaagggaacaugaggguaggacaguauugggggcaaagucgagauuucacuuaagaacuugauaaauugaagaagagcuagaagcagcaaauuagacguuauuacaggccucaucucccugccccucccauuuccaucucacuuuguuuuaaauguccccuugcaaaggaucggucacuuuagggcuguuuugagacauaccuuuuuggggcagacacguggcuccugccgggguggggagaggggggcauguccuggcaccuccccgagagucugcugcacagccaaugcuucacaaaaguuggcugaaugaaugaaugaauguggcuuagaacccaccaucccugaugggagcgauuaauucauuccaggacuuggcuguagagucuuccuuguuucugugauugcuguuucuauguaugaaaaauugaaacuuggccgggugcgguggcucacaccuguaaucccagcauuuuaggaggcugaggcgggcagaucaugaggucaagagauugagaccuuucuggccaacauggugaaaccccguuuuuacuaaaaauacaaaaauuagcugggcgugguagcaugcgccuguagucccagcuacuugggaggcugaggcaggagaaucgcuugaacucggcaggcggagguuacagugagccaagaccacgccacugcacuccagccuggcgacaaaguaagacuccaucucaaaaaaaaaaaaaaaaaaaauuuuaggcaauucauggcagauuaccuuuuucuuuucuaagcuuuuggccuccaguggauucuucugcacaggucugagaagcaaguguuaaauggaaauacuaauaagcuguuucuggcaaggacucuggaguuguugaguuagucuggugcaucggccuuuagcaucggccuuuagagcagacaggccuggguucagcucugagacuucuguuuacuuguguucuguugcaugguugugcguauucugucugauaaauaacauacuuuuaugauguguagaacacuuucuuauucagggucuaacguacuuugcccgugaucccugugggugauagggcagacauuuuauaggaagaggaaggugggcaagcggagucuggggucagccuccccacacauccagguggucucgcccggcuccuggcugacaaguucaggcuuuccacagagcagagcagaacccuggcugauuugagauaauuugcccauuacaaagagcugaccauuuaccugagccagugugcuguacucacccugagccagaguucauggucagcccagggaccccugggggaguguucucuguggcaacugugucugccacgaaauguggcauuuguaccugcaucagcucuucccuacaaccacugugccuggggcagggcuccugggacaaucggcucuucccuacaaccacagacugucccuggggaagggcuucugggacaggugccauuucaucuaugaugucagggugucagggguucucaguuccaagugauggaucccuggccagggcuucuccuaugauuccugauucauuccugguccucagaauuccagagaugaugugucaguuuucagguacauccagggauucuucccagcccuguuuagucugagaucuuacagacccacagaguagaccccgucuucccccuucccauuuguguccuuguguuggugggauguggggccuguccaugucagcgcaagucccucugagguggggccuguggggccucuagcuugccugggcacccacauccaggucagaucugagaggucgggcaugaaagcgaaggaccaagauagagucuguagaaauguucauucccuaguaguuggugccuuuucugcaaucagcagcgccauauggagucauuuucuuuuucuuuucuuuuuuuucuuuuuuuuuuuuuuuugaggcagaguuucgcuguuguugcccaggcuggagugcaguggcgcaaucucggcucacugcaaccuccuccucccguguucaaguaguuuuccugccucagccucccgaguagcugggauuauaggcgcgugccaucacgcccggcuaauuuuguauuuuuucaguagagacgggguuuccuuagguuggucaggcuggucucgaauucccaaucuaaggugaucugcccgccuuggccucccaaagugcugagauuacaugugugagccaccacgcccggcccauguggagucauuuucuaaacuacaauccagaguuguaugucuuaucauugggauuuuauggaguauauauuguaagacauuacaagaauccauguuauuuuaaaacuguugcuuggagaacggaaaacgaaaaaguucucagaauaugcgauguaucaaaauaaauauauguuauuuaaugauuuaaggcaccuacaaaaauaucaucuuggaauauuuuaagccucccuuaagaaucaggaauuagaugucuacuauguaugaaauuguugauacuuucaaauuacuugaccugacaguaauggaauaaaaacuccccuggagacaguguguaaauuuaaaaaguaaugauaugguucccguauuuauuuuaaagauuacauucaaaacaaguauuuaaaauacaucuuucuuuaggaguuaaauacaauauuacaauuuuuguguuuuagcuagaagaaccacaccucuuuuggaauauauuaaaaauagaaaauuagaaaagcagguaggucuggccuuuaccugaugaacacccucccugcuucugccauucucauccaggcaguuuauacacacgcucuuccaugucuuuagagaauucgagaagagaagcgagaagaacggaggaggagagaguuagaaaagaaacguuugcgggaagaggaaaaaagaagaagaagagaagaagaaagaugcaaaaaaaaagagacagauaaacagaagaaaauugcagagaaagaaguaaggauuaagguaauucugaggaaacauuuccuuuuuccaaaaauagcucugcuauaguaauuacacuuuuuacauaucuuaguucuuuagaauuuugaaaacauucugaauuaaucuaauauuguguuguuauuuuuuuccaucuuuuccaucuuucuuuccauccuacagcagugguuaucacagugcguccugagcccugggaguccucaggcugcuguugggugccuguccuccugggugugcaguggggagcacaccccacaggagccccacgcuggcacacguugggcugcugcugacgcucuuuuuuuuuuuuuuuuuuuuaaacuuuccaacuuucauuuucggcucaaggcguacaugugcagguguguuacauguucauugucagcucaacgcguacacgugcagguguguuacguguucauuuucgacucaaggcguacacgugcagaugugucacauguucauuuucagcucaaggcguacacgugcagguguguuacguguucauuuucgacucaaggcguacacgugcagaugugucacauguucauuuucggcucaaggcguacacgugcagguguguuacguguucauuuucggcucaaggcuuacacgugcaggugugccacauguucauuuucgguucaaggcguacacgugcagguguguuacguguucauuuucggcucaaggcguacacgugcaggugugccacauguuuauuuucgguucaaggcguacacgugcagguguguuacguguucauuuucggcucaaggcguacacgugcagguguguuacguguucauuuucgguucaaggcguacacgugcagguguguuacguguucauuuucggcucaaggcguacacgugcaggugugucacauggguaaaucaagugucacugggguuuggugugcagauaauuuuguugcccagguaaucagcacaguaccugauguuuuucagucuucacccuccucccauucuccacccucuacauuuuccuuuaaaaaaaaguuuuccucccagcacuuugggaggcugaggcgggcagaucacgaggucaggaguucgagaucacccugacuaacauggugaaacccugucucuacuaaaaauacaaaaauuagccaggugugguggcggacgccuuaaucccagcuacucaggaggcugaggcaggagaaucgcuugaacccagggagcagagguugcagugagccgagaucgcgccauugcacuccagccugggcgacagagcaagacucccucucaaaaaaaaaaaaaaaaaaaaaaaauuuccuggccgggugggguggcugacaccuauaaucucagcacuuugggagaccgaggcaggcggauuacuugaguucaggaguuugagaccagcuuggccaauauggggaaaccccaucucuacuaaaaacacaaaaaugagccggacgugguggcgugugccuggaaucccagcuacucaggaggcugaggcaggagaaucacuugaacccaggaggcggagguugcagcgagccgggaucgcgccacugcacuccagccugggcaacagagcaagacucugucuuaaaaaaaaaaaaguuucccugauuaaaaaauacacauuugaaaaccacugguuuugccuuucugugugaaggcugacucagaaccggguuuuaucauuucuuuggcaguagcacuaaugaguuucuguauuucuugcugaguuuuuucugugacugauacauucauuuaugagggugguuuaauacauagagggaauuuuucucugugugaaauguguuggccagaauugggaccagccauuaucuccucaguacuaaaccuagauuugaaccuaagguaucacucauuacuuauuauuuauugaauaccuuauauucaauaauauuguacaauaugaggaaaaaaaugaaaugucaggacuuggggaaagaagauagcuuaggaaaggguggggaagagaucauugaaccauagauuuguuucugauauggucagcagucaaaaacagaaaaguuggcuggguaugauggcucauuccuauaaucucaggacuuugggagaccagggcagguggauugcucuagcccaggaggucaagaccagccugggcaacagagagagacccuguuucuguuuuuuguagagaugggguucccacuauauugcccaggcuggucucguacucuuggacucaagugaucuuccugccucacccucccaaaguuuggggauuacaggcgugagccaccaugccuggccugguuuagcuuuuaauaaguaucugugcucaguaugggggucuuucacuucuaaaucauguggaaaauugaaauucuuuuaaugccugaaaaauggaaucuguggagaaaugcaaaagaagguguaucaacagcuuaaagaaagacagauggcucauggcuauuuugcuauuuuuuuguuugguuuuggugggggggggguuugagacagggucucaaugugucacccaggcuggaguguaguggcacagucacagcucacugcagccucuaccucccaggcucaagugauccucccgccucagccucccauuacaggggugcaacaucauaccugaauagcuaauuuaaaaaaaaauuuguagaagugggggucucacuauguuguccaggcuggucuugaacuccugggcugaagugauccucccacugcugggguuagaggcaugagccaccgugcguagcacucauggcuauucuuaauaaagagaaauaugguuugggaggccgaggcgggcguaucacgaggucaggagaucgagaccauccuggcuaacacagugaaaccccaugucuacuaaaaauacaaaaaaauagcugggcgugguggcacacgccuguagucccagcuacucaggaggcugaggcaggagaaucgcuugaaccugggaggcagagguugcagugagcugagaucacgccacugcacuccagccugggcgacagagcgagacuccgucucaaaaaggcuggaccgcgguggcucacaccuguaauccuggcacuuugggaggccgaggugggcggaucauuaggucaggagaucgagaccauccuggcuaacacggugaaacccuaucucuacuaaaaauacaaaaaauuagcugggcgugguggcgggagccuguagucccagcuacuuggaaggcugaggcaggagaauggcaugaacccgggaggcggagcuugcagugagccaagauugcgccacugcacuccagccugggcgacagagcaagacuccgucucaaaaaaaaaaaaaaaaagaaaagaaauacggcacacagaacagcucagcuguuuaauguuccucugaggaugcuaagcagugagcuuauguguggccacaugggugaacacacacaggcgagggcugggagggagcacagcugcccaugcgcuccgcuuggccuccggaagccuugcagggcguggcagagcuggccugcuccccagcucgucuccagcagcucuggccugcuccccagcucgucuccagcggcucuggcgugcuccccagcucgucuccagcggcucuggcgugcuccccagcucgucuccagcggcucuggccugcugguuucucaugaaugcaccagcggauuccaccucaggacuccgcacguuucccuccacagggacuuccccagaugugcccguggcuccuucuuggcaucuggucuuaguucccgucuuggcucugcagagagcccuccugggcccuccucuuccugcgucucugaugcuuuacucucccuucaugucuguucguagcuuuugaugcuaccugagguuaucuuauuccuuuguuuccuuuuucauauuuuugccacuguucacagcauucccccuugaccaccguugccucagguggugcaucaggcgcaaguuccuucgaggcaggggcaccucuugucucauucacagccauucccuagugccuagcacagggucuuaggcccugguuccugcacacagcuccucagaccucgggaaucugcaguaauaugagugucuuauaugccaaugagaggacuaggggcugggggccccaggcagcuucaggauggggacuaguuggccagaaagccaaggcaggacuagaggguugggacuuucagucccacccuagccuccgagagggcagagggccuagagagaggucaccgguggccagugacuuaaucagucacaccuacauaaugaaaccuuaauaaugccuaaagacagggcuuccaggggccaggcacaguggcucacgccuguaaucccagcucuuuggggggccaaggcagguggaucccgaggucaggaguuugagaccagccuggcuaauauggugaaaccccgucucuacuaaaaauacaaaaauuagccaggcaugguggcgcaugccuguagucccaguuacucaggaggcugaggcagaagaaucgcuugaacccaggaggcgaagguacagugagccgagaucgcgucacugcagucuagcuugggugacagagcaagacuccaucucaaaaaaaauaaaaaaaauagacgggccuuccggguuggugagcacaucaaggugcugggaggguuacugcauggaagcuccaaguaccacuacaccauaccccauacccaccuugugcauuuuuuccguuuggcuguucuggguuguauccuuuaugauuagccaauaaucgagaaaacagugccuuucugaguucugugagccauuucagcaacuuaccaaaucugaggagaggccaucgggaaccccugaauuuauugcugacuggucagaaguaccggugacacacugggacuuggaacugucgucugaaaggggggcagucuugugggacugagcccuugacccguggguucuggugcuaacuccaggucgaugaucucagaguugaguugaauguggagcacgcagcuggugucggaggggugguauugaaaaagacgugcagugucagaaauguaagaacaguuccuaggcacacagaauauuuguugaauggguggauggagauuugcacuuccuaugguucacauuuauuacagacauguuacuguugcaauuuuuauaaaagaugggcaguuaccagaaaggaaauguuuaaguucccagauuccacauaggcagaauaagaggauguucacagcugacauggggcccacgcuugaugagaagcggcuuccaaugcuccaccuugcaugaugcguuguguucccaagugaacacgugugauugaaugcaucuguguauggucuugcuaugcugcaauuaugagugagaacagaauucucagauguacaccuuccauuucuguucuacaaaugaucugucuguggugcuuccguuuuuuuuuuuuuucucccuuuucucaaguuagcugaggugcuuuaguuucaaaaacuauacagagagcagggagaaaggccaggggcauacagggcagaugaaauaugucguggcgacuuguucauuaauucuguuucaggaaagagaauaaucaguguuuugaaaacuauaaacuauucuaaaaaucaucaguaggaagcagccuuuuaaaaauuuuuuuuuccuuauuacaaaacuaauacuugucuaugucaggaaaacuagacccuauagaugaaaggaaauaaagucauuucaguucugccaucuagaaauaaucacuauuggccgggcaugguggcucaugccuguaaucccagcacuuugggaggccaacgcugggggaucacaggucaggaguucaagaccagccuggccaacaugaugaaaucccaucucuacuaaaaauacaaaaauuagccaggcacgguggcaggagccuguaaucccagcuacuugagaggcugaggcaggagaauugcuugaaccaggguggcagagguugcaguuagcugagaucaagccacugcaccccagccugggugacagagugagacgucgucucaaaaaaaacaacaaacaaaaacuacaaaaguuagccaggugugguggcacgccccuguaguccuggcuauucaggaggcugaggcaguagagucgcuugaacccaggagacggagguugcagugagccgagacugcaccacugcacuccaaccuggacgacagagcgagacuccaucucaaaaaaggaaauaaucacuauuaauacagugcugcagagcccuuuaggugguggugugugugugaacauaaauagaagugggggcugggcacgguggcucacgcccauaaucccagcacuuugggaggccaggguggguggauugccugaggucagggguuugagaucagccuggccgacauacugaaaccccgucucuacuaaaaauacaaaaaauuagcugagcgugguggugggcgccuguaaucccagcuacuugggaggcugagacaggagaaucacuugaacccgggaggaggagguugcagugagccaagaucgugccauugcacuccagccugggcaacaagagugaaacuccaucucaaaaaaaaaaaaaaaaauuagacggguaugguggcgcaugccugucgucccagcuacucaggagguggaggcaggagaaucacuugaaccuuggaggcggaggcugcagugagccgggagugcgccacggcacuucagccugggcgacagagcgagacucugucucaaaagagaaaaguguaagugagauuguggugcauguucuguuuuuuagcccuuuauucauuacgugaacaucuuugcaucacauuaaccuaccuuacuuuucaugacuaaaaaauauuucauucacugaauguuccaccacguauuaaaccaaaaaccucauuuuuggaccuuuagcuuuaauucuuugcugugcaaacauuuggcuucaauauugggguauauuuguaauuauuuauuuaacagcuucuuuuaaaauaugcucucaaggugauacuuuacuaacauuguaauuucucagcuucuuaagaaaccagaaaagggagaggaaccaaccacagagaaaccaaaagaaagaggagaggagauugauacuggagguggcaagcaggaauccugugcccccggugcagucguaaaagccaggcccauggaaggcucgcuggaggagccccaggagacgugagcgugcuuucauuguuaugaccacgucagcucccagucauggugacguaggcuuugucaguaugaguaugccuauuucacacuguucuuggaauccaagacuuuccagggugugcgaguacacguuagccuucauuucccaucagcauggcaggaacguagugaacucgucuugucugcagucucaagucugucuucagaucgggaguuucuuccuguuguuugcuuugcuuuugccuccauguccuccuuuuacuccugagccgccuccuggauuccugcuguugcaugucaggucuucaggaucugucuucccagucuuucuuuuuguuuuuuguuuuuuauuuuucucuguguuugugauaucuugcccuuugcucuuuuaucccccuugcaauuuaucuacagaauugcauauuugggaacccccucuuuuaggucuggcagaucuuuugugauagagaaacagaauuuuaagugcugugauccuuugguugaagcugucccuggcuccucuggcuguggaucuugaccagcagcuuuggcugugcacuguggguccucccuuuuucuuuuccuuugcugcauaugacagugcagcucuauggagggagcucaucugcgaaagggacagacacagcauuaucugcccggugggccagagagaccagccagaugccagucaggagggauccugucccucuugcuccuggcauccaccauccucagggccccaggcaccugggcuuaccuuccccuccgggacuccugcccacucacugccucucgccacccacagucuccuggugcccagggccacuuggcccacaggggaugauggacguggauuuuaggugggaagacuaaugcgauuaggcugccggcuucccagagccauagucguaggugugauuucucacugccuuucguucagaguugaugaaguauuuuuucuacuucuugggaguuuugguuuauugcuuuguuuauaaaauuuauauaugauuaucaaauccaugauugugaagcacugugaugauguuaccgguguuguuacugugacaguugaugacacagcaggaccuacugccacgugucugcugugaauucauacuugguuacagauccuuaugguccccaacagcccuggcaaaugagcgaagcagccauuuauuuacuauucauuuaauauucugauaaaugcauaaagauaauuaaucugccauuauuaaaugucaguuaauuuuacucugcacaucaugauggaugugcaccugggcucccaggacagccacuggaccacuuuagucucagucauuuuaucuguagaaaagaagguuuauuuuauuuuguuuuauuauuuuauuuuauuuuaauuuuauuuuugagacaaagucucgcccugucgcccaggcuggagugcaguggcacgaucucggcucacugcaaccuccgccucccagguuuaagcaauucugcuucagccucccaaguagcugggauuacaggcacccgccaccaugccuggcuaauuuuuguuuuuuuuuuguuuuuuugaaacggaguuuuccucuugcccagguuggagugcaauggugcgaucucagcucaccacaaccucugccuccuggguucgugcaauucuccugccucagccuccugaguagcuggaauuacaggcaugccccuccaugccuggcuaauuuuguauuuuaaguagagacaggguuucuccauguuggucaggcuggucucgaacuccugauuuuaggagaucugccugccuuggucucccaaagugcugggauuacaggugugagccgcugugccuggccuaauuuuuguauuuguaguagagacaggauuucaucauguuggccaggcugcucucaaucuccugaccucaaaugaucugccugccccuggcgucccagagugcugggauuacaggcacaugccaccacaccuggcuaauuuuuguauuuucaguagagagggggcuucaccauguugaccaggcuggucuccaacuccuggccucaggugaucccacccaccuuggcgucccaaagugcugggauuuacaggcgugagacaccaugccuggucaaaagaagguauuuacuuuggaggguuauugagaauuagaaaauauguauaaaaaguaccuuagcauggccaggcacgguggcucacaccuguaaucccagcacuuugggaggccaagaugggcauaucauaaggucaggagaucgagaccauccuaacuaacacagugaaaccccgucucuacuaaaaauacacaaaaaauuagccgggcguggucgcgggcaccuguagucccagcuacucgggaggcugaggcaggaggauggugugaacccaggaggcggagcuuucagugagcugagaucccgccauuuuacuccagccugggcaacagagcgagacuccaucucagaaaaaaaaaaaaaaaguaccuuaguauaaggcauauugccuaucugucacucaacugaaaugacagauacuauuacuaugauuuauuccucuuuguagugguuuuuaucaacgccugcugugugcccaucgcagugcagccucagcagugcagcgcugagcacuucgcaugggucccuguugucugggaaccuguggucuagaaaggagggugggcagccaaccggcgguuuacugcaguugcugaucauuuguguugaaucauaggucacacagcggcagugauaaagagcacagggauguggagagaucucaagaacaagaaucugaagcacaaagauaccauguggaugacggcaggaggcacagagcucaccacgagccugaacggcuuuccagaaggagugaggaugagcagagaugggggaaaggaccuggccaagacagagggaagaaggggagccaggacagcggggcuccgggggaggccauggagagacugggaagagcgcagaggugugacgacaguccagcacccagaaaagagcgacuggcaaacaagguuuuuauuaaacccaaaaagaaaaaugugucuggcugucuuaagguccaggcugcaugcugaccaugucacccccacuuggccuugugucuuggggaacgcagugcuuugagcauuuucaagagcaguuuuuccugaaagucagaucccagagugagacuagucaucaucuuuucucagauaaucaaauuauuuuucaccaggaaaaagaaagauuuuauuuaguauaaaacuagcacguuuauaugauucacuugagaauaagauuauuaaauuuacccuugagacaggaaggaaaguuuuaaugauauuucauggagguuucuuccacauuauuaacaacauucugauuauuggugaauauucccauggcucacaaacaccuguaaguuagaucugcacggacggugagcacaggacugugguuacccccuuagccaagcaaacaacuuuuuuuuuucaggagcuaauuuuuguucagguugcauuuucccagcgcagcacuacagauggcaucaccuuucugacagcaccaggccccacccuggccuccuagcaaacugagggcugccuaggguuccaguucccacucaccucccuccccaugucuaaccccuggcagccacugucuguucucugccucugugauuuugucauuucaagaaugcuugauaaauggaaacacacaguaugugagcuuugagaguggcuuucuucacucagucuaauuccuuucagauccuuccagguuguuguguguaugaacgauguucacuuugaaacuguuucaguguagcugggcaugguggcucacaccuauaaucccagcacuuugggaggcugaggcggguggaucaccugaggucaggaguucgagaccagccuggccaacauggcgaaacccugucucuacuaaaaauacaaaaaauagcugggcgugguggcgcgccuguaaucccagcuacucaggaggcugaggcaggagaauugcuugaaccugggaggcggagguugcagugagccaagaugaugccauugcacuccagccuaggcaagaaaagcaaaauuaccucuaaaaaaaaaaaguuucagugaagucaaggcugaaagccagaggagagccuucuugucuucacccuugaaugaacaccucuagaauacuccaguucucugggguugccuggaccucggggugcacaaaguacagccaugcgucuuuuugauagggcguugcucauaggaguccucagucuucaguuggcuuauuuuagcaguggugaauggccugguguuucccccgaccugaggugggggagcauuugcuccuguguuuagccucacagugcuguggugggaaugaggcgcugugugcaggagcuacuuucccgggagccuggcauuugucauguacuucuaaggucaggcuccaugcuccaucuguguauacagguauugcccugguaagaagcagaauugucggcccggugcgguggcucaugccuauaaugccagcacuuugggaggccaaggcggguggaacaccugaggucaggaguucgagaccagccuggccaacauagugaaaccccaucucuacggaaaauacaaaaauuaagcgggcauggugacacaugccuguaaucccagcuacucaggaggcugaggcagaagcaucacuugaacccaggaggcagagguugcagcgagcccagauugcgccauugcacuccagccuaggcaacaagaguguaacuuugucucagaaaaaaaagaaaaacaaacagagcuaugcgugcuggcuccaggcagccuguccaggggccugcugagccuguucccaccccucccauuggucagguucauaccaaggaaaagaaaauuaaguuaaacccccuggugguaagcagaugugggcuuccacacacaguccaggaggagguagaggugagcuggugaauccuggagaaggagcgcaugagauguacccacauggucguccuugcagcccacacuugggcuccugguggcuguuggaggcuaaggcugcagcucugcagggagaauaggcagggagcgggaggcgcguggagcaggaggcucacggaagcuggaagccgccuuccuccucugccaccccuucagugcuggggcagggcugguggccccaucaggaggaauugugcugcugucgcugcugacacuagccuucagggccacucuaugcuucccuggcuguugccuucuucaggcccucaacagcugcccuucauggacuucaugggucauuuuuauugcuucaccuccaggaguuuaauaaaaugauggggugaugucuucuaaaaagggaccaguucagucucccugcugguacaugcuaggcagggauaagccccauggaaauugcuuacuacucacguuaauaaguuuuaguuggcagaucugaaaccaucugugaggguccacaucucauuuuguucacuucccaacucagagggggacgucaugauuguacuguucccacagauuacauguucuuguuugagcaauaacauuugcccagauaaccaguguuuacauggcuuuuuuaauugccuuagaaugccugguuucugagauagugcugugaaaaaagggcugauuuuuagcugccuaguugauuuucuuuggacaauucauaucaucaaguucuagaaauauagggagauauugacccuucuguguugcuaccucuuggaagaguaacaugcccucuuauccuggcaggaccggccagccuugcagcuguaugauccaggagcucgcuuccgagcgcgagaguguggcggaaacaggaggaucugcaaggcagaagguucggggacugguccugagaagagggaagaggcagagugagucacugcacgcaccuggccuccauggacgagcaagggcaucccagaaacguguaaaugaccccgagugugacugggaaggagaacuuauuccuuaccaggaaacuggaagcuaaaaauacagagggugacguagaaacacgcagaaaccauucuaaagaaaguagugaucuuguauuaaauugagcagaauucucacagauuuuaccauuccuguuauaaacuaguauuuguuguuuagccaaaacagaaaaugauuuccacuggacaguagaaaaauauguguaaaauagggaagaaaguuaguauuggaucagugugaguccugaagcacuuucagugcugugagaacgacauccacuuuggguuucauucguuuguaagcagaggagcugucagucacucgugcuucucgguggccucugagccauggugucgagugaagaguaguucuuguuuguuacaaccuuugugagucagccaugcccgcaaagcgugcuguguuuuaguccugguaggaauauuuaucagaguucacacuauauaaaacccaacagcuucaacuauugcccuuucaacaguuuugccacugaccggauagaaacgguuucagucucuggauggauguguuugugguuuguaaccauuacgguuuaaaccaugguuuaagaauuugcccaaauaacagaaauuuuguucgggaagggauaaacuagauauagcauacagagccuguuuuugaguuuuagauacuuuauuuguaaauaacuuaaaauagcuuucugaaaccgugcauucuguaguuucuuccuuucagugaaauugcuaaaugucaauguauuuuuggcacugcgauuuuaaccauuuauuaaauaaaaauuuuguuaaagaaguacugaa

SEQ ID NO: 191840 - RNA, 12839 nt, Homo sapiens
uguugcugacaugaaaaccuuucuuuuuaauuugguugauacacauuugacaaaauauuuuagaauaaaauaauccaugaacagguacaagguauuuacaguaacauaauugaaaaacauaaaaucgauauauuucuuuaacagaaaugucuauaaaauuuucuacugugaaucuggaagacuuucaguuccuacuuaucaaccuggucuuaagccccaacaggcgacauguaaggcccaggaguaggauauacaaacucuaacacauuuggcaauuaagaaucaucuauuagugugagcuggcaggcggugggugggggguggggauggggagggaagaaccagaucuuaggguaagauacagaauggaagacuccacugaaaacaacuauggacaagaaagaucuaaaaucacacuuaucuuucacuugucuccugugggagaaggcugcaaacuauuuuaaagacuuagucaauuuuucccauuagcagaaaaucagcaacccugagacuccaacauuucaugacauaaaagcuaauaaacaucuagaagcugauuaagauuuauaaacuaauuuuacaucagauagaaaauaacucuuaugauuuaaaaauacauguaaggaaacaaaauuucucaaauuuauuuuucaugccuaauucuuaaacauuucaacuaauauuuucuauugucugaaauuaguuccacacacagauacacuuuaacugaaugcuuugaguacaacuugcucuugauuauuaaauggaaugccuacuuccuuguauuauuauucauacauauuuaaaagaaaugagaaguuuaauccaucuggacuauacagaaauuuauugacuuacaagauagucacauagacagagaccagaaaaaaaugaucaaaugcucauucuuaguaacacaacugagacagugaaacacgguacaccauacaugucaucuacugauccaacuaugcuaucugauaagcuauacuuacaaagaaugguuccaacaaacaccuuuguagaacaaauauucacacuguguuaucaaauuugcugcuccuccaguggcgguucaagagcuuccauuagcuuuuuauuugccucuucauuaugccggcuuugacaaugaguuaaauguuucuuaaaaccucuugggaaauuugauucaaaauuacaacguggacauuuaaguaaacuuugcccaugggcugcuacaugauuuuuaaggagagauuccaaaagaaaagccuuuccacagauugugcauuuguaagggcuaugaacauuaugcuuauuaaccaaaugaugcaaaacagcaccuuuuuucauagcacgacagcaacaaauuuugcaauaauacuuuccuuuuccacgcuucauguauuuugcaaucuccucuucagagauaaaagcuucuuuuucuucaguaaacuguagcacauuucuagacugcucuggacuagucauguccauuuuguucucuuugcuaaaaucaauggauuccacaucaaccugcucuugaucacugcuugauuccuggcccuuaauauccaucgcauccaaaucuguuuuuauguacucacuacuacuaagcucagcgucugagcucucuugguugucuuucuugagcuucuuugaggaaggaaauaaaguaucuucuaagaguuucuuaggugaagcuagaaguucuuccugaaccaaaauaucacauuuuugaucaucuauggcaucuauuuguaguucaucaccaagcucaacagccuucugugauucugagaauagagcagauuuggggaguucagggaaaagggcaugcuuccggggcucuggaaaaagggcacguuugcgugcuucuggagaagcaggaggggcuguuuuggcaggcucgggaaacagggcagguuuucuaggcucaguaucgauagagagaacaggcuuccagauaucugaggcugcuuugggggacucagauggcccagaaggaccugguuuucgggucucagggaagacagguuucugaggcucaauaaaaaaggaagacuuccagagaucaggagaaccaccacgggaacuuuucugggacucagggaaaucaagugaagcaggagaaguuuuccgcugaucaggagaaagcuuccaaagaucuggugacccugaggguuuucugagcucuggagauccugcuggacuacggaucucuggggauaguggugggccggguuugcgaagcucuggagacacugggggaacugccuuccaauguucaggagacaacgugggagcugucuuucggaguucuggugggccagacuuccaugacucaggagaugcagggggagacuuccaggagcugggugagacugaugaagauuuccaggaugcagaagacacagauggaguugguuuccaagguccaggagauacagaaggaauugguuuccaagguccaggagacacagauggagcagguuuagcuggcuuccaagguccugaugaugcugaaggauuggauuuccaaggccuaggggacccagguggcccugguuuccaagagccuggugacacagcgggggcuggucuccuaggcucuggggagacagcagggaacggcuuccaagguucaggagacucugaaggggauggcuuccuuggcucaggggagguaguccgggcugacuuccgagauucuggagaugcagcuggggaugguccccaagguucuggggaagcagcuagaacuggugacucuggagaugaggcugaagguggccccaauguuuccgggaaaugagacugcuucugggguuugggauuacuaagaguagccuuuacugacucaggagauacaggggcagguuucugugguucuggagaaggaacaggggcaaguuucugagacucacaaacagggacugauuuuggagguucaggagaagaaacagaggcagguuuugaaggcucaggagaaggaagaggugucuguagcucaggagaaacaacagagccagguuucugaggcuccaggggaguaagaggaguagguuuuggcgauucuggagacaaaacugaaccaaguuucuguguuuccauugaaagggcagguauggauuuugguucugcugaauugcaggguauuuucugguguucaggaagaggagggcuuuucacaggaucuguuucuuuguucaacugauuuuuugguuuaucauuccauuugucuggggaugcauguuuggaugugaugugauaguauacauuagaguacaucuugcuggugaagaagcauuuauggcagugaaauaacuuugcacuuuucugguaaaauaucauuuugccuagcccaccagcauccauuucaucacaaaauucuggauggaugguacccauauggauuuguacauuuucauagucugugccucugaaacugcaauggucacacuccaaacgugcugaugguuuacgaaguuccuggaaugcuuccauucuucugucuguuaccaacacacacgguuauauucuuuaaaaacuuucaauacugcugcaauaaaguaggaauaaauuauuuucaugaacuguaauucugaauaaaaugcugucaguccauucuauaacugcauaauuuuaagucuagaacagugcgugcuuuauuugauaguaucucuagggagaauuugaagaaaaaggagauauagaacagucccaggcacucugcuaggaguuucacauacaucaucucauuuaauccuaaugauaugacucaacuauuauuuucacuuacagaugaagaaacagguucagagaaguuaccugacuuucucugguccaggcuauaggacuaucagugaugugagccugacucuagaauuagcuauugcaugugcuuuauacuuugacucucaaacuccgaguacaaaaguccucagcacacaaagaugagugaauaucaaaauuaaaucuuggcuauuuaaggaugaacaagagacuaaaacuuuugcagaaagcacuuaauaaauuaaaucuagcuauaaaaagaugacuuuaaaacaugaugcuggcuugauuucaugucaacauauuuuguaauguuuaaucuaucccaauauaguauucuauuaauucauuuaauaaauaaauaacuuuguguccuacaauguucuaggcacuuaggcuuaaagcagugcuuugcaauauggcguucaugaguuggaaagauaagguggagagugauguagaggccguuggaaaagaccucuaugcaugggacauuccagcagagauccugaaugaugugaaggcgcauaccaaccaaagggcaaaucagaggacaccccagcagcuggaacacaguugccggaaaacaugaauuuaaaaaaauuguaaaccagucuucuuaaguaguaaagggaauagaagcucacaguuaaaaacacauucacacaguacgagauacagagugucagucccuagggguagccaguguacucauguguccuggaagaaauguccuaagcauauauugaucaacacacaugcuuuacacaaaugggauauuaaacauauuaucuggcaacuuacucucauuuagaauuuaucucuaagacauuuuuacauauggaauaagcacugacuuucccuguacuuaucugugcaugugaggguauuucugcagggaaaauuccuagcaauggauuacuuggccauuuguguguaaaauugauacauuuuaccaaacucucaaaaacuucuauuacugcauaacaacguguauauaugagagacaauuuccuauaaauuccuaauccuugcuacaaccuaggugaaagcuaguauuucacuauuguguuaaugugcuucucuuuaaugagaaagacugaacaccuucccuuauugacgguaaugauauuuacuccuccucaaagaacaguacagauuagaaaugcaggcucucccuuuauuaauuacaaaaccauuauuuuaaaaaaauguauaggcugggcgcaguggcucaugccuguaaucucagcacuuugggaggccgggcaggcagaucacgaggucgggagaucaagaccaucauggccaacauggugaaaccccaucucuacuaaaaauacaaaaauuagccaggcgugguggcgugugccuguagucccagcuacuugggaggcugaggcaggccaaucgcuuggaccagaagucggagguugcagagagcugagaucaugccgcugcauuccagccuggugacagagcaagacuccaucucaaaaaaaaaaaaaaaaaaaaaaauuaacauuucuaacuuugauaauuuguuuuuaaagauguucucacuggcaauacugcuuccuaacacuuuuauccaagguauaucauuugccuuuuuuauuuuuugaucuaaagcuaaaaaggugacagauacuugaggaaacaaauacuuuucuucggaaacuauuuacucuuucugaguugcccagcaguuauccuguauuuuagaaaacuguuuuggggccaggacuguaacaaaagaaaaauaaauaauuccguacugaugaaaaaucucugaaaaugaucuuuaacuuacaaacguaauugaaugcauggaaaaauaauggguuaaccauccgucucagagcccauuguuaaauaaaacuagaagacuuuaggggaaaacguaggauaugucucaauaaucccaugaggcaauaaugaacagcccaacuggcaauaaugaacagccaagcuaauauuaaagagcacuauauuacauauuguaauuacaacagagacuaagagcucaggugugcuggguuugagucugacucaccuaccauuccccauuccucccagccaucccuccucuucccgcugccuaccaccagcucuucaggccaaucucauacuuaaaucuacaaagaaugcuacagaauucacuucucauaucccaaauuauguauaucuagcacacaacacacauuauauccauaagggcguguacacuuuuagagauuuuccucaagaacuccagguauuuuuuuuuaauuuucuccucauaaaauauucuccuaagcaugcuuucccuacuagacuuaccugcugucuuacuagacaccuuaaaaguggucuucaaaaggcaggcauucuacauggcuuuuugacuaaaccacagcaaacagccuauaguauaugaagaagaacaaagaugagaaguugaaccuggaaaaaaaaaaaaaaaaaaagaaaaguaaucaaaacuauaucugugaucgugugugcccccuguaauggaauucuguguauuucucucaccauccugcccuaacagugagaggaguccaguccacuaagccugcuuacuuuuuuuuuuuuugagacagagucuugcucugucgcccaggcuggagugcaguggcgcgaucucggcucacugcaagcuccgccuccaggguucaugccauucuccugccucagccuccugaguagcugggacuacaggcgcccgccaccacgcccggcuaguuuuuuguauuuuuaguagagacgggguuucaccguguuagccaggauggucucgaucuccugaccucgugauccgcccgccucggccucccaaagugcugggauuacaggugugagccaccgcgcccagcccgaacacuuacuuuuaugaaaugacaccaaagacuacaguagauaccacuccugacaccauccuugucuacuuucucuuuaaugauccacuauggaauuaugcccguguguguaaucaaauccuucucaaacccaccaccuaacuucacuucucugauaagcacucagaagacugcuggugugacuacugacuauaacaauggcugacuuuugucaauuauugauauuacacagcagagugccaaauuaacaggcaguggaggaagggacaccacaacaaagaggaccaagaggcacaaaaagaaaggacucugggaggagcaggauggcaguguccugaccccaaggaagaacacauggaccugcuucagugauugcucugcccucuucucuuccugcaugcauuucaaagauaaagcaucauggugugggugagucugcugacaggaacagaaugugauaaacuggccaugcacaagcuacacaacagcucauauuaugcuucugauuagcuccagcacauucaucuaccccuucucuauccccuaccccuaucacugcuuuaauucugacaucugaacucccugccacuagucuccuuuucuuccaacccauucaucguacagcuaccaaaccugucuuccaaacagaagccuaaugugaucugccuguucacauguccuccaagucaacuaagacaccuacaguauacaauuugaauauggcauauaaagcucuucacagucuggcccaugaccagacugcauucucaaaauacuggcccacauguaacucccugacuauuccagcgucugugcauuuguauaaacuauuuccucuccuuuacacucccugucuugccacccggccaucaggcaaacuccuucauccuucaggcaggacagcuuuuuaagucagcugucuuucuguaaacacagggaccugguuccaggacuucccccauaugccaaaauccacacauacucagguccuacagucagccuuguggaauucccauauaugaaacaucugcccuccauauaaauguuucacauucuguaaacgcucuuuuuuauuggcauuugguugaaguucuaaccucuguuauucaugagucaacuguacuggucaauuccccacuucuucccaaucuuccuagaagccccagcuguacaugucacccucuggcacuacagccugauaccaaaaacaggaugccagcuccuggagaggagggacuauuaucccuuuauucaccucuggaaccguugcacaucccugacacacaguaugugcucuguucaauccuaacauucucucaaucuuagacucacaggauuuuaaaacuagaggaaaccuaaguuaccaucuagucucaaagucauaggauuugaggguaggaaaagaccucagggaucaucuacuuuaaaacuucaauuuauaguuaaggaaacucaagcuugacauuaaacagcuugcccaaaucagacaaaugaucaguaucugaugagagaauaaaguucugcuaucuguccagguucuuuguagauauacacaaacuaauacaguggaauuuaguaagaucuuuuaaagccuguacaauaguccaaaauaaacaagaugaaacaaacacuuagaauccacauaucaagugcauaaauacaggacuauagagaacuauaucccauauucugcacugggcagaguacacuauuccaguggaucacuguccccagcucugggcaggaaggacacuuuaagagagucucuaacaaacuagggaacauuaaaaaaaaaaaaaaaaaaaaaaaaaaaaaggcaaccaggauggcagauggcccuuuaaaaaaaaaaaagucauuuacaaauaaagacauuuaacuucaaaaggggaagaauuauagauaauauaugagcuauccuagaagugacaaucagaagcuagcaggaaaagaauuguggcuuaacacaguuuacaaucuacucuaucaugaacuagaacgaguuccuuugucagguaggaguacuccauaauuagaaucugaugaucaggccgggugugguggcucaggccuguaaucccagcacucuggaaggcugaggcagguggaucccuugagcucagggguucaagaacacccugggcaacacggcgaaaccccgucucuacaaaacauacaaaaauuagccgggugcagcagaaugcaccuauagucccagcuacucgggagccugaggcaagagaaaucgccugagccugagaggcaggaguugcagugaaccaagacugcaccauuacacuccagccuagaugacagagugagacccugucucaaaaaagaaaaccaaaaaaaaaaaaaaaugaugaucagcauaggacuagaaggaucuucagaggucuugaguucaaccucuucauuuuauaacugaaaagacugaugcugagggaaagaagugaccugucaaagaucacaacacugaggucagagggaacaguuuuuuuauucugguuuucucaauucuggucucugcuguaacaaaaugcugucuuucccacaguagcagaacgauccacgaagauguuacagaauuuagucccagaauucaacuuuuaggcaaagccuagagagcugggcguccuuccagcuuuuagguucuagcaaaauuucuuccuaaauuuaagaacuccuaacccuaacuaaaaauuaacucagaauuguccagauuaacaaaaauuucuuuuugucuuugagacagauuacaucucgucucuaaaaaaccuaaauucuaaucauuggugcucugccagucuaucacccaguauccuucaaugcaauguuaugccagaugguguaucauaccuauuucccaucucccauucaauuucuucuuugaagucgaacaccacugaucaucuuuuaaaacacaucugaugcauaguuuuuuaaauuaaaauucaauaaguagaacauguucaaagcuaaauggguucuauuagucuauacacacuagcauuguucuuuaucuuagcggacuuuuuuucuuuuuuagagacagggucucgcucuguugcccaagguuuuggugcagugacgccaucacaacucacugcagccucauacuccugggcuccagagauccccccgccucagccuccuaaguagcugggaccauagguaccugccaccacaucuggcuaauuuuuuuuuucuguagcgaugaggucucacuauguuguccaggcugguccugaacuccuggccuccagagaucuuguugccuuggccucucaaagugcugggauuacaggugugagcuaccaugccuggccuuuaagaaauuaauaaacugggcgggcgcaguggcucacaccuguaaucccaacacuuugggaggccaaggcaggcggaucauuugaggacaggaguucgugaccagccuggccaacagccaacauggugaaacccugucucuacuaaaaauacaaaaauuagcugggcgugguggugcauaccuauaaucccagcuaccugggaggcugaggcaggagaaucgcuugaacccgggagacggagguugcagugacccaagacugagccacugcacuccagcugggcaacagaguaagacuccauacucacccccaacccaaaaaagaaagaaauuaauaaacuaauuuuccaaguaguuuuauguuugaagaaaaacugaagggaauguacaagaauucccaccuaucuucuuguccccaguuuuuccuacuacaggcugagcaucccuaaucugaaaaucugaaaucugauuaugcuccaacauccaaaacuuuuugagugccaaaaggagcauuuuagauuucagauuacggauguuuaaccaguaaguacaaugcaacuauuccaaaauccaaaaaaaaaaaaaaaaauccaaagcacuucugguuccaagcauuucgaaugaaggauacuucaccuguauuaacaucuugcauuagugugagauaucugcuacaaugauaagcuaauacugauuuauuaaguagucuauaguuuacacaaggagucauuuuuauuuauuuauuuuuuuuugagagggagucucgcucugucacccaggcuggaguguaauggcgcaaucucggcucacugcaaucuccaccucccagguucaagcgauucuccugccucagccuccccaguagcugggacuacaggcgcgcgccaccacaggcucacgccuguaaucccagcacuuugggaggccaaggugggcggaucaccuaagguugaaagucagagagcagccuaaccaacguggagaaaccucgucucuacuaaaaauacaaaauuagccgggugugguggcaggcgccuguaaucccagcuacuugggaggcugaggcaggagaaucgcuuaaauccgagagacggaggcugcagugggccaagaucgcauaacugcacuccagcccaggcaacaaaagugaaacucuggcucauuaaaaaacaaaaacaaaaauaaaaacaaaaaacuugccauuuaggccggacauggugguucaugccuguaauuucagcacuuuggaaggccgaggcggguggaucaccugaggucaggaguucgaaaccagccugaccaacauggagaaacccuaucucuacuaaaaauacaaaauuagccaggugugguggcaagcgccuguaaugccagcuacuugggagaaugaggcaaaagaaucccuugaacccagggggcggagguugcagugagccaaggucgggccauugcacuccagccugggcaacgagagcgaaacucccgucucaaaaaaaaaaaaaaaaacaaaacuugccauuuaaucauuuuuaaaagcacaauuuaguuaguuuaguacuaaaacguugugcaaacaucaccacuauccacuuccagaacuucuucaccacaaacagaaauucuguacccaugaaacaguaacuuccacucuccacuuucagugcugguaaucucaauucugugccugagggggaaucauacaguaugucuuuuuugugucuuauuucacucaacauaauguguucaaugugcucguuuauacuguauaauguguucguuuauauugcagcauguaucagaauuucauuccuuucuaaagaugaacaaugguccauucauuauauguauauaccacagcuugccuuucauccacauguugauagacaucuggauuuugaauaaugcugcgaugaacauuugugaacaaguaucugagucucugcugucaauuuuuggggguauaaaccuagaacugaggaacgacuaccaauuuccauagcugcugcaccacccuacuuucccaccagcaaugcacccgagcuucaauuucuccacauccccaacacucauaauuucccuuuuuuuuaauagccacccuaacaggugugaggugguaucucauugugguuuucaucugcauuuccuuaaugguuagugauguugagcaucacugcacgugcuuauuggccauuugucucucuucucuggagaaauaucuauucaaauuccuugcccauucuugaacuggguugcuuuuuguuggucaguugcaucucuucuuguauucuagacauuaacucuuuaucagguuuacaaauguccucucccacuuuggaggcuguauagcggauuuuuaaacaguaauaaugacagaagaggaggcagucuagaacuaaaacagaaagaauggcuuucgucuugugccgcccucaacuucccaaugguuucaaacgcaauguuuccagccucggcagcgacugacaccgggccuccccgcucccugcacaaagacgcacucccgccccggccugugggggcgggcccuucccucgggccgugugggaagcgaggcagcgcaggcccccuucacucggacccgcggcuucccgggaccguccccgccaggucggcggccgacacggggcucggggaugcaggccccaaccacgccccucccccgcucgcucucgcuccucaccgguccggccgcgggcggcguccagugggcgauggaccgcgcggagggcccggcucgcggucgcgggcggcuccgcgaggcccugcagcgcagcggccucccgaauggcgacuggaugcaggagccgggauccgggugcgcgagcgugcgcgcu

SEQ ID NO: 191841 - RNA, 63068 nt, Homo sapiens
gacggaggggcagugccuacuacgcaggcgcacgcugcgggcgacaggaccaggcagcaacauugccacgcggauccgcgccggccaaucagcauggccaggggcggggcuucccugaggcgcgccgggaggcggcggcccacuuccggcaauaaccgccuggucgccgucaggugcgggcccagguggccggcgcgcccguugggcacugggggacgcgggcgcgucaggugaagacugggggccgcaggcgcgcuagguaggugcggggugcagcgggcgcgucaggugaagacuuggcgccgcaggcgcguuaggugaagauuggggcucgcgggcgcgucagguggggacgacgggccacgggcgagucaggugaagaccgggggcggcgggcgcgucaggggaagacauggggucgcgagcgcgucagguggggacggggccugugggagggucagguggggaccgggggccucgggcgcgucagguggggacgggguugucgcgggcgcgucagguggggacgggauugccgcgugcgcgucugcugaagucuggguccgcgggcgcgucagguagggacgaugggccgcgggcgcgucagguggggucugggggcggccggcggguguggaggguucauucagggagcugcgggcgagucgggugggcacgggggccgcccacaggugcaccgcgcguccucagccgcuuccccugcccaccuucugcgaccccuucccgcccccacccuccugggccgucuugcaggcccgagcuuguguccgccucgcugggcaagguguuucggggacgacuccugccggcguuugcccuccgggcucgguccuugccucuucgccggugggcaccugcuaggugugaccccucauuccuccaggccacucugccccgucugcugcuuaccuuuuuuucccuacuccuggucuguggcucuggcucugucucugucuccucccuuaauuucuuuccaugcuuauuuuucuugcagcagacacuaauuuugcauccuuccccucacaguaagcucaauuugaccuuuuucucaauuagauuccaccucuguccuugggccuauucaaacucauuuugaagacuaaagaaucuagagaaccauuucuucccuuaugaagcugucucuugcugccuccaaauccuuaccauccggcccuaaucagaaaagacguuuacucuuucauauucuguuuucuccucgucuuuacguguuuaccuuucccaugaggaaucugugauuaucuguaaguccuuagaguacaacuuauuucugacucucagcccucaguuugccauuuuuuaaaauguccuuucuggaucaaauuuguccacacuuauaagcaaaacaaauagggaaacacauguggucuuuuaagauggauuggaguuuucuuuccuguguuguauuccuuguuuuagugccuuuguauuuagguucaucauuacuugaaaucauauuagugaucuguaauagacgguaaaaaaaaaaaaaguuaaaaagcuuauaauuuaauggcaucuguuuuaauaggguuuucaggaacugcuauuauaaacauagugguuaggagcauggauccuggagugagacuccaucauuuugaaucccagcuccacugaacucuuugccucagugucuucaucuuuaaaauacauaaugaaacuuguaaaacaagaauaauguuuucuaccuuggaggacagugugaggauuaaaugagacaacauauguagauuguuuagaguaaugcguagccuaugguaagcucuaauaaauguuugccauuauuauuguuaagaaaaaauaugcuuguugaaggaaagacauuuuuuuuuguucugagucucucaugccaagaguuuccaccagcaaaugaacuucaugaaguccuuuucuacugaaguaucccacccacguguccuaccacaugaaauagaaauuaagggaagauuuuaaauaguuaaucauuguaggcugucugaaauaaguuggcauaaaaugugcuuaaaauuugcaaauuauacaagcuacacccuuugagugcuugcucuuaaaaguuuaauaauuuucaggaguaauuucuaguuuuuuuguguuuguaaauucccaaaauaaagguaauuuuaauuaaaauaagcguauaaagcucuagcaauucacauuuuuuagcugaacaaauacauucccauugaaagccgugggucaucaucauucuauaaaacuuuaguagcauuguuuucugauuugcaaacucagaagccucaguuugggaguauuuuugaaaacuugagauccagaccccagacguuuuaaauugcaacuugucuuuuuuuguuggugguguuguuuuuaaucugcauccagaguuugugcuuuaguucaugagcuguauagauuaugcuuuaagaaaaacuucauugugauccauagagcauaccauaacaaaucugugaagcacacacaucuucagagaaacaaaucuuuuccucuguguugaaaauaagccuuugggcauggacuauuuuuuuauuuccauggcugcauuucacuccuuucaacccuuaaaaaaucaaacuuaucagcugagaaauucagaccaaacuauucauuuuucacugaguugccaaaaugaauuaucuguagaguuuagguaguuguaaaagaauugguuauauuaauggaaacaguaggcaggcucuuuauguaaauguuauaaagauugugaaacuagaagauaaguguauuaaaugaugagugggcauagugucuaaauagguaaguacaauauuugugugucaucaaguuuuaaaauauuuuuucagcugaggauaccgggauguacauaggacagucauccagauaagguucuguuggcaagauauuuguugccuaguuguuuuuuucugucuccauguuuuucauuugaucuauccuacaagcccuagaaaauuauuauucucaaaacaacacugcucacgcugaucuguugcugaaaaacguuuaauuacugacagaauaaagucuaaacaccuuugauauucuucuaugaccuggcuucuagucgcuuauguaccaguccucugauaaacuuucuccauuuuaucccaucuuuucugcuuauuuuucucaaacuguggcacacauuuugcccuuuauacuuauucacccaccauucccaugauugauauuuuuugccuugccucuccauucauuuaagaucuaaccaugcuucagggcgaagaucgaguccuaguuucuagucagagcuuucccagcugauuugcuuucugcucaaauuaacuuuauucucucuuuaccacaaguuacaagauuguggacauaucuguauguauguauacaugcacacucacauaucuacauguaaacacacuuuauuauauuacacuuguauggaauuuguguguguuuugcuauuguucuuuuuuaguuccuuagcuaaauugcacacuuuugagggcaggaacaucuagcauaauaacauguaguuggugcucaaauguuugucguugaaguaauccuguauuuggucuguuagcaauauuuuucaggauuauccacuugauuuuuuuuuuuaauauagauuucugaauccacaguuucaaguugauauugagagauaauuugauaauuaucagagauguuccuagcagccauuuucuguugaauguguuuuaugagacucaaggugccacuucagucaucugcuacuucauggucuuugcugccuuuggugggaauguucuugaaaaucauaaaaucagcuguaugcuauuagagacaguuuuagauaacuuuaggucgacugaacaugggcauugaguuuugcauuuuaggauguucaguaguugugaagcaguucugugagacaaaguuuaucaaaauugugcugaaauuuaaggaauaaaguauuuucuaaagcaagaauuuaaauuaaucauuaugugacugaaaaagacauguucugacuauaagucaguuuagcaagguuugagauuuucuucguguaaagaauaauuacuucaucauuuccuacaccagucaagaauuaagcauuugugguugauccaggaauauuguugaagucuauguaauuuccuuccuuuuuuuucuguaucuucuaggauuguauaagugcccauuuaauagcuuguuuuuuguuaauuauacuaaauauaguugggaggugguguuuggagauguucaucucucauuuauucuccaugauguaaauauucuacauuuuucucuacgauauaaauauucuauauuauaaaauacucaagucuguucgggacgugaaauuaaaguaauacauuacagaaaccacuuuugcuugaguaauucagcuaccuuucuguagcuaaauucaacguauauuuucaacucuugccaugcuuggcauuuuuauaacauuuucgucucugucgaccauuucuuuccugaaauacauuuuucuccugacuuccuacuucucccucuaccuuuuuggcucuuccuuuucaguuuuucuucuuggcuuauaucugccgaucccuuaaauggugauguuucuuaggguuuuuuucuuggcucucuugauuucccucucgacauauucugugauauuauuugugugguuuugauuagugucugaaugcucaugauuuuccucuuucucucuagucuaacucucuucugaaccauggauguauauauuuauucauucaguaaauaaauacuuauagagcuccuguuguuuuccuggcauuguucaagguaauggaauacggaccugaacaagacauugcauuuucuuggaggaaaacagaugauaaacacgcuaaucauuucagacagcccuuacaacuaugaaggcacuagauaauggcuuagacugguagggaggggguugaggcagcagaagggcgcuguuuggacggggagucagggagccuuucugggaugugacauuuugaaucagcagugugagcaucugaggugguuuuuagccucaugcacagucucacuguguaugagaaucaccuguggaccuuuaaaaacuacuuaaacuuagccuucacccccaaauauucauauuuaacugaacuaagaugggacuaagcacuugaauguuuaaaaagcuuccugugauguuaaugcacagcaguaguugaaaaccacugaucaagaggagcagaaaucaagucagugggaagaacuagcauuugaagucucacucuuaucaaauugugagcgucaugaaguuaaucacgaaguugcaucauuuuuuaagucauaauuuuuauaccuggagucugguauuucaaacugaacaggcauguccuaagcugaaauuaauaucccuuaucucuccuuuccuaauaaaacccugcuguuccuucuguaugucuuaucccagauccaggggcuacaaaacaaaaucuagauaacuuccuugauuuccuccucacguuuccagacagucuucaaguacuguuugacucuguuuccuaaauauuucugcagucucugcucuucuguuuauuuugccacuguauacucucaccuuuuaaaggucaacauucagaagccuccagucccaacuacuuuccuccaggugacccucaccccauaccuucucccacugugauacugaguucuuuguaaaccacaaaucugauugaaucacuuaccugcuuacuucccuuuuuuggccccucauugcccucagaauagcauccaacuccucuaacuugauccagccuuaaaugacuucuccauccuuaauucuggcccacucucucucaucuauucuaagcuucaaccaaacugaacuacuuagaguugcugaacaugaauacauuucauuuucgguugcuucuaacuucuggcaaagagagaauacuuguuuggaauaauauucccuauuccacacucccugaccccugcuuguuuuucagguaugagcuagaaugucaccucugguaaaccuuucaugggauacgcaguauuaggccaguaaaaccacguuuacuuaccccauuugaucacuuuaguacacaguacuguguuauugucacugucaccaaugucgagccaacguuuaauuaaugagcagacauuuaaauguuaagaacuuuaaucuuuaaaauuaauaaauguucuaagugaaaagaaacuuuuaugaauuauauauacuuuuuaacauaauuuaacuuuuucauaggagaacuaugccauuuuugggucaggacuggagaucuccuggauggaguuggauuaagacagaagauggcuggaagagaugugaaucuuguagucagaaacuugaaagagagaauaaccguuguaacaucagucacagcauguaaguuacagcugagcagaaccaugccauuugccaguuuagcauguauggccuuaccuauuuuucaagucccugcaaagcuccauaacuuuugagacuugcccacccagaaggcuggugugaagagacaaguuguuuagcuaaaaaaugaggcuaguagauugccuaauauucauacacagaugcuuucgucuuuuuuuuuuuaauuuaaaacauuuaauccucacaauaauugggagagagguauuauuuuuaaucccacauuauagcugaggaaccugaggaaauugaaaugcacaguuuugguggcauauaucagaaauguaguaauaguggcuuacacaagacaaaucaguuuuucucccuugaaagccugaguuggcaugaugacuuugcucguaacauugucaaggggccaagcacagucugucuugucgcucugccaucccaagagugcagccuuaccugcaugguccaaaacgguguauuaccugcuacauuugcgcucaggccgaaggguaggugggguuggugagacacgaccuguguuucaguggcacagcccaaaaguuacaugcaucacguugcccacaccuuguuggcuagagcacuagcgcaagggaugcuggggguuguggcccagccauguguccagauaaaaaccagagacugcaugagcacaguaccaggguagguggcuauuguaugaugacuacagugucuaccacagugguguuugagaauuuggagggcuaggaaggucuugagauagccuccucuagaaugucaugggucuagucauuuauuguauauuauuuuacauuuguguaauuaucaacugugugcuugaugggccauauguuuuucugacagaaguucaguaacuuuaggccagagacugguuuuugcaguauuugaagcagaaauuaauuuuccauuuuaguuacagugaggauaacacauaauauuuuuaaacuuauauuguagcaguucucugccacgcuaagauguauuuaauguugauagcuguaaaacuuauuuaaagcuuguaauuaugcuguugguauugcauaauguuauacaguuaugaauuuucuaggucauuuuuacuaucuuauaauuuuuauggcaguuuuuuuaaaauuuaaagaugguugacuauaucuagaaaugucaggugucucacauuuacucccaguagccacuauuaaauguggauuuuaggauggggagauauauuacagaaugucaauuuaaaaaaagcuguaaugcuugaagugcaguguuacugcugcaucugcggugaggaauuugugggaauuuguuuuuuucccucauguauucuuuuucccaucaucucaaacacauuuuaaaugucugagaauuguuuuuuuuuccgcugcacacauaaaauuagagaauacagucgagauauguuuucuuugcauaacuggcuaccccucugucucccuuuccccuucgcccaaacuuaccuacagauccgccccuuugaaccaauggcugcuaacacaagcaucccugcgcaaaaagguuuuaugacagcaacgcuggguacccucuguagggcacagugagcgagaacuagucagcaccaccuuuuaccccaccuaguugcuuugcaguacugggaucccccgcccugcuuccuacucugccauuucguucaucuuccucugacuuuuguccguuccuaccaaaauggaaauccaaaccuguggguagaggcuguuggugaccugaaacugcagcagauguuuaauguauccuuucucuggaaggaaaaaccauuuaacuuugaaccuaaaauugauuuuaaaaagauaagaccauauguaaucaccauuuaaaaucacuauauaaauggccuucucuuucccccacaugucuuugagaaacauaguacuccuaauucuuugauuuaaggugggcuuucaaaacuuagaaaaagaacuauaguaaaaauaauuuagguaaucaagauucuacguaacuuuguuaauuuucuuuuuugugaacgugcgugaaaauaggccuuuaguauccuucugcuuacuuuucaacucauuuuaguauucaaaguuuagagaacauagggaagaaauuaagcaauucaacaugguugaucugggggcagccagccaguucauacucugaaagcugcucuuucaagcaacauucaugauauuacugagguuuaaacauaguuugauagacagaggauucaucuuaacccugaccuaaguaagccuuuuauuaggcuguugauucagaauagaggguaggucggcugggguccagauugaagagaggacagccaguuaaggguuucaguagacaggugagaaauguugagugcugccuauggugaugucugcacagcuggacagagggucaggaucaguaaaagagugagucacauauugauuggacuagccaaaaggguggcccugagaaggacucugaggguucagcuggggaaaugguguaaguaaauaaucuggcugggucuucucuccagcguaguguuucugccacucaguuuuauguuugaugacagaaauuguaugauuccuauaaaggaaagauacugaagaagagugucuaaauacuauauaucuuuaagaauuucuaaccuuuuccaucagauuucaguguuauuaugggcacuguaauugccuauaguuauuucaguauaacuauaggcgcuguugaggauauauaagaaguuguuccuugucuuuuaugaaguugacauuugacaagggaguguguagucaaacauaacgcauucagcucagucuuggcagagacucccauugcuugcuccuccuuguucacccacucauuuauuugcuuuuuucacuugcucacucauuuauucuuccacucauucuguaaacugauguuucuuggucaucugcuaugugccgguagggcccccaugcggcccacagccccacuguguuugcuugguuggccugcucuacuccucuuuguguuaucaauauuucaaacuccuucacucuacucugauguucggcucccuacauacuccuuccccaucuuuucaaaacaaccggaucucuugugucaccaggaaauccagagccaucagacuuuuucucagaaccuuagguugauuuaaaauuuucaucuucauugacuuuauccugaaucuuuauuuuuuguccagaacaccugagauauuccgaacagaggcuuauuuuuguuaauuaucucacagggaacaguuaaguguguugcccuuugccuguugauuacccccagggguagagucauagggauuuuuguuacaugagugguaguggcuuuucuuugcucuugaugggaaggacacagcuuuccccaccccuccagaaaggguuuccuuggaaauggaaugggccggaguccuaccucuacuccuuuguuggguagauaaaaucuacccaggagccagacuuagagaugucucuggucuuauuauuacacauacuguuacaccuguuuaguccacaauauauuaaggauuuacuaugugcuguggugucaggauacagcaauaaaugaaacaugaaaacccauuucugauggagcuugcauucuggugaaacagauaggcaguggacaagaugaguuccgcaguguaguaagugugauaguaugugggagauaagaaaugcuaaggauggguggugguagaggaagaucuauagagaguggccucuaagaagcaaucuguggaaggaaaccuuaggcaaugagagcaggaugaauggauaucugagggcagggccuccccggcagggaaagaaaagugcaaaggccucaaggcaggaguacaucaucuggcauauucagggacagcaggguuccagcauggguaaggggagcccggaagcggggccaguaggagacaagaucccagccugacugggucccagcugugaaguaccuguugucauaguaaggacuugggcuuuucugagugauguggggagucagggguuugaguagaagagugauuuguucaggccuaugcuuuaacaggauuauucuggcuaccguguuaaaaacagacuuccaagacgcaggacagaagcaaguggaccaguucuuaagaggguuggguuaacccccaugggaaaugaucauggcuuagagagaaaggaggcgguggaugaggaagggcucaaauccuggauguauucugcagguggaacugacacauggaauguguauggugcaguaagagggucgaggggugagacuaagacuuuggccugagcagcuagaagguagaguugcauuaacugauauaacaucuaaauccgccuugucuugcacaggguccuugggucugugccuaggaacagaagcacagugucacaggucaugcgccucuuucccuuuccagugagguggugucaccauguucuccuaaugcauugcauguucauccuuuuccuccacuuguauuuccuggaaguuguuccaugucagugugcauugaguuccucauucauuauaaggauggcauuucauuguuuagguauaccauaacuuauuuguccaggcuuccacugacaucauuuuggcuauuucccacuuuucauuauuucuagugguauagcaugggucaucugugaauaucucuuugcauacuugugugaauauuuaugaaaucuaagguccuaauagaaucguauauuuaaaauucuaguauugccacauuaccuucuguaauuuuguaccaguuuauacucugcauaguaguguacacagauucccauuaauucacacuucacccaaguugugugugugucagugcagguuacacacugcacaaggggaggguuucaucaugagggaauaauggcugaaaugcaucugugugccuuguguaggcugcaugugugucuucauguaaaggugcugucugcucccaugccaucugcguuuuggggacagugcacaagguguuuacagcagccuugucuuuguaauuacuuuaacuaguuuggugggcaaaaaacauuagacauuuuauuucuuuuccuuucccuuuccuuuccuuucuuuuguucguuuguuuguucuuuuuuuuuuuuuuuuuuuuuuuugagauggagucuugcucugucacccaggcuggagugcaguggcaugaucucggcucacugcaaccugugccuccuggguucaagcaauucuccugccucagccuccugaguagcugggacuacaggcgcccaccaccacaccuggcuaauuuuuguauuuuuaguagaaacaggguuucaccauauugaccagaauggucuugaucucuugaccucaggugaugcacccgccucagccucccaaagugcugggauuacaugcgugagccaccguucccggcuuguuucuuuauuaaguaagagagcucuuucaaaagaaauuauauuuccccuguuuacacuucuaaaaaacuaagaagauaagaauaguuaauuuacaaaacacuaggaugcacagugcaacaacaggagaaaucaaaguuuuuuuaaccaagguaguucaauugggaagggaaagauuuuuucaacuggauaaacgugcaaggaaaagugaaccucuacuacucacucuuacuguggacauagcauuaauguuagauggauuuuagaaugaacuguaaaaggcuaaaacuguaaaguuuuaagaagaaaacaguauuuucacaauguaaaguaggcagauugcuuaccacacaaaaaccacaagcugugaaagaaaaaaaagaugaacuucauauuaaaaacuuauaccuaaagucaucauuagaaagucagagcaacggcugggcgugguggcgcaggccuguaaucccaacacuuugggaggccaaggcgggcggaucaccugaggucaggaguucaagaccagcccggccaacauggugaaaccccgucucuacuaaaaauacaaaaaaaaaaaaaauuagccgagcguggugacaggugccuguaaucccagcuacucaggaagcugagucaugagaaucacuugaaccugggaggugaagguuguggugagcagagauccugucauugcacuccagccugggcaacaagagcaaaacuccaucucaaaaagaaaaaagaacaagguuuacuauaaaauguaaaaucaccacaaucaagagagugguaugugguacuggcgaaaagauagauacacaggucaguggaacacaacagaggaccccagauaaguccauacagauauggucgguuuguuuuugacagugguguaaaggcaccucuuaauauauuccauggagaaaguguaaucuugucagcaaaugggcuagaaaacuagauguguauaugcaaaaauaaauaaaaaccuguacagcucacauuuuauacaaaaaugaacucaaaauggaucauauaccuaaauguagaauguaaaacuguagaacuuauggaagaaacccaaaggaaagucugcaugaucuugggcagaguuuuuagauacgauaccaaaagcacaucuuuccauaaaagaaaaaaaaucuauaauuugcauuuuaucaaaauuuuaaaauucuacucucagagaacacauuuguaagucacauaucugacaaaggguuaguauccagaauaauaaagaacacuuaaaacucaacaauaagaaaacaacccaguaaaaaauugggcaauaguuucggugaaccuguacuucaccaaacaacuugcauggauugcagagaagcccaugcaaauaagcagagaaaaauaagcaugugaugcccaacuuaauuuauuguuagggaaacaaaugcaagcaauccggaagguaaacacugcagcuagccugaggccacgguaccauuuggggcaagcagcugaccagcuagagauauaacaguauguucuggggaaugagacugccacagugggccuaggugauuuggaaggcugugcaccuuccucauaagguaccagcagaggccuacgucaguagcuaagaugaaagaacaaucacgaagcaucccagugcuggcaaggacagugccaagugcuggcaggaauaugcucuccaacccugcuacugggaaugcagaauggcacagccacucuggaaaacaguguggcagcuucuuacuguguuacacugccuuaggagcuggcagucucacuccuagguguuuacccaagguaagugaacauucaugcucacacaaaaccugcaugugacuguuaauagaguuuuauucaguaauugccaacacucaaaaucagauauccuucaacuggugaaugaauaaacaaauugugguaacaucucuacaggagaauaccacucaaaagucaaaaggaacaaacuauuaauucgcacaacauggaugaaucuuaaauucguuuugcuuagugaaagaaaccaaaccuaaaaggcguccauacuguaugauucuaucuaaaggaugcgcuagaaaaagcacaaccauaaggaagacgaacaaaucagugguugccagggguuaagaguuggggaaaaggaguugaugacaaagagagucagaggcaguuuggggagugaugggacuguguuagauuugacugugcaccugucaaaacccauggaacugugcaccacagaauuucacuaaaaucaacauagauguuuguguauguguuauuggggggagugcccaaaugauacaaacugugacagaugaaucaaaugguauuacaaacuuaucccauaauccagggguccccaaccccuaggccauggaucgguaccaguccguagccuguuaggaccugggccacagagcaggaggugagcagagggcaggcaggcauuacugccugagcucugccuccugucaggucagcagcagcauuagauucucauaggagcgugaacccuguugugaacuguguaugugaaugaucuagguugcucacuccuuuugagacuaacuaacuaaugccugaugaucugagguggcacaguuucauccugaaaccauccccccuccucgccccagucuguggaaaaagugucuucuaagaaauugguccuuggugccaaaacgguuagggaaugcugccauaaccguugugaaauggauguggaauuagcugacuuaucaguaacuuuggaaaacaguguuuugacaggaugcuguaaggcuaaagacaaaaccugugguuagugcacuuguuucucauaggggcauggguuagcaaucucaaaacuguacauauucuaggaagaaguuacaaauaagaaaggauggugcuagaguuauccugugguucuggaucaggguuggaggugucagcaugaacuagggcuguugguuuuuucagagagagagaaaugugggucuaugcaugugugaguuaguauaacacaucuguuuucuaagucuguugacagagggccuuagagcagugacaccugcaucagugacuagagccagccugagaugguggauccuaagggcuccucagggaagggguugguuccagggcugggauagagcaaaugaaaggugagugaugggagccugucagauaucagaaggguagauguccgucaaaaagugcugcauuggccaaagcuggagcaguuugagccacaggauagacaacaguaguaauggauuauaaccuaaaaaagaaaagaaauagccauccauuuaggcugauaugaauacauaaaugaauguauaagugagggauaaggaacaguucuuccuuguagaauuccaguuaauaaauauagaaggaauaagggaaauagaaaaucaccaugauaauuguuauaagcacagucccuugacagaugcagcaaggugaaaucuaacagguaaaagaauuaggagaaauagaauaucugccaagucuccccccaaauagcuauucauuacaaagggaacaguacuuuacaguggagaaaccuggcagacacugccccaaccaagaacucaaagguggcaucauauuggcagcagguaccugugguguggugcugugugaauggcacaucaucuguggugguuuucccuaagcugaaucaggagaaaacagcagacaaaccuaauuugacggacauucuacaaaauaauugaccgguacucuucaaggugaugagaggagacuacaaacucuucuggcauggggggccaugguagugugucagcuaaguacaguguggauccuggacugggcccagcagcagacgggcucugguggguggccuggcaaaacaacaaagccugugguugagcugggaguaccaugccagaguuccucuucugguguugauccuuguucuauggcugcaugaagguggguggaaacuuggggacacuguguguucugccucugaaacucuugugcaagucuaaaaucaccuuuaaaagucuuuuuaagucaucauuaagaaaauuaauaggcaagccagaggcaucacguagucugacugugcugucagucgugucuggggccugcgucagcacagggcucgcaaugguggcuuaccucuuaguucccaaggagaggcagaguggagagccucccuggugauugacuuaauagcuauauggagcuuucuauggugucuuuauuggguauguguuacgggagguacacaggucaggacucccugaacuguacuuaaaagucuauucugcuguauaugaauuaugccucaggagagagaagagaacuuaugcuccauuuggaauuuaucuuggagcaugacgugaggaacaaaucuguuugugucuuugugcaguagcuguccaguuacugcagcagcacuacuaacugaaaagccccuucccugcuguguugagauaccucuuuuucccauacuaaauuuccaugggcaauugggacuacaggguuuucucucugucuuccuggacuucccucaucacacugauguaaauagagaggcuuaauacuguguuuucaugucagcuggggcuagagucuucaccauugugguucuuacucagaguugucugguuauuugugcuuacugguucuucuucuccuuuuauuuuagauacaggggguccauguacagauuuguuacaugaaaauauugcaugaggcugggguuuggaguacagauccugucaccucguuagcauaguacccaauagguaguuuuuuuuaacccacccccacucccucuaccuucuaguaguccccagugucuguuguucccauguuuguguccaugugugcucaguguuuagcucccauuuauaagugagaacaugugguauuugguuuucuguuccugcauuaauuugcuuagaauuaagucaagcuccauccauguugcugcaaagggugugauuuuauuccuuuuuuauggcuguguaguauuucaugauguauagguaccacauuuucuuuauccagucuaccauugaugggcaccuggguugauucugugucuuuacuauuguuaauagugcagcgaugaacauaggagugccugugucuuuuugguagaaugauuuauuuucuuuuggauauauacccaguaaugggguugcuggauagaaugguaguucuauuuuaaguucuuugagaaaucucuagaccacuucccacaauggcuggacugauuuacauucccgucaacaguguauaagcauucuguuuucuccucagccuugccagcaucuguugucuuugacuuuuuaguaauggccauucugacuagugucagaugguaucucauugugguuuugaugcauuucucuaaugcuaugugguacugagccguuuucauguuuguuggccacuuguauaucuuguuugagaagugccuguucauguccuuugcccauuuuuuuuuuuuuuuuuugagacagagucucacucugacacccaggcuggagugcaguggcgcaauuuccgcucacuccuuugcccauuuuuuaaugggguuguuuguuuuuuugcauaaguucccuguagauucuggauauuaggccuuugucagacgcauaguuugcaaauaguuucucucauuccguagguugucuauauucucugucaauaguuucucuugcugugcagaagcucuuucauuuaauuaaauucuacuugccaauuuuuguuuuuguugcauuuguuuuugggaacuuagccaaaaauucuuugccaaggccaacgucaagaagaguauuuccuagguuaucuuccaggaucuuacaguuugaggucuuacuuugaaaucuuuaauauauuuugaguuaauuuuuguauaugcugaaagguaggggucuggcuucagucuucuguauguggcuagccaguuauuccaacaccauauauugaauaggauggucuuuuuccacugcuguuuuugcuggccuugucaaagauugaaugguuguagguguguggcuuuauuucugaguuuucuguucuguucauuggucugugagucuguuuuuguaccaguacagaagcuguuuugguuacuggggcuuuauaguauaguuugaaguugaguagugugaugccucuggcuuuguucuuuuugcuuaggagugcuuuggcuauuugggcucuuuuuucauuccauaugaauuuuaggauaguuucuuguuguucuuaaaugcauuuuauaauuaacuuguuuagcucuaagaaaaaaacuugauuuuguauuggaauagcauuaaauuuaauauuuuuuaaaaauguuucaucuacuaacuuacugcaaagaguuuuauaaaguugccuguaaugauuuuuuaauguuuuucuucauuuuuauaaaggaaacauccuugugaccacacccgggucaaggaauagaacuuuaucaaucaucccagaagcgccccccgccccccacaugucccauuucuauuauaaccuacuucaucuccccaaaaauaaccacuucccaaacucuuaugguaaccauuucccuaaucuuuauaguuuuaucaccaaguguauauuccuagacacuauaguuuaguguuguuuuauucuuaaaauuugauauguuuuuaaagucucuuuuaaucuacacauuuuucucucuaucccuuucuuuuccuuaucuuuuacaauguuuaaauuuucuucuguuagcacuuguaacuuucuuauuuuuuuuuuucuaaucagauaccuagugguuuguuuugguugauuauuuuaucuugagagccagcuuuuggauuuacuucuuaguucuauucuuuuucuacuuaauaauaucugcuuuuauuuguaauaauuccccucuuucuuuugguucacuuauucuuuuucuggcuuuuucaguuauauguuuaaauaauuuauuuuuauuauuuaaauuuguauugauauagguauuuaaugcuauaaaguugccugugacaguuacuuuuuuucugaguccuauaaauucucuauauauuuucccagccuuuuauagcuguauaucuuauaugcaguaugguguuugauuuugcuuugugagccaauccaagacuguuuuccauuuaauaggugagccaaguccauuuuuuacaucacagauaacagggaaccaccuuguucuauuuuauuugcuuuuauccuuuugguauuuaggagggcuuucuuccuccuuuuuuuuuuuuuuuuccacuuuuauccuaaugccuuuauagcaaacacuuaguuucuuugguuggcuccccacaguaccugauacugcaguuagcugauggacaccccagucccaguuggccccugcacaucuucugcccgccucuaccagaacacuggugguuguucuuugucugcauugugcacgcuguuaaccauggcaugcugcacuuuuaucacugucaugugccagcagcuccacagauaaauaaagaccacccugcagcucaccuuugcaucugccucuagucauuuugguuuccggagcuuauucuuuagugggucaucccucagcuccuggucacuguacuuccuguguuuguguauacucauaaaaaauaugugugacuuuuacccuugauagucacuauuuagauguuaaaucuguggcuuauauuuuuucccuugaauaucuuaaauauguuacugaaccuauucuauucuggaccuguaaucccuacuacaaagccacucacgaguccaguuuucaucauuucugauuuuacagacaugcauucuuaagggggaggaauuuauagaacugaaagccauguuaauauccuagucaugagguggcugagauuuagucuguccagguaagauggugcagguagggaguguggugguccaaguggcacacgcaggaagucacagaaugugggaggcauuguuuuguguacccugugcacagagugucugaugcccuuugauagguuugcggccucaucugguggacuuucuggcacagcccuuccucgagguugcugcaucugaagcucuuuaagacggcguuucccuucugccagauugcacucugugcacagugcaguugcuucucccugcggagugagaugggcccacauuggcuguggcuccaccuggccuuggugcucuugucgcccucugcucugcugcucccuucauguaagaaggguguguuaagaguccguaagugugucguguuagauauuuaggaaggaaauguuaaugcuaaaaauagguuucacaucuuuuuuuuaacuuauauaaaauugacuggacuuucucuucugaauuuucuuuuuauaauuagagacuaauaauacacugauacgaaguagcuuuauaucaggaaaauggauaaacguaaacauuugccuaccaggagaaaauaauacgaccugauuggaaaauguacagauaaaaagcuaaguuuaguagguagccauugaugaacacagugugacuuaagacaacaacuggggauuguuagagcagagauuguagcucccuuccggggaggagcugaccaaaauguccuccagcuccugcuugacagaagaggugcagccaaauugaucgaaaggaaaugucagaggaggccagggugggaauuaucagcaacuguguuugaggauuuguuccacuuuguuuugguguuggugaaauuaucacagucugcauguuauaugaccuuggcacuuagagucauggcaacuuguugcauuuaugcgagauuuuuucucccuaaagucucuucuguuugguagcauauauguaccuuucauaaucaauaucaaacugaaguaacuugaaaagauagauacuuuuauucauuuucugggauuccauaaccacaaacucaguggcuuaaaaccacagaaauguauguccucacaauucuggaggccagaaauccaaaaucaagggcuuggcaggguugcuuccuacuggccacucagggaaguugaguuuaugaguauguauuauuuuuuauuauguguaguauaguacuuuaauaauuauuaaaacaaaucauucacaaauauuggucauuuuucuuacugguaacaaaaguuuugugacauauuuuacagcaauauaguuaagaacugaugcccuugauuagcaauuuuaaaaaccggaggcuuaccguagccugucuuauuuuccuagacuuguguggaaaugauuugaagaugauggcccauaacagcacauuucuguaaagccugugcuuaaaacccuagaguggucugggagaugaagauuaaguccuuguuauccaucucuuaagggaaauaccaucagaggaaaaugcaaaucuuauuauaggucaucacuaaaaugaggauuguaauuuauagaaauugggguuuaauuaugagaaauaguuccguucuuggcucuuguuuacuucuacuuggaguuguuuuguugauucuucucuauucucuucucuuccuuuucuugaauggaaaggaacuuggaaaagugauucccuguccuugggauugucagaggaaacuuggaaugucauugccuuuugggcacauuugcuagcaagggggugacguaugcuguggugcagccuggguguggagaguuaagggcuguuagcuccaucauucagacauguuuuaaguuuauggaaacucuguguuucauacaaguguguuugugcccuguauuuuccgcuuguguuguauaacguucuauucuuuguuuuuaacacuucccgcccccaccccaucccucggacaugcaccucagacagcaugaacaagacaagcugcuacuuccucuccucucuugcacacugucucuuuaucuuuaauuaaaacaaaauacacauaacauaaaauugccauccuaaccauuuuuaaauguacaguucagugguguuaaguacauucacacuauugugcaaccauuaccaccauccaucucuagaacuuuuacaucuucccaaacugaaacucuguccccauuaaacgcuaacuuuucauucuccagcacccccagaccugguaacuggcuuucuauuuucuguuuguaugauuugacuuuucugaguaccucauauaagucaaaucagacaguauguguccuuuugugacugucuuaucucagcguaacguccucaaguuucagcccuguuguagcaugugucagcauuuccuuuuucagacugaauaauauuccauauuguguauaguguacaccacauuuugcuuaucuauucauccacugauggacauguggguugcuuccauguuuaucuguugcaaguaauacugcuaugaacgugggcauacaaguaucucuuucauucucugcuuucaguucuuuugaauauauacccagaaguggaauuguuggaucauaugguaauucuauguuuaauuuuuugaagaaccuccauacuguuuccuauaguagcuauaccauccuccauucccaccaacauugcacgagggauccaguuuccccacaugcaugucaacacuuguuaguuucuuuuuuuuuaauuugccaguagccucauaaugagcgugagguaguaucucaucguaguguuaauuugcauuuaccuaacaauuggugauauggagcaucuuuucaugggcuucuuggcugcugugucucuucuuuggagaagugucuguugaaguuguuugacauuuuuuaaucaaguuguugggcagguucccuuguuuuuaagucagaguaggugauguuugucuugcuggugaaacaaagguuauaaaaagagaacauguuugcugugacguguaguugauugcuaugaaauguaguugauacaugcagaauggaaagauuuauaaauuaaauacuccuuuauuaacauuuuaaugugucgaauuuaaauuucagaagcauucaucuuucuucucuacuuguacauuuuuguuuaccugacaguguaaaacccacaaccaaaaaguaauggcuuuuuccccguuuaaaauacuuuguaaaaauaguagccuaguugucauuugugagcccaggcuugguccucaagucugacauagacuccccaaggcccuaaugcugaaguucucugagcccuaccacugcccaggcaggcccaggaagugucccagcagugcccaagaaggucaccuccaccuguggaauccacaguguggguagcccccagggagccacagccaucuaggcccagauucacaggaggaugcgguuacugcaagcaucugaaccuggccccaccaccuaugggcagaguugguuccagcucaguguguccaugggauaucuuuagguucaccuugcuuuucugucccaugcucacauguuggagcuaagcugcauggaguguccuucucccuguacguaugagauuagucagcaguccugucuccuuccauauucugucuuuauuucugcgacaguauuucuggagaacauuguauuugugcuuuuccuuugauauguuuguaauuuucguuagaaaaaccguuauagauucuaaagcuucuacauucaguauuucaaucaaugauaacaaacugguguaagacuaaauacaaaauacaaacaucaacacauuuccauaaauugcuguuauaaugucugccacaaaaaguucaguuguuuguauguuuuucaaaugugcuuugcuugucuugaugauuuacaacuguuggcaccgcuguuuaagucuguucugacagugagaaagugacucauuuggcaaagucagcuuuuuuuuuuuaauaaaagugaauacuggugaguggaaaggggcuuguguacaauuuucuugucaaagaacgaugaccggcaaauaagcaauuuuaguuccuuggauuugagcaccacucucacaugccuccaccaaccagcuugucuccacagagcuuccuuccucacuuuacacugaaaaucuguuaucaguguguggaaaauaaaaauuuuacacagcguuaguuuugaggauguggauuacuauuuacagguguuuuuuuaaaaaguaaaagguguucccauuguuuaguuauugccuuaugauuugauuuucuuguuucacgaagaagaaaagcuuuuaauuaaauguauuuaaauaguaaaaauauacaugucacuucaccugguuccaguuaaauguguuaacaguguauuugguuggugcuuaauaaaaacauguucagugcaguaauaauuaacuucagguaaacccuuauauagggaguaaacagaaauguugagugguuacucagcauggggaagguauacagcaagucauuggucaguauuggguaucaucauauucuuaccaucuuuuuucuggaguuuuaauaguuguuuuuuaaaaaaaucucuguuuuaauaaggcauuuugauguuugaaacuaccuuggauaaguauaucaagacccuucagagauucuaaaacauguucagcacuuucugguacaauauucucaaagaaccaggauacaucuuauuucucaaaaugaaacaaaaauguauuagacauuacccuugugauuucaagcccacagucugucacuuugaaguauuuauauccuuuuacaaaagaaaagccaaaugaagaucucccugaaaaaauauuuuaauagaaugugucuuuauuucaguaucuuaaauagugaagauggagaaauauucaauaaugaagagcaugaauaugcaucgaaaaaaaggaaaaaggaccauuuuagaaaugacacaaauacucaaaguaagaucauucucauuaauuuuauuuuacuuguugauuacguugaaauacuaaauuacucugacaaugcuaucuuaugaaauaaaaggugauacaaauauguaaauaacagcccaguauccagcauugccuacagauuuagugaucaaacuuuuugcagcucaaccguuucaguggguaagaugugcaaaaacaaaauaagagauagccaaacccacaaaacagcccaugaaucugaaugcuugaauuauggucaugaauucagcucagucuugagcagugaggccaaacugagagguguccugacuugaguuuugaagucacugaagauucagagcaggagacagacauucagagcuggaguuuaggauguuagauggcagcaggggaaggcuggaggugggaccuaucuaugugagggcauagagcucuaucaugcagcauaucugugaguuaccaagacacauguuaauguauaguaggcucccuuaccucaggggauagaccuccaguggaugccugaaacuguggauacuaccaaaccuuauggauacuaugguuuuuuuuauguauauacacacuuauaauaaaguuuaauuuauaaauuaggugcaguaagagauuaacgagaauaauaaaaugaaacaguuauagcaagauggccaccaucacugcucuugcacuuuggggccauuaugaaguacaguaaggguucuuuaaauacaagcacugugauaucucaacaggugauccgauaaccaagacggcuacugagugaccaaggggcggguaguguaggacucgcuugacaaagggaggauuugcaucccaggcaggacagagcaggacggugugagauuucaugacaccacccagaauggcacacaauuuaaaacuuaugaaugguuuauuucuggaauuuuccacuuaauguuuucaaaccaaaccugacuguggguaauugaaacuguagaaggugaaacugugaauacggggggacuacuuuaugaagaagauagggucacauggagaauacaguuagugugauucuugaaacuuuuaagauuuaucugaaaaauuuguuucuauggaguaccauacacagcaacagaagaauagaacuuuuuauuaggguacauaggaauguaguaauguaauugcauuuuauaaucauuuaugucuucauauggcuucagucauuaauaauacuaauuuucuucuaaguuacuaggacuugguacugucugaaaucauuguucauaucuuaaacugauuuaagaaacaaagcaauucuguuugcauucacccacguaaaagcauuucuugucaauauaguaagucagauaauuuuguuaacauguccaauuauuuaaauuccuuuaaaaucuucauuuugaaaugauuugccagauuuuaaaaacaaagguaauuuuuauucuagguuuuuaucgugaaaaauggaucuauguccauaaagaaagcacaaaggaaguaaguauucuauuauaaauaugagaguaucuuguauuguuucuguugaauauggagucacauuaaauaaauguauuaauaaaguugcauaaaacacauuucuuuugcaauaucagaucuaugguucacauucugacagauaauagcauaugaggagcuuuugaggcagugauuuuccauugugugugcuugcaugugcaugugguauguggcuguguauuugugcacacauuuguguguguuguguguaugguguaugugugugguauauaugguguguauguaugauugugcauguauuugugcagauacuggugugugggauguauggugugugguggcaugugguauaugugugcagugugugguuccugccuaccuguacauaucugagucuacagcaggguuauuuaaaccaagcauggacuccugcagucauacgcauuuucucuguguuagcaugaaccccugaugcugaugggaauguguccucccuguggcguguuuuggagggcagggcaucugugagcccucucauuccacauaaagaguggcuaacaugaaauuaguaauuggguuggguuugugcagagcugugugaacucuuucccugccuuucuuuugccaaguugggcuaaagcuuuuucaugagccauaaaacaaacgagagagcuucaagcuguuuccuguuucuuuacuaggauccgggaaguugaguuccuuuuauaggccuagaaacucugcauuugcuuuauuuugcaacaauuggggaaaauaauuuagggaauuacugucuaucguauguuauuucaggguaaguuaaauauuccagaaauguuuguagaugcucugaaacuaguccagcuuccaagaaacugaaggauuagauucugagaaagaaaacuuaaucuguuugguuaugguuaguggguauagaaugaaucagauccuuaauauacacucgaauacaccauuagacgauuauuugacagaaucuaaccuaguuugugaaaaacaaaauuuagugcucgugaaagaccauuaaauauuucaucugcucuguugccauacugauuacagaacagaggaucccauccaagcuagcauaugcaggaaaggaggaucuucuugugaggcuguggggaugcucccuggaaugcuaggaaccaggaccuaacaaggcugagagggaccagaacuaggacugggugcuggugucccugcaccacgucaugucuccauacccucaccugguacagagcaagugccugcugcuuguccaugcuggcuggugucucaccgcuuccgagguuacaugcugugguucuagguccgcacaugcucuuuguggucugcucugugaaucagauuuaauuuccuguuguaagauggguggugaccuuggaaagugccugcugcaccaucguguggaauaucagcugugauggauuucagauuauaaucuauaucaaaaugaguguuuccuuuccccagaguucccaggaaaauguuuuccacauagcaggcagucagucaacauauuuggauguuuuaaaugaguauauuuuguugaguugugcacccgucagggcgauugggguuggcgcacagaagcacaugagccucugaguguaucggcugucagagacaaaggugcuaugacuccagcugcuuucucuaggacaucucaagucaccuguuuggaauuugagaccaaucaucucauguuuucuauuauuuuuuucuagcuuaucucuacaacuuugacaugaaaaucuguagauuuuaaauauuucaaauauggaggaugaagauggaguuuaaaaugacuucugaaaccuagugugcuaaucuauacaaaccaauauaggauaaggguauaucauggaagaaaaacaucuaagagaauagcagcaguguuuacaguacugaaaauaaauuguuucauuuucuuccuucaguucuuggaccugugggucuaaacaccaguuuuuuuugguguuuuggguucuuggcauccgugcucccagccugaaagcugcccguggucacauccagcacuugccuucagcccucuccaucccaaugcugguuuucagaagcaccuucuugcuaccgaagcaccucucccagcccugauccuugugguugagcauacuuccagccugggcagugcauggcugcucuggagagaaaucccauguuauacuucaaacucgggcagugcaugccuccccugcagagaaauccuguguuucaacuagauauuuguaacaccuacauccuuacaaugcaguuaaucaggugauuuauguauuuuuaguugcguagccuagaaugaauccaguuuuuuuaugaucuuagcuuuaacgucguccacaccccaguuuguccccaacaaaacaaaccggcaagauauuuaauaaauauuugucuuugucauuacuucagcagguuguaaaaaaugucaguuaacggugucucagguauacauaaacagcuuaaauuauuagcauugcuauaauuuuacuauacucucaucuaaaucuaaaaucagucuucaaaauaaaaacaaauuguccuuugccaaaaauuuuuuuaaucgcacaauuaauugacauuaacugccaauucuuuuuggcuaauugacuaauuuuaacuucuguguugcuuuuccagaggcauggcuauugcaccuugggagaagccuuuaaucgguuagacuucucaagugcaauucaagauauccgaagguucaauuauguggucaaaguaaguguucuauuucaaaaacuacuuugaugacucuuuugaacaacuauauuuugaagauuguaaguguacaacguugaagaugcuuuuggcagcuugaaggugugccuguuugcugcguauuaaucaaaaaacagaagggaacaaguucaggagaaaacagugagguuggaggauuucuccaguauugguggcagagguugcagagccucagugggagcaaacacucaucugcccuguggcucugugguugcugaggaugccacaagguggucccuuggggguuguaccacguaccuacauacugugucagugauagaacggucgugggaucuuuaccugaugauuucacaaauguuuucugcuucguguuuuucacaaggaaugaggcuugugucgcagaggaagaaguagcuaauagaaaacaggaauuucauacaaaauagaauuccacaaaagccuuauugcauuaaugauacccuuuuggaagaaauuuuuaucuugggccacacucaaaaagaaaggaucuuagccauauauuccauuuauuguuugcuuuuguccaaagauuaauuacuaugugguuuaugcaccuucauucuauuauggauaaaauagaagcuauaguuuaugaagcuauuaauuuuguguuucuaaugguucugugagacauuggaaaaauguugcuuuuaauugcuuuuaggcauuuaaaagugcuacugggaggaccaaaaauuuagggaguuaaauaauuguaagccuuagauaauauuauuuguucaguuugcuucugagcagaauuuccagggcugcuuauguaacuacuacuuacaacuccuguugugcugcaugcuucacugaagcccagccaccacaugcaggcuggacuucccugguguuuucugaguccuccuuuagauauuuacacacuggccagcaggguguccucgauagguaccuuucuuauagaugaugaaaugcagauuugacucagccuuguggaaauuuucaguacuuaaguagccgggaaaaacaucagcagagaggucuguuuagcaguaacuguuucuccauguagcucucugauaguucagaccauacugaguugcuuuauaguagcaauucuugaccaucugucuacauaaaaggauuuaauucuuggugugagugagagaguaggauggagcacaggaggaagucguuggcuccuggugguuucugugcugggugcccugcugucucaucuuuggucacugacucuggagaaggugcgaguauucugugcuuugucagagggggcauccauagaccaggaccagcauuuuaucaguuucagucauuuggacgacugcauaauuuuuuuuuugucuguguaccacauacuacuauaauuugcuggguagcuuuucuucaaauuuacuuuucuaaacagaaauaccuacuuuagccucauccuaaacacuaauaccugugaaaugguaaauuuucugucggucauuugucuaauacauauaaaugcauaacuauaaaaauuaaaaugugcugugcacucauguaccaacuaagcuuacuuugcaacccucuugagaagggcuguguuucuccaaagcaccucucagauguggagcgagggaacuggugagcucaggaagcaaaagggcugcaguguugcauggcugucccagcacccucacaggucugugcaucucuguugauugcugccuuccaagcagggccuugcuuggcucaucugugcuccugcucugugggaaucccaccuucccucuccugaagucgcucuggaccuugcacaccauucuucacaaguccagcaaaguuaccucuaaaaagugauuugcucaugcuuaccuucugcuaaaaacaaaaacaagaagcagccuuugugacugugguaaagccugagccugugucuugccuuggauugggcuccuccauguccccaucccaauucuuaaccucccuggcccaugcccagugcccucuucuguuggcuuucuuucagugugugcuauuuuuuuuuuuuuuuuacuuuaucguaugcauuuaucauacauacugugcagguauuugguauuuuuuugcuguuuuaaauguuuauggcaacacuuacuacaacaacugagaggauugucuuguaguucuacuaaauaauuugauuuuccauaauuuagucuaaguuguccauaaugucacucaguauuauuagaauaccuauaaauaagaaauguagaagcauuuuuuuaaaaugcuugauaaaagguuuccuuuuuuucuaauggcauuuaguaauaucugcccuuaagaauuugugugaaaaacuuaauguguaucuuuuuuuuuuuuuuagauggagucucacucuguugcccaggguggagugcaguggcacgaucucugcucacugcaaccucugauuccuggguuccagugauucuccugccucagccuccugaguagcugggauuacaggcaugcaccacgaugccuggcuaauucuuuuuuguauuuuuaguagagaugggguuucgccauuuuggccaggcucgucuugaacuccugaccucaagugauccaccugccucggccucccaaagugcuaggauuacaggugugagccaccaugcccagccuguaucuuucaacuaauguuuuauguaaaaucauuuuuuccaucuaaacagcaauuuuaaacugagacuaaucaauaauuacuacacagucuuaggauaaaaguuaguaguagaauuuaguguucaauuacagauucuuccaguugccaaaauaaaguuaaguaguuuggaauggaaguuucguuuuuacucuaaucuuugaaguugaguuugagccagauguccuguuggaggcauaaaauggccccaccuuuuguucacuguccaggggcagaugcucuucacucaaggcaggaggagcccaucagugcuggcaucgcugagcaccuccugugugcagaucaacguaccuuggcuuuucuaacuuucaagaaacuuugaaauccaguucuagucacacucccaccaugaaaucuucuuugccagugaucacaggguuguggcaauaccaacucaagccuaccuggcugggaccuuggccucaccgcccccaucaugucagcagcauucccuggcccuuaggugugccaguggccacguguuuaaguugucugcguccccaucccaguugagccccaggagcaggggcuugguuuguucacugcuguucacccacugcugaaaacaacacccccuuugucaaaguggaguaagugugucccaacugcagugaggagcugcacuuccaugaacucagaggugcccagcaaacccaggacagcuguaaacacagagagggagaccaguacccaaaagcugucuggaggaaguagaacuggguccugauccuauagguuaaugugacugugguuuuuacacauuuguuaucauucccuuggaguccugggcuugcuuauagcacugagaagaacagccugcccccucgccccucuggcagccaggagguggcuucugacagccaggcacgaacagcccgaggcuugggagguccaugcagggcagugcacggcgugaaagcuuccugaaagcugcacggugugcaacugaaauuuauaaaaauguuaaauaugcucuguuuccuaaaguacacacaucuguaggaaaaaaguuuucagaaucguaaaguuuauauaucuaauuuugguuauuugauaaauuaucugaaguacuucauucucugccugugguggaccaauuagauagcacauccagugucacauacuuccagggguacuguauuuuuaguuuaguuucuugccaucauuuauuuuuauguuuucauuugcuuuagauguaggcgaagagucggucucucuuaucuuuauucaaaaguuucugugucccugggcauugcucugccccuccaagacuccccaguccuguuuccuuuagcccaccugcuccucaugucuggagauggacuccugcuucucaguaucccaaggaucucuuaaauguggaaagguggccaggugcggugacucaugccugcaaucccagcacuuugggaggcugaggcaggaggauaacuugagcccaggaguuugaggccagccugggcaacauagggagacccuguuuuuacaaauaauaauaagcaaauaaggaaagacaucucaggcuagaaucucuggcuauaugaagauuuuuuuucaaauuuuuucauaauuucuacuaaugacuacuccauaguagcaacuuaauagcagcagccucacagcagcgcaugggaaagaugcuuagugagugacccugagcccucccaggcggggacucgagggugaggcagggagggagagaggcucugcagccacacagccguuguuggaauucugucucuuucuuauuuauuuacucagggaucucaagcauaugacuucaucaucacauccauaguaucugguagauuuuagcaucuaccucagagcacuguuagaaagauuagauuaguuccaucauaggaagcucuuggaacagucuguacucuguguuagccacuauuuugauuuucuuuugaggaggauuuaggcagagggaugacagcugcauggagauccauuuaugacccaagagguaaagacaagaaaauggggcccagagagaugggcugaaggucacaauggagucaaggacagagaccaaaaacguagcuguccugacagccgugaagagcuuuuucauuacgacuuuauuuccuaagucuauaaacuuugauuuuccucugauguaaauuaagugacuuucuuaaaugcgucauaugacuuuuuuuuaaauuuuuuaaauuauacuuuaaguucugguauacaugugcucaaugugcagguuuguuacauagguauacacaugccauggugguuugcugcacccaucaacccgucaucuacauuagguauuucuccuaaugcuaucuguccccuagccccccaccccccgacaggcccuggugugugauguuccccucccugugcccauguguucucauuguucagcucccacuuaugaauaagaacaugugguguuugguuuucuguucucguguuaguuugcugagaauaaugguuuccaguuucauccauguccuugcaaaggacaugaacucauccuuuuuuaugacugcauaguauuccaugguguauaugugccacauuuccuuuauccagucuaucacugaugggcauuuggguugguuccaagucuuugcuauugugaacagugcugcaauaaacauacgugugcgugugucuuuauaguagaaugauuuauaaucuuuucaucauacuaccugacuucagacuauauuacaaggcuacaguaaccaaaacagcaugauacugguaccaaaacagauauauagaccaauggaacagaacagaggccucagaaauaacgccacacgucuacaaccaucugaucuuucacaaaccugacaaaaacaagcaauggcuaaaggauucccuauuuaauaaaugguguuggaaaaacuggcuagccauaugcaaaaaacugaaacuggaccgcuuccuuacaccuuuauacaaaaauuaacucaagauggauuaaagacuuaaacauaagaccuaaaaccauaaaaacccuacaagaaaagcuaggcaguaccauucaggacauaggcaugggcaaagacuugaugucuaaaacaccaaaagcaauggcaacaaaagccaaaauugacaaaugggaucuaauuaaacuaaaaagcuucugcauagcaaaagaaacuguuaucacagcgaagaggcaaccuacagaaugggagaaaauuuuugcaaucuauccaucugacaaagggcuaacauccagaaucuacaaagaacuuaaacaaauuuacaagaaaaaaacaaccccaucaaaaaguggguaaaggauaugaacagacacuucucaaaacaagaaauuuaugcagccaacaaacaugaagaaaagcucaucucuggucauuagagaaaugcaaaucaaaaccacaaugacauaccaucucacaccaguuaggauggcuaucauuaaaaagucaggaaacaacagaugcuggagaggacguggagaaauaggaaugcuuuuacacuguuggugggaguauaaguucaaccacuguggaagacaguguggugauuccucaaggaucuagaaccagagauacuauuugacccagcaaucccacaugacauuauaaaauaaugaccuggcaaauuagauggaacuguugaaaagggcuguuuuuaaaauuucagaucauauugcuaaucaggcuuuuguuugcucuggugaguguuguuuuaagcaacacaauccaaugcuaauuuacuguuguauaauaauuuauucaguaggcccugcuauaucccaagcaccuggcaaguaguaggcacuuguuauuccuaaaaugaaugagugacugagcauacaaaccaacuauuguauacauaaauguuuuuaaguuacuccaauuauuuuuuuuuuuuuaccacaguuaaacuccuucauaaguucuacuugaaguaggaacuauuaagauacucuaagauaauuacauuuuugcugauaguuguacugcaccuacagguuacuuuuuuuuuucuucaagcaaacugcauaguuagaaagaagcagaggaaguuauuuccacuuuaguuuuuuauuuuguauuuuucugagacagagucgcuuugucgcccaggcuggagugcaguggcauaaucuuggcccacugcaacuuccgccccccggguucaagcgauucuccugccucagcuucccgaguagcugggauuucaggcaccugccaccacgccuggcuaauuuuuguaauuuuaguagagaggggguuuugccguaugggucaggcuggucuugaacuccugaccucaggugaucuggcugccucggccucccaaagugcuaggauuucaggcguuagccacccugcccagccuauuuccacuuuauaaaaagauucuacacaaagauaucuucuaauuuccuaagcaagacuuuucuuauacagaaaaagauauauuuacauguauauuuuucaguuuuccuaauugucgauccaagaauugguuguaggcuauuuaauuccaggcauuuccuauaauuacccccauaaaaaugccggauuaaaguguauuagcaaaguauguuaacgcuccugagaacagauuuguuaaagaagguccaagaaaugacaguguugucaccacucagaaauggccauuuccauugaaggaagugcuccucagcuccgcugagagucugaccucaguugaauuaaauuugaccuuguaacugauguuuuuaagaaaaauugaacauagauugcugacgacgguggauagguggugucagggcaguuugagcacacugggaauauaaggcuccucauuauacggcaugccaaaaaaaguuuguccuccaggcaaguauccgaauuauauuggaaguuugaaaugccgguauugauaauagucugcaaauauccacuaccaucuucauuuuucuuuaauucucaccauauuuauccuaccaacaagauaauuuguagaguaugacuaaacacagcaacuaagaaugcuuuuaccaaaauaaaauuauaaguuguguaacaguuuaguuucagauaaaaaagcagacguucuuucugccagugcuagaagucagugaacauuugacagagucaaaaugguucccaagaaaagcagagaaaagggacaaccccaaaaauagaaugacuucucacagaccacugcuugagcaacuugugagcuguaggaggggcgcugguuccuaagccugaaguggagggcauguuuuaauccagccugcaugagguuguaguguggugcuucccuaccucggggcagcggugggcgggcaguccacacauugcuaaaggaccugaggaaaguggcuggagcguccagaaaauugaugaaaacuacaaagucugcuugguucugcuuuggcuugcuagauuacaucccuuuuuuguaaaagacaauaaacuugagaagucuuuuuaaaauuagauaaucaaaguugagaucacugagggcuguguccagcacacaggcuagcugggaagcagcagagcaggaaggcacaagcacagauugugggaucccccugcucuucaggucuggccccucccuccucagugcuguggccuuggggccagcuucuucaucucucccugccucaguuuucucaucucuagagcagggauaauaguaagaccuaccucacaggggcauuacagcauugaaagggcaucagguacuucagauggugccuuucuaauaaucacucaguaaaugcuuacaguucauuauaaaucugaaggaacccaaaggcgaagauugagcaaaguugauuuggucugcccagugaagaauacuuucuguauuuuguaguaaggcugacuuuaaaaauagagguaguggauguuguuguuucucuuucucugcccuuccccauguaugugaggcccuucaggagcacaggcacacaugcagugccaauuuacucccagauccaaggguguucaggaguggaccucgaauuucaaauagcugugauuuuauuuaacuuuauuggauucuaguuuuauuauauuaccaccagagaguuuggccuuuaagaucucuaauucuuugaaaugauuaaguuuuccuuuguggccuucuuuauaauugauuuuuauaaauauucuauugaugugugaaaaaaaauacagauucucuauuugaaggauguacuuucuuucucuuuaucuaauucuuccacaucuuuacuuguuuagaauugucagauuugaggagauacgcagucaugcacuacauaacgauguuuuggucaaugaccgaccgcguguagugucguggccacauaagauuauuuccuuuuuuuacuguaccuuuccuauguuuagauauauuuagauauacagauacuugccauuauguuacaguugcuguucagugcauuaauauguuguauaggucuguagccuagcuguguagguguuguguaauacacucugugauguucacacagugaggaaauuaccuagcaaugcguuucucggaucagauuguaucccccuuguuaagcgacccaugacuguauaaaaaacuuccuacaauauuuguguuuuuaacaaauguucauuaaauucccaacagacuuugcuuuauggcuaauuagaggcuuaugaaugauuacaguuucuuuguuaauugucuuucgcccuguuaucuuaauuaccaguuuaaccugaaauguaaucuugucaacugugaacacggcccuucucaccucuaugcuuaccuaugccucgugauguccauucuguaguccucuguggguaacuagucuaaacugaccgugcuaagcuaaucccuugccuucugcugcugauuucagucuuuuuaaaaggaauuuuaaaacaugauauuaaagaaauguagaaaacuuauuucgaugauaggaggggagguagucgggaagaccuuaucucccagggaacacauauucucuguucugguauuucuuccccuaguggagcagcaguuccaaacccaaauguugucucagggguccuuuucacuuuuuaaaauuacugaggaccccaaagagauuuuggucaugugaguuauaucuauuaauguuugccacauuagaaauuaaaacacuuuuaaaaauauuucuccauuuauuuaaaaguaaggacugggcugggugcaguggcucacgccuauaaucccagcacuuugggaggccgaggugggcggaucaccugagaucaggaguuugagaccagccuggccaacauggugaaaccugucucuacuaaaaauacagaacuuagccaggcauacagaaaacuaccgggcaugguggcaugcaccuauaaugccagcuacuggggaagcugaggcuagagaaucgcuugaacccaggaagcagagguugcagugagccgagaucgcgccauugcacuccagccugggggacaagagugaaacuccgucucacaaaacaaaacaaaaaaacaguaaggacuguaugucucacaccuuggcacccuccuggugucuggugugauggaggggauuauuccucaucucugcuccugaguucagucuuccauaauguagcaugucggacuguaugucucacaccuuggcacacccuccuggugucuggugggauggaggggauuauuccucaucucuccugaguucagucuucuguaauguagcaugcuggggccucuggagcacuucacugcacacuaacgaaugugaggauggaaaaggaaaaucauaucuuagugaaacuguggaaauaguuuagaccucgggcuccccuaacaggccccuagacgaugcuuugggaaccguggugguagaacucucucucccagacucacucugcccugaccccucuuauuggugagaaacaggcauguguaacucuucuuuuuccuuugaggaauaaaagauauuuguacauuuuggucuguuucuuucaugucuuagugcuguagggcaagaagccuaucuggggaggcuuugguuauuaagcagugcuuacggcuggcuggcuucaucucagucuaggauucagauuaggaaauccauuguugugugaaucugaaucgcauccgccaguccagcuauuauuagcgauaaugcugauaaccucaguuggccugaauccuuugucucuaaauugauucuaaagugaggcagggaaaaggggugcuauucaacacuaaaacaaggaauuuaauaacaauauucaguuaauuugaaaagauaaaggaacaggauugaaauuuuaacauuggucuucucagcuuugcuuggccuaaccugaucuuaucucuggccagugcccucaacugguguguuuuaguguaagauauuuuuauguaaauauguuagaaaucacagaauguuuuuucccccaaagauuaucauguaauugucacauuuauaauguuauuuguggcucaguaugugacuuagugauuucucauucuggaaaucaagaaaggcuggaaggagaauuggaaggaagggaugaaaaaacuccauuuucagagaaauaagaggcagaugcaauucacagacucuaaaaugugcaugaggcuuaccaaaagcagcuaagccugggcagugauacuauaggcggaacugagcagaagggcuuaggcuaacaaaagcacucgucagggccaggucuagaagucgagccccacauacccugugcacugagaggcugagucgcagauguucaacuccagcuugcagagugcagaaguuccagggaggaccacugacagcaaagggcuuccuggauccaguuuuacucagggacaugggcuguggggucucccagggauucacauacaugcagguagcggcugggggagagagugguggaacugggaaggcuggaagcugcccuucccccaacccugagggcaucugcaaaacaggugcccuaggaagucccaccucacucugaaaugccuguuagagaaggugaccgucaccgcauggauauucucuaaggaaauugucugugaagcaggauggaaucaugagcagacaguucaucauaaaugaaaaaaacaggaaacucaugaaggaguucuguggcaggagaucccagugcaggaaugcgacaaaacagaaaagagauuuuaaugagguugaguaucccuuaaucccaaaugcuuagaacuggaaguguuuuagauuuuggauuuuuucagauuuuguaauauuuacauauacauaaugagauaacuuggggcugggauacaagccuaaacaugaaauucauguauguuucacauacaccuuauacauauuaccugaagguaauuuuauacaguauuuuuaauaauuuugugcaacccaucacaugaggucaaguauggaauuuuccacuuguggcaucauguccaugcucaaaaaguuccagaguuuggaggauucuggauuuuggaauuagggaugcucaaccuguacaaccaagugagacagcaggagacaaagucaaguuggcagaagaaaggauggcagcagccgggagaaccaccacagaggcgaaggugggauuggaagggcccaggagaagacagagauguuuugggaaacacaaaaaaggugauggaaauaauacgaaugagaaaauuaauaagaaugaaaccguaaucaugaguuuaaaaggaacuagaaagaaaauuacagcugaagagaacagggagagggguuccagcauauuuaucacuggaaucuucaaacaggaaaacaaaacaaaaggacagaacaaauauuuaaagauaauguucaggaaaauucugcucagguaaaaauagauggaaguguacauugugagagggcaaauuuuaugcuggggaagguugacugagaacagguuaugagugugccauauccuacaggaauuauuaaacucugaagaugaagcaagaaccucccaauggcugaacaaacaugucgucucuuacugagggaaaagaucaggguggcuucaaauuucuccaaauucuucagauaguggaguaauccuuacuuaugggauccuccaggaagaaaggauggcccaugaauuuuauguccagucaaaccaucuuuuguauccagucugcaaacaaacaguauugaucaugugagaacucagggaauacuuacuguucucaugagcaguuucggcuggagaaacaguguccaucggacuggaugucagugaaucucugcagcaucagcuguguggcugagggugacggagcagagugugaguggagggcagaggagaaaaggucggugguuagagguuuguugacugucucaccuguaaucacagggaggcacuaagauguuauucacuaaaaucaaguuguagaggagagggauggaaggaagaaggagcaagaugaauggcaguuuuaucacaauguggaacaguaaacuaacaggcuaagauguguuguaugaggauuccgaaggagagggaauuacauagaguuaaaauuccaaaaguaaccccuaguacaaaauagugcaaacauuucuaaauuucagaagaacuacagagagaacgcaaaguuuuucaaaaagcuacaaaaacaugucauaaaauuaagaccaaacaugcugugucuauacauguaaacacauaacuuuauacacauaaccugaaggcugguaaaaguaaaagauuucagauugaaucaaaaagugaaacccaacuccaaguuguacguaagaagcacaccuaaaacagagauuuacaaaaguugaaaauaaaagaaugaaaagauacacuagggaaaaguaaaaaauaaagugggacaaaaagcauuaaaggaaagcagcagcccacuuuuuccugccaugaugcacaucagaguagggguaacuggaaaagcagggcaucccuggaggggcagguggagcagcggcgagggccucggucaucauucccacaggagaccucuacuucguggguucugucacagggauuuguuacuguggcuucccagaauacaaauucuacaauuuuguauuuuagugcaauuuauuugcuauuuaauaaugaguuuuuaaauacaaaaugguauuuaacaaugaguuuugguguuguguuuccuuuuuaauuucuacauggaagggcuguuugauuuucugauugucuguucagcaaacaacugcgaguaugggcuuagguugugaaaauacuuguuagugcccaaccauucauucuagccucuuucuggugugcccuuuugcuacagaggcuggaaagcuaaaagcuccauuucagacucuugcagccugggcuccgggaggagauaugcuuccacuaacuaaaugaauagccugcaagacuagaagacagagcuguaggcugcggcugccucagcucccuuguaugaaggucucuucagguuugcauggguagugacuguuuccuauacuuggacucggacugauacagugacuuaauuuaggauggcauguuagaaaucuucaugcauguguguuauaucacugugguuuguaauuccauauuaaauauauauaucgcucagcuuuuuuccgucuuuccuuuaagcuguugcagcuaauugcaaaaucccaguuaacuucauugaguggcguggcacagaagaauuacuucaacauuuuggauaaaaucguucaaaaggguaagaugaucacuguauuuuuaauacucuaaaucuuaauuagaaauuuggugcaaggagaugggauuuuucuuuuaucuuuacccaguacacauacugucaaaaacaauuguguaaauaaugugauaacaucagaaauacaggucauccuuccaguucccaguguucuguuacugccguuuacuuuuuuaaaguugcuuuugcauacaaauggauauauuaggaaaaauaacuaaucacacaacuuaaaaaagcuauuuuacuuuuucaugguuagcuaaucacaguucauuuuagauguaugcuuccaaaauuagcaggauugugacuuacucacuuaggcaucagauaagccaauaauuuucuuucuaauuuaaugagcuugccuugauaaguuacuggcuguuaguaaauggaacuuuaaauuucacaccaugacuuuauacaugcauaggaauauaugacucuauauuuaagccauuuuaaaguagccucuuuaugauaaguacaaaagaacguguaaacugaccauuuuuaaggcaaaauuguagacccaacugaaaauuuaucagauaaaauuuuaaaguuuuaagaaaucucauauuugugauaucucaaaaaugaugucacuuuuggguugcagugaaauuacaucuuuuuauugugguaaaauacacauuacauaaaauuuaccauuuuagcaguuuuuaagcauacaguucagcggcauuaaguguguguauauuacugugcacccaucaccaccagucaucuccagaaccucuucauugucccaaacugaaacucauaccaccuuaaacacugaguccccauuccuccuccccaccagccccugguaauuaucauucuacuuucugucucuacgaguuugacuacucauguaagugccuuauguaagugggugccucauguaaguggagauauauauuuguccuuuuguagcuagcuuauuucacuuugcauaaugucuucaggguucauccaugcugaauaugugugagaauuucccuccuuuuuagggcugaauaauauucuauugcauguauagaucacacguuguuugucuguucgucuaucaguggacauuuggguuaugaaacuagaucuuuuuuuaaaguguugcuuaacuguaucaauccauaguuuuauuuuuauuuauuccaguucuugaugaccaccacaauccucgcuuaaucaaagaucuucugcaagaccuaagcucuacccucugcauucuuauuagaggaguagggaagucuguauuagugggaaacaucaauauuuggauuugccgauuagaaacuauucucgccuggcaacaacagcuacaggaucuucagaugacuaagguauaaauaucucggcauaagaguuauuacacucuguuuuuauauuacagaaguuaucuuuucuaagcauacaugaaagacugcuauagcuuuuugaaagauuuucuaaugcuuucauaaguauucauuaaauuguuuuaaaauagaaaaggaccaaagaccccaauggcuuauaguugcuauuggaaagacagugggaauagcaaucaucaaaccaggcugauccuaugggugauuagauguaaauaaauuuaccuucaugggaaacugaauauuucaguuauuagaauaacauucaguaaauuaaggcuaaauuguguugccaguaauucucuauuuauuuaguuguugcuucucccaaguuaguaacuuuuugucuucuuccuugcugucuuuuuuggggauguguuuauaguucuuagcaacagugaacaaggccaaaagaaggugcaaaucaugucaguuuuuuugauauuuuuucuuuauucugguaacuaguuucaacaagaauaauguuaacaccauugccccgaguauuuagauaguguuuuauuuaacucuaguacucauaagaaaaagaauaaaccgaagauauaucuuagcggugugccuuacguagccuuggugguauaaaugauucugcagauugcacugcuaagauccuaguuaccuuuuaucacagcaccccaguuuucacauaaaggaaugguuuucaagugcccuuugaaugccuuaacuuuuggcuguuuauuugccaucuaaauaugggauuuacaaaaagagugaugauugccuaguuaugagucugaaauuauccuuaauaauguaacauucagcgucaguaagaguuaagcaaguuuguuauaaacguuggauucuuuguucuguuguugucuuggugugacccuacagucauucaaagcuuugcacaggcuggcucuucgcugccucuuuuacugcguuccccaugcauagguggguugugcuaaaaguccaucuguaagacacuuaugcauggcauggggcuugcuguagaaguccuaacaugaguggcgaggccacauggccaaaguccccuuucuccugaugaggcagauccgugguagugauguucagcaggugaccuucuggggagagaauaggguguguccuuguccaugguggguuuucauggucaggaucccaaggaaggggguguuugggaaaggccaaacaccagaccaggaagcagccuuucuugucuggcugggaaguuccagguaggauuaguggcucugcauucuuuggagagagauguggagccaguggagagaugugcaccgguggagacaacagcgaagcuccaaggauugggccacaccucaccaagaggagagaaaggagaaagcaagggacaagcuugcaucuuugacugggugggccgagacagagcaggaaggcauggcuguaugcugagcuuccuucuggaucuucuuuccauucauacuaccugggagaggcacgggcugagggauaauagugcauguggccccagcuugccccacucagugcugaccauagccagugaaggaagacacucugcuuuuggcccgggaugguucuuacagcccugguaggcagagcacacuuacguggcaauaccucucugccucagcacagaaggauagguguuacuguagugccauuuugaucaagugggaaaaauaagguacaaaaaugaaauuaauguuuaaucuuuggggaauaagaaagcgcugaugauaacacaaaggugccaguuuucgucauguccacucaaaucuuaccaucagagaccuugaacuuguuucuucucuuucauuagugguugcaugcugccuggcaucucuucaccugagucccugggugcucucuggagcacgcagcuuggcaugugccucugugaggaucuuggcuucuggacccugugcccugcuucuagccucgaggagggucagguucccuuguaggaguuggccagaggaguuuuaccuuucugggaauguuacuugaaaccaguagaaagagcacuuuaccagcucaguuaacugagcugcauuuguagaugccggacucagucagccaaauuggucuaaggcugcuuaagguaaagaccuggucuccugaccugcuggcugaugcuggauugcugccucccgcuuauucacgugaauuuugaggugacucaagcagaugggguuagaacagagcagcugagagccuucccggaucccugagaguggaaguccaagcacaccgccugaaguuccgccaugucagccucaggauauagggccagcuuucuccagugagcugacaguugucuuugucuucuagauuaucccaacaagaaauaccuugacaccccuggccgggcgcgguggcccacaccuguaaucccagccacuuugggaggccaagucagguggaucaccugaggucaggaguucgagaccagccuggccagcauggugaaacgcugucuuuacuaaaaauacaaaaauuggccaggugugguggcagguaccuguagucacagcuacucgggaggcuaaggcaggggauuugcuugaacccgggagguggagguugcagugagccgagaucgugccauugcacuccagcgugggcgacaagagugaaacuccgucucaaaaaagaaauaccucgacaccccuuaaaucuaaauacucauagucccaaaaguaagcagaaauuuaguauauauuuguguuguaaaguuccuaagaacaucagaaauuuuuuuucuugugaaacaaauauacuuugcuguuuaagcugcauuugaagauauggcagugcuaaugaauuggaagugcuuucaugugcacaucucugugacucagugagagcaggcacacagguauguguucacaugcuuccucaccccgucagcacuuccuagaugcccccaugugcucgcugggcccaucaugaggugggacacauggaucagcaggcguagccuuuagcauggggccuccgagggacccagggagaugagcacaugaugugucacagaacucagugggguguuauaacagauaugcacacagggcuguugacauuacauugguucacaagugaugugauguuuuagguggagcuuaaagaaugggccgggcgcgauggcucacgccaguagucccagcacuuugggaggccgaggugggcagaucacaaggucaagagauagagaccaugcuggcuaacacggugaaaucccaucucuacuaaaaauacaaaaaauuagccgggcguggugggacgugccuguggucccagcuacuugggaggcugaggcaggagaauugcuugaacccaggaagcagagguugcagugaacugagaucacaccacugcacuccagccugggugacagagggagacuccaucucaaaaaaagaaaaagaaaaagaaaacaaagaaugaggggagaguauccaggugauggccuccuggucagugcuuaacaacuggcucuccaggggcaagagguuugauuuguagccuuugucagcuucccacuaugacugacuucaagccaccaacaaaaaguaaacuggcuaacgaaauucccagaaguugcagaauugacuccugugagaagguaugggaacuuccgcauccaggggcuaauaaaguguguuaugccaaauguguggacugcuuggaggaaggugcaggggauuaggaccagacucagggcuuugugggcauugcagagccuuugcugcucucugccaagggucauugaaagguccuuguuuagagguccccuucagugccaggcagggaccagccagguuggagggaaguaaacccucauugcauucaugagcagugacagugaaaugggaagaaugaacuuggggauacuugagcaaaagaguagacuggugacuuugaagugggugcgagggaaggaagaauugagggagacuucagugacucaccacauauugaggggaugggccucccauggagaagggcagagcaguugggaacacggacuuggggccaggcagacugggcucgaggcuggaccucgaucuugggcaagccagucaacucaucuguaucucuguuuuuuuucuguguaaaauagaaugauaauagcaacacaaguuucuguuagcagaagugcuuccacagagaagugggaaucauugacaguugcaugcaauagcugagacuauccuaaagcaagagaagcagcagcaucguuucuuccuuccagugcaguguaggugugagagauuucaugauggcagagagcauguagcuaaucaguggaggaagugcagcaaaaaacgcagcaggauuucugacauguucagcaagacuuuugugccuugucacauuucgagauuucguuuggaugagaagugcuggcauuucugcgacacccucuuguuauagccauuaacagggauguaaaacuggacucugccagaaaucccaaaugcugaguugucacaccagacucuauaacucuacuaauccgggauuuuuuuucuucguacuaccuucauaccaccacuucaugcuaccuuuaaaguuuguaauuuuagcagcagaauauuuguaaacuacugucugcuacagaaauuuuucucaguaggaauuagaaugaagcaccuggaagacauaauucuugugagaguguuagacuuuuaguuagggguuaauuuacuugcacguuaucuuuuuguuuuguuuuguuuuugucuuugagauagggucuugcucuguugcccaggcuggagugcagugguucagucauagcucacugcagccuuuaacuccugggcucaggugauccucccaccucagccuccuggguggcugggauuauaggcgugagccacccggccuggccauauucucuuuucuaugugcucucugccauaugcuagacgauaaagauggaaggaugggcuaagacuugaaucaaacauucgucaguaaugagcaaagacguuuacugagagccugcggggaccaugcuggcugcuggggaagugaugucucuuggacugugcagcuccauagccuacaacagggcugacaucugcccuaugcgugggucccaucagcuguaggagcaaaaaacguguguacagacagggcaggacagcacacuagugcaguccaugaaagcuucauguccagaauguuagagcacuucacaaacugucaagcaguguugaggccccacucgugucuggcagaugcauaggaugcuugaggugaaguggcuuggagugcaucacuggcgguccaugcucgugcugcccacugggaugcaugagaagggcccugcagcaguuuccauucugaagucccaggaaggugcuuccauagcgaggacauuauaggggagcaggagaagaaaguggggugucaaggcacgggugccccagucaccucucccuacgcuccacucuccacagaggucaggugauuuugagaaccaaacucauggaauuagcucagucuagccaaaaauagauggucacugugcuuugugugcaguaggauuauagaaagccacgacacaucagaaggaagcuagcucuccuuguggccaaguacauacaucgaccuauugggaacaaaaggaaaacacaaaucagaagcucgcaggugagcacacgacagaagcgccaccccagacuggggucaggagcugaggcgggaccagguagccucugucccgcccaaacagccagaaccccacugucaggaagacguguuucuagugagaaugaagggauuuauuuagauacaacugagcccugaaaagucugaaacaguuugagcucaaacccaauccagggcugucucaggucaaccucagagcagaguuuaguuuuugaacugauucagcccacuucuuggggccaaggacagccacccuuccucagccuggcacgugcacacacauguaucuucugagggcagaugcauugcauuuacucucuggcgugugugagggagaaaugguuuguaaacuugaagucauagaaauguaaagcuggaagguggggggauguuggauggagggugaaagguuucuguagugcaggaggaguccauuguggagguugucuacacagcaugaugacugcaguuaauaauuauacauccuuuacuucaaauuugcuaagaguagaucuuacauguucucaccacaaaaauaaaaggauuaugacuugaggugauggacagugagcugggcuguggccaucgguucauaacgcauacaagcacagaacaccacaugcugccaauguagacagauugcauuuaucaguuacaccucaauaaagaaaaaaaccccacaaagcuagaaggagcuuugcagacgauguggucaaccucccucaucacuggggugaccagcugugacccauaaaggccuaggggcuguccaggccacccagugguguggcacaggcccugcccccugcuggugaugggugucauguugcccucauggugcauuggauucaucuaggcagcagcgccacauccacagacgcugcccuucuccaggugcgucuugaugcaguagaggaguacugaccuccugaugcugacgcacaccugucgcauggggaggugcagcaguagggccucacccaggaacagccugguucugucacgcugugcagcccucucuugcucuccuccuccagccuuccccacggugguggaugcaggccccuugacaccuugcgacgcaugacauggagagcucuuuuuguguuaccauguuuugaagcauucauuccagcuugacucuucaguuacugugugaacaaacauuggccaucuucucagugaguugcuguuguguuuuccuuucagcaagugaacaauggccucacccucagugaccuuccucugcacaugcugaacaacauccuauaccgguucucagacggaugggacaucaucaccuuaggccaggugacccccacguuguauaugcuuagugaagacagacagcuguggaagaagcuuugucaguaccauuuugcugaaaagcaggugagugggaugcagcagucuccccucaggcugggaguuuauagacucugccugggggccauacccuauaaacucaccuggagagaaagaauggcugaguauuuucuacuuuuaaagaaccaggaacaaucagaguuuauugagauugcuguggguucucuccuauagaauguaagguuuauuuuucauauugaauagaaccaugacucuaaaaauaacccaaaacugaacagcaaagcaagaacugaguucuuuucucuccuguugauaacgaggugcauagagucccuggcucacugccuuuucuccugauuugaugaaucagauuccaguucuuuugaccaagcugcacauccuugaaaagucaggugcccucugugugccucagucucucagcacucgguagaugccgcuccugaguguccacagccccuccccccugccuugugugcugcacuugggagugcacguggggcagcagaagguguguucugcugucacuccuugaggccuuugcaggguggucugcuuauuccucauccacgaugagacccuguggucccuguuccugggccucugcagaaacuggggguuccccucgucaccccacagauguccaaggcaccugcucugcacagggcuggucgcagccagagaaggcagguggcuggagggaggcauguugugcuccucguggggugugauuugaacuguggucagcaccuugaagaccuaggaugggacugggugccuuucaugaggagcauagccuacccuuggaaugcagggcagucgacagggccuaggcagagagccggacccuagcauggggagggugcuguguguuugguggauagugaggaagcacggcagaggccgagcuacacuaagaauccuugucuguguccugugagcucaggggagccagcaaagcacauggaauugcagcuuucagaagagccucuguucuuguuugaggacuaggcuggaguggauacaagaggauccaugaggauccugccucaggaaaauaagaguuaugggcaaggaagugcacaagggcaacagggaagacaucagaagaugaccccgaugggaugggggcugccacaggaaggggcuggccugaacaugggccucacggagugugucugagagguauguggagcuagggccuagacagaugcauauggagaggacaggaggcaacgggaucagccugggcagggccucagggcaccaaccccaauguugagggauagaaugaggugccccagaaccuggggggagcuggacucucaaggccauggacagagagauuaauaggacaaagaaaagccugugagauuuagccgagcagagguuauggaugccuuggggaaaacucucucaaguggacuuguucgggagaagcaaaagaauuccaguauuaauuugaguaggagaacaguagauugaauuuuaagucagcauugggcaugggggaggggguggauagaauuuuguguggaggauuuagauccuaggaaaagagguaaaugaagguugccugggaugagcccucugccucccaguuugcccugggacacucccuaucacgugcaggcccgagcuguucccaaaaggcguuaaugagagugccuggcagguguuuauacaucuagacccuaaacauacuuaaggaugucuuuuggccauuucuguggucauugccauucuuaaaagaguugcuuuaaauaaguuaaaugucuguucugcacccacauccuagaauaguuaaguugcaauuagcaccugcaggugcaucucauuuguacacauuuucuuaacugaaucauaaaaacacagcaucagaaaauaaugaucuguucuucaggccucaguaacuaacauuaaggcccugaaaaaaaaagcauauuagaaauagcuuuuaugagaaagcuuagauaaggaagcauccucaaaguaaaaacuagauaccugagaaaacuggacugguucaagauaauauggaaggaaaagucagcuaaaugcucuugacuggagcaucuggugggauguugcauuugaguucagaaaaaucacagaugguuauucaggaggaaaaccaugggaggggauucucccgugaacacuggugucacacacagucagugagaaguaggaaugagacaacaaacgguuguuuuuagucucuaggaacuauuguuuuaacaguaccugccuggaggacagagaaauuaauauuaaauaugaacaggcugauaacgacuuuuuauuuugcaaguagucuucuuuucaaauuuuauuagaaacaagauuuccucauugacuccacgauaauuuccagaguccucaaaagccgugacugaaguaugaguauguuauacaagugauuguuuuuagcuuugaaaaguaaaacaugcucauugcagcaacagccauaaagacuaguacaguguuguacaaacaaguuaaaaggcccccaccccaaggcagcccuguuacuccuuuagcccgugcauuuuguuuuuuguuucaggcuuuuguaugcacucaaacauacacauuaauuucgcuagcucugcacuggucauuuucaaaacuguaauugaaagucacucuguaauacugauguuuuugguaacaccuuuauuaagauacccuccacuuuaugcagccaucacuacagucgauguuaggauauuggcaucuguauuaguccauucuccgcugccaauaaaagacauacccgagacuggguaauuuuuaaagaaaaagagauuuaauggacucacaguuugauguggcuggggaggccucacaauccugguggaaggcaaaggaggagcaaagucacauccuacauggcagcaggcaagagagcaugugcaggggaacugcccuuuauaaaaucaucagaucuugugagacuuauucacuaucacaaaaacagcaugggaaagacuugcccccaugauucaguuaccucccaccgggucccucccacggcacaugggaauuaugggaacuacaauucaagauuuggcgggggacacagcuaaaacaucagcaucaccucaggaaaaacaaaacaaaacaaaacaugcccuucagcugccauuccuagccccaagcaaccccuaaucgacuuucugucucuguguuucccuguucuggauguguaauguaagaggaaucuauggcauuucucaucuugugacuggcuucuuacccuuugcaugauguccuuacggcuccauguuguagaauaaaucagagcuucauucaagacugaauaauaucccccucuauguauauccacuuuuuguuuauccauucaucaguugauugacauuuaguuuguuugauaaaaguuuguggcuuuuacaaauaaugcugccaugaacauguucgaguuuguguguagaugcauguuuucauuucucuugguuauaaaccuaggaguagaauggcugagucauaugguggauucuguuuaacuuuuugaggaauugccagacuguuugcaaaguggcugcaccauuucacauucccccagcagugugugaggucucuugauucuccaccccuccccagugcuucucauuauuucacuuuuugauuaaagccauucuagugggcaggaagugggucucauuccauuucccugaugacuggauucuagagcaucuuuucaugagguuaucguccauuucugagacuuauuuagauaaaugucuuugcauguccuuugaccauuuuuuaaacuggguuauuugucuuuuuauuauugaguuguaaguguucuuuaucuauucuagauauaagucuguuaucacauaugauguguguagcuuauuuuaauuuaauaauacauuauggacauuauucuggauuggaguauuuaagucuguuuaacagcugcuugguauuccauuauacaggcauaacacaauuuauuugauuugucacuuauugauuuaacccaagugaguuuaauuucaaauaauuguuuuauguacuacacugccuuugaaaaauaauuucagauagaccuggaggccauuauucuaaguaaaauaacuuaggaauggaaaaccaaauaucauauguucucaguuauaagugggagguaagccacggguacacaaaggcauucagagagguauaauacacauuggagacucagaagagggaaggguaggaggagggugagggaugaaacacuacauguugggucacugcauacuucuccagugaugggagcacaaaaaucccagacuucagcacuguacaauucauccauguaaccaaaacccacuuguaacccuaaagcuauugaaguuuaaaaaaagaaauuaaaaacuaaaauaaaaugaaaaaguuuuacaccuaauauuauguuuugaaagucaucuuaugcggauucugaauggaguuuuguuuguuuaguuuuguagacauuugauccuuucagaaaaaggucauauugaauggaaguugauguacuuugcacuucagaaacauuacccagcgaaggagcaguacggagacacacugcauuucugucggcacugcagcauucucuuuuggaagguacugauuuaaaugcacucuuggaauuucaggauuaaauuuuggugaaacaaacuaaucaccuauauuuuaaguauaagacuaaaaagcggaaaauacuguuuguuauaaguaaguuaaggagauauauuuuaccaaauauugggguaggggaacagauguucauucaauguguagcuuaaaccagaaacgcugaaaaccaaaaugcuucuccuuuuugcagaaguuagcaugcaggagggcguugcaggcggauugcagccagugaccuuuccuggcagcagcuccagauucccugcuggcccccagccugagguugaaggcuggagugugaccccucugcccaucugaggacaagugcaccuuccucguuuccccagacuuagcccucggcccuuuauguccccaccgacucugcagggccaggaccagcuuaggcuucauuucucaaagccacauucuuagaaaaaaaguguccauagagaaguccuagauuuuaaaaucugcauuuuucucauucauaugaucagaacuuaacaagacuaucguuacuuaucugcaagucucaucccuucauccaguuacuuccuguucucaccauccagacugugugucuaaauagaauguuuuucacagucagagagguaacugcuuauuucuuuguugucuuuuuucuuuuuugaaauagggucucgcucugucacccaggcuggagugcaguggcgucaucacggcucacugcagccucuaccuccugccucucaaguagcugggacuacaggcaggugcuaccacacccagcuaauucacuucuuuuuuuuguuuguuuuuuugaaacagcaucuugcucugucacccaggcaguuaugggugcaguggcgcaauuauggcucacuucagccccgacuucugggcucaagugauucucccaccucagccuccugaguagcugggaccagcugauuuuguuuguuuguuuuugguagagacaggguuucaccguguuacccauggcuggucucaaaacucccaagcucaagcaauaucuaugugccccagcuuuccaaagugcugggauuacaggcgugagccauggcacccggcaauuauccacuuuuuucuuaacauguuaauauuauuucacccuggaguguguuuccaugguuugccuugcguuugaacauguuuauguugugagauuucaccgugggggaaaaaaaauguugaaacuaggcauaagcugguccuggagugacccugcugagcugcuggcugcucugcggagggaguccucugacugucccuggucuagaugaggcccugccucuugcaagagugggcugucucugccucuugccuucucuaggucuagggagaugaggcuuuugccugauagacaccauaaccuuuugugauuacuuuuuuugcuuuacauuaucuauauuuguuaucagauaggucauacggcaaacucuagguugucggaaagagacaacugcuuuucauuuuuucauuucaaauuacauuuauucuaaguguggcuuuaaaaauuaauccgugguugagcagagaauguaaagauguguuuuucuuguauuauuuuaauaguuuuauuugguauaucaaagguaaacagcaucauacaugaauaugagauuuuauuucugauuuauuguuuuauauuuugguaugacuucucucuuuccugaaauuaaaaagaugcaaguuguguuauguguuuuugcaguaguacaacugucuuguagacuauuaucccucaagagcagggaacaucuugauuccaguuuauucucgauuuggugaagucagcaaaucaguucaucaguaagauuauggauauacaggagagaacccucauucuauucuuuucuccccaguuauagggcacagaaggcacaguaugggggugaguugucugcaguagaagccacaggcagaugcuuguggacagaaggaaaggggccgauugagugaaguccagguucccagccagcuuugacaccugacccuggagggaacagggccccccuucuguguaauuccuucuaggacugacaccuguucuucucugaaauauuaacacugaaaacaugugacugugucuucagucacagaguaagaguggacacaauacuguaguuucuaauuugaguuagugcuucuccuaagaguuacuugucuuuuuuucuccugagcagauuguuuuguacuauagaacuauuacaagcaaugauacuuuuauagggaaaauaccauucauagaagggauagaaggcuuucaguuuuguaugugguaguauuuuucuuagaacaauauuuaucaauauuggagcucucccugucugcugagcaacuaacaaagaaauacacaguccuucgcuuccacauuguuaggcaguacagaucaagucucccuuaucugaaaugccugggacuugaaguguuucagauuucagauuuuuuucaucuguuucauuuacacagagcuugaagauaauuucauacaaugguuuaguaauuuuauacauaaaacaaaguuuguguuacuuaacauguguaguuuuccacuguggcaucaugucacugcucaaaaguuugggauuuuggagcaucucagauuuuuggauuacaggugcuccauguauauaagaauaugcugccuuaguuuccugaaauauguaauuucugauuuuuuuaaauugagagaugauguagccuuccaaaagaauuugcuuugccauucuuguauuuagugaacuuuguuaucauacuugaucauaucauggaaauugagaacaagucucuccuaggaaggacagcugcccaucucuuaguucugggagguucaugucuugcccuuggaggcugugauguccacuucacuguagcuacagugaguggucccaucacagcuucucccacugaauaucauucuagaaggcaguccacguuuuuaguucugaauccaugcauuggaaguauucaaaaagagccaucucuccuaauuuaaccccucaagaugucagguacuucuugcccugucuuccaucuccuccgccguggguuugcccaguguggcuaaccagaggcgaguggccuggugggccaaacccagauuggagucaggcagaccuggaccugccuccggggucuccugagcuugcugccccuccuagggucuugguuugacgccaugacccaccacacagaggagcuguggauguucagcaguccugcaccuggaaacuggcacauagcuggugcucagaaaauggcacuuaggguuagggucacugcuuguucuuuguuuguuuagcaucccaguaguuuguguugacugagaaacuaaaguaauaucaaagcuguuaagaaaaugagacuggguguuguugacucuaaauucuggcccugggacuuggucaugagccgacaccauggugcaucugucucaggucugcaucugguauuuaucacuucccacaguacauaagcuuggagcucuccagucagcagugcuguggagccacuucaucugcucccaagcugguuucccaucuguuguggcucuacuauauuggaguucuuuuuuaacuuuucuaccugccuuagucagccuuccacacagucuguaaguaacugggcugaguuaagcucuggagccaaagacugacuucgauggcccugcgaggguccacugagagggguggcguuaccucccggcuguacaaaaccucaguuaaaaacuguagacuuguuggcugggucagggaagccaugaugagcauuuggccuuuuuauguccuguuuuuucuugguguaucaguugccagaauagagggcuggccaucugacguucaccccacaggccuguguggacaucaggagcaaaguuggagccagaauccaagaugagguguccauggucuggugguccuggucuugcaggggaaccgcuuugcuaguagcauccugaaccagcgggggagaacagcacaggagggcagcugcugaggcuugggucuguguuggaaaguggcauucacuggccuggaggaacaagugucagagguggaggcuggcuuaagggcauguguggaauugacuuaaugugcauuacugagcacagagcagagccuucggauguuaaaugaagaacaaagaacuuuccccaaaaaaaucuguuauaaaguuuuaauauaaacugcacauggaaauagcaucucuucuucagugaauaauuuuaaagguuauuuagcacugcagccucauuaguugccaaauuugaaagacuuaaagguagagauauguugucuuaagacugucuucaaguaguuugggaauuuuuggguuaucugaugagaacuuguuugcuuuuaauaaccuuguacuguccaaauuuaguuaccugauguuuuuaguuauuuucguaaauaauaugaaucaaaccugaaugcuuagauacacucuggcucuuucuaaucuuaacuuuuccuuuuuuucccucccuucacugcauuccuuccugauucuuucuucaugaucucgaaggacuaccaucuugcuuuacuauucaagguacuucccugucuugccacacauccuguguucgggaugaaaacguugcaucgugcugcaucucaugcacgucaucuuggccacugcccggcucgauuccagcucucgcugacuugagcuuucucaggacccugagcagggcugaguggccacuuugaucaaacaccucagcaaggacgagaguguugaugaaauauuuugcagaacaacaccugagugcugagggaggcugcuagaugugcgcauaaacacuucaccacacagcaccugguuuggcagcacugccagggcaugccauggagagauccagcacugaccccagagccucuggucccguuuaccugcguuccuccuaagagucugccagucuucauccacaaaauuaauuuuucugucgucacuucucauauuaaauauaauucuggauccuuagguaugugagcauggccagcucccuuggagcaagcaggagccuugggggcugaggccgugugucccccucuccuguccuaugcagggagcccaagcugauucagggaugaauggcggguggagggaacccuguguaacaaagugagccaggaacaggaggacaggacaaaggaauggcugggaccagaggacagaaaguccccagugguuucuucuguggccuuguagauuccggggcagugcaggguggugucagcagcuggcuccucugacucaguaccagauucggcacuggagggcagaccuggggccaccgucuccugcccuaccugagcaggaguuccaugggaaaccucuauguagaaucggcugcggcugcccuuguguuggucauucucauccaaguuaucucccauguaccucugagguggggcccaggguccacaucaacaagcagcugacgaccccucaagcaccaucacuagaguguggcuggugguggggcccccuccuaaccaucucccaccuccccacaggacucaggacaccccugcacggcggccgacccugacagcugcuucacgccugugucuccgcagcacuucaucgaccucuucaaguuuuaagggcugccccugccaucccuauuggagauugugaauccugcugucugugcagggcucauagugaguguucugugagguggguggagacuccucggaagccccugcuuccagaaagccugggaagaacugcccuucugcaaaggggggacugcaugguugcauuuucaucacugaaagucagaggccaaggaaaucauuucuacuucuuuaaaaacuccuucuaagcauauuaaaaugugaaauuuugcguacucucucucucuauauauauaguucaaaaauacuuuagguggucagcuccacauucuuuguugacgugacacuaacggccaauaauaugcuucuuaauuaucaaauuauaguuucccaauugggaaacuaauuggggguggguuacaaaacauuugauccuuguaaauacauuguacagaauauuuauuuuuucucaaaaugcauuuuaacuacuacauuggcugugcccaaaugaguccucuuugaauagaaagugaacccagggcaaugacagccauucuugucuuagggauuauggaucgggguaugaagugugcacacgcagcccaacaacgggcaguggucucugugcuccuaggcauccagcacagguucuggcagggcaccccugcugggguugggggcuggucugugcauaauccuggacugugaugggaacagcccagugcagucuaaacuucaauuguguugaaacuacuuuaauagacaaaguaauaaaucauguuuaucuauugauuuaaacuucaucaguuuugcauccuacugagaaauguuagugauuuugauacuuaaauccuuaaaagauugcuucguuuuuaaaauaacgcauguccauuuuagaaaauuagaaaaucagucccaccacccaaagauuauugugcaugcugaaaagaguaugaaaaauccccucagcaggcauaggauagaaacguauuguuguauauuuccauuuuugaauagggucaaggagcccaagcaaaucauuucuacuuuuuccuuuaagcauaauaauaaaaguauacuuuuauggcguuauaa

SEQ ID NO: 191842 - RNA, 207074 nt, Homo sapiens
cuuuccggggccggcagaggaggaucuagguagaguacagacgucagccccgcucuggcggggcccggacagaaccgggcaugcuccgggcaccucccaucaugcggaccgucccacaaacacacguuagcauguuuagaaagggagcuaagaagaacuaaguacaaugcggcacuuuuuuccaaaaauaauaguuuuuaagcauuacggaagugcuaggugaggaagggcugcuccuggcccucaggaacugaggcagccguucacauaaacgaugcaugucuccagaggugaaggaccccuccuucccuugcuccucugugucuaaacauauucuaagcaaacucaggaagcaggguguucccgcauuugcauuuuucauguagaccuuccuuggcaggaagcagcucaucucuccagcuggccccacacacuggggucuggaugcugaguaugacugugcgcuuccuuccaagggcccugcgagaggcugccacgacacacuuuccccgaugcugguucaaaucacguggaaauuucauuucugagcugccaccagcacagcaaagcuggugccauauuugccaucagucuuuugacauggagcuaugcuuacaagaacaaggcccaaugcuucuguuaaagaugugaaauguugaauacaucugacaucaaacuguugaauaaaaucaacgucaaaccacagcugaagacggaagccccaucaguggcucugucugugguuauucucuaaccuaaaagagguuuguugcugucugugguuauucucuaaccuaaaagauugucagccucuuucucaagccacugacagcugucugcagugacagcacucagggcugggucucggaucauaaguucaauuuauauuuaaauguacauuuuuaaaaacguauuucagacuuuuagccagugcaucuauugcugguuugauuugccuaaagaauaauaucgaaaauugaaggaguccacuuuguauaaagcugugauuuuuguuaaagaaaacuacagccaaaaaguguuugcuuuucaauauaagaugauggaaauggguagaguucuaaaggaugaccguccauuauccacugcaacugaguccuagauuuguugcuaacugacguucuacacagccuuucuucacucggaaauagacgagugaaaguauuucgacuucucauuaggaaggaacaguggcuaucauguuugaauaauuaugcaucuguuuuuuuaaaccucagucuggcaauacuccaucgcgaugaaucuucacuacucagccugccuggggaggcuuccaaaugcacgggacucauuugacguuuguuuucuugaggcuuuggagguagcucagcugccuuugcacugucucuggacaauguuaaugucauaguugugucuauuccaguucuucuccauagcagcggcgcccacgugccccaggggccuucucuggggcagcaggagguaccuggggugguucugcuugggcucaggcacagugaaaagaaccuggaggcuggagcagggggcacagaacugaaacaagagugcaggagucacucuggggaggccagcuuugccuggauucugacccuggacuccgugguugagaguuuguuuguucugcagccacacaagugagcaucgagggaugaggcuggggggcgaaggaggcagaaugucacauggguggcuuggugaaggcuggauuguagggacagaaagcauuuuuucaucuuagcccuuuguaaguaaguucaacagcauuaaaugcauucauguugcuguauagccgucagcaccucugucucuagaacuuuuuccucuucugcaaguaaaacucuguccccaugaaacacucagucccuuuccccuccccagcccuggaacccccauucugcuuucugucucugaaacugacuccuccagggcccuccuagaaguggaaccacacaggauuuguuguuuugugacugcucauuucacaugggguaaugucuucuuguuacugcauguaucaaugugucacacgcccuuucuguugaaggcugagccacacugcacuuuguggauggaccacacugguuuccauuccuccguggacagaccccgggucgcuucuccuuggccagugugaaugguacugcugugaacacggagugcagcucucucuccacgucacuguuuucgguucauuuggguaaauguccagaaguggaauugguggaucccauggugaagcgaugcuuccucguuuugaggaaccuccacacugcuuagggacagggugugcuuugcgagcugccucuacagucuugccaugggguggggguuggccauuguaagaaugagaagggucagauguuagaagcucuggaaagaaggaaaugagagaauuuggugacgguuggcugagaggacccucaaacacgugccuggcuuuccccucuuggggugguacguggguggaggacucuggagggagagggaggaacugcuguagccaucuggugagcccagggaccugaagcagccaggugcaggcacacggugaccuggagucacaagauuugugcagaagugcaccucgugaggaagguggacgcauugguuccagggaggccuuuuagcccauucgugcaaauauuaggucuugacccugguucuaugucagucaggaucacuuggggaaaguuuaaaaacauaccagugcccaggccccaccugauguauuugucugagaaaggacuuggccauugucgucuuuaaaaguucuuuaccugaugcuuuuuuuuuuaauggaagaaacgcuucuuguuuuacuuuaaaaauauuuuuucuagcuuuauuaaguuauauucacggauauaaauuguguguauaguauacaacgugauguuuugauacagguauacguugugagauaagucaacaaagcuaguuaacaucuugccaccucacauccuuaucaucaccuugugcuuuuaagaacauuuaagaucucaucucuuagcaguuuucaaguaaacaaaccauuuaacuguggccaccacgugguaccauagaccucgucacuuacuccucuugucuaacugaaaugcugcacccuuccgccaacauccucccaguuccccccaacccucucucuguugaccacuguucuacccucugcuucugaguucuaugcuuucagauuccacguguaagugaggucacgcggcaccugucuuucugugccuggcuuguuccacuuagcaugauguccuccaggcucaucuauguuguugcaaaugcuaggauuucucacuuuuuaagacugaguagguauuccacauuuucuuugucugugccucugcugaugggcuugagguugguucugcguguuggcuguggugaacagcaucuuaacgaacacgagagagcagauaccccuuccacacauccauuuuauucccuucagaaaaauacccagaagugggauuccuggauuauuccuuuaucauucuaauguaccccuaggauugagaauccugauauaaaacauaugaaaggauaauuaagagaaaaagcaaaaaacacaaaaagaaaggaaggaagaaggaaggaaagagggagggaaggauaucugaguuauguucccaacacuaucauaacaacauugggagcaaauagcauuauuuuagacauuuguuuuuccaaauugaguguuccaaucuccucaucuuuaaauugagaggguuaaaugaugauuuuuaagggaucuucccagucacgaauuuauggaucuauaauucuacugggucaaauuaaaauuaaaaacacuucauaaugaucuugaugcuauuauagugaaugaguaacuaucauuuccaaaaugcugugggacauuuuacagcacaguauagguuaaagucauaaagcaaugaagugacauuugcuucugguccuauuucaaagcaucaaucuuuuuuuuccaacuccccucagucuucaaaagcuccaaggaaagcugaguagcauuggcugaagagcuuaagauaccauuagugccagaugaauuaauaaaaccgcccacacuuguguuauuagccauuaccucuuaagagcauuugcguucucugaagcucauagaguguaauguaugaaaaguaauuuuaugauggggaaaauggcugugaaauauaggaggauaaggaaguuuuccauaaaauuaaagucacugauaaaaugaauuaauguagcacauucaaaacgaauaccuugaaagagaaaaaccucacuuuuuccagaagaaauguuucuagggaagaccuucagacacacuagaauuaaauugcucucuuaauaacuuuuguaacauuggcucauuaugacguuacuucuaagaauggcauuuuuucauuuucccgaauguuauauuuaaaucagcuguaaagaguuggugauuuauuugcaucuaugaagagugcuauauugacccaaauuuugcauugauaaaugaaugcaaaaugaaauuuuaaaaaguuggcagauuaaauuaucaaaguauauuaagcacauauuauauaugcagcacaacacugagaaaauguacacacuguguaauuuugaaauaccugaauauuaaaauaauacuuagagccuuccaccuggcaggcacauagauugugaacauguuuuuauauaauagaacaucagcuagcauagcuuuaaucaucuccacagcauuuaagugcaccaaugucucauucuaauguuaauacauaucuugucucacaggaauuccccuugggauguuuauuuuuguguguucuuucaaaaaacaaaaacccagcucuaccuauacuugucauuuuaucguccauacuuauuuucuucagggaaauuuauagaaauagcggaaguguauuacauuguagguucuuggucucacugacgucaagaaugaagcuguggaccuuuugggugaguguccggaguuuguuccuuuuaauguucagacguuuuuggaguuucuuccuucuggucgguuuguggucucaauggccucaggagugaagcugcagaucuucgcggugaguguugcagcucauaaaaggagugcggacccaaagagugagcaacagcaagauuuagugcauacagcguaaaaauuaagcauccacacugcccaagacgaucucagcagguugccagugccggcucaggcagacugcuuuuauucccuuaucuggccccacccacauccugcugauugguccauuuuacagagagcugauuggucuguuuuacaaagagcugauuggucuguuuugacagggugcugauuggugcauuuacaaucccugagcuagacaaagagugcugauuggugcauuuacaauccucuaucuagacauaaaaguuuuccaaguccccacuagaugagcuagacacagagcauagauuggugcauuuacaaaccuugagcuagacacagagugcugauuggugcauuuacaauccucuagcuagacauaaaaguucuccaaguccccaccagauuagcuagauacagggugcugauuggugcaucuacaaaccuuuugcuagacacagaguucucauuggugcauuuacaaucuccuagcuacacauaaaaguucuccaaguccccaccggacucaggagcccagcuggcuucaccuagcggauccugcgcuggggccacgggcagagcugccugccaggcgccugcacuccucagcccuuggagggucaaugggaccgggcgccgcggagcagggggcagcguccaucagggaggcuugggccgcgcgggagcccaccgcgagggggaggcucaggcauggcgggcugcaggucccgagcccugucccacggggaggcagcugaggcccggggagauuuggcgugcagcgccggugggccagcacugcugggggacccagcacauccuccgcagcugcuggcccaggugcugagcccuucacugccccgcuggcgcuggccggccgcuccaagugcggggccgcggagcccgcgcccacccagaacucgcgcuggcccaugagcccacaccucucccuccacgccuccccgcaagcagagggagccggcuccggccucggccagcccccagggcaguggcuggcugaagggcuccucaagugcggccggagugggcgccgaggcggaggaggcgccgggagugagugagggcugccagcaugcugucaccucucagaagcagugaugugcugagcuucugucuagaaagaagguagcaguccacccuccugucucccaggcauucguucacccagguccucagccaccgagucuuccuccuucacccacgacccuccuucacccaccacccucccuccacccaccacccucccucccaggcauccuguagccuccaccaccacacuuccugggagguucaggcuucagccuugaccuuccugcacugcccaaugggagcaucgugaccacacauuuuaggagaaggcuccuuccccacugugacaucaaacacguggucacaugaaaggccuagucuguggcacaggaaaggggcccugaggugcaggggagggucauugucaguuaaucacaugaaagcucaccagggcacacugcauuuuaacaaccccguuuuuaaauuuuauuuccacacaaacacaucagauaccuuuaaaguuagacacaucuaacauuuguggaacuuaggaugccagggcuuuucaucugaauuucuggggugcauuuacagcuuuucuccuaaacaucacgcgucccauucuggccuccugaagggcggugccugcucccgggcugcccccugccauaccccgcaaacccccgccacccccugcaaacgcccaccaccccccaccccucaccaccccccgcaaacccccgcaaacccccgccacccccugcaaacgcccaccaccccccacccccccaccccucaccacccccugcaaacccccacccccccccgcaaacccccgccacccucugcaaacccccgccacccccugcaaacgcccaccaccccccaccccucaccacccccugcaaacccccgccaccacgcgcacaucgcuguugaucauugcugccuccacgcgcgccgacauccauucaaacagcaauugcugguguuuucuccucugugggaugugccaguaagaaugaccuggaagcucccagacauacguagcaggcucaacguggcgggggaguuggaaggaaaaauggaauccacaacugcugcgcacaggagggaaaugaacccagugcccgcaggaggcgcugacggcguucccuaaaaacaccgagcaggcaaaugagugcggacuaagcgcccggggaagacggggaagacggggccaggcucgggcuccggggauucguaggaucuccagaggggaucauuuguaguuaaggaucuaauauugccacauucucaaugguuuucuguucugcaguucuuuagagcacugaguuuuaaaccaugggcugcaacucauuaaugacccgugaauucaaguuacuggucacugccagcaaauuuuuaaauggaaacaaaaauacaacagagaaguauagacuaggccgggcacgguggcucacgccuguaaucucagcacuuugggaggccgaggcgggcggaucacgaggucaggagaucgagaccauccugccuaaagcuguaaaaccccgucucuacuaaaauacaaaauauuagccgggcaugguggcgggcgccuguaaucccagcuacucgagaggcugaggcggaagaauugcuugaaccccggaggcagagauugcagugagcugauauuacgccucugugcuccggccuggcaacagagcaagacuccguccaaaaaaaaaaaaaaaaccguauagacuagaaaauaccaaaguacacucuggauaauaagagcacaugucuaaugaaacauuuuuugggugugugcguguggguguguguguuagguucugauguaaaauauacgucuuauuguggaauauaauccaaaaaguuugaaagcccuuggcaggagcaauaccuugcagccaucaggguggugcagagaaaggaagucgcuuuugugcugucucgguguuugaaacaggaagcagugcgugucguggguucucagaggcagguucugcaggcaaagccuccgcacauacacuggaacuugagcaauucacccaccucuccuguucuucucauucuuuguuuguuaacaaaaagagaagggaucguaaccuuccuaccucguuggaauuuuaagauaauuaaauaugguaauauaagaccuuagagcaagguguggcucacagcaaguguucaaugucaguuuuuaccaugauuaguaucauugucaucauugcucauacgcugugaccagguaacccagcaucaccuguccagguuuaaaggugcauucaggagguuucaggagugcagcucuggaggacgcggccgcggagaggagucgguguaauacuccagacagauguccacguuaacuucauguguuucccgaacaugauuuccaugacaacuaauuuauuugcauauugcaguaacugaaaacacagacuucuguaauuuuagauucugaagaguuuuuuguaaggauuugccccuuuaacugccuguaaauuacaagcacgcucccgugcaaaugggcauucgaaaaggagucggaauuugucccugggagguauuugugauuuagauggaaaauuaaauagaaacaggcuggcuuucccuggacaacagcgauaacuugcugauguguuuggaggucagccuguggcugugaaguguggcuuccaggcucauaggaagugaagguccgcugucgggaccuugccagccucguugccccagaugucaggcuuccagaggaacucugcagugcgugacgaacguauuguugcauccucugaagagcugagaaacgucaucaguuugugaugccugggccacuccgugaaagugcugucaaggaugggaagguccaguuuuguggcagguccaaggguugaacacgacgaaggagggacaaggaaaggaacugccucccaccugucacucugcgugggcucccugcguucuggugccuuggucaauaugcuuaacgccacagcaaacaugaaggucacaggacgcgcauucucauucugcaggugaggaaacugaggcacagagagaguggugacuucuccaaggucauuagugaaugaguggccagucuaggucugaaccaagccaaacccuguaggaccuuuugaguauccacacugcuuccccaaggaaacuaaaauauuauauguccaaguccaggagguccacucaacaaauaaaaggcaaaccuugcauuugacaccugaaacugaggucgguguuacauaauuaauaaggaauuguguuuggaguaaaccuagaaggaacuugcacauaagauaauuugcucaaucaaucuggcacaucucccuuugcuaaugaguuaggcuucuccagauaaaucugugagaauguuccauuuucucaaacaguauuuguucuccccagggcaucaguuaguucagcuugaaaccuuucuuauaauacaagcaucgucauuuucaccacacuguggaaccgaaaauaaauuucccuagugggugaccauccuccauggauguaagggcugucuaguguaggacaaucaauagaugaccaucuuccauggacguaagugcugucuaguguaagacagucaauagaugaccaucuuccauggacguaagggcugucuaguguaggacaaucaguagaugaccaucuaccauggacguaagggcugucuaguguaggacaaucaguagaugaccaucuuccauggacguaagggcugucuaguguaggacaaucaguagaugaccaucuuccauggucguaagggcugucuaguguaggacaaucaguagaugaccaucuuccauggacguaagggcugucuaguguaggacaaucaauagaugaccaucuuccaugggcguaagugcugucuaguguaagacagucaauagaugaccaucuuccauggacguaagugcugucuaguguaagacagucaauagaugaccaucuuccauggacguaaggucugucuaguguaggacaaucaguagaugaccaucuuccauggacguaagggcugucuaguguaggacaaucaauagaugaccaucuuccauggacguaagugcugucuaguguaagacaaucaauagaugaccaucuuccauggacguaaggucugucuaguguaggacaaucaguagaugaccaucuuccauagacguaagggcugucuaguguaagacaaucaguaggucacaugagcaaaggugaaccccaaaaucuguuuaggaauuggaaagagaaacauuaggcuccaagucuuaucagagccugacaaaaagcgugcguguuuuaugugcacuuucuaccaccacucggguuugguauuggaugaauacuagcugcaguuagcaguaauuacacaucugacuaacaaucuucagaagucucccugagaacgguguuccucagcccugugacgcaucagcccagguaggcagggcugagggccgacggccucccuaacgcgucugguccacaguucagugggagaagcccugcugggaacagcuggguuagagugcacucacguugcagaaagccuguugcuagcaaacagauguccauuguagaagaaugugugcuccuccccauaaauuucaaagaaacaaaugucccauaaacuuaaaaauaacccaugaauguuauuacacuuaccuugacaacaugaucaaaguuguuuauuucacacgguuucauaagcagaaaucgccagcuagugaucacgguucagacaaaugguggaaaucgucggcggcauagggacggggccagcgugggugucagccguggguguggcaguuccgcacugaccucggugcauuccugcucuggagucuagcaugggaaaaucacagcccagaagacccucggguugcacgugugacugacgcacucccccgagagaggccaacaccucacagcagccugccgcagcagcgaaaugccugcacugaggcugucuguuaaaagcaaacaacauggcaguuguuuuagccaagcacgcuucuugcugagaauucuaggagguucagcugacagcaaaugcgugaguaccccagcucgcuguguccauggaguagagaucucagacuucgcagcuuugacuuaucaaucuaaagguuaauuagacaaacugggugacuacugccaacauuuucuaaagacaggucacacucuagguuucuaauuugucuuccgaaugacccugauccuggaaagugaggccccgggucauggucgcaccgccacccugugccaucugugugugcacguuggugucccaggccacagcggagaaagaugggagaggccacaggccaggcccugggaggaucagugggauaagcaucugccuuucccagugcagaggaggauggaagaggccacaggccagcuccagggaggcucagugggauaagcaucugccuuucccagugcagggcaagacgggagaggccacaggccagcuccagggaggcucggugggauaagcgucugccuuucccagugcaagggaggacggaagaggccacaggccagcuccagggaggcucagugggauaagcaucugccuuucccagugcagggcaagacgagagaggccacaggccagcuccagggaggcucggugggauaagcgucugccuuucccagugcaagggaggacgggagaggccacaggccagcuccagggaggcucggugggauacgcuacugccuuucccagugcagaggaggaagggagaggccacaggccagccccacggaggcucggugggauacacguccgccuuucccugggaacagcuggugggagcggugcaagcacagcccagcucagaggggccgucacccccaucaguggcaagugguuugccucuguggcauagcaccugcccaucucccagagacaauacugccuggaaaauugcagcauugaauuucuaaccuaaaaauugaggugagaccuugcuaagcccuccuggucguguauguaagcucguugggaacugcagcuuuucucaguaaaagcuuccuaaucauaugcaauucccuaaaaguacacuuuuuaauaaacaauuauagauguguaaguuacaaaaauaauacagagaaauccugggcacccuucccccaguuucacccauggucacguucguacaguccaagguccaacacgaaacauccuucuuccagacaauggcggucgaaccucagacccauccuugccuuccuucccuccuucauucauccauccauuucagcauuuacugaaacccugcugccuacgcaaugugauugagauguugaacugaaagguaccaggagcucacacauccccuccccuucccggguuaucuuacgugauauggggcacagauuugcuuuaaauaauuuacuucugagcgcccaccacucuggagaagagcuaggcaggcauuggguggcgucuuguggccacacgagcagccccaggugaagcaaagccugcacccaauuagacaucuaggaauucacagugacgggaaagaggaauuguacauaauuagagauauguuuucucuccaguacaaauguccucuuucugccugaauuuaaaugcaacucucauuuuuucuuaugcgacuauucccagaaggcuucccgcauccugcgaagcgaaggguaacccccaacagcccagguguuuucaauggcacacaugguuccugcuuucuguuucacauaacacagaaccccagagcacguuuuaagcuccacuuuuaaaacuuaaugaaauuguauaaaauucagcuacuguaucaaggaacagcgagaaaauauuguguuggagaauauaaaaggaaauaauaugaauagcguuaauauuucaguaagagcuacacauguggucaggagugugaaacuucuaucagccauuuauggguguuucucaccuccaggcgccgcuagagaacuuugcuuauacucaccuaugucacucaucccuucacagcuguguggccucucugcugucaccccauucuaaaggaggggacagcacgugacagaacgagucccacagucagugaggaugggcacacgcugcagguggaggcccaagcuccuaguccauguagcugcugcaucucucagcaggacaggaaaggaaggccggccugaguccggaggguggcgcucagcgugaugccacccagagucugacagagcugcauggcaggaccccggggagaugaaagccagccccacgaggggaagagccccuacaagagcacagccagcgggcaggagcacgcagggagaccgacgugcagggacaccaacguguagagagacugacguggagggagaccgacauggagggagaccgacgugcagggagaccaacgugcagggauaccgaucccugcagggagaccaacaugcagaaaacgcauguuuggccugaaaugggauggaugcauccaaccaaagagaaaacaaggaaggaggagacauggaaggcagccuuggaaaucacggagaguuguugcauugauucuuuugcagccgaugagcacacccacccugcacuugaguuucagggccaaggugucuuucuuucuuuugaagggaaaaaggaccugggccagagaaaccaucauggaggcauccugggaggggcacagagaaaaggaguccucucccuucccuuaagacagacagggcagucagcauacacaugcacauacaugaacacacaggcaugcacacagaugugcacacacacacgcagacacaugcacacacacgugcagacaugaaaacaauuguagacaugcaaaaauaugcagacagaaaugugcacacacacacacaggugcaugcacaugcagacacacaugcagaugcacacaaacacgagcagacaugaaaauacaauugcagacaugcaaaaauaugcagacacacgugcaugcacacacacaugcagacacaagcacacacacaugcagacaugaaauauacacauacacauguugacacacacaacaugcacaaauaugcagacacacaaacacaugcacagauaggcacacucacacacuuguaugcacacacaugcacaaacauacaacacauacaacacaccugaccugucugccccuccagucuguucccugcucccauucccucuguacugugcuauggacucuuuaauuccuuucccuuuuccuccacaucucacagagggaugggcuuauuacaaugugcaguucccuuaauggaugagugagugaaugagugcaggagggaaugaucgagugagugaaugacuggaugagugacugaguuacugagugagaaugagugagugagugcaugaaugagugagugaaugaguaacugagugaaugagugagugggugaguaaaaaaguacaugaaugagugcaugaaugagugacugagugaaugagugacugagugaggaaaggaaagagggagggaaugagugagugagugauuggaugagugaccaagugaguuacugagugagaaugagugaaugugugcaugaaugagugagugaaugagugaguuacugaguaaaugagugagugaaagagcacacaaaugagugacugaaugagugcaugaaugagugagugaaugagggagggagggagugaaugaguucaugaaugagugagugaauaagggagggagugaaugagugagugagugacugagugaaugagugggugacugagugaaagagugagugacugaaugagugggugacugagggaaagagugacugagugaaugagugggugacugagugaaagaguacaugaaugagugagugaaugaguucaugaaucagucagugagugagugagugcaugaaugagugagugaaugagggagggagggcgugaaugagugagugaaugagugcaugaaugagugagugaaucagggagggaaggagugaaugagugagugagugacugagugaaugagugggugacugagugaaagagugagugacugagugaaugagugggugacugagugaaagagugagugacugagaaaaugagugggugacugagugaaagaguacacgaaugagugagugaaucagugagugagugagugcaugaaugagugaaaggcacaaucaggcuugugccuuuuuuugugcugaaauuaguuuuaagcaggugaaacucccuacagcuucaagaggaugaggagauauguuuuguucuguuugcuugaaacaauaaaauacauaaaaaaugaagcaccucauccacugucucaggcagcgagagccugccaguccccaacagccccagggugcagaggugaggaaggcuuucucaccuccgcggucaccaggaaucgagguucaguagaaucaccccaucuugaaggccgcagccucaagguccaagucuucauuccccagguugaagacaugagcuggggacccccauggcuguggguggagggcgaguccuggacguagugcuucauucugucuuuugaaaggggugauguuagaaagugaguucuggcagcuguggggaggaagaagucaagcccucuguggggucaggagcuuggaaaaaggacccugaagaguuagaccuggaguggccagaccuaggcagggauggaagaacggauguggagcccaggaggagcagagagcacgccaugagggaggggccguggugaggggcaccccugggcgcccagugcuugguccugcaacaccuuacgucucagggcguuuccccacccccugcuccacugagagccucccacccuggccucguuuccuccaccgagcugugcauccucagggagagagagcagaagagccgcuccucuuuggaaaacugagaagcucuccuccgagucagugcucuccccauccaccagcaaggggccccuccauccgaaugcaggcacacaccugcuaaaaugcaccacacagcagaagggccucccguuucuggcuaggagagcccugccuguggcaggcagcagcauuugcaagccucucugcaguuacgcuuggaguuuuggugugguggaaauaggcaagaagucgauguccagcugcuuguuggauuagggaucacaaauguguguuuauuuuccaaaaacaagacauuggcaugauaguguggcccugggggcagggucauggaauaagacagagacuggggagccuugcacaaaauaaccaucccccacgguauguuguuuggaccugggaacuuucuggagcaagugcucaucgucaguaacacacacuaacugaauuucacucaaggcagauuuguggacuauuuuguugaaaugacaucuguagaaaaauuuaaaagugauuaaaacugauggcugcugccggaugauggagucuggugcaucucagacagcccuuauuuggaacagucugugggcaugucuagguuauugaguguuacgcuucuguguuaugugacuuguccguaccauuuagccucccaauuggacacggaaucgaguuugcuagcguucagcccuaacuggaauggcgacugcucccaaauugcauucuggcccuaaugaaaucugucugcuucauccucaucugccaggacacagcacauuagcucuuauggguuuuguuguuuguuuuugucuucagauugucgguucuguggcuguggcaaaccgaguggagguuuaagauggacuuuuaaauacaaauuaugaagggaaaaagcaagucacuucauguaugcuugugcauuuacaaggcacauagaacaaagcugacauuuauauaacguuugaguuucauaagagcauggcuguggugacuguccaguuuuuagaugaagaaauugagucucauccaaccuugaucagcuaauaaaugaccacguggugauuucggcccagacacccuuauguuccuaguagacuugagcucaagucauauaaauuugguucucccugccauggacaaugguucuugaguaaauuauggagucuuugagauuuguuuuucucaggcuccaaauauugugauaauauauaaauuguacagugauucugcaaaccauaucgaacccauguuagauauuugcauucuagucacugucuuuggcuacuggaaaugauuguaugugugugcacaucagcauucaguggauacugagcggcaucuggauauuuaguaaaacacauucucacgccagugcccgugcuucucccucugcguggcuaagaugagaccaacucugcuuggaggguccuguccaucccaggcccucccgaccguguguccuccagcuaauuccgaaauuuugagugccaggaucucaacaacgagccacagauaggagccuguggucccugccgugaaggagcuggcaguccaggaagggauacgaaggcuuggcuuucacaugugaugugcuaaggugucagaagggaagaauauuucagcugcaauugggaagaaacagaaggggcuucuggaaaaugagcaacgcuguccuggaaagugaagaacaccaaaguuagcucagcuuuacgcagcggcaugucccauccuacgccugaaaaccaaaaagcauagaacccuugucuacuuggaaaucuuaaaaaaaaaaucuaaacaugugcuuugugugccaaacaguagcuccagguucacugacugcccgaaauucaguguuuugcacgacaaguucauuaaccugcugcugaaagggccuuugcaauucaagguuggauccaucagaaaauagaauaugaaacugauaaagcucucuuuucaagucaauacuuuauuuccucuccaggaagagacuuucguuagagaggcacaagcugcauucucugacccugauccccuuguuuaacgguucugacgacccugagccuggcucuccccaugcaccuuccccauggacaccaccucuugccuaaacuagauuaaauguuccagaccccagaagaaaaguccagaacucauugugggccugggauccguaugcacuugccugccuguaagaagccagccugcgggccuggcccagcugggaugucagcauccuggggaccuggcccugugcugccugucacaguggguuuugugcucagcaggugauggccccggcagggccgcccauggcuuccuuugggggcacagagcaggggagcaugggugggguggggauccuagaccaaaggggcguggcuggguuugggucuauccucccacaccugcccugggagccucgguuuccagucugcaggaggaggaggagcucccagcugcuucgcaggagcaggaggugugggccaucgcuguuggcugcaugugaaggaggggccuucuccacugagagcucucucugccccuggagugcugggcacgcuguccccaucucugcuucccaacauaccaugggcuauacaccugaugaacauguuagugauuaucugacgagaucaaugguucaucagcuaucgaugggguguccacaauggcugaggagaagaacagcugcaggcccccaccccggagcucaugguucacagagggaagaagaugggaaaacgcuggggcacacggaggggagcgaugcaaucggggaacccagaaaguauuuggggagcaggaggagguucacuccgagugguuucccguguucuucaccccucgcacuggcguggugcaucugucacaauugaugagccaggauugauguguuagugacuaaagccauccuucauccuucacgucaggggucacgcuuggcaugguccacccuguggguuuggacgaguguuuaaugguguggacuccccacugccaccucacacagagcaguuuccuugcccuaaaaauccugcgugcucccccuauucaucccucccugcccccaaccccuggcaaacacugacucuuucgcuaccuuuguaguucugccuuuuccagaaugacccauggauucaaagagugugaaggcuuuuucauggcuugggagcucauuucauuuuagcacugaauaauauuccacugccugauguaacgguuuacucaccuccugaaggacaucuuccaaguuugggcaauugugaauaauguugcuauacacaucugugugcggguugauguguggauguaaguuuugagcuucuuugggugaauaccugggggcgugauugcuggacugcauggugagugccuaguuuuguaagaaaccacgaaacugucuuccaaaguggcugcaccgcuuugcacucccacggguaaugaaagaguuccugaggcuccgcguccuggccggcgugugguacuguuggggucuggauucuggccguucuauucggggugugguggugucuuguuguuguuuuaauuuggaauacucgggcgggaggugauauggggcgucugguuugcacacuuguuuuaauuuggaauacuugggcggcaggugauauggggcaucugguuugcacacuuguuuuaauuuggaauacucgggggcaggugauauggggcaucucugguuugcacacuuguuuuaauuuggaauacuugggggcaggugauauggggcaucucugguuugcacacuuguuuuaauuuggaauacucgggcggcaggugauauggggcaucugguuugcacacuuguuuuaauuuggaauacucgggggcaggugauauggagcgucucugguuugcacacuuguuuuaauuuggaauacucgggcggcaggugauauggggcaucucugguuugcacacuuguuuuaauuuggaauacucgggcggcaggugauauggggcaucugguuugcacacuuguuuuaauuuggaauacucgggggcagcugauauggggcgucucugguuugcacacuuguuuuaauuuggaauacucgggcggcaggugauauggggcaucugguuugcacacuuguuuuaauuuggaauacucgggcggcaggugauauggggcaucugguuugcacacuuguuuuaauuuggaauacucgggggcagcugauauggggcgucucugguuugcacacuuguuuuaauuuggaauacucgggcggcaggugauauggggcaucugguuugcacacuuguuuuaauuuggaauacucgggggcaggugauuuggggcgucucugguuugcacacuuguuuuaauuuggaauacucggguggcaggugauauggggcaucugguuugcacacuuguuuuaauuuggaauacucggcagcugauauggggcgucucugguuugcacacuuguuuuaauuuggaauacucgggggcaggugauuuggggcgucucugguuugcacacuuguuuuaauuuggaauacucgggggcaggugauuuggggugucucugguuugcacacuuguuuuaauuuggaauccucggguggcacgugguguggagcaucuuugguuuccacgcuuggcaucugaguguccucuucggugggguccacucagaccuuucgcccauuuuucccaguuggguuugaugcaccagcauccugccguauaacagucugguucugaugcuuguucuguuucuucaagcugugucuucuguguugaaauaugccuugugguaguuuugcugaaagccgaaacagcugagugcauggggaagcuggcaggugugcagcagccggggcccagggcaucacacccacaggggccugggggaccuccuuuugcucagagcacgggauccacagugcuggggccaaggccagucagagccucacgcacgggugcugggucaucaccaugcccgggaagcugggcccccggccaucagcagauccuuuacuuccuuacgucuugguuuucuccucagugaagcaggacgcacagguuuccucauguggccauugcaaggauuuaaggggacgccuguaaagucaccagcagaaccugggagcugaguggaggagcuucuuuuucagcagaaagagggagaaugaguuuucaggaucaggagacggcagugaccugcuguguaaacuuucaaauuacacgcgccaagugguucuaaauaaaugaaucagguuaauuagcaaacaacagccauuuauucucuuuaauagccucaugggauaucaagaggcuauuauaugauaugauaucaugcauuuuggcaugaaaauuagggaguagcucuacauugcuaaagggaugcagcuuuuuaccugggugacagauguauauguuuuaaaguaacuuaaaugcauuacccuuugcucuucacgucagccacauaaacuaaggaccaggggcagcuggagacucacuggucagaaccagcagcacuggggucacacccaggcugggaaccugcagacggcacugcccgugcggcaucuccugggaccugggagcuuucacgccacgcguaugauaaguucuggggggcgggagugaggaaaaggccccccucuggugguccgggcccaugguccugccaggggcccacagcaugaagauguagcucccucacacacacguugaauuuggauuugcuugucuggcuucugcuggggcgcaggauguggggauggaaggaccaagacacacgacagagaacagcgucacggggucaccgucccacuucccaccccgcgccucacagcacagacgggggauuugccggccucacgccggccgagccacugcugacuucacgcagccccagccaugcccccacgcagacacacggagccccaaggcgggccagaucucagggccggauggggcuguggagcugugccuuagacgggggggaaggacucccugccccaggccggcaccgcacagucccuggguagaaaauugaguccuguuuggaggacagcugcucccacaucugggggccucuggaucugcagggcagggcuuuggugguccauaaacauaccccgaggaacacucguggagccgucugcauuuuauuuuugucaauuauggcacuaaucauguccuuuuacuagagaucccgcagugucugugcuccuucguuacaucccuaaaagacaagcucccgagggccauccaugguggccucccagcaguuccugcacgucacagcauuuaaaagaaauccagugaauaaaacaguucagcuucaauucaguaaccgcauagaauuucacuugugaauugaaaaguucagggccugagauaaucuuaagcugcuggaucuguggggaaaacaaacaucugagguccagaauucguuuggagacuccgccgcaaguccggauucggcaucagaucagcugugcugugugugcuuccaaagacguuucugaucugcagggacgucgucccguguaagaguucagcggugccuccacucuggacggcagaacugauccccagacggggcuggccuugucuuucaagcagagaccagagugggcuuuuaaaggggaacaucuucagggugugcgucggggucagccucauguucccagagcccaucugagaggccggcagggaggaagggacccuguuccuugcugucuguuguccaccaaucuccuuagaagguugucucuuuaggggacaacacagacccucaccggugcugacugggaggaaggagccuggcuacccccagcugugcuuccaagcagugugagucacauuuagcguuguuugcagaacugaaaugcucccuguagagucagcuugggcagcccuaacuaaggagcccagacugggcggcuuaaacaacggacguugauucucccauguccuggaggcugcaguucaagaccaagguauggcagagcugaauccugcugaggccccucucccuggcaugcaaaccccaucuucuccuuguguccucacagcgucaucccuccgugcguuuuuguguccccauaucaucuucucaaaaaaauagauccuggagcucuuuccauauaaucacauaaaaaaccuucucauugccuuuccaaggguacaagugacgucacacagugagagggacacagucaucggaccagcuuacagucuucccaccgccuugccacagaccugggcuuucugugaacaucucagguccuuccgucugcaucacucuuaccacccguggguucaucaucuucccacaugauccugggaccuuuuagcgcuguguucugcuaacccuccugcacacccuuggccauuuguccccgguuauuuguugguauuuuucuucuugacuucuuggugguuuugcggggagauuguccuuuuguggauggcggagcagccaauccuuucccuggcuuucauuugccuuuacuuugcuuccauuguuuucuuucuguucagaagugcugagugugcucaaauuccuugguccuuuuuguacagcuucuggauuuucagcuguuguuaggucuccugaggcaacaacuucaaagcaauucaccggugugucucuaggacucugaugucuuuuuuuuuuuuuuuuuuuuuugauauaugacauuguugaaacuuuuggggagcaaacuuaccuuaaagucaugaguucaaaauucaaaccaggcuucugacaaguuacuaccacuauguauuaucuaauguuuaguuuuugguuaauggcuuuuuauuuuaguuggauuuuucugaaugaaauugauugcuguuagcugguggaauuacaggagcauuuuccauccauuuuuucugagcugcgcaguuauugauggugaccaucagagucccaguguacaauccuggcgauggcagaacagggaggugggcagaccccaaagcugcgguccucagaaaauggaagaacucaggacuuacacagcagaagcuccacacuucuaaagauuuagugaauucccagauccaaccaugugcgaaucgcagaaagaauaguagauuuaaaaagucaccuugagauucuaaugcugggagguucuuccugaucucaccucugcuuauacaguguauccucacucccagccucuuagcaaaaugccccaaaucaccugugugguguugggcagugauggagccuagguguaucuuggccucaucucuugugugacauuggguagugacgggaccucagcaugucuuggccucaucuccugugugacguugggcggugaugggaccuuggugugucuuggcuuugucuguaaaguggauuuaugcugcaggcuaaguaucccucuucugaaaugcuuggcauuagacguguuucagauuuggaauuuuuuuggaaugggggacauuugcauuacauacuugccaagugaacaucccuaauccaaaacucugaacuccaaagcgcuccagugagcauuuccucugagcgucaccguggcagccaguaaguuucagauuugggaguaacaauguaaugacaaugcugugagcgcuucucaguucccaugguguucccaacgggcuucaguuccugaacgcuguucccuccucugcuggagccuccugcauugacuccccagguggacguugcgguggcgauuguguuuuuacacucacggguccauagcccugcucugugacagcgccucaccugcguuaaccuuccuaccucuuaccugcacgccuaccggcagggcugagagucucccccacucacaggggaggaauugggggcucagagggugggaaugcauguggguccaagggcagucagugguggagcuggauuuagacucauucaacuuagacuccggagcccaggaccauaaucaugggcagugcugccucuuuauuuuggaagcagaugaugaaacaccugaauuacaaucauuugaacaagcaaagcugguuuguucucauagcgagacuucccgaggaggacgguggugaguccuggcugaccgcugaguucugccacugaagacaaaggcuuucuucaucuuuucacucugccauccuuauuggguugacuuuaaguccucuugguugcaaggagguugccagguauccagccacuaacuccacaucaagagaggaaggagggagcugcaguggugugagcuacgucuaucccuguuauuggaaacccagagcuucccagagacuccccuacgugacuuccauuuaccucucaggcccaggguucucucugggcagcccuccugcagcagagccuggaaagggggcgguggcuuugccaccuuggagaggagagggcagggcaagagcaaaggaaacgugguguggccucgaguuaggcugcaagcagcgggugccgucacaagcccacccguuaccacgacuucgcaucgucuacauugcaggcucacguucacaugcccuauccaacccucuccugcgagcagcgggugccaucacaagcccacccguuaccacagcuucacaucgucuacaccgcgggcucacguucacacgcccuauccaacccucuccugugaguucacaaauccgugacugacauggugugcaccucguccucuuguccaggcuucucacaaacaaaaugucccaccccagcuuucaagucucaccagagccuuugcugccccaugccugagugacaccaccauccacccggcuccagccagaggcccuugcccacugauccccuccgggaggggccaccuggcacaucucugagucaagucaccgucacaggcaagcucccgcuucucacgugcaggacagauggcgccaggaagaggaugucaguggaaagccauaauaaguucaaacaugaaauuagugucucacacagcagcucuggucuuugucagacuuuaauugggaucagcacagauucauugccauggagagggaaguaaaauggguaaauuccagugcauuucugagagugagaaaaguuucuauuuuuccuaaggaaagaagagaacugaaauacgcuuccuuuuauaaccuaucuaugugggaacggaacggaaauauucagaauguaaaacacuccugccugugucuaugcagcaugcacggcguaacuggggcuggcacgaggggucaaggacaagcaggacucuaccugccaccccccucagggggacacagugcacgcguuuagcaucucccaggacaugugcuaccugaagcccaagggaaaguccacccauuuuuaauauuuucuguuugaaaaaaaaaauacacagcucaucuuuauguucaacuaugcuuuuaaguaucugcaaaaaaaaaaaaguucauucaacugauuguauuacauacaauuuucauggacauuuuuuguacaguuaugacacuucagcuaaaagaaaaaaguccuuacugaaagaggcuuaaaauacagaaagcuuugccucuccuggaggaaccaucaauaacguggcuuccagccacugcacggcagugacugcugugcgguccaggccuccaccccgucggacgcagcgauaccuuugaaaacagcaccuccuccuggguuacuggguuccacugcuggaacagcugccccgaggcuuucuagcuuuccuccucaggccacuggccaggucuaggcccaagcaggagcccaccccaggcaggaggacaaguaucccaggaggaccugagcccacgaacacuccuggcucacugcccaggccuggagugaacagggcauuguucccaccccagugccagggaugagggcagaggaagaaaguaaagcaaaacagaagacgucauaaacuccuaagcccagagcacugggagaucucacaucuaugaaaacuucucaaagggcggugccuccaccaggagcagcagcagcuaggaacuugacagaaauguagauucucagggcccacccgggggcuggccugcgauaccccaggugauucucaugcugagaauaaaugugaugcuggcucugucuccugucaccaccuuccgccuggagccucuuguccucagucaacauggcuuugccauugcagcuguagggacaggugagugggugaccagaugaccgagcugaaacaggcccuggcaguaaggagccuggccuuccuguuuggaaacaggaggaugagccaaggaggagacacaggaaaggaauguccugccaucuuaaggaaggacugggagcuccccuuuuacagaaagcaaacaaaugcuugauuuccuaggugcuuccaggcagaaaauagugaugcucaggaaacaguaaaagccuuucugcaauuuuuaaaaaucaguucuuuccucacuuauugauuccuagcauuuccuaaaauguucacgugauauuuaaccuuccucauguuuauaaaauuauaguggcuaaaaauccuucuguauuagucuguuguccuacugcuuuauauaaagagcugccugagacuggguaauuuauaaaggaaagagguuuaauugacucacaguucagcauggcuggugaggccucaggaaacuuacaaucguggcggaaggugaaggggaagcaaggcaccuacuucacaagguagcaggaaggagaaggggaagagccccuuguaaaaccaucagaucuugugagaucucacucacuaucaugagaacagcaugggggauacagcccccaggauucaaugaccuccacuuggucucucccuugaaacauggggauuauagggauugucauugaagaugagauuuagauggagacacaaagccuggccauaucaccuucuuaugaugucuuucaugccacagauuaucucagugguggccaacaagauggaccgaagacuucagaagcaacaggagagcugaggguuggaguguucaucauaugcugagaaaaauucauguuuauagaaagcaccaaaaauauuaauuacccaaagagagugagucaccaggugcugucaaacccaaggcagggacucgaguugccaaaaauuccagacaacugcugauauggugaacauuaaaaaauuacagaaguuaagcuugaacaaugugaaaaaauggcaaauaauuacucuuugaacagacacuuaucagggaaccugccccgauauucacguagguucuuuucuauuuuccuuaagcguuggccagcuugagaaauaaagggacagacuacaaaagagagaaauuuuaaagcugggcauccggggagacaucacaugucgguacguuccaugaugccccacaagccacaaaaaccagcacguuuuuauuagggaguuucaaaaggggagggagugugcgaauaggugugggucacagacaucaaguacuuuacaagguaauagaauaccacaaggcaaguggaggcagggugagaucacaggaccacaggacgggagcgaaauuaaaauugcuaaugaaguuucgggcaccacugucauugauaacaucuuaucaggagacaggguuuugagaucaaccggucugaucaaaauuuauuuggcaggaauuuccucuuccuaauaagccugggagcacuaugggagacuggggucuauuucaccccuacagucucaaccacaggagacaggugcaccugggggggcuguuuauaagccuauaccuccaggcacguauucucuuucccagggauguuccaugcugagaaaaagaauucagcgauauuucucccauuugcuuuugaaagaagagaaauauggcucuguucugcccagcucaccgguggucagaguuuaagguuaucucucuuauucccugaacaauugcuguuauccuguucuuuuuucagggugcccacauuucauauugcucaaacacacaugcuguacaauuugugcaguuaaugcaauuauuacaggguccugaggcgacauacauucuccucagcugacaggauuaagagauuaaaguaaagacaggcauaggaaaucacaaggguacugaauggggaagugauaaguguccaugaaaucuuuacaguuuauguuuagagacugcaguaaagacaggcauaagaaauuacaaaaguauuaauuuggggaacuaauaaauguccaugaaaucuucacaauccacguucuucugccauggcuucagccagucccuccgucuggggucccugacuuccugcaacagacacucaaauuguuguggugauuauaacaauuccacgugcauaccuuccccacuuccagcagagguaggugaagacuuggggucagaagagacuguuuccuaugugugaauaucagccaguggugugaucuggucuaucaggaauucaguaggcugaaauuccaacuguaaagaacauuuuuggauuccauauauaaaugguuagguacaaaaauuuguuuucuaacauuccucacuuugaaaguucauuccaauguuuucuguuuaauaaauauugagaaaccauaaaguuuccaaauguauuccacauucccuugaaagugcugaaacuuuguuucuuuuuuaaguuuauuuuugaagcaacuuaaguuccuccccuccccgcuaaaaaagcaggcaacugguuaaguauggugcauuaauuaaauaguaagauauuauuagagagcgugugcguguguguguguguguguguguguguguguguucagguucuuaaccugggacaaauuucauaagagauaauaaugagauaaggaaaagcuucuuucuguauucuccuagaauaaguuuccaggucaaauuacuugcuaaaaggaccuguauuucaaaagcuguuuucuucauuuaguucagugguuugacuguuagugagguuagaauuuuuuucagcuauuugguauuaauuuguauuuucaugucuaugaaauuauuucauacugauaauuuuuugaaggaaauguuuucuuauuuacaggaaucuuuuaaauauuaaguauguuauugcacuccagccugggcaacaagaaugaaacucugucucaaaauaaaguagauauauuaguguuuaggauguauauuuccuuuuuuauauuuuaauauucucuaagaggaaaauucucuuuugauuuugaaauguauuuuucugaccaacucguguggucuuggugugugcauaacuaaauuuuguuucucuccuugcauugacuggcagaaaguuagagcuacauguaaaucaugcccauagcuaacugugaacccugaacauuugagacaggucucaguuuauuuagaaaguuuauuuugccaagguugucacgcacacccgugacacagccucaagagguccugaggacaugugcccaaggugguuggggcgcagcuugguuuuacacauuuuagggagacaugagacauuaauauacguaagaaguacacugguuccguccagaggggguuccaggucauaggaaggugagagacacaugguugcauucuuuugaguuucugauaagcccuuugaaggagacagucagcauaugcaucugucucagugagcagagggaugacuuugaauagagugggaggcagguuugcccugagcaguucccagccugauuuuucccuuuagcuuagugauauuggggcccaaagguuuuccucucacauaacaugggggagguccuggaacgcacucuuuguggaaaccuccuucccaugccacugccauuccgauccuucucucucuugcuucauaucuaaaugcuuuauaaauuuaccugacuuucucauuuguauuugcaaaucaaauuagcuccuuuuuagaaugugucagggaguaaguaaauaagcaauacgagauugguuuucugauacagaaacauccuucugcagugucuuuguuuaagaguauuuucauauggaauacuauaauuaccuacccaaaggauggaaacauuuuuauggcucuuaagauuugggucaauuuauuucucagaaggucacacuaacugauaaaugcccucaaauaaucaauucuugcuuuacugcauccuaaucauaacaguauauuuuaauuuuuaauguauguauuugauucaaagaaaugugcaaaaacuuuuaauuuaauuuacaauagaguuacuuuuuaaaauagguagaaaggaaagaucggguuugugaaaauacucuuucucugcuuucuacugacgucaguuaggagguucgguuauagucaaauguuuugaaacaauuuuaaggaauugaacucacaaaaaggcucuuccuaggagaggaauacaaguccagccuaacuuuuuaaaguccucaugagcguggcugccuuuccaccugccgagcaccacguaugccccacggugaaaucacaccuuuguugggcucugagaugcauucaccugcacuucugucuacucuccuugcauauaaauuauuuccagaugauucuuucaaaaucauaggccugauuuauagauucccaaaugagauauucucccccgaagaaauuugucauguuaaaaaaugugcaguuguuagucacugauucuagggaaaaaaaaaaaaaaaagauuaacggcauaaauccauauugauguugccuauuuaucauuugauuuuuagaauauguuuuucaaccgggcgcaguggcucaugccuguaauuccagcacuuugggaggccgaggugggcagaucaugaggucaggagaucaagaucauccuggcuaacauggugaaaccccgucucuacuaaaaauacaaacaaaaaaaaaauuagccgggcguuguggcgggcaccuguaguccgagcuacucggcaggcugaggcaggagaauggugugaaccugggaggcagaguuugcagugagccgagaucgcgccacugcauuccagccugggcgaaagagugagacucugucuccaaaaaaaaaaagaauguguuuuuccuaaaaaugcugugugcacugauggcaauaaauaaauacugucugacuauuuucaggauuuaaauuuaaauuuuaaauuuuaauuaaaauuuggauuuuaacuugcaauguuuauaccaaagguucugaguuucugucaucuuaaaacuuaaaauuaacuuaauuuucauaaaacuucaaguugauaaacugagaaggucaucaauaguaccuuaaaaauacugucaaucagcccaggcaauguggagagacccugucucuacaaaaaaauuaaaaaauagccuggcacagcggccugagccuguugucccagcuccucaggaggcugaggugggaggauugcuugagcgggaguuugaggcgacagugagcuaucaucacaccacugcacuccagacugggcagcagagcaagacuuuaucuaaaaaaauaaaauacuaugaauacauauuucaaaauuacauuugcuuaugaaauaauuauuaaaagucaaauguuuuaaaacaagcauucuucuuuugcuguauucugauauauacauuuggaaauugucagcagguuauaaauuugugucaaagcaaaaauauaaucacccaaaaccguauaaaagguaaaagagaaagauugauugguugguuuaaauuaaggagccccugaucuuguuucaaaggaaacucaggaagauauuugggaaacaauuauaauuacuuuugugaagcgaaaagugugugucacaaggcaaauuuucuagcacagaaaguaagguaugaccuuuuggcuucaggaauaaugagauuagguuuacaacugauagcagcuuucuuuugugcuuuggaagucauuguuuucuaauguuacaauaaagaucuguuuuaaagcuacuuauuuugccuauaaauaagaugucauuugguaaucaagggcaauuaaguugcaaaugugcucaccauaaugcuuaaucgaaaauguaaugaaauucugaaagaguugaagaguugaacaccugaguuuagaaucacaaaacuccuuauguucaccuuguaccaaucaaaagacaucuaugagcaguuuuucuuuaaaauuagaacuuugauauauguggaaucaguggggauuuuuuuuaaagauguuucuuaaagauggauuuuuuguccaucucgcuauugaaccugcuggucugagaaccugcuggucaaagauuaaucacaaggcuguguguguuugugugugcaugugugugagugcacguguacgugugugaguguaagugugugugcgcgugaugugugugcgugugcgcacgugugcuugcgugugugugaaaucagacuuugcacgacccacucuggaacacauuauaagaguuaaugaaauccuaaauauuagcugagauuguguugaauggaugaaaucuucuuggccagcuccauuuccaagguggccuuuugacuccauuugccagagcgcacuguuuucgugucccaagcguucauuucauuaagcucuuucugguugcaaagggcaggcacccggagccaccuucuguagggcaagguccuguggagccacgggaggaaucgagggaggcaggcccugucucagcaagugcuggccgcuccccgacagaugcccagaaguccccccagggguaguggccgccucugugaagacacucagagggcugggcuguagcccuggucaucacagccucagcccuggacagcugaauugagccuggcagcugaauuguucuccauguugcugugagcccacugacaaacuccugcccucagugucuggauuucacacgcccugagaaagaggaugugauuuauccucucaaucacccacaaacaugaaaugcgcuugccuggccucaccccacgaugggucaggaacgauggccaagagggcaggauuuuacggggcugagugugucgacacacauguuguucaugcugucagaugggcaugccuagcacagacguguucaagcggucagaugggcaugccuggcacacacguuguugugaacucuugcauuguugguaagaugugugauggauuugguuuuaccaaaaauggcaaauguggaguuauuuuuaaggcauacuucgugugcuauuucuugaugugguuuuaucacacaguguuguuuucguccaccuuggugcaacggcccugguguugcaagaggaggugagcucugagcagaauucucacauaucuccacuuaggacacauuguugagcaucgaugugugccagagacuugcagggcauugaaggcagacagugggcugcccugugccggcucucaggucccaagccuggaugacuagggcauggacggugcuguggauggaugguguugguggucagccagcacaagcaccacaagcacugcucugacaucccuugcguggcagacacguugccauccucuccgaggcucaccugagagucuagugugucggcuauaauguaacagucaugacacgugaguagcauuagccccaguuucuccauuaaaggaauuaaaccguuugugacagucaacucgguguagcaggacaagcaccuagggcaggugggggcacccugaguauucaggagaacuguugguugauggaguggaagagacagaagccagggcaccgugguucuggcuggaacuugggcaccuacaagccaucugaacuugggaaagucaccuucuuggagcaguaauguugucaucugccagucauggguagugacugacgacuucccgggauuguuagcagaaccacaugaaaucagcaccaugccgacgaccaugaaaacugccucucauuucauacccgagaaccaauaucuuauucauuccuaaaaaaggauuaucuaacauccauggggucagauuagccauacagaggcaggugcauuaaaauucugaauuuucaagugaacgaaaagaucuuccuuuuuccauucgguaaaccagagcaccaccuugaucugaaagcauuuugagccuggcgugauggacuuugugcuucugcgaaaguguaguauaaauuccauggggccagcccugcauccugacuguccccgagggcucucuagagaaagaugucaaggccagcccuguccucaggugcagucagcagacucugaaucugaacccgcguuuggucucauauucauuuugucucccuuuugcccaaagcaucccauuccuuuucugccacuucucucccaaguuuucccaccucuuuauuuuuauuuccauucaaauauuucacuuugacaccauugaacuaauuccucccuguaggaggcgcuggccaggcccaggaggcgacaugagggcauucagugcucacagucgcuaauaugucaucugcuugcugcgggccuggcauggucuaggauguuuaccucuguuggcucauuuaaugcucaccacgacccuccaaggccgguacaaugauuacgggcccuucacaccucggagaaguagucaggaagucucccaaggcagcaccacugguaugugguaugugguaugugguauguggugugugguguguggugugugguaugugguagaccccugcagcucugcagccuggcugucaagccucuggguucuccuggagcuuacgaccuaaugggugugcaugcaugcauauguguguacaaaagcaugugcaucuguguguuugcgugugcgugcaaguuugugcaugugcauaaucaugcaugugugguuacacaugugcacauaguugugugugccuguguguguggugaguguguguugggguggaggugaacaaggcaggaaaauggggaggccaugacaguuuuuaugucauuaaaaugauuaccuauccuugaguuccaaaugauaucugccaaacccuucccugauucucccaugccugccaccaccacccugccccagucucucagcugcaccccguguaccucucucugucugcaggaaaaaccccauuccaaggacuggcuuacucacccuuuucugcuauuagacuuugaacaccagaucuugcuuccguaggacagggaccauccugcucaucucucuauccccaacaucuacuguggagccuggaacucgugaugccuguggcuucauggaugcaaggauggaaggauagauggaaggauggauggauggaugaaaggauggaaggaaggaaggaaggaaggaaggaaggaaggaaggaaggaaggaaggaaggaaggacaaauggauaaauggauggauggaguaaaugucauaggaaaagugcagauaaaauucuaauauucagagaaaagagagcuaaauuuaggugggagaguuuaagaagaugcucauaggagaagaaagcucuuacaaugggucuuaaagauggauggaguggccauaaguaaggaggugaaucagaggaagauacugcggggggaacagagagcugcuguccaugguaagggcagcuguagccucaugcaaagugccugcauuugaggaugagaagcuggccuggggcaccugcagggcucggggcugcugaugcugcuggggcugccgaggcacucaugucccaugcagcauggccucaguccucccugcauucccugccuuuucuuccuuuuccuuccuguuuucucucccauucauucucaauucucucuucuuuuuaucacuaucugcauccacccaaauacacuuaacuaauuaaaaucucuauaguguguucaaaaguuauuucucaccugcaguacucccuugagcuccaggcuguccguucccccaauuucauuaugcccccaaaaggcugggcacauuuuaaaacauguucucuccacaaacacagaauucccugagcaccuaagcagaauugaauggagaggaaaugaagaacauauuaacuuccucuuagauccccgggcugauuucuuucaggcucagggcucagacugcaugauaagauaaccauuuugugaaaagaugaaagcugcuccgugcagggcgcauucugugcagguacagaacagauagggaggggcuuaugucuccgucccuccucccccgcucccaugcucaccgcuugcuuucuguugcgagugucuagaaugcccuggcccucuuuucuaggaauuggauuguaccauugucauuccaaccucucuuaucagaggcaaagccccagggugcagcccuccccgcagcguggccacagccacucagaacuccagagagucacgccccggguggacaugugugugaaucaucagcacagcacccucagauccccacccugaggcacagccccucgugucaugacagcugucacucaucuuuuuuuuuuuuuuuuuuuugagacagagucuugcuuuugccuaggcuggaaugcaauggugcgaucuccacucacugcaaccuccaccucccaggcuucagugguucucauggcucggccuccugaguagcugggauuacaggugcacaccaccacgccugacuaauuuuuguauuuuuaguagagaugggguuucaccguguuggccaggcugaucuugaacucucaaccucaagugauccaccugccucagccuccuaaagugcugggauuccaggcaugagccacggcaccuggccugucacucaucuuuuuucguuuguuuucauaacuaacagcauguccaccaacagacucugagagagcucaggcagcacauauucucugggacuuaaucgcugcuguuggccggaugccuuccacauugagaugcaauccacagacaaguugucaaguccaucugggugaggacuccgaagaggaaaacagguuaccacgugguuagccacaccauuacaacacuggcgacuguuccuaugauggacggcucuaaucucggugcacugggagauaacaagcccauccccacgaguugagugagaauuuaacuugugccuggagccagaagcgcgacgcagaguggacuggggugcacugagccuugccagggucccgcacccucaccgggagcugugauggggccaccuucucccucuccaggccccacuuuccuguuugaaggaugcccgcccucaccaggagcugugaaggggccaccuucucccucuccagacuccacuuuccuguuuggaggaugccgacagcgagaccugcccacauugcaucgcuuugcaugucuagcugugcuugauauagaagaccuucuguguggaugugugacacaccucagagccagcaggugggacacagcugugccaugagcaccacggcccguguccuuguagggccucccuucccugccuucuuccugugccccccaagccccucaguccauccucaacagccagggagacccccucaagcaucaguggcuucccaucucuucucugcuccuauggccuccagacucagaagcccagcaaaguccuguuauuauugccagccccacccuucaggacccagacagggccuccucuugccugcucucccugugguccuccucccuggcagugccgccacaggcaccaacucagagcuguggacgcaccgugccuggaacccuccacccaggacccucagagauacguccuacuuccuuaggucucugcccuggucaagcccuccccaccacacuugucccagcggguaaaggcccgaaacauggggugaugagccccuugccccgcguuuuuuagaguguuugucacugucugacguuugccuguuuaucuguuuauugccgguaccaccacccaacugaaggcuuuggagcaggggcuguuucacucacugucuaccacgguaccuuguuugcagcaggugcuuuguaaauuuuguuugaauggcuggguugagucauuaaugaaagagagggaaaggaaggcaggaaaacacuuuuaaaacucauaccacagaagaucuaucuaaaaccucuccaauucuguaauucuaugaccucaugagaaaagaaaaaaaaacacccaccuagugaccauaauguagcaaacuuccugccgggcugggcgcuggagucggguguggcugcacagcucugcugccuugcagaccacuccagggagcugccgggagcuggacgcaugcuggugucuuaccccacggagggggcaucacugcggacagagcccagcgugggcggccgugaccagcagugcuuccucucagaagcugccuguaccuucuggaaauaugaaauauggcaaccauacaaccauuucuggauaauacaguuccaccuuugaaaaugguuugaaaccacacaaacauccaggucucaucuauuuggggcuaagauuuuagaaacaguagaauuuuucuuacaaaacauuuaaauaagaaaguacaaagcggcuccugugagcacagcagcagaaucguuuccacagaauucggcccagggauccacaguuugguaaccagcacaggauuuucuacagagcccaggauuuucuacggagcccuuccucucaagagcaucagaguacuugagaauauuaaccauguguuauucggagcaauuccagccuuggaaauuugcggaggauguaaacuuugccaacuaaccuaggggagagcuucacccaaauucuuaccuccacugagccccuaaugcacacuuccucuuuguguuuaauccauuuauuuguuuaauacauuuauuuauucauuccauuaucaaacauucauugagaccucuguugguaguuuaagacauucugcuaaguauacagcaugacucagauuaaaauggccguuggagacacaauaucaaacauaaaaacuaauguaagacaaggcagagcauaaaccugguagcugcugauauuuacugauaucaguaaauauccugagcugcaccccagagguauggucuuacugugccugggaugauguccagaaauuuguccuuuacacacuuccugggugaugcugagguauagccucgguuuaaagcccuuugaacuauggaaaaauaaaggcaaaccucaaacagauaaggaaaugcaagaucucagugagcugucccaggaccagaucuuggaucccacgacugggaaccagcagagcccacuggguucuagaaccucugccagcucacccagacgagaucuaaggauuucccuuaagcuuuccucagcaguuaucuggaugguggauuaaguaaccaucagccauuuguguguaacucaaacucacauuaucgggucaguuaacagauuuacuaauuuauaccuugcuucuuuucaugaggaacugaagcgagaacagaaacguguacaauggaaugauggaaugucuacugacuccacaaucauggucacggaacguuaagugagaaugaaggcaaagaaaagagauguauaugacugucacaggaccuuugauuauugauuuaagagccucagauguuucucugagccauauagugaucagagcaacacaggaaacagcuucagccacauucuuuguucuguggagaaggaggagauuuagaagcaaaaaauaaacauaacugcuuuccuaaauguuaugaaacagaucuuuuccugaguucuaaagcaagugaagaaaaauuuuaagugaagugugucuauauucaauuuugaguuucuguguaugucuuccuucaucacaugcguguauuuauuuuauucgagcuuuauggggauauaagucacacaccauaaaagucacgcuuuaggauguacaauucgguagcauucaguagauuuacagguaugugcaaccaucgcucuaaucaauuuaaaacaucuucaccccaaaaagcaacccugugccuuagcagccgccugcccucucaccuacccugaugcugggaaucaacaaucuguuuuccauuuugagaucugccuguucugcacacuucauaugaaugaaauuguacauugguggucuuuugugacuggcuucuuucccauggcauaagguuuugaaggcccuucccuggugcagcacguuucugggcuuaauugguuuuaauugcugaaaacauuuccauugugcgguacagcccccauguuuguccauucauccgucgggcagcauugaggucgucuccacuuuuuggcaacuaugaaugaugucgcuguaagcauucuuacacaggcuuuugccuggauguguuuucauuucucuuggaugugcaccucggaguagacucacuggggcuuuuggugacucuguguucagccuuuuuaggacccuccagccuguucucccuuccccagcagcgugcgagguuccaguuucucugcaucuucaucaagcuuuggaacuguguccuuuucccucuguccacuccagggggcuugagugguaccgcacugugguuuugauuucauuucccuacuggugagugauucugaacgccuuucugugugcucuuucgccguuaggacaucuucuuuggagaaauauucagcuccuaugcccauuauuauuuggauuauuugucuuauuauaauggaguugucagauuuauauauucuggauucaaguuccuucacaaauacgugauuuacaaaaauguuucccauucuguggauggccuuugcauuuuuuugauggcaucuuuuaaagcauaaaacuuuuuaauuuuagguaguuuauuuuaucuauauuuuuuccugugcuuuggugacaugucuaagaaaccauugccugguucacagucacaaagaaaugcaucuauguuuucuacaaauagcuuuauaguuugagcccuuuucugucuuuaagccacuuugaguucauuuuugcagauuuuguaagauggggguuaaauucauuguuugguguguagaaauuggguuauccuagcauuauuuguaggagagacuauucuuuccccucugggugaccuugucucccuuaucaaaaguaucacaugugcaggugcaugucuggacuccaguucaguuccauggguccaugugugcauccuuguguggggccccacccuuuugauuacuaucacuuugugacucuugggauccauaagugugagucuuccaaccugguucuucucuuucaagauuguuuuugcuucucaggacccauugcauuucuauaugaauuugaggauuggcuuuugcacuucugcaaaaaagccaugugagguuuugacaggaauuucagggaaucucuaggucacuugggguaggaccuaccucaucuuaaccauuaagucugccaaucuaugaacauaggaugucuuuucauuuacguaagucuugcuuaauuucuuucaguagcgauguuuucuaguuuucaguguacgaaucuuucacguccuuuuuuucuuuuuuuuuuuaagagacaaagucucacucugacacuuaggcuggagugcagugaugcaagcuuggcucacugcagccuugaacucccagacucaagcaauccucccacauuagccucccaaguaacugggacuacaugugccuacuacuaugccuggcuaauuuuuguauuuuuuuuuaaagacaggguuugccauguuguccaggcuggucucaaacuccugggcugaagugauucccccaucucagcaucccaaagugcugggauuacaggugugagugacugcgucuggcccucuuuuaccuccuugguuaggcggucccagggacuuuauucuuuuagauguuauuuuaaguggaauugcuuuucuaauuuccuuuuuggguuucucauugcuaauguauagaaauacaauugauuuuuuauuuugcuccuguaaccugcuccuuugcugagcagcagugaaagugggcauccuugucuuguucucuucucacagggagagcuuucagcccuucagcauugaguaugauguuagcuguggguuucccauaaaugcccauuaucauguuggggaaguucccuccaguccuaguucucugaguguuuuuaucaugaaauaguguuguacuuugucacaugccuuuucuguaucaauuguguugaguauguggccuuuuccccuuuguucuauuaaagugauuuauuacauugauugauuuuccuauguugaaccacccuugcauugcuaggauaaauucuacauagucacuguauauaauucuccucauaugcugcuauauuugauuugcuaguauuuuugaggauuuuuuuuuuuuuugagacagaggucucacuuuugucgccaggcuggagugcagugguguaaucuuggcucauugcaacuucugccucccggguucaagcgauucuccugcaucagccuccugaguagcugcgauuacaggcaugcgccaccaugcccagcuuauguuuguauuuuuaguagagaugggguuucaccauguuggccaggauggucucgaucucuugaccuugugauucacccaucucagccgcccaaagugcugagauuacaggcaugagccaccauaccuggacuauuuuugaggcuuuuugcaucucuauuuauaagggauauuaaucuauaguuuucuuuucuugucuuuaucuggcuuugcuagcaggguaauucuggcccugauagaauuaccauagaaugggcuuggaagcauuccugccuauucuaguccugggagacuuugagagggaucgguguuaauucuuuuuuaaauauugauagaauucaccugugacaccaucugguccugaacuuuucgucccacaagcacggcgugcacccuguaaacauuugcugcauucuucauauuuuuauuguuauacuuacaauaugcuauuuagauuggguaggccggccgccccauaagugcaacaguaagacgugcauuuacauucuauucugaauuuggggagaugguuguacguucaugaauaaaugacuauaauugcuguuuucucucaaugacaaaaauggugucaugaagcaguggaaauuaggaaacuaagaugcuuuccgcauuuuguguuugcuaccucauuuucacaaaaagaaauuaccagccccuaaguauuuauuacacauugugcacaccuaaaaaacccggagaccuagcuuagugcucguuacauguucuaguguugccauuguuuacagcacgcugccauugucauuauugugauaauauuuuaaaguacauguuuccaugcauccaucaggaaauccaguccuguauaguggaaaugagaaugugguaucaacauguggcauaaucaaauuuaauucauuucaguuaaauuuuaucuuuuaugccauucuuuuaugaagccacauucauaacauagcuucuaggcuaaacauuaggcagaaguaggauacgugaguggggcaguaauggacucucuuuuuaauaugaaggaagauuaaaauuguauuaaauuacacguuaauggaaaaacaaagcaaaagauaauaggaugacaacuuuaugcagcuguaaagucuggauuacagcacauaguuuugcuauuuagcaguugaauauugaauuucauuugaaaauuugcuuuuaauuauauuaaaauaauaucuaaauauucccccaauauauuaaagugcucucauuauaauuugacuguuugagaaaggaagacgccgccggccauuacaguguaggugcuccugugagacagcguaggcaccugaaauauaacacagugaggcucaccuugaaguuaaaggaucucuuuauccuucaacuggggacuguuuacugugagaauaugcaggagcaaucccuuugcuggccucagugggagaaacagccccacaccuugcugucagucucucgggaucccucaggaaaucuuuacguucccuucugcauucacaccugggugugagaagccggucccugacuucccagggacucaugaaaucguaucccuuccuuaucccauguuuccauggccaugcuggcccagacggcuggccguccuggauccugaaaucugcgacguuuugaggccauaccuaggacuagucacuugguaaacauuaucagcaggggauuuuguuguuguuguuuguuuguuuuugccuugguuaccuggaggguugggguuggacacgaugggaaaacucucacuccccaucacucugcuugcuuucccuggcauccauguugcucagggagucagaguggguggcucuccaagcgcagggcaugauggacucaccccaagacugcaagcaggggugcaucucaggcugcuuagggugguggcgagagaggagcaagugggagagacgcuuauggugacgggagagcuggcaggcaggaauucguuccgggauccgaggcauggaggugguccaggagaggcagguauuggacaaacguguggggggauaguucccuuccugaggagacggccacgcucagccgucgagguggccacuucuugcuccugucugggucuuuggccucgaggacggcacacagcaaggccgagugguguggagccgggucuuggagugaaugcagggaugcauuccaggccugggaggagaggcggcaggacccgggcagcgacaucuacaaaugacggcagccgggugugcuuaaggcucagcagacucacagggacgugcggaccguggggcagagggaggcucggcagcuccucuggucaucacagagcuuggacgucuggucugggccuggcacugcugcgggauggcccguggcugucacaaggaaggcagcugugcccgcagggagcuugcuguccuagauguggcccugggugacaggcugagaagaacagggcuccccuaaaaguugguggaugggcuggggugcauuugagggggucagccccacagcugugucuggguggaggcagggggagagggagagagaggaggaggccaucgugaugguccuggugacaaggaggagggucuggggcaggaggggccugggauggaggaggcagaugugggguugaggggggccugccagaaggaggaaggugugagugcagagaccaggggagcaacaggccguggagcuggcagauccuccuucucugcaggucaccccagcgcccagccgccuucccagggagagaggagagagcaagcgaccugccccuugguggcucaguggccauaagacagguggugcuuuguuguagccacagccucgcuccuccaggcauucagggaaagcccaucacaggccgcagaaggacacagggaggagucaagcgggauuccucuggggaaggaggcacagcugcccccacacagaugggaccucgagaaagcuccucccauccucacuggccuguaaggguguggacugaacaaacgauuucacgauuaauaccuguguaugugauacaugagcuuacuagacaauaucacccaucaaguaccagaugcuauuuuuaaaacuucuuaagcuguacgacaaaacugaaaucuaugugaaauacaacuaugcuuuucccccaaauuguuaauuuccuuuaauaccacaaaauccggcugucaagagaccuguucaaucuacuagaugcuaaaucuuggucauuaaccauuugggaacaucaguguuuccucuccacuccucacacuuugcgauauaaaaacaacugccuggccggguguccuggcucauaucuguaaucccaggacuuugggaggcugaggccaguggaucaccugaggucaggaguuugaaacuagccugaccaacauggcgaaaccucgucucuacuaaaaauacaaaauuagccgggcgugguggcaggcgccuguagucccagcuacucgggaggcugaggcaggagaaucgcuugaacccgggaggcggagcuugcagugagccgugaucgcgccauugcacuccagccugggcgacagagcgagacugucucagaaaaaaaaaaaaaaaaaaaaaaaaaacccacaaaucugcccucucgagugcccaggccagacauggacacugauuaaugaaguccacggugggggucacauauuccccgcaccugaggguuuccgccgcgcuuccggguguucaaugccguuucuguuuccccacagacccgcaguacucauggucgcccacgcagcacuucaaugaggagcgcuacucgcccgcgcccaggagcaugaagggccuuuccggaagucggacccagccgccgcuguguuccgggcacacguguggucuggcgcccccggaggacugcgagcaccugcaccacgggcccgacgcgcggccgcccuaccugcugagccccgccgacagcugccccggggggcgccaccgcugcucgccgcgcagcucggugcacucggagugcgugaugaugccgguggugcugggcgaccacguguccagcagcaccuucccgcggaugcacuacagcucgcacuacgacacgcgcgacgacugcgcuguggcccacgcgggcgccaagaucaaccgcaucccggccaaccugcuggaccaguucgagaagcagcugccgcugcaccgggacggcuuccacacgcugcaguaccagaggacguccgcggccgccgagcagcgcagcgagagccccgggcggauccgccaccugguacacuccgugcagaagcucuucaccaagucgcacucgcuggagggcuccuccaaaagcaacgccaacggcaccaaggcggacggccgggcggacgaccaccaccacgcccaccacgccaagcacagcaagaggagcaagagcaaggagcgcaagccggagggcaagccccggcccggcaugagcagcugguggagcucggacgacaaccuggacagcgacagcaccuaucggacgcccagcgugcucaaccggcaccaccugggccccguggcccacugcuaccccgacgcgcugcagagccccuucggggaccugucccucaagaccuccaagagcaacaacgacgucaagugcucggccugugagggguuggcgcugacgcccgacgccaaguaccugaagcgcagcuccuggucuacgcugacggucagccaggccaaggaggccuaccgcaagagcucgcugaaccuggacaagccgcugcugcaccaggacgccaagcccgcccugaggccgugccacuaccuccagguaagcaggcucacggcccuguggaggccgucucggcacagcaggugguauugucguuauuccuuuuuuaauugacagauaacaacugcauacacauuuagguugugcaacaggauguucugagcuacggauauguucugggacagcuccacugagcuguuaacacacgcauuaccuuacauacguaauuuuuuuggugggagcacuuaaaauccacucuggaugauuuccaccuauucaauacgugguuguuaacugcaguuaccgugcuggccaacaggucucuugagcugaccccuccucacugaaauguuguccuuugaccaacaucucccaauucuuccccauccccagucccucugguaaccacgguuccacucucugcuccuaugaguucagcuguuucagaugccacccgugagagggaccauguggccucuaucugugugcgccgggcucauccugcuuugcaguuucuuccagcucaccuguguuguggagaauggcagaucuccuucuuucaaagacugaguaguguccccuguguauguaccgcaucuucuuuauccaucauuugccgggagacucgaggauugacggcacgcuauggcuuugugcgcggggcugcagggauggcgggacguuaucuacgggcagcucucaugcgugagucuggccugcucugggagggccucugaagaucccgacuccuccuuggaaccaucccucuaaacacagugggccauuucuuuaaggccucuaaggcuggaggguuuaacaaccacagcaaacacagacuugcccauguggguguuuuccaugugagagcugauggaccggccuaauggaagugggccugcgacauucgugaguucacucccugcaccuggccacagccucucuaagcaccccccacuacaaaaagccugauuauggaaaaggccucugugucucugggguguggauuaaaugaauuuaccaaaggcaaaaacaaagaagguagaucccuagagcuggcauauugcagaauucccuguuuuaugugauuucacucucugucucugaauugugccaugccugaguuuacuggagaagcucucugggaggcacacgcuacuucugaggaugccacucagugacuuccaucagucgauagcgcuguuaaaaaaaacauaacaugugugucccaacucacaaaucacucuugcuugccuagagcagcggcugugggccucgcaucagcuuagagacaucuucauggaguaaugggccauugcuggcugagccaacaggcagucaacuaaugggacagggggacuagcagccgugauucuuucugggagucgugguggcaaauccuuccaguggcaccgucaccaucagguccagcguccacaucucaacagcucuguuuugaaaggaaaugcuaaccaaauugccuuugcaggcagauuuauucagagacaaauugguaguugcauaaaauauuauuuuauagcaauggaagaggcauaaauuuuguuugccgucggcaaacccuaaucauauccaaauguaaaaguugugucugcuuguuuagagaagccugguagaaagaaucgggguucacucugaucugucuccucauugucacagacacauagcucucuuguuuuugucugugccugguguggauagucaguguucccugaaugagcacuucaggacacugucagagccuccagguuuugccccagggucaccugccuccaaugccugccacucuccccaagccccuccagcugcgccuucuccacagguccugugccccuuggaccugccuucuccaaggagcuucuuccacccacuuccucccaggaacacgcuucucucugccuccaacagcuauuccacggucuaggugcagggaauaccagucguccacaaaggugaagugagacagaaugaacccacacaccgucagccccuuucaaaaaccaucccuccgaaagugaccucauuccaucugcacucacgccuucccacccaggcuacacugcaacaaaucccacacgacagacagauacaacuguaaauaugccuguguugaucucccagagauccacacggaaugaugaguacgcuuucuuuugaaacauaaccaccugcauuauaucauccuggucaguggucacauuccccugagggcucacugucucuuguuggcuuuuauuugaaucaggauccagagaaggggcccgccuggcagcugcugaugagccucuucaucucguucagcccgagguuucuccucucuuuccucucuuccucccccuagauuuuuuuuguuuggaaccagcugguuggucugauugugucugucagucugaguuccgugccauggggucauuccagacacucugguccuguuguucugcagccagccacccacuccuggacuucccugcccugacgccacuggccucccucucacguccacucagaugacacauccucggaaacaacacagagcguuaucgugccgacauugggaagcacugcccggaggaucggaggauagaaggacgucugcagggagcagccacggcuuucauggcgcucguucacaagggcguuuucuugcaguagcaagcuucccccauccccacauccgccucccagugaaaccaccucuucggggcaugcagcucggugacuucucuccccuccucacugucccccagugguugcugcuggaccccucauggaaggaucuaugaagcugaauaucaggagcugugugcaaccuccucgggcuguuucuguccuaggacucagcuggauugacgucuggcauuuucaaagaugccugugcagggcugucccuuccugucaauugcauuaaacuuucugguggaaaacuacagguuucuggguccucacaaccccagauuuuauuucgcagccaggaaacagggaaacuaaaggaauuugucuguggguccuaguguacggauaagauuuaaaagaauaagaagagagaaauaaauguuuauaaauuuucuuccuuuuuucacuaggagcacuugcagcugaacgacaggaucacuuuucauuuucacccuugguuuguacagaguaugugguucacauuagaggaagauuuuuuucuuguuuuuaaguaggucaaaacggagaauaaguggaauugaaaggcaauucaggccucacguuauucuuucacaaagcucuuguuuucaucuuuucugcaucagcagacuaagcaucuaaggucaaacuuuucaugagcauuguaggaaugcagaacggauucgccguggcuuagcucaggaugccaaaggcucucuaugccacaguccaccgaaacucccagggacgugcagggagggagagacgccgccuccccgggaaggcuccuggcggcaucagauggagggacagcggggccccugcugcaucccagagaagacccggcagccccuccagcccucggccucuguccccgccuccuucccuccuguccucaggccuccucucugcagccucccagucucccaccgcguccugcgcuccugguuuucuccucuucuagugucuuccccaccuggcgucgcccggccgcaacccuggcccuccuggggaagagguucggacccuacucuuuauuugacaugaagagguucggacucccaguuuuauucggcauguucacgggcagcagccccauuuuguuuggcguguucacgggcagcagcccuguuuuauucggcguguucacggucagcagccccguugugcuuggcguguucacgggcagccccguuagacuuuggguuuuaccugucaggcuuuuuacauguucacguguuggaagcaaauggcagaaaagaacacagaggggagggggugcgaugaaaacggggagcccugagcauucccucccugcguguaaaguguuucagaaccucucccugcucccgcccucugcagccggucccaucacugaguacugaccuuuccuugcagccauucgcugaaggacguguugcgggucccaucaccgaguucugagcuuuccuugcagccauucucugaacgacgugucuguuuuguaggccgugcagaucccuggcuuucaggcucagcuacugcauuugugagguuuccaguuagguacaaaaacacaucuuaaaagucccaucucccaggucaacaggucauccuugcgguguaguuuagaaaaaucauccaucuuuuacaaaauggagccaggcuccccuguuucuugucucuacaauaagcauuuaaaaggcuugucacagggccaggcacgguggcucacaccugucauccuagcacuuugggaggccaacgcagguggaucaccugaggucaggaguucaagaccaaccuggccaaaauggcaaaacccuguuucuacuaaaaauacaaaaacuagccaggccuggugacaagugccuguagccccagcuacucaggaggccaagggcugagaauugguugaacgugggagguggagguugcagugagccaagaucacgccacugcacuccagccugggugacagagcaagacuccaucucuaaauaaauaaauuaauuaaauaaauaaauaaauaaauaaaaugguuugucauggaaugcacgaugcuggccauuugcuucuuucugcccgaucugggguggaaccugagucucaucagaguugggugugguggccugggacagccugggccaccucuggcccuccugccacaggcccaccuccacaugcugggugaccccucccugcugguuuccuucacgcccucagcucagcuuggccuccaccuugaccuuuauugagggucccucugcugcccaucugccuccugagcccggguccugucuuugucccgcuuugccccuguaucuaggaggguccaacacacucaguaacaauuagcgaggggcaccuguauccugcagcguuccagaggaugcuggcuugagcauaagggucucuccgggcaccuaggugucccauguuccagaacuuggcaagcaggaaggacccacgcgccccagcccccccucccccgcgcccaccacccucacgguauccccaccaguucaggaaggcuggcguuguggcuuauggggugcuuucaacuccagaaaaccaauaguucuaacaagcuucucagaaaacuucucuguauuuguaguuuuaggggcaaaagagggagaaaggagauugcugugguugguuccuauccuuagcgauaccagugcucagcagaaugaaagaacuggccagccuggcugugcuccacucuaaugcacguuugcaauuugaaaggagggcuuuuguuuuaaguggcucaugguauagaucuggggccgugaauggauaggagaguugggguguggccacaccucacuuccaaucccguaguggaauagcagguccgggaggagcuucucauccccuuuuaagccacucuggacacagacgcacaacccugcacaauccuuccgcagccccucgaguuucuggucuggaucucuccugcacugacacccagccaccagcugccccauccauccagugugaguccuaaaacgccuccuugagacaaagcggugaccuccgcuuccaggagccacgugugccugccccccacacucuauguucccuguccuguggcccaggccacaccauuuccugacugcaaagccuguguugugaggggcuccuccacaacugcccugccucugggccaccgcuuccccccggccccgacugccacagaauccucucccaccuugaguaccgucacacagggcuuggcaggaucucgcuggugcucaccgagcccguucguguaaucagggaccgucugcaggagugcaggagcugggccugugccuucgagccucucacugucuccccggcuggacuccuccaucaccccccaguuguccugggacucggugugucaucgcugggagcagcuuggugccgggcaggcagggagaucgcugggcugugucacaucucagugacaucaucuuaggacccaacacauucuuauccccaugacggaaauuccagcaauguuuguugaaaugcugauggauguugaagggugucugguuuuggguuguuggcuagccuugugucugguaaaucuuucugccucuucaauccuucacgccuccguuuguggugagauucaagacaguguuccgaaaagcacauuggaaaucauaacucaugugaacauggaacacugggugggugcaugcgcuguuuuauccagguuuaccaggggagaaugacauggccuacauguaacucaagauggucguggaugcagagaccucauggugacugggugcagaaaccuugugaccugugacuggguccuuggauucugugaucuaagacccugaggaaccaucugcauuuaugccaugacggccaccgaguggucaccuuguucugggcacagugcccucaacuuggcagcugaggcucugcuucugcaggagugcagguagaugggguccggcucuguccucucccucccagggcagaugaggcucugcuccugugggugugcaggugggcggaguccugcucuguccucucccacccaggacagcugagggucugcuccugcaggagugcagguggacgggguuuggcucugaccucuuccucccagggcagcuaaggggucugcuccugugggugugcagcugggcggaguccggcucuguucuuucccuccuagggcaguggaugccccaggcuugucuguucccgcugagucugugucuccugccucagacuuggugguccacaugcaguacugcucugugaaugauccuggaagggcugacccaacccaaaguacagcaggacuaggagcuguuggagcucaggccggugaacugcaauuuaaguuaucccuugucugucuugguguuaaggaguggaauggaaucaaguuuguccuuaagaaaauaaagugggcagcugaacucuaaaccuaacucugacuugguuucaguggcucagaggaaaaaccacaacaaacaaacaggaaaggaaagacuucccacccaagcuaaauuguuguagggacaccaggguggauuugagcagcaucgcgaagaucucuucagcugagauguacaucccgggaggcagcagccaugcacccagcauuucucaagcucagcacagcgggaugggggcugggagaugcuuguggggucggucuuauggaaugggggauguugagcacagccaugcacccagcguuucucaagcucagcacgggggugggggcugggagacgcuugugggguacgucuuaugcacugggggauguugagcagcauuucugggcuccaccuacuaccugccggaagcacccccauuuagugacaaccaaacauaucuccagaugucaccaaauguccccugggggcagaauuaccugguugggaacugcuggugucauccaaagagcgugagcuuuagaacaagacagacgcguggaaccuucucacaagcugugcagccggggggcucacaauaggggcuuuccauggaaauaaauggcuauaacugugccugccugaccucccucagggucccggaaagagccccuggugagauggacgugccgauggccacggguguccucucaacaaggagaugguggcugaggggugaggacacaggauggggcagagggcaggggugagcagcggggacaggucucggccgauucugagagaacucaggugcugugugaacucaggggucuccgcaccgaggcaaggaguggccguccugccuucaugccgccagccuggguggugcgugagucagcucgggugccaugacgggcauacacacccggggggcguguaaaggcacauucauuccgcaggguccugguggcuggugcccaagaccguggagucccaaggccagcuccugcugagccucuccugggcacgcagacgccguccucuccccauguccucauaggguugcccccucucugucugucugugaccucaucuccccuucuuaggaggauaccaggcagacaggaucagugcccacccuggugaccucauuuuaccuucuucaccucuguaaacgucccaucuccaaauaaucacauucugaggucccaaggguuaggguucaacauaggaauuuggaggaacacaauucaggccauaacuuguguguccuucccaaggagggguguggggaaggcagcuuucucccgcugaauggcugagggcaugcccuggagagacucagccauuggcuggcaccuccuggcagguuggagcaggcaccuugguccucgaggggugaguguggcauccacgcauccugggggcucccaugugggugggguuaugccaggcaugcagcgccucuguugguggccuccugguguccaugagcccguggcucccauuccaagcaugagggcgauaggagcuggacggggccaaagggcccagucacgugugcccagucgcaggcggcuuagauggggguuuuguacacucagcuguaguguggcccacagguuuggagauggccauaggaaagacaguucacaacucacagccccagaagagagugaggccacaccgcaggccugggggacacaccuaugggucaggaggcaggagaagagggaagcgugggcaggagccuuugccacagucucugggaaggagggagacacauacaaacaugcacacacauacacacauaggcaugcaugcacacccauauaccugcacacauacacauauaugcacauuacacauacacacacauacacacauaggcaugcaugcacacccauaugccugcacacacacauacacauaugugcacauuacacauacauaaacacacauaugcacauaggcaugcaugcacacccguauaccugcacacauacacguauacacacauuacacauacccacacauacacacauaggcaugcaugcacacccauauaacugcacacauacacauauacgcacauuacacauacacacauaaacacacauacgcacaugggcaugcaugcacacccauauaccugcacacacacauacacauauacguacuuuacacacacacacacacggcuuaaaggaaugcagaagacauuucccugugggaacgcacagcaauggacgauaauguuuuuccucgguuccagugccuccaagagaauaugaugauauaauccuggccccuuucaccugggcuuugcagcuuggaagaaagaaaagauauuccaguuugugcaguguugaacuaucccuaaagcaaguaacaggagacgucaaaauguaugcuuaugucacccuuaugaaaaugccuuuuuguuagaaauuaugaacaucacccaucacuagguacaaggagguaauuaggguaauugauuggcguuaaaugcagcagggacugcaaacuggauuugcagagucugguagccgucguggaaagaaauuuauucauuccuucacugaaggccauaaagccauuuugguuucagagcgugcacuaggccacccugggcugagggcugcaggguucgaaugcuguaacauaacggagagagauuuguuugcugaggcaggcuggcauuuuaguauugcucuucuguucuuuugauagucuccagacauaugcuuuggaauggggauuugguacuugaauucaugcuuugaaauugacucugguugacauucuuucuguauugaaauuucuucugucaaagccugcgaaauuggcuucuuaaaucagaaacagaaacauacaagcuggucucauuuguuaguuaauuugcaggcugcugaagaaaaaaaucuuuacuuuguuuuuuauggaaacauguuuuuaauucacaaaaaaaaucccauaaaccugccaaagugaaucucuucuuugauggcagaggagcugcucuuccaucugccaccagccagccucagccucccuucccgaacugagcuuuucacacauucccaggagaguggcagcgugagcucccccgugcccaggaacuggguggccgggccuccuucugccccaucgccucugccugcaccuucugcugguccagcucagacaaaaguaaacccggaccucaccccaggaccuuuccugauccuggccccucccgucagccgacagugaccuucaacacguguccccuccacacuggcuucuccacccugaugaugcuaccacucauuucauguccaucuccuguaccgaauuguaaugucauugagaacuguggcuuuucuuaaauuaaaaauaaggguguuuauuacaaaagucauauaggguucauguagacaauuuaaaaauauaaagaaaagucauugaaaacccuguaaucuucaucuccuagugacggucccuguuucacaucuucuggcugcuucugcacauaacacaguuacaucuuuaaaagacauaaaaaugucaagugcuuuaaaaauugcuuuucccccucaugagcaucuuuucaucacuaaaugcacauucuggaauaguauuuuggguagcuggguaguauccauccugugcuuuucgcccucgugagcaucuuuucaucgcuaaauacacauucuggaauaguauuuuugguagcuggguaguauccauccugugguuuuaauaaauauuguaagccauccccuaugauacaguacuguugucauuucuccucuuucccugauuaccaauuccccagucccugacccugggcugcauugucuuggggaagcuucauggaaggaaaguugcccacucuaaggacaugaccaguccgaaggccuccagucaucuccagaaagaccgggcgcuccacugcccgccaccuggccugaagacacggagauaagaauugucaaguccccaaaguugugaauucuuuauucuuccuuagucaucuuuuuccagugcucaaacuuccucacugucaggaaauguaaaccaaaauucacacggacaaaaugugaacaaaacauuggcaaauguacaccuguuuucuuaacugcugauuucuugcugagagaaccugcuguggcugaggccccaggccugucucuuaccugaccuacagcucugcagcucugcggugucaucugugggacauuuacauugaccaugucauuaauacccgauaugguuuguguccccaccgaaaucucguuuugccuggcagcucccauaauccucaugugucaugagagggacccaguaggaggugacugaaucauggggugggucuuuccugugcuguuuucaugauggugacuaagucuuaugagaucugaugguuuuuuaaaagggaguuccccugcacacacucucuugccugccaccauguaagacaugacuuugcuccucauucgccuucugccaugacugcgaggccuccccagccacguggaacugagucaguuaaaccucuuuccuuuauaaauugcccagucugggguaugucuuuauuagcagugugagaagagaugcauacaauaccuccaauucccuuucagcgcggucuguauuccucuuugaacacgugcagaccugggcacaaggcaccaggucauaaaggcuuuagaagaacccggcuggagagcaccacagacaccgccuguccagcucacggucacaguucaggauccuuguccugagccuuugggccucuuggaaucuggguggagggagaaucuggaacuucccauccuguccaacccucuccucaucacagcaucuggaucuucuagugugcguggugcuagggugucacugugagcugccgugugccugggccaccuugggggugcuacagcugugauccaccugcaccgugacccacaggggccugcgggacugugguguuggguguccgcgccucguuacugggggacugugugguguugggguguccgcgccucguuucugggggacugugugguguugggguguccgcgccucguuacugggggacugugugguguuggggugucugcaccucguuacugggggacugugugguguuggguguccgcgccucguuacugggggacugugugguguuggguguccgcgccucguuacugggggacuguguggaguugggguguccgcgccucguugcugcgggacugugugguguugggguguccgcgccucguugcugcgggacugugugguguuggggugucggcgccucguuacugggggacugugugguguuggguguccgcgccucguuacugggggacugugugguguugggguguccgcgccucguuacugggggacugugugguguuggguguccgcgccucguuacugggggacugugugguguugggguguccgcgccucguuacugggggacugugugguguuggggugucugcaccucguuacugggggacugugugguguuggggugucugcgccucguuacugggggacugugugguguugggugucggcgccucguuacugggggacugugugguguugggguguccgcgccucguuacugggggacugugugguguugggguguccgcgccucguugcugggggacugugugguguucggguguccgcgccucguuacugggggacuguguggaguucggguguccgcgccucguugcugcgggacuguguguuguuggggugucggcgccucguuacugggggacugugugguguugggguguccgcgccucguuacugggggacugugugguguuggguguccgugccucguugcugguggacugugugguguuggguguccgcgccucguugcucggggacugugugguguugggguguccgcgccucguugcugggggacugugugguguugggguguccgcgccucauuacuggggggcugugugguguugggguguccgcgccucguuacugggggacugugugguguuggggugucugcgccucguuacugggggacugugugguguuggguguccgcgccucguuacuggggggcugugugguguugggguguccgcgccucguuacuggggggcugugugguguugggguguccgcgccucguuacugggggacugugugguguugggguguccgugccucguuacugcggggacugugcaguguccggguguccgcgccucguuacugggggacugugugguguugggguguccgcgccucguugcuggggggcugugugguuuugggguguccgcgccucguuacugggggacugugugguguuggguguccgcgccucguugcugggggacugugugguguugggguguccgcgccucauugcugggggacugugugguguugggguguccgcgccucguuacuggggggcugugugguguuggggugucugcgccucguuacugggggacugguguuggagugucugcgccucguuacugggggacugugugguguugggugucugcgccucguugcugggggacugugugguguugggguguccgugccucguuacuggggggcugugugguuuugggguguccgcgccucauuacuggggggcugugugguguugggguguccgcgccucguuacuggggggcugugugguguugggguguccgcgccucguuacugggggacugugugguguugggguguccgcgccucguuacugggggacugugugguguugggguguccgugccucguuacugcggggaccgugcaguguccggguguccgcgccucguugcugcgggacugugugguguugaggacuccuugccacacgggguccaugguaaggggagcuccugcucguccaggcuggaaguccaggauaugugagugacagaaaugagcaugccucucccucucccuuggcuccuguccugggcugcaauguggaagaugucagaucugccggagcacugguguggcauggcauuuaggaaugaauacaggggccuucagccagaagaccugccuucaccaccagccacgcagaucccugcugguagugcugucgaucggcucacaggcaauauggacacuggaaagauggcagguuccuuuucugaugauauaaguaguauaccucaguagcuaaguauuuuacagcaaggaaaaaaaauacccugucugaagaccuuuuaaauauggaaauuuuuuauuuucuuucucuguaaacagcauuuggggagauucucuucuccuacaugaaaaacaugcuauguuaguuccuugacuacagacugugggugaugagcuaguugcuguggaaagcuuuggaguucucuacacucagcgacugcaugcuguguucuuuugccuuuguaaacgugaguuugaccuauggagugaacuuuacccagagccucuggggagcuguucaaagcuaaugaaccguggggaaaagaaaccagguccugaccugcagggagcagcucccgcaauggaaaccauuguguuccaguuccaugacuuuuugcucauggcuauguuggguuuccaguuucacagaugguggauggaaacagaauacuggccugcacugucaucuucaugguuuacccuccccucagagagacacguaacgcaaacacacagcaggcagccuguggggccguuaugggugauauauaaaaugcacguggguucaguucucgaacagucagauacacagcacagggggguuauauguaugggcucucagcucugugcaaggcagauauauagcaaguacaugggcccaguucugugccuggcagauauauaacaggcauaggugcucaccucugugccaggcagauguauaacaugcacaguugcucaguuugguaccaugcggauauauaauacgcacgggugcugaguucuauaccacacagauauauaacauucaugguugcucaagucugcaccaggcagacacauaacaugcauaguugcucagcucuguaccaggcagacauauaacaagcacagguggucagcucuguaccacacagauauauugcaugcacaggcaggugcugaguuccauaccacacagauauguaacauucaugguugcucaggucugcaccaggcagacauauaacaugcgugggugcugaguuccauaccacacagauauauaguauucaugguugcucaggucugcaccaggcagacauauaacaugcaugggugcucagcucuguacgaggcagacguauaacacgcacaggugaucagcucuguaccacccagauauauaacaugagcgggugcugaguucuguaacaggcagacauauuccaugcacaggugcuuggugauaugucagguggaaugugauguggcugggcaagauccuuuugcaacucugaguacugagaauuugcauguaugauagaacuuggcuucuagauuuaaaaccguccucuuuuauuugcuugcaauuaagauauaaguauacaauaagauaggcauuuucucccuuguuuucuuuuuuuuuuuuccuuuucuucucuguucaguuucucaacuuucaauuuccucuuauaccagagggaaauaaaacuaaauuuuagccagugcuuugucccagcugcugagauugcaagugucccuucuucucuuacuuuucucacauguucucacuuuauccauaguguuuaccuaucacuuauaaugaagaaaaaccaacauuuuuauauucauuuccuuuuaggauaugcauuuuuauacaucugacuuuaacugauaaaugacuguaaagagguguaucuuuauggaauuguagaggauuuguuuccaaaaaggagcugaugcugccguucucagugacaaaguugaugcguguuucaugucugucugcucccagguaccucaggaugaguggggaggguaccccaccgguggcaaagaugaggagauucccugcaggagaaugagaagugggaguuacauuaaagccaugggggacgaggagagcggagagucagacuccagccccaagacaucaccaaagucggcaauccuaccagagccgcugcugaaguccaucggacagagaccgcuuggagagcaccagacguaagugagaccagcugccuucccacuccaagcacuuucccacugccugcgagcucccucuccaaaaccacuucaccgugagcugagugccauccauuuaaacuaaauugccaagcugaaaauauuagacccauggcugucaauuuucaaguauuuuuuuaaagaacaaccagagcuuuuguuauuuaucaauuacauaauaauuaaggaagugugcuugggcaacuuccuugucaaauuauaaagccaacaugagccaucguaucuuucugaucauucagauuauccucaggacaagcacaugucucuguuuguaugaaugugugcguauggguguguguuugaaugucuuugugaguaaaacucguuaacggaauuuuguuguugacuauaacuuuguaagugcauuucuaggcaacacauuuuuuuguagaggagggaggaaauggacuagcuuuauaaauauaauacccuacacuuuacauauuugcccaaaauuuauuauuaauaaauuuaauuuugaaaauauagacagauaaaacucuuugggaaaucagcaauuccuaugaaccaugaaaauaugacuguuacugucaacagccacgcugcuguguaucuugagucccacaaguuaguuugggugguaaugccaagaacugccuggaagcuaccccugccuucugcggccggcugugagguccugggcaaguggauaggcagggcggaacugcuucucagccuuggccagugccacauaagaguuauuaauuaugacccacacaucagacagggagcccugggccacagggcccucccuguauugucucuauccacgccgagugcacccagugaugagccagugaccauauaaccucuuccaauacaucuaguuauucaucgcuguuggcuuacaagaugaaaaagugaaauuuuaaauugaaaccaaaucuuacaaauuagaacuucacaaauccgaacucuaucauuguugccuaguucagcuaaauucaagagcuaugguguaggaaugccagacaagucaugcccugagaccgggccgcaugucugcccagcccaggcccauccaucuccucucccuccacagaggguggucagugccagcuugugggacgaguggcugagaacaaagccaaaauguugcccuggggaagcucuuagacuuguuggaaggaaauggggagcagguguuuguaagccaggaaauaaccaggaaagaugauuaccaggaagggguuggggagcuggacagagcugggagcagagccaaguugucugacccaucugcuccagcaggaaagugaaggauuggacuggaugucagcucucacccaccuuuuauuuggcacacuuaaagacauuaggagaauuaugaauuaucugaaacgucuucuggggaaaagcacacacaugcagaagcuaugcuucguggguccagggcuccaaggccagccucaguccugggguuuuggacccccagguaaacagccauugguuaacuucccacuuuaaauguuugugauucauugcauaauucuauauguuugaaagcaaaacaugaaaaaaccaaagccuuuuuuagaccaugggcagggacuaaguguuuuaagaauuacgaacggcguuuuccuguugacggguuccuucuuccacucauucaccaucacugccacgggucccccaggaucauuaucaccucauucuucaguggcagagacagugucucauuccuuucuucacaucagggacuggcccagaguccuguacgaggcuccaguacuaacaauguucaaaggacacucucagaacuuuacacuggcaaaacucacaccaucacccaauguaguugaaacucuucaaaaaaccagcggaaggaugugagccugaggcccccugacagcaucaccuaaacacuggccagacccuucccugcccaagugggaaacccucugggaguucacucaccaacagcccuuaacaccugaccagaaagcauuccauggccucaaaucugaucagaugugaggaaaaugggugagaugugcugccuacguuacuccuguucuaaacacaaauccacucugcccguggacccccaugccacuguccacucagcaaacacaaauccacucugcccauggcccccaugccacugcccacucagcagacacaaauccgucucugccuguggcccccaugccacuguccauucagcagacacaaauccacucugcccguggcccccaugccacuguccacucagcagacacaaaucugucucugccuguggcccccaugccacuguccacucaguagacacaaauccacucugcccauggcccccgugccacuguccacucagcagacacaaauccgucuuugccuguggccuccaugccacuguccacucagcagacacaaauccacucugcccguggcccccaugccacuguccacucagcacacacaaauccacucugcccguggccccgaugccauuguccacucagcagacacaaauccacucugcccguggcccccgugccacuguccacucagcagacacaaauccgucucugcccguggcccccaugccacuguccacucagcagacacaaauccacucugcccguggcccccauuccacugucuacucagcagacacaaauccgucucugcccguggcccccaugccacuguucacucagcagacacaaauccgucucugcccguggcccccaugccacuguccacucagcagacacaaauccgucucugcccguggcccccaugccacugcccacucagcagacacaauuccgcucugcccguggcccccaugccacuguccacucagcagacacaaauccgucucugcccguggcccccaugccacuguccacucagcagacacaaauccgucucugccuauggcccccaugccacuguccacucagcagacacaaauccaucucugccugcggcccccaugccacugcccacucagcagacacaaauccacucugcccguggccuccaugccacuguccacucagcagacacaaauccaucucugccuguggcccccaugccacuguccacucagcagacacaaauccacucugccugcagcccccaugccacugcccacucagcagacacaaauccgucucugcccguggcccccaugccacugcccacucaccagacacaaauccacucugcccguggcccccaugccacugcccacucagcagacacaaauccacucugccuauggcccccaugccauuguccacuuagcagagauggugcaacaguuggguccauucuuccauuuauccaggauuuaucacuccauugaugaguccaacaaaugucaggcauucugccaaacucgauuuauacgugccccaaucauucuuuuucccuaaaucugacgccguguuguagauaauaaagcagagaaagcagccaugugaugggucuggacagcgaccugccugccagggaccugcuaacuugaaaguccucgaaacuccucugagucacucuuuggggguuaauguaaugaaaguuucugcaaaaaaaaaauauuauguuaccaggagguaucaacacauuuuugcuguugccuauucgcaucuuaguuuaucuuauauuccuucacguuuuauggauuccaacguaauucauuuauuuccauuuuagaugacauugcugaagcucagcuuuguaacucagggaagcucucaugaugccuguuuuauggacagaaacaugacucagggaaaugaggugcuggaggcugcacaagccaccaaggcucucagcugaagguagcucagccccaagccccguggccuucagcccauggcacugcucuguggagggcaggguagaucuucacccuguggcacuguucugcggagggcaggauagaucuucaccccauggcacugcucuguggagggcagguagaucuucaccccauggcacugcucuguggagggcaggguagaucuucaccccauggcacugcucuguggagggcaguggcggaggccaggguagauacuguggggagaggagagaaaggaagaaaacggccaggacugggagaauucccauaguugucacucuguaacccuguguuuccaggaaacaagggcacgcugagcuguagugaguguggacaaaauucucuugaaagauuuuaacaguggagaugucagaagcacaucauagggaccucagauuaaacaggaaagacaagaccggggaggcacauacacauccaugugccgucuucauucugcuggccuccagggucauguuaacugugcugggaacgacuuggguuucacccacgugaacgcccagcacccccuaugacuguggcuggcaccaugaugucgucucugcauccuguuccauuacgcacagcccuuucauaauguucacuccugggggcucuuucaaucuaggcacauuuaaauaucagcauuuuuaacguguagcaggugaauauucauaucccaaacauguucuccuaauccaauuccucauuugucuuaguuuuaaaauugauuucugaguugaccauucccaccuaagcuuugagaaggcucaguuggauuucacauguucaccacaguguaggugcagacgcuguaaugcccaagaggcuggcuguggaggcgucugcugggauggagaggagagaaggaugaagagaggacacaucugcugggauggagggaggggugaacugugggggugucugaugagauggagaggagagagggguaaacuggagggacaucuucugggauggagaggagaggggugaacugcgggggugucugaugagauggagaggagagagggugaacuguggggaugucugaugagauggagaggagagagggugaacuguggggaugucugaugagauggagaagagagaggggugaacuggaggggcgucuucugggauggagaggagagagggugaacugugggggugucugaugagauggagaggagagaggggugaacuguggggcgucugaugagauggagaagagagagcggugaacuggaggggcaucuucugggauggagaggagagaggugaacugugggggcaucugaugagauggggaggagagagggugaacuguggggacaucugaugagauggagaggagaaaggggugaacugugggggcaucuucugggauggagaggagagagggugaacugugggggcaucugaugagauggagaggggagagggugaacucugggggugucugaugagauggagaagagagaggggugaacuggaggggugucuucugggauggagaggagagaggugaacugugcgggcaucugaugagauggggaggagagagggugaacugugggggcaucugaugagauggagaggagagaggggugaacugugggggcaucugaugagauggagaggagagagggugaauuguggggugucugaugagauggagaggagagaggggugaacuguggggugucugaugagauggagaggagaaaggggugaacuggaggguugucuucugggauggagaggagagaggagugaacuguggggugucugaugagauggagaggggagaggggugaacuggaggggcaucuucugggacggagaggagagagggggugaacuaugggggcaucugaugagauggagagagagaagggugaacugugggggcaucuucugggauggagaggagagagggugaacugugggggcgucugaugagauggagaggagagagggugaacugugggggcgucuucugggauggagaggagacggggugaacuauggggcgucugaugagauggagaggagagaggguaaacugugggggcgucugcugggauggagaggagacagggugaacugugggggcgucuaaugagauggagaggagagaggguaaacugugggggcgucugcugggauggagaggagagagggugaacugugggggcgucugaugagauggagaggagagagggugaacugugggggcgucugaugagacggagaggagagagggugaacuguggggaugucugaugagauggagaggagagagggugaacugugggggcgucugaugagauggagaggagagagggugaacuggaggggcaucuucugggauggagaggagagagggugaacugugggggugucugaugagauggagaggagagagggugaacugugggggcaucugaugagauggagaggagagggggugaacuaugggggcaucugcuggaauagagaggagagaggugaacugugggggcaucugaugagauggagaggagaaaggagugaacugugggggcgucuucugggauggagaggagagagggugaacuguggguugucugaugagauggagaggagagaggggugaacugugggggcaucugcuggaauagagacgagagaggugaacuguggggcgucugaugagauggagaggagagaagggugaacugugggggcaucuucugggauggagaggagagagggugaacugugggggcgucugaugagauggagaggagagagggugaacugugggggcgucugcugguauggagaggagagggugaacugugggggcgacugaugggauggagaggagagagggugaacuggaggggcaucuucugggauggagaggagagaggguggacugugggggugucugaugagauggagaggagagagggugaacugugggggcgucugaugagauggagaggagagaggggugaacugugggggcaucugaugagauggagaggagagaggggugaacugugggggcaucugaugagauggagaggagagaggguugaacugugggggcaucugaugagauggagaggagagauggugaacuggaggggugucugaugagauggagaugagagagggugaaguauugggggcaucugaugagauggagaggagagagggugaacuggaggggcgucuucugggauggagaggagagaggguggacugugggggugucugaugagauggagaggagagagggugaacugugggggcaucugaugagauggagaggagagaggggugaacugugggggcaucugaugagauggagaggagagauggugaacuggagggguaaucugaugagauggagaugagagagggugaagugucaggggcaucugaugagauggagaggagagagggugaacuggaggggcgucuucugggauggagaggagagaggguggacugugggggugucugaugagauggagaggagagagggugaacugugggggcaucugaugagauggaggggagagaggggugaacugugggggcgucugaugagauggaggggagagaggggugaacugugggggcgucugaugagauggagaggagagaaggugaacugugggggcaucuaaugggauugagaagacagaaagggugaagagugucugagagaaaaguccuuuagaccccugacugccauccguggguuucacagcuuggggagcauauucuugcuuaaguuauauuuagucaucaauaauaacagcucguuuauucgggaaguaugcaggaaacaucacgugcuguucuggugcccaaaugcagguaaacuaacaccagagaauggagcuuucaguccagaugcuggcaagcaagggccugccaagggccuuuuuugugaauaaaguuuuauuggaauguggcccgcucacuggucaucauguugcuguggguaccucccagcuucaggcagggcugagcaggugugaggcaccccgacagccggcagacccuagaauacuuacaucugggccuuuacagaaggugugagcugaccccuuagaaucuaacagacccagugcacuucagugaguagucauaaguggcguagguaacuuacaaguguaaagugaggugcucucuaaaugcgugagacaggacuccuaacccauucugggagcuccaggcuugucucccugcagacucacauuugcauugagggguccacccuagagcauuaggguaagcgguggguaggagagcaucagcccugcacagagcaggaccaaguucccaaagacagcauauuuacgggagagggaaauaauauuuuauaguaacacuauuucauguugaaugccaacucuguugaaucacucaggugcaaucagaaaauggaaacagguucugcgucaccagauuuuaguguaugggggguaacgugagacaggagagcaaugaacuaggcacagcaccggcaauaauugcaggacuuguaauacaccaagaacaacagccaucccagcccucgccgcucugguaacugugcugaagccaacaccaugacccaagccuuagagaugaagacccugucucagcgagucacaccaccggaagucaacucuaggucucucaguuuuacgcggcuaaaccaugcugcccccugcccccggaggcagcagaaucuccccucggugaugagucaccucccucggugaugaguccuguguguggucuucccaccagagccucaauaccaucgagcaagcacauuuauuaaacaguuaguugacauuuccauuuuguuaugacccaaaucauguguuacugcaaauaaaagcuuccacuuaggcugagcuaagcaccuuuacugugcugaguugauaaaguugguugacccacauuaaacugccaauaaucagccaauauuuaaaagcagaaauuguauaugguucaaccugaucauuccggacacaagaaaggaaacccacgaacauacgugugacaggcaucucacucugcauaaauaugugacucaugagauuuugcaagcauugagaaaauaccuaaugagucuugaagauguuucuucgccuaagaauuguauuuggaauccacuguugugcuuccugcuagugacugaguaucuuccacaaacacacacgugugcacacacucacuacacagggacagagagaggcaagcgagggagaaacgcaauguuaggucauaauaacgcacaacaagagacuaugaacaauacaaaaaaucaucacagacgacagaguuucuuccucuuuaggagugacuaguauuccacaccguaucugcugcauuuucauccacucacccuuugaugacagagguugacucugugacuuggcgauugugagcagugcuguggcaaacgugggaaggcagacgugaauggaagcagagggcauuagguuacaugaaauaagccaaaauacagaaaaacaaacaccgcaaauccccaccuaaauacaggaccuaaaacaauggaacucacaggugcagacaguggaauggagguuacagaagcugggggugcggaaaauggagaguugagggucaaaagaaccacccuccgugagacaggaggauauucuuuauuauuauuauuauuauuauuauuauuauuauuuaaguucuaggguacaugugcacaaugugcagguuugcuacauauguauacaugugccauguuggugugcuguacccauuaacucgucauuuacauuagauauaucuccuaaugcuuucccuccccccuccccccaccccauaacaggcccuagugugugauguuccccuuccuguguccaagucuucucauuguucaauucccaccuaugagugagaacaugugguguuugguuuuuuguucuugugauaguuugcucagaaugaugguuucuagcuucauccaugucccuacaaaggacaugaacuuguccuuuuuauggcugcguaguuuuccaugguguauaugugccacauuuucuuaauccagucuaucauugauggacauuuggguugguuccaagucuuugcuauugugaauagugcuguaauaaacauacaugugcaugugccuuuauagcagcaugauuuauaguccuuccgguauauacccaguaaugggauggcugggucaaaugguauuucuaguucuagauccuugaggaaucgccacacugucuuccacaaugguugaacuaguuuacagucccaccaacaguguaaaaguguuccuauuucuccacauccucuccagcaccuguuguuuccugacuuuuuaaugaucgccauucuaacuggugugcgauggugucucauugugguuuugauuugcauuucucugauggccagugaugaugagcauuuuuucaugugucuguuggcugcauaaaugucuucuuuugagaagugucuguucauguccuucgcccacuuguugaugggguuguuuauuuuuuucuuguaaauuuauuugaguucuuuguagauucuggauauuagcccuuugucagaugaguagauugcaaaaauuuucucccauucuguagguugccuguucgcucugauaguaguuucuuuugcuguucagaagcucuuuaguuuaauuagaucccauuugucaauuuuugcuuuuguugccauugcuuuugguguucuacacaugaaguccuugcccaugcguauguccugaaugauaaugccuagguuuucuucuaggauuuuuaugguuuuaggucuaacauguaagucuuuaauccaucuugaauuaauuuuaguauaagguguaaggaagggauccaguuucagcuacguauggcuagccaguuuucccagcaccauuuauuaaauagggaguccuuucuccauuucuuguuuuugucagguuugucaaagauaagaugguuguagaugugugguauuauuucugagggcucuguucuguuccauuggucuauaucucuguuuugguaccaguacaagguaauuuauagauucagugccauccccaucaagcuaccaaugccuuucuucacagaauuggaaaaaacuacuuuaaaguucuuauggaaacaaaaaagagcccacaucgccaagacaauccuaagccaaaagaacaaagcuggaggcaucacacuaccugacuucaaacuauacuacaggcuacaguaaccgagacaggaggauauucuucauguuuuuagaucaguagcacacugaauacugcaaguaaaugaguacugcacauuucaguaucacugagugaauuucuaauguucucaucacaaaaaaugugaaauauuucagcugauagcuguguuaauucacuucauuuuucuacauuguacuuaaaaucacaacacacuuuuuaaccccguaaauacacauacuuugucaauauacgauaaaaauuuuuuaaggggcugggcgcgguggcucaugccuguaaucccagcacuuugggaggccaaggugggcagaucaacugaggucaggaguucgagaccagccuggccaacauggcaaaaccccaucuuuacuaaaaauucaaaaauuagcugguguaguggcacaugccuguaaucccagcuacucgagaggcugaggcaggagaaucacuugaacccgggaggcggagguugcagugagccaagaucgugccauugcccuccagccugggccacagaauuacacucucucucaaaaaaaaaaaaaaaaaaaaaaauuuaaagcaaguaaaugccacaggauauccaacaagagguuuauugugagaaauggaagaggaaaggcaucccugcuggaggcugcagccuggugucccugcagcagggacaggugucaagagcagcccggggccaggggagugagaggagccugcaggacccaggaaggagcagcaaccucggauucccacaggggcacacagcaugcuggggaacgggcagcacucagcguggucagcacugaccuuccuccucaaccugccccuggccccgcaaguccugagccccgcccggugccuccgaggugccacuggcaccagcgcgagugcucauagcugccagaggcaagguguggaaaucugcauuaauguaaucugauaacguuuuguugguaaauuacguagacacucuuauacuaaguuuaucuuauacccaaagucugcuuuaaacaaaauuggugauucuauaauuguauuuuaaacagaauugaaaguaauuggauacagugcacugaguguuuuucucuuuuuugcacaaaagagcuucccagcaggagcugacugacaaaaucuuuuacguuuccaagugauucaaaugauaaaaaugauaaugaauguuugcuugucuccaugaggcuuuuauucuccucuugguguacaugaacaacuucucuucaccugaacaauaguuaagaaugcaaauguuaugggaagaucgacuugcuaauuguauuuaauuuuaaugugauagguauggguucagguucuuaccccggaaguuaucgggcacaccaaguccuugggaggcucugggcaccugcguugacugugccgucccgugagauggaacgugucagcaguucuuuuuugacugccugguacgggacuggaagaagguugggucuuuaauuggcuguuaucagcccuccuucuaaaccacagagcagagcacuccugcaaagacugcaggaauucugcuucaaaauguuccaccucuuggaacaaugccagaauuauucuguuaaaaaccaucuuaucuuccugcuguaaaacugagaaaaaaucagucuucucguuaaucacuuaauaugcacauccuaauuauauauauaagcguuuucacuuauacccugcuauguucucuaacauagugcaagauaauagaaggccuuuugcucucaaaaauaaaaauaaaaacaagcagaaauccugucccaccugucucaugcccugguguacagacccucggccuuguguccccgaucgggaaggucagauucccagggcugauggccccgucugugggucagacccugcccacgugcagagcaccacuuagaauuauuaucaacuaauugaaaugcaaauuccaaguccuacugaauccaauuuacugcauuucuaaauuagcuuauguauuagugauugagauacuggacuugcuuauauauuaacauuugaaauacuugaauaacuaauucaauucugauugugaugaaagguagaccaaauaauuucauuuggaggccuuugcuuuuuuuucugcuuaguucaauuagaaagucaaagcucuaauaauuuugaaugucucugggucauucucuaaugaagguagcacuuuaaauuuauaaagaaaaaagagcuuauuucaaagauacuucauaucauauguaaagauaaauucugauggauuaaauauguaagcauuaaaaucguauauauacacacacauauauguguguauauauauagacacauauguauaugaguauucuguacucuggggguggagaagacguaucugggcaugauuccauggggcguaauuauaaagauaccacuuuaaauucauaaaauuaaaaacuuauuuaugauacaagccaacaagcaaacuaaaaauaauaucgccaaaguaaaaucauaauaaaaaccugagaguuuuucaauauaaguaacaaauguuuauauuuuuaauauauaaagauugccuuacaaaucaauaaagaaaaaaaugaaugacgcagugcaaaaaugaauaaaggccaagcaaagacuauucaucuaccuuaucaauaacuaaaacguuuggagagcaugccauuuaaaacugaaaaucuaaaaguuuauucuagagaaauuccugagaagcaugcaaagacguaaaaaauacagccacguucacuauuguguuacauaucguugcgugacacgguacauugccuaagugcccaucgugggcguugguuugggugaugugggggcacuaaggaagcccccaccaugcgcugcuaccacccucagcaaaaggcugcucuggaggagguaaagugugugcugcagcacaggcagccgcagggcagcacgacucagccagcucugcaccugaccugauggccucaacaccuccaccgaaagccugauggaauaagagccccgcccauuucccagcacugauaccauucacauccauucccacuguucuguacacgaugaccaagauuucaucaaaauuuaggagacaccguaaaauuaaagcucauucucaagacacagggcaaucaauacaagauucagaagugacauggauguuccuucaaacucucagagaaaacgugaaaguaacuauaguuaugcgaucaagcagcggcacagugggccuggcuaaaugggaagcaguggagagaggagaacucuaagaaagaggcagagggaaagaccacagaugggguucaugguuucagaaauaaaggauuuugcuggugagucaucagcaggcucgacauaacgaagaaaucagugaccuugaagauagguucauggaaauuacccagcggaggcucgaagagaaagcgugggaaucgaaaggcagaaaagagcauccgagagcugcagagagcuaucaaauguucucacacacauagaaccugaaucccagccagaaagacgaaagcagagcagaacagaagaaacgugggaagcacuaaugccagggaguuucuaacauuagaaagauagaucacaucacagacugaagaaccugagaaaaucucaaagacagaucaacaccagaaacaaaaccccauacacaucuacacaccacagucgaacuaccagaagugaaggauacagacaaacccccacacaucuacauaccacagucaaacuaccagaagugaaggauacagacaaaaccccacacaucuacacaccacaguaaacuaccagaagugaaggauacagacaaaaccccacacaucuacacaccauagucgaacuaccagaagugaaggauacagacaaaaccccacacaucuauacaccacaguaaacuaccagaagugaaguauacagacaaaacccugcacacaucuacacacaccacaaacuaccagaagugaaggauacagacaaaaccccacacauauacacacacaccacagucaaacuaccagaagugaaggauacagacaaaaccccacacacaucuacacaccacagucaaacuaccagaagugaaggauacagacaaaacaccacacaucuacacaccacagucaaacuaccagaagagaaggauacagacaaaaccccacacacaucuacacaacacagucaaacuaccagaagugaaggauacagacaaaaccccgcacauauaugcaccacagucaaacuaccagaagagaaggauacagacaaaaccccacacacaucgacacaacacagucaaacuaccagaagagaaggauacagacaaaacuccacacauauacacacaccacagucaaacuaccagaagugaaggauacagaaaaaaccccacacacauauacacaccacagucaaacuaccagaagugaaggauacagacaaaacuccacacauauauacaccacagucaaacuaccagaagugaaggauacagacaaaacuccacacacaucuacacaccacagucaaacuaccagaaagauacagacaaaaccccacacauauacacacaccacagucaaacuaccagaagugaaggauacagacaaaacaccacacacaucuacacaccacagucaaccagaaagauacagacaaaacuccacacauauacacaccgcagucaaacuaccagaagugaaggauacagauaaaaccccacacacauacacacaccacagucaaacuaccacaagugaacgauacagacaaacccccacacacgucuacacaccacagucaaacuaccagaagugaaggauacagacaaacccccacacauauauacacaccauagucaaacuaccagaagugaaggauacagacaaaacaccacacaucuacacaccacagucaaacuaccagaagugaaggauacagacaauccccacacacauguacacaccacagucaaacuaccagaagugaaggauacagaaaaaaccccacacacgucuacacaccacagucaaacuaccagaagugaaggauacagacaaaaccccgcacacauacacaccacagucaaacuaccagaagugaaggauacagauaaaaccccacacauguacacaccacagucaaacuaccagaagugaaggauacagacaaacccccacacacauguacacaccacagucaaacuaccagaagugaaggauacagacaagccccacacacauguacacaccacagucaaacuaccagaagugaaggauacagauaaaaccuuaaaaaaaaaaaaaaagaaagaaagaaaauuauagaccauuauguacagaagaauaaagaauuacagcacacuuuucaucguaaaugauucuggccagaacaccguaaagugacauacuuaaaacaggaaaagacguuagcccagaauucuagaaugagagaaaauaucuuucauaaaucaaaaugaaaaaagucauccuuaggaaaaaaaaaaaaaagcuagggaaauucauugcuagcagaccaguacugcaagaaauaggaaaugaaguucguucuuuucuuuucccccgccaagauggagucucgcuccgucacccaggcuggagugugguggcacagucucagcucacugcaaccucuuucuccuggguucaaacgauucuccugccucagccucccgagcagcugggauuacaagugugcaccaccacacccgacuaauuuuuguauuuuauauuuuuaguagagacaagaguuucaccauguuggccagacuggucucaaacuccugaccugaaauggcccacccuccucggcuuccuaagaaaggaaguucuuuaagcauggcucugaaagaagagggcagcaggaacuuagaacugcagugagagggagggcugcaugucucgguuuuggugguggcugcaugaccgugcauuugcggaaauucuuacagccaugcagaaagugagacgcacugacccauucagcaucugaaccagagcugcaaaagugaaucuuaugaaacaauggaucguggaggauaaaacagaauccugugaagccauuucuccaaggugagaaauaaacuguauucuuguacgggaagagaaggggcauaccucagccuccugacacuuccguuuugggauauguuugugaguaggcuauuuaagucaugagauggcuccaagccucuucucccucccaucugccauggguugggugaggugaucaagugaguaaccaagagaacaccagcuauugauggacgcaucugagaagagcucagaagacgggcucagauauuccucuggcccaugagccugcccugggaucaccuuuugcuccacacagcguaacaccaccaugcugggcaagcuggguaccuggccuggggaucuccuagcauccacuggccuguggcggguggcugugccuccguaggcagggagcgucggggcugcuuuugagaccuugcagagucaggcugacaucugauuaagaagccuuucaaagaaaucacaguuuuugcagaauccaucuagaaagaugaaagacccuucagagccacuuccuguguuucuaagcccagcaguccugacguuuuugccuuuccugaugcugagacuccauuugguaucugggcucucacagcuuccuucagaucacucagcuccuagcaccucucggccaccagcuccaaguccugccucucacaucaaaggcugaucucacgucucagcuuucuguuugagacccuccacgcgcugguugcagggguuugccugaucccagugcagauccuucgugaucugcccccggaaagccuuguuccccugacaauuuucuuccuccucgcuccucugacuugaagucggcuguucaccgucuccuccuugcugccggucauccuuccaugcccagcucugauugccuccucugggaaggcucccuggaguuacguccccugcagcauauuuccucacugcucgugcuugucucuaccacaugccuguuugcuuucccgagagucccuauagccuuugaaagcaagagcugucucauuuaucauugccauugcgccuucacugugaggcauuauaugugcuccucacacacuggaugaauggauaaaaccaucgucuuaugacucauuugucagggauuauugauaaucaacuuaauaaaugaacugcuauuagcgacgccgauaaaguaauccuguuuagagccuaaacauaaagauaaucaauuuaaaagacgugugcaaagcugauucacauucaccugauuucuuaagcuccuuuagguucuauuagucaaaacgggagcagacgccagacuccucgugcaugccacacaccugcaaccugcaguucuucaguuaauaggaagccauaugcuccuggggaggaggcauccucucucacagucuccuccacuaccgugggcugcuggcucuucauuuuuaguuucagcuggagggaagcggaggggagauucugguccagccuguguugcaaccguugccagcacgugcagagagagcauuugcacucugaucgguccagcccuagggguucccaggucccugacgaugucucuccucagaagcucaggcaucugggcaugaggugaggaccuggggauucgaauggcacuuggcacuugcuccugggggucucugcccaucagggaagcagcucaccccacacccggcggacccaacaggcagccaugaagaagggcaccagaacauuauccauccaccuguuucgugcuguuuccaguaucuuaccuuacaucucuucauggauuucauuguuucucuaguaaauucuucacuuuuuaccucauuucuuucuucuugugcauaccaacucuagucuuauucuaacuuuuuucuauuagaaaaaauguccuuaacguuaaaucaaaaacuuaaguacaaugaaagacaaauuaaaaacuuccauuuuuaaauuuugugcuuuacuuauucuuuucuguuauuucuauguuucucauauuuuacuucaacaucuaguuuuuggccugcuacaacugauauuguuuucaugaagaccuuaguuaagagggaggcuccuaagacuggcgccugguuuguucauuaauacuccuggcugugaaugagggcucacaccugugaucccagcacuuugggaggcggaggcgggcagaucacuugagaucaggaguuugagaccagccuggccaagauggcaaaacccugucuguacuaaaaauacaaaaaauuagccaggcauuuuggcccgugccuguaaucccagguacccagguggccgagccaggagaauugcgugaaucugggaggcggagguugcagugagcugagauugcaccacugcacuccagccugggcaaaagaccgaaaaagaaaaaaaaauacuccuuagggcugucaguucagggggcuguagugagugcugucuuuuaccauccagcacuuuuauggcgaacugcaacugaaaaacacauaauccacagaccacguaagcuuuucuuuuuuuaacccaacugugccauugcaggugcaaacaagaaaugcagcuuagcgagcucaccacagggagacaucccuagagaugcgucucuggaaaaccuggcggccccgugcccccaccacccagccgugggcagugccugggcaguacuguagccagccucuccauacacucgcaguccauucauuaaaucaguuauuaaacugaugcuuaaacuguaaaauuaugacucauuguaaagagcuaacacacguaauugugugaaguggagugucacucugucucuggcauguccaucgccagggguuuccacugcccaugacuuuauccuguccggacacuuucguguguguauaaaaauauacacauaugggcguaguuuacaauaaacaugaggucccacugcacgcauuacuguacaauuuccuuuuuucucccaaauauuuuguuaguuuuccguugcugucauaaaaacugccacaaacuuagugucuuaaaacagggcguuuauccucagccaaguccugcaggucaugagccaacacggguuucucugggcuaaggccgaggugucggcagccugcccuccuuccgggucucucugggcuaaggcugaggugucggccguuggcccuucuuuccggggaucugcguggggagugguuuucuuucacaucaagauguuacaguugcgggaccgaagccccguguccuuguugucagcugaagucagcccccuguuuccagaggccacccacagggauguguuagcucuggccccugccugcaucuucagagccagcuggacgggguguggggucucucucacucugcagaccccuccugucucacguccacaucgaucuccgacuugcucugccuuccucuucugcuuucaaugcuccugcgcugagagggggccugccugggucaucaggagauucucacuaccccggggucugcugguuagcaaccucgauuccaccugcaaccuucaugcccgcuugauguguagcguaacguguucacagauguggcaccagcguggaaggcccuaggggucagagucccgccugcagagguaccacgugcguccuucuguggcggacucuaggcccagaugucacuggacggacacacugcugcgugacuuuaacauuaccguuggggaacugccucuauguuuuuauuacugcacagaguguuguaaagaaaauauuugcgaaugcucaaccaccagucuacuuauugccaagguaucucuucuucuggguagcaucauaaggggauuuucugggcauguggcucccucugaagcuuuuaugcuuucaccuucaucagugcagcuaaggagauucugacuagaauggaggucuuccaaauugcuuuuuucuaaugggcugauuauacccauaaucuaugcauaguuuaaccccugccucuggaaaguccuagcgggaggggcaaggaucccacagacacuggcuuauugccuguuucccuaaaaacauuacaggaugcuuucuuaaaaacauccuacuuccaaagggcaguuugagaaucuccuaauuuuaggcagcaaagccuuaucccaaauacuggucucuuugcagaaauccauugcccguucaucuauaggaacuauuuaauuucaggaaauaacuuucuuaggagauuuuuauagauuugcuucucaggaaaaauaacuuugccuauaguggucugccagcuucagggggauggucuugaaaaaggaaaauggugaucuggggugaggccagagaggaacuggcucuuggguggauuuauacauuuucaguuguuuucuaauucauuaacuucugcuuuuauugcuauuucuucuuuuguuuucuuagaccuauuuguuguuucauucuuuaucugaaaguauauuuacuaauaaaaguauauaaggcuaugaauguuucuaagaauauaucuuagcuacaucacacauauauugauagaugaugcuuuuauagucacuguuaucuaaauacucagcaauuuugacuuugauuuccacuuugacucaaggggugaaugaaugaaaugaaggagagauaggguuacuauuaaaaauauagcuacuauuaauuauuuuucuuucuuuaaauuacuuuuucaaauuuuuauaauguguaaaauuauuuaauaguggccauuuucucuuuucaggcccugcuuuugguagggaguucgguugagagacauaaauaaaauaccaugauuuuuuuccauuucuaauuauaugaagucuuaacuuuccaaaacaguuaagucauucaugauaacacucagagccacaaaaugcauuuacuagcucuucacuauaccaaugagcuacuuuucugaguuuuccuguaacugugacacgugcauuccugccccauaaccaagggccuuaccugaguucaucacgugacuccuaauagaguucugguagcacaauagaaaaauaauuuuucacauucgcacgaugaagaguguucagaacaaccauuccuuaaauaugagucacucucuuuacugucauagccuucagaaugucuaacagcagcagcacggauaguucagcuaaauacuucuguauuuuuagcugaaaaaauucaugcaaggcuuucuguucaugucucuuaaucuaauggcuauugaaggugcgaccuucgagauuccagagaauguacugaaugaagagaacagagcaaaaaagaguccaaucuguaagaucugaggacacaguuaaguggaaucacaccauuaguagaacccggugcuaaccuugaagcagcagcgaguuuuacuaaacagcucaucuuauauguaauucuccccaauaguaaagacaauguguucuaugaguucauugucuucuuuggcguaugaugccuaauuuaugaauuuuuucauuuauucauucgguaaguaaauauguauuaaggacugaauagauaaauaaaauaauugucaaguaaauaauauguguacagacuguuaaaacauuaacaguguuuaacagggugcuguggcucaggccuguaaucccacaacuuugggaggcugaggcagguggaucacuugaggucagcaguucaagaccagucuggccaacauggugaaagcugucuuuacuaaaaaaaaaaaaaaaaaaaaaaaaggaaaaaaaauuagcugagcaugguaguacaugccuguaaucccagcuacucagaaggcuggagcaggagaaucccuugaccccgggagguggagguugcauugagccgagaucacgccacugcacuccaaccugggcgacagagugugacuucaucucaaguuuggagggaaaucugccuuacucaaaaucugccaaugugagcauuaaucucuuguaaaacacaccuucacauucagguauuugagcaaaugccaugguaccauauccuaguugacacacacaaacuaucacacacagcaaugaaaacuaauaauguaugaaugcacaguaaucccaauggugguuaucucuggguuugugguugaauuguauuuucuuuuaaauauuuuccaaauuuucugcaaaaagcauguagcacuaaaauaagaaaagauaacugaaaaacauuaguuucguugucuucuaggcccccuagcaaccuauaaguacaguuuuuccaauaguaacacugcauuuaaaaacaaauuauccuuguauugcaguuaccauaguaauaaauuugucaucaacagcuuuauuuuacuuuucagcuaugaguggaacaauaauucuguguguuucaaagccucagaaaugaaacuuauuccuugcauguugccacauuuugugucuccaagguaauuuuuuuugagguagggucuugcuguguugcccaggcuggagugcagugggaggaucacagcucccugcagccucaaccuccccaggcucuaauccucucaccgcagccuccccaguaucugggacuacaggcuugcgccaccaugcccagcuaauuuuuguuuuuguuuuuguuauuguuuguagagaugggguuucaucacguagcccaggcuggucucaaacuccugggcucaagcaauccacccgcccaaggcuguuuuuaaagaagauguacaguaagggaauacguagagacagaaccacauuacagggagugguugggguuugcuguuagcaccggggaaucccuugccuugauggagggugaggaaugcgcauuugaguauugcuagaagcuuucugaggucacuucugaccccgcaacaccauuuacauuugggggauggacuguacuaguuucuggggcugccauaacaaaguaccacacacagcguggcuuaaaacaauagaaauuuacccucuccaguucugggagccagaagucugaaaucaaggugugggcaaggccucgcucccugcacgucucuaggggaggaucccuccuuccgccucaguguccguggcugugggugcaucacuccacccucggccucugccucccaggaccuuccccaucuucgucccuucuccucuucucauaagagcacugucauccucggagcccacuccggugaccucaucucaacucauuucgucugcagugacccuauuuccaagcgaggucauguucugaggcacugggggugaggaucuccauggaccucuucuacagggagacacaguucaggccguaccagaagcaaucgcgucgccaggauaaugaaguaugcauaaaauggcaccccucuaucuugguaauuaucagacacuguuucugaaacuuauuuccaucuccguguuggcuuuucucuuccggaauguauggucaaauauaggaugucauuucuccagcugggugaccauggugauuuugcugcugacuacuggaagggaagcacggauuacucagcugaaaccugauuuccuuuccucaguuaucugucuucaaaucaguuuagcgauuguuggugauucuucaugaagagcaguaacuuuagcuggcuaaaauaaagagaaauguguacuccacacucucaaauuccacuuuaauuucaugauuaacugaguuuguaguucuaagaaauugguugcucaaaaucuuguucuguccuauucacuugaaaaugggaaucccaccucugugcuccuggguccugagggacauuccuuccuccccaucccguucggaggcucccucugguccagagcagacagccccuugcaucccugagccccaccccuggcagaggccuucacugucaaugucauuaccagggacugguggaucucuaucccuuaaccauucuuuaagccaccuuaaagaagccaucuucaaugguguuggaggaccaagcaaaacauaugugcuucuagucuugggauaauuaaggaagcucaaaacaugaggauguagauaugaaaacaucuuacacauucuugcccuuccgugcucgggacccaaccccaugccggcagcugcagaacugggugcacucaaucucaggugcagcccaugaagacaccagcccuuagcccuguccagacagaccugaugucuuuuaaccuucagucuguuuuccuauucaaaguucuguucuucccuucccucugcaaagcccaaacauuaauuucuagggaauuacagggaagggagguuagagcaugggggucacucacacccccucccccucccucuuccuaacgcuggcuccaugugggccaggugggaaggaggauggaggagaaagaaggcucuugacugagcaaaaagaaagggcccuccuggucucuggucacugcuucucuaagacuggacguuggacugggcauuuuucaauucuuuugaguuuccugauggggucuuccccuccuuucuuuucuaacauggagagauggcucagccuccccuuuccugccuaacccccuccucccacuccaccuccacuguucaccccugcagccuauuugugggguacguuucuuugggacucacuguggguaaaaugacccacacccgauacuugucacacaucuacuugaccugcaggaaauaugcgugugauugcucuacccaaaggcaugugugcagccaguuuacaccccacacacccgcauaucuccuggccccacaucacacccaacugcauccuggaucuccagcgggaggcccucacccauccccagcagagggaaacccugcugcccuucacguuuguggauucugaagcccucgcuuggccucugcgucaauaauucugacaugaacuacaaacucccacggacucccagggagguuccucccacccggggcgguggauggaggaggagcggagggaggagguggcaugcagacaggccuuggaaauccgagcacauuuuccaggaucuagcuucaugccuccugccacacgauucugcugggagcuggggcagugaguauccagucucauuuaucccuuauccaccauggcccuuguugggcccagacacacaaacagcugcgaugggugcagagcaaggugccccagcacacgcccgcccaggcuuaccuaacggggccaucuccuggccgcagcucuccaugguuccccacugccaguuuaguccaguucacauuuaccaagauccuucacaaaauacgcccccaucggcuguuucuuauuagucuaagguugauuauguucgauuauguucaguaaaaaucuuuaauuaugaaaacucugaaaaucuucacauacuauuuuuuaucccuuucuaacaucuuuauauugacgauuggccugacgugugccucuggcccccuugacuuuaccccuguguuucugcuuggaaagggcucccugaagugcaaauaugguccuguugcacauuugcccccugaagcucuggaaagcgguccccaaaucccauccggauguaacuggaaggaaauuccaacauccuccuaguccagccgaggggguucccaccacggauuuccuuuucagggcucccauugcauuacuggacaacuucuaacuauugaaaauuuuccauugggagaauucuccgugugucauuuuucuguaguuccauuuaaugcagugauaguuauuuuuuaucuucuguguuuucucuacuuccugauuaaauuaugaccuccucaaauggaagggcaauauaaacucauuucuuuuuauuaucccacaguaauugucaggcucagacuucucugugagcaucaccgacugaccaggguaccgcuggcugggauguuacauggagcaguuacacuagcauuuuaguuucaaauggaugcagauucagcaaacacuuugauuaucuaaaaucacagcaggaugauagauuuuacugucuacugauccuuacauuuauauuaugaaguacucaaauuauuuauuaauucagcauuugugauuauacauugcaauaguaaaaaucuuuuggggagugauuucaacaagauaauggaguaggaaggucugggcccuccuuccccucaacaaacacagccguucaacaaugauuuguggacaaauucccuuuacaaaaauuuagacacuaggccuggcgugguggcucacuccuguaaucccagcacuuuaggagaccaaggcggguggaucaugaggucaggagauugagaccauccuggguaacacggugcaaccccgucucuacuaaaaauacaaaacaauuagcugggcgugguggcgggcgccuguagucccagcuacucaggaggcugaggcaggagaaucacgugaacccaggaggcggagcuugcagugagccgagaucgcgccacugcacuccagccugggcgacaaggcaagacuccgucucaaaaauaauaauaauaauaaaauaaaaauaaauaaauaaauaaaugacacuaauugaaaaucuccugcaccuugggaaaauacaaaaccagacuuaccaaagaugcucgggagauucucucaagaauuccuacccuggcacagcacccuacaaucaggaagagacccccuggcuucuaccuucucccaggggagggaaggaucaguuagcacauccagcaccccaacuuuuccaagagagcucccagagucuggccucugaccugcaagcauugggccugcuggagucuggcccacucugguugccugggggagaaugaagacaguggcauggcugguagaugccguagauccucucccuccucagcacagaauaagcaaacaagaacuccaucucucagcuucccacugaagaggaaagaggugauccaugcaucccacaccucagcuucuucaggguugcacagagaacuggcaucuaccuuccaagccuuccagucuuggagcucuguuggguccagcaguccagccacauaggggaggacagagaugacagcuuagacuaguagaugcgaugguguucuucccugauucaggcagagcaaacaggcgaaaaccacagcuaccuucuucucucugggaagggaaagaauuggcugagacccucagaaucucugaaugauuggugggggucuucucauguauaagacaaggucaugaagacugagaaaggcaccagugcggaaagucaaggaaaaugaaaacucaggcaaagauauuucaaagaaauaaaacaaaucuccagaaacugacccuagugaaaugaaguuauaugauuuauucgacagagaauucaaaacaagggauaugaagaugcccccuaaggucaagagaacaaugaaggaacaaaaugagaauuuaaguaaagugacaggacauauuuuuuaaauaugugccaaacagaaauuauggagcugaagaacauaauugaccugaaaauuuuacuggaaagauucaacaacagaccagaucaaacagaagaaagcaucggugaacucaaagacaacaucguuacaaauaauucaaucaggacagcaaaaaauagcaauaaaaagagugaagaaagcuuacagaacuuacgggaaaucaccaaacagaugggguuucaccauguuggccaggcugauccugaacuccugaccucaagugaucugcccaccucggccucccaaagugcugggauuacaguugugagccaccgcgcccggccaggucacacucucuuauaaugacuaauagaacuagaguuuaacugccaaaaauauaguuuuuuuaaaaaaaaguuaaacauuuuaaaagucgaacacucauuccugccccugaucuuucucugugcucuaccuccugccagccaugcccccugggcacagccaauucugucccaccucugacuucuuccugccacucacuggggucuccagcugucagcaggaccaucguggggucacuccacuaacuggccucccgcuucccaucuugaauccauacacacuguccuccacacaacagcuccugggguuucuuuuuuuuucuuuuuuucuuuuuugagacaagaucuugcucugucacccaggcuggagugcagggcgucaucucagcccacugcagccucaaccucccgggugcaagcgauucucccaccucaaccucccgaguggcugguauuacaggcaccugccaucacaccuggcuaauuuuuguauuuuuaggagagacaggguuuugccauguuucccagguuuuacgggcuuuuuuuaaauauauauaaacuuuuuauugacaaauaacauaaauaacauacaaaagagaagaaacaauagguucccaccucaaaaauccucccaaauacugaagucaagaaauaggucggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaaaauuagccgggcacgguggcgggcgccuguagucccagcuacucgggaggcugaggcaggagaauggcgugaacccgggaagcggagcuugcagugagccgagauugcgccacugcaguccgcagucccgccugggcgacagagcgagacuccgucucaaaaaaaaaaaaaaaaaagaaauaggucauuccggaagcccccagcgagcuccccacccaguuacucccuucuucccaaauucaccacuacccugccuauuauuauuuuuuaacuauaaauauuuauuuaguagucugaacuaagugcuaaaugaaauugaaauguauuuuauucuuuuuuuaauaguaauuuuuuuuuaauuuuauuauuauuauacuuuaaguuuuaggguacaugugcacaacgggcagguuuguuacauauguauacaugugccauguuggugugcuguacccauuaacucgucauuuagcauuagguguaaccccuaaugcuaucccuccccuagcuccccaccccccaacaggccccugugugugauauucccuucccuguguccauggguucucaucguucaucucccacuuaugaguggcaacaugcaguauuugguuuucuguuccuguguuaguuugcugagaaugaugguuuccagcuucauccaugucccugcaaagaacaugaacucauccuuuuuuauggcugcauaguauuccaugguguauaugugccacauuuucuuuaugcaguuuaucauugauggucauuuggguugguuccaagucuuugcuauugugaauagugcugcaauaaacauacaugugcaugugucuuuauaguagaaugauuuguaauccuuuggguauauacccaguaaugggauugcugggucaaauuguauuuccaguucuagauccuugaggaaucaccacacggucuuccagaaugguugaacuaacuuauacucccaccaacaguguaaaagcguuccuauuuuuccuuaucaucuccaacaucuguuguuuccuggcuuuuuaaugaucgucauucuaacuggcaucagaugguaucucauuaugguuuugauuugcaguucucuaaugaccagugaugaugagcuuuuuuucauauguuuguuggccucauaaaugucuucuucugagaaaugccuguucauaucguucacccacuuuaugauuggguuguuagguuuuuuuuucuuguaaauuuguuaaaguuccuuguagauucuggauauuagcccuuugucagauagauagauuacaaacauuuucucccauucuguagguugccugauaguuucauuugcugugcagaaguuauuuacuuucauuagaucccauuugucaauucuggcuuuuguugccauugcucuugguguuuuagucaugaagucuuuaccagugccuguguccugaaugguauugccuagguuuucuucuaggcuuuuuaugguuuuaggucuuauguuuaagucuuuuauccaucuugaguuaauuuuaguauaagguguaaggaaggaguccaguuucaguuuucugcauauagcuagccaguuuucccaacagcauuuauuaaauauggaauccuuuccccauuguuuguuuuugucagguuugucaaagaucagauggucguagaugugugguguuauuucugaugccucuguucuguuccauuggccuauguaucuguuuugauacuaguaccauccuguuugguuacuguggccuuguaguauaguuugaagucagcugguguucuuugucagcuuuguucuuuuugcuuaggauugucuuggcuauauggacucuuuuuugauuccauaugaaauuuaaaguaguuuuuuuuuuccuaauucugugaagaaagucaaugggagcuugauggggauagcauggaaucuguaaauuacuuugggcaguauggccauuuucacaauauugguucuuccuauccaugaucauggaauguuuuuccauuuauuugugucuucucuuauuuccuugaguggugguuuguaguucuccuugaagagguccuucacaucccuuguaaguuggauuccuagguauuuuauucucuuuguagcaauugugaaugagaguucacucaugauuuggcucucuguuugucuguuauugguguacaggaaugcuugugauuuuugcacauugauuuuguaucccgagacuuugcuaaaguugcuuaucggcuuaaggagauuuagggcugagacaaugggguuuucuacauauacaaucaugucaucugcaaacagagagaauuugacuuucucuuuuccuauuugaauaccuuuuauuucuuucucuugucugauuguccugaccagaacauccaucacuauguugaauaggaauggugagacagggcaucccugucuugugccaguuuucaaagggaaugcuuccaguuuuugcccauucaguaugauauuggcuguggguuugucauaaauagcucuuauugagauacuucacaucaauaccuaguuuauugagagcuuuuagcaugaagcagugucgaauuuuauugcaggccuucucuacaucuguugagauaaucaugugguuuuugucauugguucuguuuaugugauagauuauguuuacugauuugcauauguugaaccagccuugcaucccagggaugaagccgacuugaucgugguggauaaacuuuuugaugugcugcuguauucaguuugccaguauuuuauugaggauuucugcauccauguucaucagggauauaggccugaaguuuucuguuuuuguugugucucugccagguugugguaucaggaugaugcuggccucauaaaaugaguuagagaggaguccgucuuuuucuauuguuuggaauaauuucagaaggaaugguaccagcuccucuuuguaccucugguagaauuuggcugugaauccaucugauccugggcuuuuuuuuguugguaggcuauuaauuacugccucaauuucagaacuuguuauugguguauucagggauuugacuuauuccucauuuagucuugggaggguguauguuuccaggaauguaucaguuucuucuagauuuucuaguuuauuuguguagagguguuuauaguguucucugauuguaguuuguauuucugugggaucaguggugaucuccccuuuaucauuuuuuauugugucuauuugauuguucucuguuuucuucuuuaauagucuggguaguggucuaucuauuuuguuaaucuuuucaaaaaaccagcuucuagauucauugauuuuuuuugaaggguuuuucaugucucuaucuccuucaguucuucucuaaucugaguuauuucuugucuuaucuuagcuuuugaauuuguuugcucuugcuucucugguccuuuuaauugugauuuuaggguguugauuuuagaucuuucccacuuucuccugugggcauuuggugcuauaaauuuugcucuaaacacugcuuuagcugugucccagagauucugguauguugugucuuuguuauuguugguuccaaagaacuuauuuauuuuucccuuaauuucguuauuuacccaguagucauucaggagcaaguuguucaguuuccauguaguugugcaguuuugagugagauucuuaauccugaguucuaauuugauugcacuguggucggagagacuguuaugauuuccauccuuuugcauuugcugaggaguguuuuacucccaauuauguggucaguuuuggaauaagugugauauggugcugagaagaauguauauucuguugauuuaggguggagaguuauguagaugucaauugggucugcuugguccagagcugaauugaaguccugaauaucauuguuaauuuucugucucauugaucuaauauugacagugaggugugaaagucucccauuauuauuguaugggagucuaagucucuuuguaggucucuaagaacuugauuuaugaaucuggguccuccuguauugggugcuccuguauugagugcauauauauuuaggauaguuagcucuucuuguugcguugaucccuuuacgauuaugugaugcucuucuuugucuuuuuagaucguuguugacuuaaaauuugucuuaucagagacuaggauugcaacuccugcuuuuuuugcuuuccguuugcuugguaaauauuccuccaucccuuuauuuugagccuaugugugucuuuguacaugagaugggucuccugaauacagcauacuaaugggccuugacuguauccaauuugccaguuugugucuuuuaacugggacauuuagccuguuuacauuuaacauuaauauuguuauauaugaauuugauccugucauuaugaugcuagccgguuauuuugcccauuaauugaugcaauuucuucauagugucgauggucuuuacaauuugguauguuuuugcaguggcugguaccgguuuuugcuuuccauguuuagugguuccuucaggagcucuuguaaggcaggccugguggugauaauaucucccagcauuugcuuguguguaaaggauuuuauuucuccuucacuuaugaagcuuaguuuggcuggauaugaaaaucuggguugaaaauucuuuuuuuuaagaauguugaauauuggcacccacccucuucuagcuuuuagcgugucugcagagauauccacuguuagucuaaugggcuucccuuuguggguaaccugaccuuucucucuggcugcccuuaucauuuuuuccuucauuucaaccuuggugaauccgacgauuaugugucuugggguugcucuucucaaggaguaacuuugugguguucucuguauuuccugaauuugauuguuggccuuucuugcuagguuggagaaguucuccuggauuauauccugaagaguguuuuccagcuugguuccauucuccccgucacuuucagguacauuaaucuaauguaggauuggucuuuucacauugucccauauuucuuggaggcuuuguuuguuccuuuuuguucuuuuuucuccaaucuugucuucacacuuuauuuuaauaaggugaugcuucaauuucugauauccuuucuucauuugauugauucagcuauugauacuuguguaugcuucacgaaguucucaugcugcguuuuucagcuccaucagguaauuuauguucuucucuaaacugguuauucuaguuagcaauuccuguaaccuuuuuucaagguucuuagcuuccuuguguuggguuagaacauacuccuuuagcuuggaggaguuuauuacccacuuucugaaaccuacuucuauaauuugccaaacucauucucuguccgguucuguucccuugcuggugaggaguugugaucguuuggaggagaagaggcuuucugguuuuuggaauuuucaaccuuguugugcugguuuuuccucaucuucauggauuuaucuaucuuuguucuuugaugcuggugacuuucggauaggguuuugguguagacguccuuuuuauugauguugaugcuauuacuuucuguuugauaguuuucuuucuaaccaucaggccccucuucucaggucugcuggaguuugcuagagguccacuccagacccuguuugccuggguaucaccaguggagguugccgaacagcaaagauugcugccuguuccuuccucuggaagcuucgucccagagggacuccugccagaugccagccggagcucuccugugugaugugucuguugaucccugcugggagaugucuccccaucaggagacaagagggucaggggcccacuugaggaggcacucugugccuuagcagagcucgagcgcugugcugggagagcugcugcucucuucagagccgagaggcagaaacguuuacgucugcugaagcugcacccacagccgccccuucccccgggugcucugucccagagagaugggaguuuuaucuauaagcccugacuggggcugcugccuuucuuucagagaugcccugcccagagagcaguuuuacaggcuuuuuacagacagaucagaccgagucccugaaaacuccgugacagauguuugucacauugaaaguaaaauggagccucuccgccucggcccacaaacgucuccauuaugagaccaagccuggucugcucguucaccacucuggucuuuaauuuccucaaaugcucagagcucucucguagcuuagggucuuuggaguugcuguuuccucucccuaaaugguuccucucaauccuugcauaauuagucauugagauaucagcuuaaauagcaccuguucagugagacauuuuuuucaccaggcaaucugagguagcuauguagucacuuuugauccuaaaaccuuaauuuaacagggugugugugugugugugugugugugugugugugugaucagcccgugcuaccuucuugcuugugggggccucuaucccucacgagcugucaguccugcugccugcugcaucccagacuugggccaugcaagcugcauugaagcacucagcccacacuugucaaauaugugaaugagagagugagugaauguauauguucuuaaugcccagcaucauucacaacacauauucgauauuaauguuuguugaauggcccaauaugacaagaggaguaaaaguguuucuaguaaacaguguaagauaauguuguuauuucuaauuaaugacauucuaguagaaaguguaagacaguguugcuguuucuaauuaauggugugcucugaugaaucgaugucacugaaauggggucuuucuuuaaaaaugcagacaugcuuuacagccuggcugcuucaaaguugggcauuauuaagaaucuccagcuuuaacagugaaaggccuauuccacacagggaauauacugauucaugcagccauguugcccagagcuagccagggcuggaggcccgaauccacggaggccgggccaggccaccccagcaucaggccucaggccugcccaccugcacuggcuucauucagaccgucccaggcaaugaugagauggcaccagcuacuccaggcugacccucuaccagcucagagaccaccaaggcagcaaggaagccccuccuucccaggagugacagcaguuuauucauucauucauuuauucaucccacaagugucucuugagcuccuccaugugucaggcacugcuccagaugcuccccaaugucgugggcauggcaggcagugacagcucucaugcuucccaugcugucacagaggaggacagauaauaagcaguaaacaugacaggugaucaguaauaaaaagugaaguguguagcacccuaaaggugucgagugccgcgagggaaaauucaacagaaugagggggucuguaaggguggaaggcuggcucucaguucugcagaggcuggauagaguggaggcugggucucaguucugcagaggcugguuagagcggaggcugggucugaguucugcagagcuugguuaggguggaagcugggucucaguucugcagaggcugguuagaguggaggcugggucucaguucuccacaggcugguuagaguggaggcugggucucaguucuacagaggcugguuagaguggaggcugggucucaguucugcagagcugguuagaguggaggcugggucucaguucuacagaggcugguuagaguggaggcugggucucaguucuguagaggcugguuagaguggaggaugggucucaguucuacagaggcugguuagaguggaggcugggucucaguuccauagaggcugguuagaauggaggcugggucucaguucuguagaggcugguuagaguggaggcugggucucaguucuacagaggcugguuagaguggaggcugggucucaguucuguagaggcugguuagaguggaggaugggucucaguuccauagaggcugguuagaguggagucugggucucaguucugcagagcuugguuaggguggaaggugggucucaguucugcagaggcugguuagaguggaggcugggucucaguucuguagaggcugguuagaguggaggcugggucuucauucuuuuggguugugccagcaaggccaugacaucuccuccacacugugaugggcucagcauccagcucauaguaguuggaacagucaguauuucugucucagggauuauuuaucuaagggacuggggcugaggagggaucugcaggcuucuaaaccugaccacaucauccuccccaugcguccugcuggcaggagaccaccguucaauauuugaccacuuaauauuuggugagauuccaugcaaauuacuaaacucaaguugccuccguaugaggaguuuucugaguccugcagcuccaacccccaccuccccacauaccccagccaccgcgucggcaccucuccucaagucaagccagcugcggccacacauuuccauucugaugcccaagacacagcugggacagaacacauucuuaaagacacuuaagugaacaggcacaaagaugaaugacccuucuucauuuuguggacacugcagacacuguucacauauggccguuaucgacauggauucagaaaucauuuuccuggaaacauugcuagguaacugcgggagaagggaccuugcuauaaaugcacuggaguuugcugaaaauguaaauacgaauuuuaucuccuaacaccagggagagauguuucacuaggguguucauuaugauuugcaaaugaaauggacaaaauucagauucucuaaacaguaccucaguggggcauccuaucccuccauccaaauagauccauguuucucaaaguguggucuggcccauagaccaccaggaauggaaucaccuagaauguuuauuuaaaauuuggauuuggggcugaccucacccuucuaaauuccaucuccggggaugcgauccaggaaucaacauuacaugcaagcacucaggagaucgugauacaggaaucuauauuacaugcaagcacacaggagaccgugauccuggaaucuauauuacauacuagcaugcggaagaccgugauccaggaaucuacauuacaugcaagcacgcaggagacugugauccagauugggauuugcaaaaccauccaaugaaugucuucuuguugcuccgacaccagccuuuaaauguaaagugacaacagucaaaaauauuuauaaagaaaaaagcaauguacuuguuaaaaaaaaaacucaaacauaaauggcuuagauguaaauaauaaugaagauaccacaggcagaaucauagcuucucugugauaggccagccguuagaaucgcugagcuuagcaucuaccaggagcugcugcagaaaaggucugaugucuugugucguguguggaguacuugugguguaacaggauaaagauagugcagucgcuuuguuguuagaagcaacagcaccagaagccaggcggggcacaccacccugcagccaaccucggugccaucggcucaccugaccucaucggccccugaggaugcaggccaggcaccaucauugcuuccacugccgaaagaggaaacagugggugagcaacauccgugacuuacccagguucauacggugaggaugcacagaaccgaaugcaagccccagauccggaccuccugaccuccacuccuguguucuggacacagcucccuacuacucaggggaguggaccaauuugagccgaagaugguuaccuacuugauucgcacuuccgucgccacacaagugauacagcagggcucucagagugcgugccucugagaugcuugagaagcaaaguggucuccauauuccccugacgucuucuguucgugacuugaaggaagcagaugaucacaagagucucuggugaaugcgugaauccagggcucuagugagugcggccuguccuuugugcaugagcuuuagaaacgugcuacauucuugugggccuaagugccucuuuaggaugaaaucuuuucaauuagcaaucaaagacuuuuauacccugccccuuuccaugguuguccccuccagcaaaucugugaucccgcugauguuaccuucccuguuauaaggaagaaaacagagaaugcagcguuugcuaacuguccgagcccacagcguccaugauggggugagaaccgaagccagcagcuccccacucuggaaguaaacuguugacucauuuccguguuugucugaauuauuaguuuaucauauaguuguaauaauccauggcaaauguuuaaaauaugccacaaaagcaacacaugccaaauuuggaaucagaaggucuucaggcucaaaucucagcucgagcucgugcuguagaacgugucaccucugagugaagacuuucucuucuuguuaaagcaagguuaauuauaauaccuuccgcagagaaucauaaccagcaccaaaucagaggcgaagaaugaaaguauuuguggaaaaugaauuaucguuaacucugcugccccagagcucccucacuguccuuccuugaggcccaagagaaaagacgaacugaagguaccaguggguuuuuuuugaaaauuugcuucaagucuacauucugaacguacgguucauuucaacuuucagaugacauaaagcuaaauagagugcucuucguaucuuauuuuccuccuuuauugaguuaugauuuaagaaccauacaauucauccacuugaaguacaauucagugguucuuaguuuauuuauggacuugcgcgaacaucagugcaauccauuuuagaacauaaacuuuacaccaaaaagaaacccuguaccgucacuccccacuuccccuaacuccuccaaccccuggcaaccacgaaccugcauucucccugucguggccauggaaccccacaauacuguaucuuugugucuggcuucuagcauaacguuuucaacauugauccacauugcagcaugugucagaacugcaauucuuuuuaugauggaagcauauuccauuguauggauagaccacaguuuauuuacccauccaucauggauguauacuuagguuguuuccuuuuggaggcuauuaugaauaauucugcuaugaccauuauucuguuuguuuucugagaugaggucucacucuguugcccaggcuggagugcaguggcacaaucucggcucacuacaaccuccgcccccugagcucaaggaauccucccuccucagugaccccaaguagcuggguccacagauguacaccaccacacccagcuaaguuuuuguauuuuugguagagacgagauuucaucauguugcccaggcuagucucaaacuccuaagcucgagagauccaccuaccgcagccucccaaagugcugggauuacaggcgugagccacagcacccggccuccuguaugaguuuuauguggacacacauuuucauuucuccugggcauauaccaaggaguggagaugcuggguccuugauaacucaauguuugaccuuuugaggaacucccagacuguuuuucaaaguggcuguacuacauauaauauuaaauaacauaaauuaguugcauauguaacauuauauuauuguauuguuuucauauacauauguuuauauaaaaauuauccaucauucuuuaaaaucugacuuauauucuuuaaucucuaaagauuuacagagacacaguuuuauagcaagagcagauuuuucaucuaucuuaaaauguguauguucaucaguauggauauacugacacccauauccuggaggacaaaugauuggaggauuuccauaaugcucaucacaucuguucugacguuuaagucacuguccuuucucaaaggaaaucuaauuuauacuccuuagcacaauauugcuaucuuuucuuagaaauacauuucacaguugaaauauaaagcaauuugaggaaaauaagauuuuuagaaagacaucgggccuguguaaauauauccuuuagaaaauugacuucagagcgugagcgacgcagaagacgggugauuucugcauuuccaucugagguaccggguucaucucacuagggagugccagacagugggcgcaggccagugggugcgcgcaccgggcgcgagccgaagcagggcgaggcauugccucaccugggaagcgcaaggggucagggaguucccuuucugagucaaagaaaggggugacggacgcaccuggaaaaucgggucacucccacccgaauauugcgcuuuucagaccggcuuaaaaaacggcgcaccacgagacuauaucccacaccuggcucggaggguccuacgcccacggaaucucgcugauugcuagcacagcagucugagaucaaacugcaaggcggcagcgaggcugggggaggggcgcccgccauugcccaggcuugcuuagguaaacaaagcagccgggaagcucgaacuggguggagcccaccacagcucaaggaggccugccugccucuguaggcuccaccucugggggcagggcacagacaaacaaaaagacagcaguaaccucugcagacuuaaaugucccugucugacagcuuugaagagagcagugguucucccagcacgcagcuggagaucugagaacgggcggacugccuccucaagugggucccugaccccugacccccgagcagccuaacugggaggcaccccccagcaggggcacacugacaccucacacggcaggguauuccaacagaccugcagcugagggugcugucuguuagaaggaaaacuaacaaacagaaaggacauccacaccgaaaacccaucuguacaucaccaucaucaaagaccaaaaguagauaaaaccacaaagauggggaaaaaacagaacagaaaaacuggaaacucuaaaacgcagagcgccucuccuccuccaaaggaacgcaguuccucaccagcaacggaacaaagcuggauggagaaugacuuugacgagcugagagaagaaggcuucagacgaucaaauuacucugagcuacgggaggacauucaaaccaaaggcaaagaaguggaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaguggaagaugaaaugaaugaaaugaagcgagaagggaagguuagagaaaaaagaauaaaaagaaaugagcaaagccuccaagaaauaugggacuaugugaaaagaccaaaucuacgucugauugguguaccugaaagugauggggcgaauggaaccaaguuggaaaacacucuacaggauauuauccaggagaacuuccccaaucuagcaaggcaggccaacauucagauucaggaaauacagagaacgccacaaagauacuccucgagaagagcaacuccaagacacauaauugucagauucaccaaaauggaaaugaaggaaaaaauguuaagggcagccagagagaaaggucggguuacccucaaagggaagcccaucagacuaacagcggaucucucggcagaaacccuacaagccagaagagagugggggccaauauucaacauucuugaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcgcuaaacauggaaaggaacgaccgguaccagcugcugcaaaaucaugccaaaauguaaagaccaucgagacuaggaagaaacugcaucaacuaacgagcaaaaucaccagcuaacaacauaaugacaggaucaaauucacacauaauauuaacuuuaaauguaaauggacuaaaugcuccaauuaaaagacacagacuggcaaguuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauauaugcacccaauacgggagcacccagauucauaaagcaaguccugagugaccuacaaagagacuuagacucccacacauuaauaaugggagacuuuaacaccccacugucaacauuagacagaucaacgagacagaaaguuaacaaggauacccaggaauugaacucagcucuguaccaagcggaccuaauagacaucuacagaacucuccaccccaaaucaacagaauauacauuuuuuucagcaccacaccacaccuauuccaaaauugaccacauaguuggaaguaaagcucuccucagcaaaugugaaagaacagaaauuauaacaaacuaucucucagaccacagugcaaugaaacuagaacucaggauuaagaaucucacucaaaacugcucaacuacauggaaacuaaacaaccugcuccugaaugacuacuggguacauaacgaaaugaaggcagaaauaaagauguucuuugaaaccaacgagaacaaagacacaacaaaccagaaucucugggacgcauucaaagcaguguguagagggaaauuuauagcacugaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauuaauaaauugcucgacacauacacugucccaagacuaaaccaggaagaaguugaaucucugaauagaccaauaacaggagcugaaauuguggcaauaaucaauaguuuaccaaccaaaaagaguccaggacaagauggauucacagccgaauucuaccagagguacaaggaggaacugguaccauuccuucugaaacuauuccaaucaauagaaaaagaggaaauccucccuaacucauuuuaugaggccagcaucauucugauaccaaagccgggcagagacacaaccaaaaaagagaauuuuagaccaauauccuugaugaacaucgaugcaaaaauccucaauaaaauacuggcaaaccgaauccagcagcacaucaaaaagcuuauccaccaugaucaagugggcuucuucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccaggacaaucaggcaggagaaggaaauaaaggguauucaauuaggaaaagaggaagucaaauugucccuguuugcagaugacaugauuguuuaucuagaaaaccccaucgucucagcccaaaaucuccuuaagcugauaagcaacuucagcaaagucucaggauacaaaaucaauguacaaaaaucacaagcauucuuauacaccagcaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucaccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaacaccgcauaccuacaacuaucugaucuuugacaaaccugagaaaaacaagcaauggggaaaggauucccuauuuaauaaauggugcugggaaaacuggcuagccauauggagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcaugggcaaggacuucauguccagaacaccaaaagcaauggcaaccaaagccaaaauugacaaaugggaucuaauuaaacuaaagagcuucugaacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggagaaggacaugaacagacacuucucaaaagaagacauuuaugcagccaaaaaacacaugaaaaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuauuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaagccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuauugcaagaacaaaaaaccaaacaccgcauauucucacucauaggugggaacugaacaauuagaacacguggacacaggaaggggaacaucacacucuggggacuguggugggguggggggagcggggagggauagaauugggagauauaccuaaggcuagaugacgaguuagugggugcagcgcaccagcauggcacauguauacauauguaacuaaccugcacaaugugcacauguacccuaaaacuuaaaguauaauaaaaaaaaaaaaagaaaagaaaagaaaauugacuucaacugaaauuuaugcacugcgcacccagcuccaugaggacaagggcgaugccuucauaaaugaugcccagaaaguauuugauagaugaguaacucauuuucuaaauuaacauauuuugggagaguaguuuaacagcagcaguaaagcccuuuuucgagaaccuguucuguacugcuucggacagauguaggucuccauucugaauucauguccacccugcauguucaguucacucacacuggccuccucuguauucuuuuuggaaaaaucauagagaaagauuagcaaauugaauuuuuuaaaaauaagccucaaaaauguugaaugccaaaggacuaaauugcuaccuuccauucuagcucuaucaacuauucccgguacaaauaugaacaguaaggccaggcuuugcaaugcgugaccugacaggucucagacucggcgggguuuucagcgaaaaugggccucaggaggccuuuggaagagccaggugggggaggcugguucacugcaaguguaugcccuggcuucagcggugacugagcccucguagcccaggggacaugguggaucaucacauacuucucaugggauccuucacaaaccccaccagcaccuucagcagauggagaaaucaacucuucacaggcagaaaaaaaacggauggcacagaccuggggucuccugagcauuugcagucaggcaagagaacagccguggggccucugcagccagagggugaaucucaccucagaacugacucagugaacacggaauuaccagccacauuggcagagaccucacagucagugcugcugguaccacaggcaggacaaggggugccgagguuggaauaugaccacagacacccggcggacuggagguggccucugccgcagcugccauugacggcuuggaccccgcuuuguguugccagcaucaccuccaggugugcagaaaacaugacuuaccggacgaccuugugcccacacgagcuccggggacucugggaaaggagaccucccaggcggagcccccuguggcacagccucugccucugcagugcugggcuccccaaaccaacaacuacagcagcagaacugauaugcagguuggccaagccaaggacaguugcucacccuggcgacacgauuuuuuaaaauguaauaauggggaguucuggcucugggauaauaacuuauauugaagaaacacucauacagaugacagccaugaacuguggagcccacacacacaugcauugcacgugcacacacgugcacacgcacacacacacacgcaugcccuccuguuugaaagcagaguugggcaggaaguagagacuauucacauuuuaaaggaaaggcgccgcgcucacucgcggcugcccaugguccugugaguucccucugagcacccucgcuaccugcugcaggagggcgguaggaacugaagcagacagcugcagucuccuuggaugugucuguuacaggauggaauuugggguugccagaagaggugggggucagaacagaagggauggagccauggagggagaccccaaagucuauuaacauuugcggaccccugaaaaaguuuaguuuccagcugcugaccaccgauggugaagaucagucuggaggcugaaccccaccaagugcacaggccagguaaaccaucugcagccuccccaggcccaccccagcaacgcacgagccaaacacccaaagcuaaggaggaucggccacaaccaaaauuagcacacauuggaggagggagcaggugccggggucucugccagucguguccuuuaugccgaaaagaggcugaaguuguagcaacaugaaacccaccugcaaggaaaaaacugaugugcucaaaacgaagccugagaagaccccgaugguagaacucaccagaaagaucuuuaaacagccauuguaaggucuuaugaaugauauaaaaauguuagaacucaccggaaagaucuuuaaagcagccauuguaaggucuuaugaaugauacaaaaauguuagaauucaccggaaagaucuuuaaacagccauuguagucuuaugaaugauauaaaaauguuagaacucaccggaaagaucuuuaaacagccauuguaaggucuuaugaaugauauaaaaauguuagaacucaccggaaagaucuuuaaagcagccauuguaaggucuuaugaaugacauaaaaauauuagaauucaccagaaagaucuuuaaagcagccauuguaaggucuuaugaaugauauaaaaauguuagaacucaccagaaagaucuuuaaacagccauuguaaggucuuaugaaugauauaaaaauguuagaacucaccacaaagaucuuuaaagcagccguuguaaggucuuaugaaugauauaaaaaugucuguuacaagguuaaagauguuaaaggagaagaaggucuuaaugccugacuagauggagaaaugaaauccaugagaaagagacaaauugaauuuucaagaacagaaaaccacaauaucugaaaugaaaaauuuaugggauguguuuaagagcgaauugagagagcaggaaaaaagcuuaguaauuugaaaaugaaacaguagauauucucaaauaugaaaaaguagagguaagauauuaaaaaaaagaauagagccucaguaauauguguaguaagaagaagugaagggacacacauauaauuagagaaccagggagaaaacugagagaauuuggcagaagguuuugaagaaaaaauggccaaauauuuuacaaauuugguuugaaagaauccacagacccaaaaugcucagugaacucuaagaagauaaauagaaaaaaaucauaccuagccacaaaauaguuaaacuguggaaaaccagagagagacaagucuguaaagcaaccaaggaaggggucaaacagaaaccagaggaauaauuagaaaauuaugacugccuuauugucagaagcaaugggagccagaagacaauggaaucauaccuuuaaagugaucaaaaacaucuauugauucagaauacuauacccagcaaaaauaucuuuuaaaaaaugagagcaaaauaaagacuuuucaaacagaagcuaaggaaucuauuuuuaacuuaaauacauguauccacauguggcuacuuuuuuaucuuucauuuaguuucagggguacaugcacagauuugugauuuagguaaacucacgucaugugggguuugguguacagauuauuucgucauccagguaauaagcauugcaccuaauagguauuuuuuucugauccucucccuccuucuaaccuccaggaggccccaguauguguaguuuuccucucuguguccauguguucucaucacuuagcucccacuuauaagggagaacaugcaguauuugguuuucugucccuguguuaguuugcuaaggauaauggccuccagcuccauccauguugcugcaaaggacaugaucucauucuuuuuuauggcugcauaguauuccacgguguacaugcaccacauuuucuuuaucugucuaccauugaugggcauuuagguugauuccauguuuuugcuauagugaauagugcugcaaugaaugugcauguguuuuaaugguagaaugaguucucuuccuuuguguguauacacaauaaugggauugcugggucagaugguaguucuguuuuuaguucuuugaggauuugccacucugcuuuccccaaugguugaacuaauuuaugcucccaccagcaguguaugagcauucccuuuucuucacagccucacagcaucuguuguuuguccacuuuuuaguaauagccauucugaugggugugagauacuaucuuauugggguuuugauuugcauuucuuuaaugauccaugauguugagcauuuuuucaugugcuuguuggccacauguaugucuucguuugaaaagugucuguucauguucuuugcccacauuguuuuuugcuugcaaauuuguuuaaguuccuuauagaugcuggguauuagaccuuuguuggaugcauaguuuggaaauauuuucucccauuuuguacguuuucuguuuacucugucgauaguuucuuuugcugugcagaagcucuuaaguuuaauuagaucccauuaucuaccauaauggacagcgcaccucuagagcaaccacucaaauauuaacgcuaugcauuacagccaauacgagcuaaagcucaauguuaaaaauauuugauuaacccaaaagaaagcaaaaagaaaucagaggaacaaguauaugaauaggacauauggaaaacaacaguaaaaugguaggcuucaacccagucauaauaauacguguacuaaaguaaguggaauaaguaaguaaaaggcuacaguucuaacccuggggaaaaaaugucaacauuaagggugcaacauuuaacucccuccguaagaugagauaaaacacgaggaugccgacucucagcuccucuacuuaacauucuaauggagguccucgccagacacagaaggcaaacaagaagagaaaaagcacgaaauuuaaaaggaaggagcuccuuccauguuuagguuccagguuuauucuuauaucacaugauuguuuacauagaaaaccuaaggaaacuacaaaucaaauccuggaacagaucaugccauucaucaaggcuaggacaugaaugaaauagguagaaaucaauugcauuucuguagacccauaaugaauaauuggaaaaugcaguuaguuuuaaacaucucaacagcauuguagaauuguggugcucuaagauagaccaucuaaauaaaucgagagcuagacugugaugcauuggaagucucaguaaugugaagaugugaaaucuccccagacugagguauggauucagugcaaccucaguagaaucaaugucauucaaagcaaccucaguuuuuagagaaacugacaagaagauucuaaaaugugugaaaaugugaagaaccuagaagugccaagacagucuugauaaaaaagaacacaguuggaggacucacgcuaucugauuucaagacuugcguuaaaucuaaucgggacagugugauauucauauaagaauagaaaagggucucucagccucagcacucuugauauuuggggccagacaauugucucucauuggggggaucuccgugcaccuucagcauucuugauauuuggggccagacgauucucucuuguugggggcccucugugcacuguaggaucuuuucauggcaucucuggcaccuguccaguagacacgaguagcacccuccucuaaauuguggcaaacucaaaauaucuccauacaucaccagaugucccuugagggccuaaucgccccagauuaagaacuacucaaauagacaaaauagauccgugugacagaauagagacuccagccgucaaaaucuuuaaauucuguucauuaaaagacacaacuaagaaaauggaaaggcaagccauagaauaagggaaaugucugucugacaaagggcuugaaugcagaauaugucaagaacuccuacaaaacaagaacguaaagacaaccccagaaaaaugggcauaaaagccaaaagguuacuuugcaaaagaagauacacaaauguccaauaagaauuagucauccaggaggugaaagugaaaacuuuauugggauacacuucaauuucacuagaauggccuaaguuaaaaagaaugacaauacaacaugcccaagaggauacggguggaggccacagucaacaucugucaaaacucacugaguccuacaagugagaccugugccuuucacugucuaucaauuuucucucaauuaauacaauuuaauggguauauauuuuucuguuucauuucuauguaagaaagaaaaauaaauuuuuugguaaguuuaccuuguucuuuuaagaaaaauuuaaacaguugaaauauuuucuucagaccaguuguuucugagacaucuaccaaaugcuaaaaucucgagucacaauacaggucuugcaaggacaaguuaaacauaguauguguuaacauuaaguaagugcucaccauguauuauacuuguauugcauguaacauucuuaccuuauauucacagaacuccauaaguuauguccugugacuacuguccucauuguacguugcauagauuaagagauuuguccaaaugacaccguuggcgagagguugagccaggaucucaaugugggcuuucaggcaucaacacaugugcuccacugugcauacaaacugccuucugcgcaccauguuacuuccgaccuguaaagcacauuucacggccaagcacacuguuggccucagcauagcguuuccuguagacaggaaaaaugaucccaggcccgccucuuugagugucuuucccauggugucuuauuuucaccuucuaaaaauaaauguucacguugcuucauccccccauccaagaaaacucacagccuuucucaaaucgccuguccucucugcuguuccugacaaguuguucaaaaguuccacucauacuuccauuuucuuaccuuaacgucugcgaucucauuucugcacccauauccacugaaacuguccuuuuuaaaaaugaccccagcuugcugcaucugacggucuuuccccaucucauuccacuugauuucucagcaucugcuccggggccgggcuccuccugucccucgggugcccaggagcgucccccgccccacgccccucucacuuuccuccuggauucccuucguggccccgccucaccugagaggccuccuccaccuuucugcugcgugacacucacagcccgacgucuuccacacuuuuacaucugaagcacucagagguucacagcccugcccgucacacuugcucuguucuuucacagacuucuuggaagugcccuagaaucagcagguccaaaucaaacucagguccaaccuccaaaaccuguuuuucuuccuaucauagaucuugccuuuguugggagaagucuaggcgccuuggaaucaucucaccucuaacacauuccucauuccugugggcucugucccuaaaauccaagcccuuuggugucucaugagaaaccagcucaagucugcaggagccucucggggucuguguccaggacaccacuuccugcauucaggcaccucguccuccaggccccacgcacagggaccguccugagcucccagcucacaagucccugauuaagaacuugcaguacuuuucuuuugccuguggcauaaacaucaagcugucuggggugucccucacaguuucccacucugcuuccccaaacuucucucccagaaugccuuucccccuuuacccucugcucuccagacaaacaaugcucacuccccgccucccagcuggcacacacucuacauuuccuuuuagcauuuugcauuaagaaaucuauguuccagucuuuguccccaacacacugucaacuacacgagugcuacgcuugccaucuugcagaaggccuuucuugcacuuccaagcacccagacuuacgugggaggugccuuauuaagaugccuucuccucguguucuguuugggaagccuuugguggcacauccuucaaaccugcccaguccugguuauagcaaaggacggguagagccaaguggacgagagccggaggugguugguccggcugggucagggucagcugcacugggaccagggcagaggagagccagaggagguuguccacacuggguuggggucagcuacacgaggaccagggcaaaggagguugucauggcugggucacuguuagcugcacugggaccagggcagaggagagccagaagagguuguccacaccggguuggggucagccccguugggacccaagccagcgucaugcaucugagcaugcuggcucucacucucagcuggccgugggucagccauugcagccccaccugccacgggcuccaggaagagcagucaucaguauggagaaggccggacucugcucagaagccacugagcaggugcuccauagacucaccagcuggagcggggucacaucucggaggcaccgucagcaccaggagggcagccaagcaaggguauggcauuuccgagccucugcggucaaggguaucgcauuuccgagccucugcggucaaggguauggcguuuccgagccucugcggucaaggguauggcguuuccgagccucugcagucaagagcccagagauggguugucggggcagcugugggggcaucccagaugugggugccaacagugagaugcaaauguggauuucccucaaaaaugugcuguuagggaacaagcaugccuucaucuccugcaagggcacagaaagcucaagaacacuuuuuacccugaauguggaaaugaucuggaaagaagccauuuucugaaauccagucauuaauugugauauuauuugaaauguauacugaaagguguucuaagaauuuccauuuugcagguggaauaauacacacaugugcacgcacagcacacgcacgcgugugcacacgaaugucuguuucacuagcacuguuuagcgugcuccauuuuccauugaaugcaguggaagaaacacuucuuauauuugggagcuucuccugucagaucccauuuauagaaaugagaagaugaucucuguauuucaaaugaacacauuuaguauggaaaaaaauuuucuuaaauaucuccuuagcacaaccugcauagaauccuuacugcuuuccaagguaacaagggagaugguuuacguuguguauuuucaagcauguuuagauggaucuaaacagcuggggucagaggcccuuucagggguacccuuuguuauguauauucguucucauaaugaccuaagucacagaggagguucugagcccaggauucagcaagcagcucuggaaccauucgcaaagggcgagaacaagguugaacaccaggaauccugcaguucugucuugggguuauggauucacuugcacagcuuuccgucucgccuguuuguggaugacaaucuaaggggagcaacaucugaaaggcaaaacuagaacaaaaacauuucuguguuauucuagaaaacuuuucacuauuuaaaaaaaaauucugagcuacuaaguccauauagcaaaauauguuuccauuucugacaccugggaugccgcaggaauuaccacuuagagagauaaccaaaggggcugaaagucaacuucaaaaugccccgggauguaggagggggauuuucagggggaagagucagguggauuuuguggagugagccgugcuggggacuucacccugugucaccuggcggggccaccggagggugcauccccccaucuugauuggcucccccuaguccuaguucuugaguuuugaucugugacugugaggaaccuggccuucugggacucuauaugauaaaaugcuaagccauuauaauauuuuuuaaaaagccucuuaagccaaaugaggcugagguuuuauuuguuauuuuuuaacuauuuaaaaagucugugguaucagaggaugggaucuuuggcucugugguccuaugacucagcaucuugagugcuuaaaaucccagugaccuugggauuuuaaagcaugaauuccagagccaggccaccuggacucagaagggagugcugcccccaucccgcccaagccugagugcaugaccuggcaccagugugugaugaccuggcaccagugugugaagaccugugcgugaugaccuggaaccagugcgugaugaccugacaccagugugugaugaccuggcaccagugcuugaugaccugacaccagugcaucaugaccugacaccagcgcgcaaugaccugacaccagugcacgaugaccuggcaccagugcgugaugaccugacaccagugcgucaugaccugacaccagugcgugauaaccuggcaccagugcgugaugaccugacaccagugugugaugaccuggcaccagugugcgaugacguggccccagugugccaugaccuggcaccagugugugaugaccugacaccagugugugaugaccuggcaccagugcacaaugaccuugcagcaaugugcgucugaugcugcauucauaggaggaagguugggaagaggccugguuuauaggacuaauguaaacauuaaauguguuaggacaaugcaaaacacuuauuagcauuucuggcguaaucuugcauagaaaauguuagcuauugugagucuauguuuuaaaaaaaauuauuagcuuucuucagcggcaacauuuaugugucacacuccauuuugaaauaaagagaaucauugagagaauauguauuugaaacauagacucacaaaauacauggauccaccugugagggcuguccagcagccacugccagagugaugagccauggcucagaggugaucccuucguucacguagcaggcacugguuagaaacuguggacaccagauccagaggacgagaauccuucuuuuauguuuucucagucuagaaggcagcuucaauuugagaauguuaaaaugcaaaacggugguguuaaucagaaggaacggcuguuguauuggaagaaaauugguaauugguagaaagugccgauugguagaaauggaggguaugaaaccagcaaucucaaggaagcauggaaggagagcagaagugcgggaaguuuacauuucugcaaagacaaaggugagucaaguuaagagccucagucagggcucuuggcauccaccugaggccacacugcucgggcuccauagcucggggcuucguccgcugcacaugacucuguauuaaacacgcacaggcacguggacacauucaaaggaagccagcaguggucucuuacagaaugaguccacgcauccaucaaccugagccugaaacuugugaccgugucucaggaugcuguugacauuuugccgcucuguugaacccaugcuuucaggguggugacagccaaggucagggauccguguuagcucgccuucuguucacuggcagucgaccugggggauccacagaggaggggaggggacagggccccugcuggugcuggugccgguccccacaucugcagcagagcugcccgucccacugcccaggugcagcgggagucggcgggcaucgaugugaagacugugugcuucauacccaguaaaauuagaaucagcucaaaacuaauuuccucccuuugcuuucucucucucucucucucucucugucucucucucucucucuuuccuuuuuuuggucuaagucagggaggggaagguagguaggagcugcuauauguuauacauuuucuuuuaaagcaaaaauauuuagcagaaagaaugacuuuaaaucuauaaugaauaagcuucacuuaauaagaauucauugaguccaguuuuuuuucucugauauuccauuuuuaaagacugaaguaaaucagagaaaaaccacaccaaggguuuacuuugaaaagaaagugugugcuuuaaugcccaacucuggagucagaaucguccaccuaacaucuauagacauuuuuauguaccugcuugugcacugauauuuaauguuccuauuaucauccaaaacaggcaagaagaauaauuaaucauuucuguccacauuucuacagcuuuugauaaaauaaaaugaauuuuacugcacuguggaaagauugucaauaaaacuggaaagugguccaguuagccagaaguuuaagcuaagccagaccuuucaucggccaaacacucacaggguucuuccaugcuuuuaacauuucacaaaacggcgagaaggaagaccagagaacauugauuuauuuuaagggaguuuggaagaaaacgaccguugugcuuauaaaaugguuuucauuuagccuacuccuccuauuauauuugcugauauugcauaaccuggacaacuuugcauaaguuaaaacugaaagugagccuuguauuuuuucuguuauuuuuuaaauauguaaaguugccagagagccaauaauuuuuaugagacucucaguuuuuuggcuuaaauucaggagcugaguuugcuauuaugcugugugaguuacuagugcuuacagcacuuuuuuaaaaauauggaaugacccaaauuucacuaccuggccauaaaaucucagguuucaaaggcaauuuuguaaauagccuccccuauuacuuuugaugaaauucacauucauaaauaugaaucucagaauauuugcauauggcaaaguuacucaucaagacacagacauucaguuggaaaugugaugcuagccucuggguguggauuggacggucguucccaucucuggccuguggcgggugcucagccucuggguguggguuggacggcuguucccaucucuacccuguggcgggugcucagccucuggguguggguuggauggcuuucccaucucuggccuguggcgggugcucagccucuggguguggguuggacggcuguucccaccucugcccuguggcgggugcucagccucuggguguggguuggacggcuguucccaucucuacccuguggcgggugcucagccucuggguguggguuggacggcuguucccaucucuacccugcagcgggugcucacccucuggguguggguuggacggcuguucccaucucugcccuguggugggugcucagccucuggguguggguuggacggcuguucccaucucuacccugcagcaggugcucagccucuggguguggguuggacggcuguucccaucucuacccugcagcgggugcucacccucuggguguggguuggacggcuguucccaucuguacccuguggugggugcucagccucuggguguggguuggacggucguucccaucucuacccugcagcaggugcucagccucuggguguggguuggacggcuguucccaucucuacccugcagcaggugcucagccucuggguguggguuggacggucguucccaccucugcccuguggugggugcucagccucuggguguggguuggauggucauucccaccucugcccugcagcgggugcucacagaaugccuuuucuccuuucuucuuuccuguagccagaccuaccugcaagcugcaagcgaugugccugugggacacagccuggaccccgcugcgaacuacaacuccccgaaauuccgcucccggaaccagagcuacaugagggccgucagcacccugagccaggccagcugcgugagccaggucagggucccuucgcccuuucucccugggguccagucuccccagccaggcuggcacggaggccccggccgcauagguggcgauggcgcugcccuccuggucagcagcacuugggcaaggcuacaccaaaggggguuccccuggaauuagcucuggcugauuagacucguggacuuacuguuauauuuuugacguguauaacuccauaucauuuuugcguugauuuuuuucugaggaagcaaugaccaaaaggguggucauccuggccucucuuguugauaaagcacaggcugucuuccuucuucccaggcuauuuuuccaguaaaagggggccagggaaaggcucuggcagcauggcucucagcucuguccucugaauugugccucagaaaguccugugagaggauagccuggugucgcucacagaguccugccggucggccccacucccagggcaggacugauuucgggacaggcacaguggccaggagaagggucccugggcaccacgggaggggugguauuaaaaucaggugccugagacacgggggcugugaaagggaggccccccugcuccccaccugugguggacgggccugagaacgcacagugaaaaaaucggcaaguguccuucagucuaaucauccuauauuacauggcaaagaagaaucgaaaguuuaucauuuuaauuaagcacguugcuuacucacuuaaaugccuuugaaaacagugcuugagcugaccuugaguuuguauaccuaacaaacauuuucucuuaguguggaguagggauuaagagccugagccgaccucacauucucucugacuuacuguggaguagggauuaagaucuugagccgaccucacauucucucugacuuacuguggagcagggauuaagagccugagccgaccucacauucucucugacuuacuguggagcagggauuaagagccugagccgaccucacauucugucugacuuacuguggagcaggaauuaagagcuugagccgaccucacauucuuucugacuuacuguggagcagggauuaagagccugagcugaccucacauucucucugacuuacuguggagcagggauuaagagcuugagccgaccucacauucugucugacuuacuguggagcagggauuaagagcuugagccaaccucacauucucucugacuuacuguggagcaggaauuaagagcuugagccgaccucacauucugucugacuuacuguggagcaggaauuaagagccugagcugaccucacauucucucugacuuacuguggagcaggaauuaagagccugagcugaccucacauucuuucugacuuacuguggagcagggauuaagagccugagcugaccucacauucucucugacuuacuguggagcaggaauuaagagcuugagccgagcucacauucucucugacuuacuguggagcagggauuaagagcuugagccaaccucacauucucucugacuuacuguggagcaggaauuaagagcuugagccgaccucacauucugucugacuuacuguggagcaggaauuaagagccugagcugaccucacauucucucugacuuacuguggagcaggaauuaagagccugagcugaccucacauucugucugacuuacuguggagcagggauuaagagcuugagccgaccucacauucucucugacuuacuguggagcaggaauuaagagcuugagccgaccucacauucugucugacuuacuguggagcaggaauuaagagccugagcugaccucacauucucucugacuuacuguggagcaggaauuaagagccugagcugaccucacauucucucugacuuacuguggagcagggauuaagagccugagcgcagggauuaagagccugagccgaccucacauucucucugacuuacuguggaguagggauuauucugggcuucugggccaaggccugggcuuucugugcccucccauuaugcaguuaucggcgugacaauggaaguacacagucaauuuuagaugcuauuaggcaaagaguccagcauauacugagcacucaaaaaugauagcccuuauuauuaccaugauaacaauaaguaauacuauauaauucugggcacuaaagcccuccuggcugcagaucaugcugugagcucuugguagcuugccuggggcucaguaagcacaagucuuucuuuugccgcagacuuuaaauuccucaugagguagagucuauucauuuugcagguuuuuuccucaucggaagguuguacccaggacuuuuuccacugaacuauugaggcuuuuccuauugcacaacucaagaaggauaccaccucuuuuaucuacucgguuacuucuuuccuuccagaaauggaauuaaguucucaucugcaucaggaauugcauugacucuuuuucccaaugacaaggaaagaccgucccuagcccugcgcucaaguccugggcaaaugggaaugguggguccuccagcccccugcucccagccagcccccugcaaacaauaacaucaacugauccuccccaacuagauaauuguaauuauuuuaauaacugaggaaacauucuauuucagcauaaaguccaagaugauauggggagacacuaauuaacuaaacagaguaacugaaagucagugauacauuuuaacaacuugcuccauacacagagaugaggauacagcagacuuucuucuuuuaaagcuaucaccuucccuuucaguggauauaaccuaguuuaccaaaauacagcuuuaaaaauccgauguaacccaacaaaagguuuaaacagaagugcaaaguuaucucauccgaggugugaacguucaucucuaauacuuuuccacaaacaacuuucaauuaaauggaucucacaccucuuuaaaugcucuuaugaaacauucagaggcucuuugcgacucgucguccuguuuggggguaaauguaagcuaaauauacuaguucucucgucaucuugcuuuugaugaacccaagaugguaucuaccaaaauaagucagugaaaauaacauuuucucacaucuuugucuaucugaaaggauucaucauuggaaacaaugguuaagcagacaaguugggugcuuggggguuuauuuaacgaccuugaaauuuagaauucuaagucauuccuaugcagaguucuauggcauuacuuuaaauugaacucaguuuugaauucucaggaaaaaaaaaaguguuauucaaaauaauccuggaaugcugguaguaagugagacuguaucacacccagaaacaaacguaguaggugagaagacugugucacacccagaaacaaacuuccacuaauugauuguccagcccuaggccacgagaccugacaauucuggaaggaaggggacagugcccaugguugagggugggacaucuggaauuacuaacacuuaggggcucuggagagaugugaauuuggugacaaaccaaaguuuguugaaaguuugcccuuggccagucgcgguggcucacgccuguaaucccagcacuuugggaggccgagguggguggaucacgaggucaggagaucgagaccauccuggcuaacauggugaaaccucgucucuacuaaaaauacaaaaaauuagcugggcaugguagcgggcaccuguggucccagcuacucgggaggccgaggcaggagaauggcgugaauccgggagguggagcuugcagugagccgagaucacgccacugcacuccagccugggcgacagagcgagacuccaucucgaaaaaaaaaaaaaaguuugcccuucauguuuaacauucaauuuuuucucaagcacaggaagggaauuaaaaaucuaacugaagucuugugagaggugcuuauguccaugccguuuccuccuuggaaccucaguagcugcacucugcuuggguuuccugcagcucaugucccgagggucucggcgggagguccgggugucccgagggucugggcgggagguccgggugucccgagggucucggcgggaggucccagugucccgagggucucggcgggagguccgggugucccgagggucucggcgggagguccgggugucccgagggucugggcgggagguccgggugccccaagggucugggcgggagguccgggugaacagaucauuuuaauucccugcuggaccaucuugagaugcugcucaaccacuuuuuauuuguuuuggggaggaggagucaccuucaugucuagaaccucacugaaaggcuuguagcuggaagcauagccgaggguccuugcugagaugccagcuucuguuugugaaaugcacauaccagguuaauggugucucuucuuuaggagcgagggcagcugggcccugggucgggcuuacagaaggguguccacugagguguacuagggccucacacagguucugaccuucucacgcugucuacgauacaucuuugacaggaaugacacaaucuaagacuuuuccauaaaauucuacauaagugaaaacuuacauuggaagaaauuuaugguccagaaaaacauccuguuuccaagccagugugcaugcuucugagcccuuugcuggguuccugaggccauccugccggcuguguccugguugugccugccuggguuugucugucucuguccagugucaggaauccucagaccuuucugaaaaaggccaccccgccggcauugugccaacucuuucugcagccuggcaugggucugucuucccugcaggguggcuucaggcuuugcugcccuuugcucacccccugccucuccaggguccaugcugaguuaggcucacgaggaaagaggccguccuuccagcacguaggucaccucaggugaaaccagagaaguccacaggucugaacuuggagacaggcaaccagugucguguugugucaacaacacaacugcuagagggagaaccugauucuuugaccuugccuuuuacucugcugacaacuaaaggaaaagaacuaaucugguguuuaaaacaguguauuuuuacaauguaucugccaacauaauccaggggguucagaaagcuguuggugcuuugagcugucacacauccccaggagaaacaagaagagaaauaaucugaaugggagggggugaggggagaaagagagacaggggaggaaggauggaagggagggaggaugggagggaggggaaaaugaagugaguauacuaauauccuaagcuaaggaagaauaaaaaaagccuggaauuuagguaaaguagcacauuucauguggacgaaaacaccaguacagccauuucuuucucaucuggacucagauauaugcugccguaauggggauaaggagaugaguuuagaagccaaauuugugaugaguugccauggcaauggguagaagcagacuccauauucugaaaaagaacugaguaguguaugcacugaaugugcuuucccuuauacggccucagugccuggagccaucgugccauuaguagcuuggaaagggggggccgucaugugggaaagggaaggaagaaauggauucugaacccuuccuuuguaccagguacuuugcuaaucuuuuaaaaguucuaucucucuuacacuuuguaauaacugucagccuuaccuugaagguuugccuugcggucccccagaauuucaucaacacuuggaauuggcuguuugccuaaguguuucguaagggaaaacccaaugcuguauuucccaagcucagccgaugcccaugcugacuucagguuaacugugcugaacuaugaggcagugaaaggcagccugggaaugagcgcgcucuccuggcuuuucuguaacgugauggugacccuggagggccggggcaucacgugugcuguugaugauugcaggugagcgaggcggagaucaaugggcaauucgaguccgugugcgaguccgucuucagugaaguugaaucucaggccauggaugcccucgaccucccgggauguuuccgaacaaggagucacagcuaccuucgagccauucaagccggcuacucccaagaugacgaauguauucccaugaugacacccucugacaucaccuccaccaucaggucaacagcagguaaggggacgccauuuucagccuuccagcggggacucuagaggcauaccugucuucauccuagaaggagcgagcagcacacagcaccacaguacaauguacucuccugacaucuaguaacguuuccuaauugcauguguuacacugucacauucgcaaggguguuuugucucuuguagauaaccuuucuuuuucuuagaaugaaaucuacucauuagcaaguuuccuuaaaauaaucaaguguaacuuguguaaaguuuuagagaggagaaagaaauggaagugcuagcauuuggaaggugauuaaguuuuaaauaccaaaguuuaauggauugcagugagauuucugcugaugcgcagugacucucaggcugcccuguagugacguccagccggucucuugcucaguaagcagaucuguaaacaugacucaccgccgcuaagcagguccaucauuaaugcagaugcacuaacuaucuuagagcuccgaagacucagucucgcaauuuccuuuaguucucauggaaaaccauacccaccccuuugaaaauuuaccgcccaaccuaaauaucacugccuaauauuuuacugccuaauauguuauuauuucuauaacacgaugaauacacauggccuagagaaacccauaaaacacagcaagcaauaaaagcucgaggcgccgcacauagagguuaaggaaaggagcuauaaaaaaacauaguguuggggacugagguguucugaauaccagagggcuuggaaugcugcagcuguaucuuagaaauuuaaaggacagcuccgaggggaaauagaacaaagcuauguucaugaugaauagcauuaggaacagcagacacauaacaggagagaagcaaagagaaauucaggcaggagugugucaucauaccugugaauaggucuugguuuguuucaaugcuaaagugaacaagaaauccaggagauugcacuuugcagaauuagaaauugcagucggcacuaucauugcacuuuguguagaaaguauuucauaguagagucuguggauggaagggaaggaacuguguucaaaccguguuccaucauguccucgcugcaagaacuuaggcuuguuaacguuucugacucuugguuucugcgguauucaagagaagcuguagccauagauaauuuauuugcauaaauuuaaagauuauuuuucaaagaaagcuguggauccucggugugcuuuuuaugugguagauauuucuucaaugcuggcaccacugagccgggggcuucgggagaaaggcaacagauccuggcucucuggcucccagcagggcuuucuguacgagggaggguggugcccaggacccacccaagggaaauccacaggcugacaacacaucccccaggugcagccaccgggcagcugugggcacccugcguagccuccuguuuuccucugguuuggccgguucugcucacuccugccccuuggugaaguccugggccaguucucaugcucuguccugaugugaacauugaacaaauuagaaucagggaaguaaugagauuuacaaugauugcauugaaaaacagcgguccaagagaucauuacucauacuuucagcaguauuuguuuacugucucuuaggagcaaguaaacaauuaagaacuuucauagucuucagaaaugcuuugaaacaaucauuaccucguagaaaaggacuuuauuguuuuuaggacugucauuauagagagaauaaaaauaaaacagauuucacagagauaagaaccaguucugagcucagacuaaaauuuuaauuuauauauauacaauguuuaccauguauauuuuguauuccaaaaauacaccuaccaaauaaauuacaaaaaaaagauuccauucagaguuucuaccggaucuuggcccaguuuugagucagaauuuccucuaggugaugcaggggacuguccaaguuaugugacaucugagaaucaaaugagaaaagaaaugaaaagcacuaggggaaauacuuagcacuguaggauuacaaguuacccuugugaagaaauaaaaguacagauuaaucauuaaccucugcuguuucccauuuuacucuaaguauuguauauuaguuauuuaaaucuuuauuuacuaaauaaaauuuagaugacaugcaauauagucuauuuagcaagauuauggaaaaauaccaaagaaaugaaaacucccagucugggaaaacaaaauuauggaggaaaacuaucaacauguacgggauguaggugccucgauaauugugauagcugaacuucaaauuucauccaaaguuuccuguccgugagucaggcggauuucaaaaauuuucuacuuaaauacuucugacuuuuguauuuaaauacuuggaaauugauauccuagcacuacguucaauagcugucauuuacugauccauguauacauguguguaugugugcgugugugguguauggggagagagguuauuuugacagauugauuuucuuuuaugauuuucugucuaaaacuagcucaugaaaauaauuccaaagaguuauuuuugaaaacauuccaaagugaguaccuugaagaacgagauuuauuuaaacacauuacuuuaugcaggcucaaaagguaaaaguugauguuauuauuagauuauuucaccuuguauaacuacaaauguauaauauucauauaauaauaaauauugaauauaugcaugaaagauguauugagaacuuaaaaauacaucuuagaccaucuguuuuaaacauggacagguugagguucccagaggacgucuguugguuuggggacaccccaguucaccugcuuuuucacucaaccuuuaaaggcagcuggugaucgagcugagacagacccuuuuaaucuaaucaccagggaacuccaguaagaacagaauacccugugaggcggugugagccacgcauauaaacguuccuucgucccaccguuucucucauuaugaaaaacacugcauauugauuaguguccuccccuuaaaugaagugguuuugaaaacaucuaacucauuucacacaugguuucuuucucaucugggaaauuauuuaucggauugcuuuacuuguccaaauaugcaucucacccgauuuuucuagggagggaauauuauugauauugugaaggaaaaugguguaaaauuagauuauaaugauuuuucucugggccggaaauuuucucaacauaugauacaacugauucuagaagucauuaaaacaaagggaaaaccuauagaaagcauggcagaggaaacagccacagacuuauuuuauuauuuauauuucuauagcaacuugucucucaaggguacauaguaauuccauuuccaagauacauacuugccaacauagaggagaaaaauuaucucuauauuucaguaccuugaauauaagagguagaauaacuguuuuucaauacuaugauuuuuguugcuuuuuuaaaauuuuacuucuuugcugaccuuccucaguuugaauaaauaugacuauguauuugauucucccauuuuuagucuuuuacaauaaaagacaguguuuuacuuaauuuuaucuugucacaaagaguggauuuucaggcgugugagccuggggaaauuuucaucguggacuaaacuuguugccucaaccuucuucugauaccaggaccugguaccgucgaguuacuguguaacugauaugcaaguuugccugacaagauggugagaacauauuuuaaaacuugaauuugaaaaaguagagaauuuaaaggaaaagaaacugaaaauggaugucagcugggcugaucauaaaacguuuuggccaauagaguaaaggugauuugaaaucacaaaauaccgcagggcauauucagguguguugggacacacaggcaccacuugguaaacccggccgauggcugccgagugcgcagcaccccagguuggagggaggaggugcaccccagaggaggaauacccgucuggccgccggcuggcuccgcaggcaggaugucucugcagacgugcuugcucggggaccaggugugcagugugcagccuuuccagguccacauaccucugaccgggcccuucacccuccuauccuccuuucccagagggcuggcaaggaggcccugcagccagcuucccugcggaguuaaaauaaaacacgcuauauggggaaaggcuuugggaaggacauuuagcucuuuacuggaaaaaugagcagcuggagguucugugagccacaaaaucugaaaaccagaagauuccuccaaacacgucuucuccuuggaucugucacucugacacaagggcuuuacaaauaggcucagaaacuguugcgcggggcucucagaugcauagccucaggucauagcuuuccauaagucaacagcuaugcacugcgaggaccagccugcacaccccacaaaggcaacaaaaagcugcguuucaguaaacaaaugaccagaggaaaugaaugaaaaaagucacacaugaucacuuuccguuuuagaaauguaaaaaaugaacuagaauaaagaacaaucaucuuauaugccaauugaagauucuaaagaaaagaucaaauuacauuuaugucguaagcauuuauuaaguguuugcugugugccggccgcugcgcuaagugcucugaauccagaagcacugaaguccugagcauuggccccgaaggccuaaagucuggaaacaguugcaguugaagagcucgucagccauggcacaccugcugggugcugugagauguguguggauggcucuggaaacccaggggaaagccagcacugcagcagcguccgggaggccuuccgccugcaggaagaguugagaggcuucagggcugggcagcagaaacccagggagagggaggugccagccugaaguaaugacaaacgucccgaaaaccgcugggcaccucagcucugggauucgcagggcacccggccuggagggagaggcuggaaggcaggacggaugggggacaugagcugagagggacauccaugcugcaccuguaguacuugcaccugcagaauucggaggucacuggaggacucuaagcaggagagggaucuguggcugaguuguguuccccggacuuggugcugaacccuaaucccaggaccugagaaugugacugcguuucagacagacccuucgaagaggugaccagguagaaugaggucacagggggcccaaauccaaucuguccgguguccuuauaagaagaggagaugaggacacagacaugcaggaagggaccagcuugugaggacccggggagaagacggcaugugcacacccaggagaggccucaguuuucccagcgccuuggucugggacucacagccuccaugacaugaaucaauguugcucuguuacggcagcacgggaggacuaacacgggggccagagucauguuauaaugaagacccgcggcccggccguacugcagaagagcacggagaagacagcuccucaaauagcacaggugagaagggaugaggccgggcugugccaggcacaggugcaggaauggcuuucagagggagcuccaggggcucccggcugagcucuggggagccgugaagaggcuuuuaagaggccuccugccccagccguggaugaggcccagaaagccagcaugcaggcagggagucuccaggacuucauccaggaagcugggucucccggggaguccaggaggagaggccguaaugauggcuccauuuagggacagacgcagagaaggcagcggaugcaugcagaucccagcgauggggcugugccguugucuccuccugcugaagcaacaggauggaggugaugcuguugcagcccagagagcugggucauggagugcagguaaaagaagggauggccaguacaaccggggagccgggauggauugggaugaagugcccaacagcccucuccagcugcugccucucagcagccgaagccaacagggcccagcccacaggugccgaguaguucagauguguugagcugagggucccaugacuugcuaacccaacuucaagaagagguguggaggucgaggcuggaggugcgguccagagccauggagccacccccgaacaggaggguauagaaagagaagaggccugagaccagagcccacagcgucagcaucguggggagaaggggccuccagaaggagcaguggaaaggugggagccaggagggauggggaggggccacggaggggaguucaacacugccccaguucaccacagugggaacagaggcugucccugggucuuggcagugugggcagaguccuggaaggcugcugcgaggccugaauugugcagccccucuaugcggagcagcagggguccugugccacccccgacccaggguaagcccagguuccugguguccauaagcccugcacaaauucagcacagcggagaccccuguggguccucccagagacgggccuggacugaggaaccccuacaaagcagguguguuugucucauauuugcagcuguaaaaauggucacaagcccuauggucuccagcagcacagaugugccgucucacagucacagagguuagaagucuaaaguagguucuguggggcuagcgucaaacaucaggucguucuggaggcuuccggggagcccgcuccuugccuccucaagcuucuggaguucucugccguccuuggcugcgggccacauggcuccagccugggccuccauuguccaagccuccucgucugacucugacccccucccuuccucauguaaggacccuggggauaacacugggcccacugggaugauccaggaucaucuccccaucucaaaauccugaauuuacucacaucugcaaagucccuuuugccacauaaaguaccauggucacagguucuggggacuaggaugcggacauuuuuggaggggcguuauucuguuuaccauaguagguuuugguaaauacugguagagugcaugaaugaaugaggucuucucugaaaccgagcccaguauaaauggugacauccuucaggcacugacccaaggggaacccauuucucuucuaggaguauuacacaaauccuugucguaaauccagguugauccugaugaagaggagccaaaucuggcucgggcugauggacgcugugugcaggcucagaguucacccugggaagcccaggugugcugccccguggguccucagugucagaccugcugcugaagggaagcccaggcgugcugucccauggguccucagugucagaccugcugcugacaucacgucuccaaccccgcagcacagcguaguccaaaugccagaaaccuggcaacaacgauaucgugcgggagucgguccgagaugucccagggaaucugaacgucuucccagccgcucaggaugucucugauugucaugauccccauuagaacgucucagaaacugccaaccaccauggcuuccaugaagccccaagaauccuucagcaaagcuccauguugcaaacuaaagcccagggugugcaucaugaagacgccaucccugugucccggguucagaggcuuguacccgggacucgggcaugagaccccauuacgggccugagcacagcaccaagaccgucaaacgcuaaaaacaggcacagguggaagucucacguggcccgcccccccgcaucuagacuuguguuuuacaguaaaugacgaaaugcaguccagauaccuaaaagaugaaaacuaaucuuugugauuuucauugucuuugauuuauuugaacuacagccaaagccuuauguacuuuauccguugugcgcuaagccuauaggaugaguggaugaaagccgguuggcccuggggaccgguagggagaagccguggcagagcacagucucugcggagaggagggagacccaagcucuccuggcuguggggaaggagaagcccugggagacacggguaagggucgggugucggaguuaggacaggagccccuggucugugcuguagagaaggaguggaaccagcucccaguaaggguuuccaaagguuaaauacuugacaccucugucuagaacagacaugacagacgaaucacgugccucccgguuugcagaaggcgagcgugaugcagauaaaucgugcaucuguaucaggaacugcauauguaagccagaauugcucgggugagaacaaauguguucauaaagauuuuccccaaguguguagccugcucuucccuucaaaaccaccguuuucaaguaauuuguguccuucucuuauaaaauccuccugucugcguacuuagacuggaauuacaacaugaaugcugggaugaucucccagguaaugagauuucaagaugaagcugucauugaacaagugaacuugucuagacgaauuaaucauaauacgaaugaaacuagagccacggguuccugacucauaguccagggcucuugcaguugacaacgaucugcgucuguccuauggcucugucucuucccugaaguagggguacauuuggagggacauguguauggggauggagucagaaguccagugaggacuuccacauuguuguccuaagaguaacaguuacuguaagaaaggauuccuaauuggucauuuaacaucuuaucacccagaaaaguaauggcugaaauaaauaauugaugcuugcauaagucaguaggugaauaaauuagucauuucagguuuucagauauuguggagauggaaguacuguugaaucugccucccauaccccucgaacccgccgguccucaccugugucacccucgaccccgccggcccucaccugugucacccucgaccccgccgguccucaccugugucacccucgaccccgccgguccccaccugugucacccucgaccccgcugguccucaccugugucacccucgacccugccggcccccaccugugucacccucgaccccgccggcccucaccugugucacccucgaacccgccggcccucaccugugucacccucgacccugccgguccucaccugugucacccucgaccccgccgguccccaccugugucacccuccaacccgccgguccucaccugugucacccucgaccccgccggcccucaccugugucacccucgaccccgccggcccucaccugugucacccuccaacccgccggcccucaccugugucacccucgaccccgccggcccucaccugugucacccucgaccccgccgguccucaccugugucacccucgaccccgccggcccucaccugugucacccucgaccccgccgguccucaccugugucacccucgacccccccgguccucaccugugucacccucgacccccccgguccucaccugugucacccucgaacccgccagcccucaccugugucacccucgaccccgccggcccucaccugugucacccucgaccccgccgguccucaccugugucacccucgacccccccgguccucaccugugucacccucgaccccgccggcccucaccugugucacccucgaccccgccgguccucaccugugucacccucgaccccgccggcccucaccugugucacccucgaacccgccggcccucaccugugucacccucgaacccgccggcccucaccugugucaccccucgaacccgccagcccucaccugugucacccucgaccccgccggcccucaccugugucacccucgaacccgccgguccucaccugugucacccucgaccccgccgguccucaccugugucacccucgacccccccgguccucaccugugucacccucgacccccccgguccucaccugugucacccucgaccccgccgguccucaccugugucacccucgaccccgccggcccucaccugugucacccucgaacccgccgguccucaccugugucacccucgaccccgccggcccucaccugugucacccucgaccccgccggcccucaccugugucacccuccaacccgccggcccucaccugugucacccucgaccccgccggcccucaccugugucacccucgaccccgccggcccucaccugugucacccuggaacccgccggcccucaccugugucacccuggaacccgccagcccucaccugugucacccucgaccccgccgguccucaccugugucacccucgaccccgccggcccucaccugugucacccuggaacccgccggcccucaccugugucacccuggaacccgccggcccucaccugugucacccucgaccccgccggcccucaccugugucacccuggaacccgccggcccucaccugugucacccuggaacccgccgguccucaccugugucacccucgaacccgccgguccucaccugugucacccucgaacccgccgguccucaccugugucacccucgaccccgccggcccucaccugugucacccuccaacccgccgguccucaccugugucacccucgaccccgccggcccucaccugugucacccucgaccccgccgguccucaccugugucacccuccaacccgccgguccucaccugugucacccucgaccccgccggcccucaccugugucacccucgaccccgccggcccucaccugugucacccuccaacccgccgguccucaccugugucacccucgaccccgccggcccucaccugugucacccucgaccccgccggcccucaccugugucacccucgaccccgccggcccucaccugugucacccuccaacccgccgguccucaccugugucacccucgaccccgccggcccucaccugugucacccucgaccccgccggcccucaccugugucacccucgaccccgccgguccucaccugugucacccucgaccccgccggcccucaccugugucacccucgaacccgccgguccucaccugugucacccucgaccccgccgguccucaccugugucacccucgaccccgccggcccucaccugugucaccccucggggcugaaaccauuuuaagugcucaccugggugccuccucagccuccaggggccuggcaggacuucccacccacucuccauccugccugcaggacauucuugcuaaaaaggcagccugacccuaagcccgcccgaccaagagccucgucucggcucugugcaagagccagaggagugaagacugccguccucugugggguugcaaaccccagugacccggccccaccagacggcccagcugcccucucgcucccacccgcucccagccagucuuccugaaauucucgcaccuccaugccucuacggcugcugcucgucggcccgcaguuucuuccuugaguuucugccugaguccuagcugugcuuuaagccccagcucaggaaucauuucuucaaggaagcggcagagacgcgcuccugaucugaucagcgucugcacgaagcacggcuucugcuccuucccacucccugaccaggagcuccagccacauagcacauuuacugaaacaaacagaaucucgauguacauuuaaaauguacuuaucuuuuaaagacauaaaaacauuagaugccaaaauaucuaggccauggcagagaauuauguuuauuauuuguaugccauuacauugucucaggaauauauuuaaaauguauugacaccauggcuuuuacucuaacaggauguucgucuaaaaagcauuacauuaaaaacaaauuauuuagauucauaaaauuaaaaauauucugaaaacauugagaaaaaaauacuuuugcucucuuagggaaaaaaaacuagagugaugcuuuuaaaugaaauuacuugcugggcacaguggcucacgccuguagugccagcacuuuggaagggucacuuaaggccaggcauucaagguuagagagagcucugauggcaccacagcacucuagccugggugacagcaagaccaugucucuaaugaaugaaucaaaugaaugaaucaaaugaaugaaucagaugaaugaaugaaugaaacagaaucauucaacaucaguacagaccaccuuugacuuaaagaugguuggacuuacaauuuuuuaaccuuauaauagcgugaaaaucauccacauucuguagaaaccauacucugagugcccacacaaccauucuguuuuucaccuucaguacaguguuccaugaauucgaggagauagucaacacauuauaaaacaggcauuaagugagacgauguuggccaacugcaggccagugucaguguuaugagcuuauuaggaguaggcugggcuaaguuacgauguuugguggguuaaauguauuaaacguguuucccacuuacgauguuuuuaguguaugauggguuuguggggacauaaucccauugcaaguugaggagcaucuguauauuuauuuuuucccuguaaugaugcaaaauauggacuauauggagucacauuugaaauauuuaaaaugugaucaugaaguccuauagauacauuuguguugguugauuauccagacaauaaucuuacagguacuauguauuaccuuaaaagguuguaauuuauuugcuacuuuuauaacuugaaauuuucuuccuuugcuucauggguuucaagagucauugacaugauuuaauaggauauuuuuggacuuaaacaaaauugcuuccugauagguauuccuagaucccagagaguuaaccuuaaaaagaucuuuuuccugugaagcaucacauggaaaugaaaggggaguggacgucuugcucccaacacgucauauuccagccuugucuuucccguucaguuugcgaaugguuaggugauguuugccauuggugguggaggccgaauaaugccgcacaguucucuguaugauagugugaugguggaguucauguggcaacuugacugggccauggagugcccagauaucugguuaaacauuauugugggugugucugagagggugacucuggaugagguuagcauuuggagggguggacgaggugaagcagaugcuuuccccagugugggugggccacguccuaucuaguggaagaaacaaaacagcugacucuuccauagagagagggaauuccuccugccuuugaacugcgacuugcaccaugagcccgcccagaucuccagcuugccacucucccugcagaucucggaacucgucagccucauugacgacaggagccaauuccuuauccucuuucucuguauguauucaccugugucucuauugucugucucuuccuuaccaucucucucuauauguguucaucuauaucucuaucgucuguccauccaucccacccauguuccauuaauucuguuucucugaaaagccccaacuaauaucauacccuuaaaggguauuuuuucagguucuguauuuaaaaugaucagagaauuuacuaagagaauucucaccaucagcucuucacacuggaaaacaauuugaaaauuaaaaagcuaggucagaaacuucaguccuuguagcuguguugggggaauguucauuaaaauaaaggccgcugucucagugucaaugugcuguuugaaaacaggugucagaggcacagucucugcugacaggucgaggcuggcacugcugggacaggucacuaguuaggcuggugugucaggagugaagggggccagagggcaaacggaucaaaauccccuucuggaaaggagaacccaggugggcuuggaaagccagcgucgaaaacuuuugucccuucuucuaaucagcgucugucaccacagagaagugauggaaaggccagagaagcgucggaaaggccagggcacagggcagaggcagaggugagcggacaguggaggaggauccaggacuucagcagacacagggcucaggcuuuggcucaucugacagcggugccggggcauggaggccaccaccauugaaggccuguggacugaugguuccagggacagaguccucugugaauuuccagcaggacacugcagugagacuagugcagacagucccccagcugguugcuggaucuggaacugaagucuccaagcuagaguccaugaccccaggggaacccuagcguaagguauucaugaauucagggcugcucacaguuagaugggauaaaaagugugucuuuauccuggcuaacacggugaaaccccaucucuacuaaacaaaacacaaaaaauuagccaggcgucguggugggugccuguagucccagcuacucaggaggcugaggcaggagaauggagugaacccgggaggcagagcuugcagugagccgagaucgcgccacugcacuccagccugggagacagagagagacucugucucaaaaaaaaaaaaaaaaaaaaaaaaaaaaaaaaaaaaaagugcaucuuuaucuucacuaacuuucacuaacuugaauuuacaauuuccuuccauuaugaaugcagacagcagaacacauuccuaugagauucaugcuaacaauaucaagauagcuuaucaucacugaagaguucuugcaauggucuggaaacaccacccuccccacgcuugaggcugcaggagcugccaguccccugccgggucucucucucauugcaugccggcugcuauaaggaagcgucauagccugccuggcuuaugaaccccagagauuuaucucucacaguuauggaggcuggaagucuggggucaggguguccagugugggcagccuccuuguucauaggcagcagcuuuucccugcguccucacaugguggaaaaagcguaaggaaguucccuaggaucccuuuauaaaggcacgaaucccucauccugcccccagacaauccacaaacccacggucacagacgucggucaucucuuccacauuucaugucacugccaugcccaaggccuguggcgauaagccagaugaguuuaaauuaacccgugcguguaccgugccacaccaggcucaauaaauauugguucaacguaugagugagugauuugaaaauuuacaguugauaagcucuuuaauuccuuuucuauugagaguuuguccuaacuuagaggacucugacguuuaaguuauaaacuccacugugcucggcuguuagccuuggcaucgacuugagccuuuuucuguagaguuccuuucugaggacaauacuuacucaggggcacccaugcauccuuaucagauguucuauguggacaugauucaauuaucuauaaccgacaugugcaagaaauaacauuuuuuuuuaaaucaacuuccauucuaaguucccaccccuccugcgugguguacugugaaauucagccucugucauuucagguuaaacccaaggcaauaccaaaaccaggacucccaggagguuuggaggcaucugggaagccuccuggucauaggccauugguccccucauugguccccuccggcuguuaugagauccccagguccccuucugcaugcaggauucgcucaagucugcagaccuucccuggggcaugaucaggacaggggccguguucugcagcugcucagagacccgcagguccccuucucuggcugucaucauucccagcuuccggccucuuuccuccucucccugagccccugguccccucagucaugucucuacugaguacaggcuuuugugaaagucauggugaucuuugccaauggagaggauaucgugggguuggcuuccucccauagaaaucucugaaaagaagaaccgcugaucucacuugaaaugggaagaauuguggggaaaaccuacaaauccuaucacaaagguuuauucugcaacgugaguggagugcaggcguuucccagaucggcagccaccacgaggucauccuuggauggcgucugaacacaugucuggggagagguccggaggggcccaaaaaaucauugccugugacgcuucaaaauuuaacuuuauucuccagaaaaguaaaaauuauccagguguauacauugaauuugaauaacugccuuuaccuaaagcuuaagauguccaaaagccaaugcuauauaucaaaaauauuuuuaaacugaagcaaaaacccaaccaguaaauucuuuuuguuucuucaaagcuaccagaacacucaauacccagugucuaaauucuuuuugcuucuucaaagcuaccagaauacucaauacccaguguguaaauucuuuuugcuucuucaaagcuaccagaacacucaacacccagugucuagucauugcuauuuauauugucagcagugguguugggguaaacagaauuuauuuaggccauuuuaauguucccaaaauuaaagcaagagauuaaaugagaaugauuacucugaauuaaucuuugaacccuuuuucaaacaccaaaaaugcagagugcuagaaauuuaacuggcaaguuuggucuaugguuuuagguacuuggauggugagaucuguaucacuacugauauuuuccaaugacauagaagguggcaacaaaauauaguaaggaaauaguuauauaggaaggaaauaucuaugaagguaggaaaaauacuccuuucuaaaauauuuaauuauauuggauuuauuucauccuaacauagguauuaagauagaggaucgugcugugcuuuuuaaacguaagucaugggaaagcuuugaaaaucccaguggauucaucauggggaauauuuguaucucuauuuauuuauuuauuugguuuuggaagccaggaaggaaagaaauaaagaauggaaugauggaucauaucaaauguuaccaugaguacaaggaagauaaagaaaaagaaaaagauucauuagcuaaggcagcugaaagaucaugguugacauaggcaacugcagauucauggaauuucuggagaaaaagccccacaccuuaaauaugcgggcagguuacauuuccaagucuuucaguggcaggauaugcuccuacucucuuucuguaauaaaaacgaguauuucuuguauccauuuauugguuuacagcaggucauuacuuuauaaccauuucgaucaauuacacaaucaauugaacaaacucacaaauauguauuugguaccugauguguauaagauaauggagagguacuuuauaaaaggaaaggaaacagaauuggaaauagauuuagaagcuccauauacaugaagagauaaucauguucaaaaacuuuugucccuucuucuuaucaguguuggaugauuauaaacuguccuaugauucauaaaauagucaaaauugcugucucuucuaaauauugacagcauaagcuuagaucuugauguaauuauaaggcacaggaguggucucucacacgcuuauucugugugugcgauaaaacggagguuuuaucugugaggguauucuaaaacacccguguuaucuggcagauggcgcuuaacagaaaugaauuauuuguccucuucggcuauuccagaaaaagauacugggugcuuuucaaaagauccucagaaucugcaucugcauuucuugaccaagaagacagaagcuugggugacaguugcuggagcagagaugggaggagaguagacacagaagcuugggugacaguugcuggagcagaggugggaggagaguagacacagaagcuuggguggcaguugcuggagcagaggugggaggagaguagacacagaagcuugggugacaguugcuggagcagagaugggaggagaguagacacagaagcuugggugacaguugcuggagcagagaugggaggagaguagagacagaagcuugggugacaguugcuggagcagagaugggaggacgguacggacauuccugccauugcugcugcuucucaugucugccuccagcaucuaccaccaagaaaaccccugcucagcggaauuuugggauuacauggggaauaauauggggaacugugcuaacagauacguguaugcacuuucucaaacguaccauccagcguccacauucugaagauaaacagguuuaccaauucuuugcaaacacucagacaccguauuucuuccuccccaccucugccucacagcagaagggccaggacugaagcaagagccacacacauauguggcuggaaauguugacccaccagauucuguguguucuguguggcccuucuucacagggugcccugagcccaaccgaaugaagcgcuggccccgucagcagccauggucacguccacuuggaaguuccaaaucccgagguuccugcagagagcagcucucugcuguggcaccagcugcuggugagggauccagcuccccuaguuaccucccccaucaccaagagacuggaaguuccuggcauacaacauaggcugagauccucaacugagcugcuucucuaaagcaggggcagcgggcauagcuccagcacauggcggcuggggcguccaucccuucuggaauaugcccugccaugaccaccccacuccugccgggcuccugccuggcccacagcuccaauggcuuaagccccuagcuccguucucugcguucacaaaaccaccacaggcuguguagcccuccccaugugaaauaacaggggaagaugucugacuuacaaggcaacugccaggcagcaaaaauccuucugaucguauuuuccaucuggguaugugcucaucagaaguaaauuugaaaaguuaaaaaaaaacgaagugauggagggacacagucuugugugugaccacccgaggcaagccccgccugcaccucuggucagacauuccucagcgccagccagccuuugcaugaggcagcacucagagccucgucagagccgggcugggcaggcagccugccccaggcaccuacacagcucguuucugcaagccccacuugcccagugaggcuuucucuuuuuccuugagaauuaaguugguuuuuuucuggucauacacucuuuaacaugcagguguagaauuaagagauauuuguguuucuuuccuaaaugauuccauaaaccuggugcuaaggaacuauuacauuagacccuugguguaggcagcaaaggagauugggcuuuacgcacaccgagguucuuacgugaagaugcuaaugacauuccuccuggagugugugugagcccaccacguuccucauccuguuauguauauuuuaguaauccauuccauucauugugagucucuccccuggcuagaauauaaguuccacaggggccggguuuuccucgcugcugaauucccgugccuagaacagugcuuggcacauaguagauagaaauguuuguugauuuauuuagugaaaaaaaggaauaaaugaaugaauaagaaggauucucucucugugugaacuacuaccuuagcacugcugcccacuugcaacuaacccuggucuugugcgugauauuucugaguuuccaggagagcagagacaagguagagaauaaaacccucugucaggucaacgacaccuaggaagugguaggcgguccguagauuuuuggggacauguacauggaugaaucaguccuuucugugcacuuauguaaaacuuauuuucauuccuuauggaauuugcaucgucuguuucugucauucuugaagucagggucagaucuuuauuuuaaaauaaagaauaacaugcgagacagacaguaaugagaccagcuggcgaaccaaaauguuaugagcaguuucugaaaagcaaaguaaauugccuccuuggucuauguaucaucccaucagcguucguaucucaaggcugugccacagaugacucauugugcaauuaucuugccagccucuccgguccauaugcccuuugccuugggcccaugagagucgcaauuuccuggugacccagaggacugucaugggccuuucucuauuuuguuagaagcucuucauuuucaggguaccacuguaaaugggggauuugaaacacaucuauuucgacgauuaggaugaagaaggagugcccaguugcugccaggccuggagauacuguggcaucgcguugguucuuagugcuggcccugugggugggguagggagccgacaauccucaccacgcagaugcugccaggccuggagacacgggcagcacguugguucuuggugccuggagacacuggcauugcauugguucuuggugcuggcccugcgggugggguagggagccgacaauccucaccccgcucacggggaggcugcaggugccuggggucauagggcuuccuguggcggggccagaaccgagcccggguaucccguggccaucccacacccucacugcucucaaggcugccggcuuccuggccccacaggugucguucaugcucagcuagcucaaacugaugcuuacugauccacauaggcucuggagguucacagagcaacuucagugcaaggagcccugauuuauuggcaggaccaacggcagcccucugauggguccgucucucagauccgugggcagagggcaagucaggauguuugggcuguaaauugcagggguggauuccuguauuugcuugggcugugaacugcaggggcggacuccuguauuugcuugggcugugaacugcaggggcggacuccuguauuuccuuuuccauuagggucaccuuaagauugagauuaugacauccauaguguggguuugggaccuuccaaccuucugaucaagcuuuaugggagacguugacaugauuuaggauauauucauuugacucugagguguaagucagagguaacacggucuuaacucuugucaguugccuuugcuuuauuguuuuauuaauuuuuuaauugaaggucacuuccuuauccuuagaaagagagacauuaguaacuucagguauguuaguugacggaucaaugucugcgcacucacuauuugccaugugcaugguaaaaauaaacucucaucaucaaauaaaauaccaccuacagaauuagcccucccuugaaaucuugguaguaaagauuucauucugauacaacuucaguauagaugucauucacaauuaggugucccguguacgcacaugcacauauggagagacacacugacugugaagauguguaacaaaugcuaccuccuguacaguucacagcaucucaaaaaacaggcccaccagcauccuccaguucuuggucucuucauuuuuccacuggaaaaauuauuccuuucaaacauguuuucaucuaagaagcuuugcauucuuaaagaauuggaacauggccgggcaugguggcucacgccuguaaucucagcacuuugggaggcagaggcggguggaucaccugagguugggaguucgagaccacccuggccaacauggugaaaccccaucucuacuaaagauacaaaauuagccaggcaugguggcaagcgccuguacucccagcuacucgggagacugaggcaggagaauuacuugaacccgggaggcggagguugcagugagcugcgaucacgccauugcacuccagccugggugacaagagugaaacuccgucucaaaaaaaaaaaaaaaaaagaauuggaacauaauuguguccuacuuaucaauuggauugggaaggagccaaacuauguugcugauauguuucuguuuuuuguguguguugaugucaaaucauccuaaaagucagugugcgccaucacugaugaugcauuccuuuucuggguuauccuuuaguuuuguuaccuggcccuuugaacauucaaaauucuguacuuagaaacaugugacucuuccguucacuaaacguugaugcauucucaguguucuucagaaaauacaaguucucgccgugugaugugauguucaaaccuuuucaauggaaacaggaagugucucgaacagcagagcagcugacaucacuucauuuuacugucuacauguuaaaugcuggugagacuauaauuucuugcuaauuaacacauucaaaauagacaucuuugcugcuagccuaucaacguugccccagaacuugugggacccacauaauuucuuguaacuucaggaaaaccauuguguguaugcuugugggaugugacuucuguguccugucugauuuauucuucuguuuugugacuagcauuaauuaaagugucaaaauggcuuugauccucuauguugaaucuuuugccuugaaaguuuaguuuguccaauauucauucucucauucagacagucaugggcuugaugacuguaauuccuuuuaugcuaucauccuugaaguucuaauuaagagagugcaaugaaugcaaguguggcuguuacauucaaauagaauggcaaugcuugccauucaagggauauuuuaucuugauuacguauuugugccuuauacgauggaaugcuaauuuucaaauucccguuugguuugcaaaugacuuucaagcauugaauucagaagugguguccagaauuccagguguagaaggauaauuaaacauguguuuaaagcgaugauggauucacauuugcgauuccucaaagccaugugaaguguagauuguggagcaguuucuuucaucucauucacacgagcuucuuuccaguaaaaugcuuugguccaaaaucuccuccacgagguuggcuaacccaacaccuugaagaccugaaggaccuucaugaucagaguccucugcuucaugugcuguguuagaacacucagggaacuauguccagacauggccucuucaugcaggacauguccuagacagcgcugccagcacagccgucaugaugaggaagacguuccacgcuuaggcaggccagcgugguagcugcuggccgcaccugaccaugaccaguggacacacagcgugugccgcagaggaacccaaguguaaugguauuuuagguguucagauauuuuagaauauuggaggccagguguggcaucucacagcuguaaucccagcacuuugggaggccaaggcgggcagaucaccugagguugggaguuugagaccagccuguccaacauggugaaaccccaucuuuacuaaaaauauaaaauuagccaggcgugguaccgcgugcuacuugggaggcugaggcuggagaauugcuugaacccgggaggcggagauugcagugagcugagaucgugccacugcauuccagccugggugacagggcaagacucugucucaaaaaaaaaaaaaaguuugagccauuuguuguggccaguagcuaaguuauuggucagggcagucuagaaaggagccuuucugacacaacugugguaaaccuaagaauguaggcauuuucaauggguagcagucucccaccccuucacucugccaacacugcagccaccacugcguauuugucaauugugccaucuccccuucugacaguccuuuugacuccagauauuugggcaauuuuuucagaagggguuugcaaaugaggugggcucaauuccagauacaucugaggaaagucaguuuuuacacaccucuucccugccccauuuauucagcucuaacagggagggacccauccaccugaauacauuuccuuuaagcaucaacacucuucauuucaugcaauuuuuauggaauucuuccuaaaacuuacuauauguguggcucucuccauccuaaguagugugauuaaccuuuucuucgugccccaagucauuccauuggccucagaguacucaagaggcaaagcauguuacacaguuccuucugaucacaaccccauuauucucagagugacaccaacuuaugcgaucccugugaaacaaacaaaauccaaaccaauucaguaauugaauuacaaagcccagguauguuuucaucuauuucccuguaauuuggaagacacuuaaaaaaaaucaucagggauuuuauaguguuguuuacaugguaaaagaaaccaaugcuaggcuuuaaaaaccaaacagauacucaugcuuggaauagguauuuuuuuuuuaaagaaaguagucaggucaggucuucagaaacuuucaguuauuaaacaaucauuucuucuucuaauuucaaaauacauauuugaucacuuauauaaucccaugugguuguuuaguaaucucugucucugucuugauucaucuucuuuuuaaggacguagacuagaauuacauugcuaaauuaaauuuugaauuuucaaauacauuuaauguuugacauacauauagaaagugauagauaacacagccuauagcucauaaggauuaguugugauaaacgcaugcuaggcgugcacucacagaaacagaaugaagacgauuauuaucacccacaccauccaacugaauggcuggauauuuuucucuaauguguaaaaugcuuucauucauugauuuuaaucuguggcagcaaauuaauguggucaaaugaucauuuugaauucuuucuuuacuauuguuucccagccuccaauuuuaacuuuaaugagccauguagagauuuacaauucuaucacacagggcuguacaggcacaacaaauguuugucaaaagaauggauuaaugaaugaauggaugcagugauauacuuccauguuucagaaaucauuucuuaauguuaaucucuauaucaaaaucauuuuauguacugcaauuuuuauuuaaccaggacaacugauaauuuuuaaaauauagaaaucaaauauugccaauauaaggaaaauauaagugaaacagcuucguugucugggguauaaacccugguccuuuugucacagccgagaaagaauuuacgacauggacacaugguuuuagggggcgaaaaguuuaauagaaaaagaagugagagagaaaagacuuccuuaugcugagggagcagaucgcccaaaagaaagucucccguuugcagcagaaugcaaucgguucuguacagaggcuugaggagguggugauuggcuuacauagggcccaggggauugguuagaccagaugugacauuuacauaguucgcaaaaagacuggcccucccacccucgucuuuuauuaugcaaaugagggcuccacccuccaccuggcugguugccaugauaccuguauaccuggcuuuaccuggaggcugccaugacacccugcacauacugacaagcaaaagcgagcaggagaugccauauugaauguaccuggcuuccagguacagcugcuccauuuacauaugaaagcuccuagucugcauaucuaugccugacuucuuaggcagcuuucccuuaaagaagaaacgguuuaggggcuacuuuuuuauauauauacuuuaaguucugggauacaugugcagaacgugcaguuuuguuacguaggcuauggauccgucugguccugggcuuuuuuugguugguaggcuauuaauuacugccuauuucagaacuuguuauugcucuauucagggauuccacuuauuccuguguuagucaugggaggguguauguguccaggaauuuauccauucccuucuagauuuucuaguuuaucugcauagcgguguuuauaguauucucugaugguaguuuguauuucugugggaucaguggugauaucccccuuaacauauuuuauugugucuauuugauucuucucucuucgcuucuuuauuagucuggcuaccgguccauguauuuuguugaucuuuuccuggauucauugauguuuggaagguuuuuuugugucucuaucuccuucaguucugcugugaucuuaguuauuucuugucuucugcuagcuuuugaguuuguuugaucuugcuacucuaguucuuuuaauugugauguuagggugucaauuuuagaucuuuucugcuuucuucugugacaauuuugugcuguaaauuucccucuaaacacuguguuagcugugucccagaaacucugugucccagagauugugggacacagcuaaagcauugguuucaaauaacuuauuuauuucugccuuaauuucguuauuuacccaguagucauucaggagcagauuguucaguuuccauguaguugugcgguuuugagugaguuucuuaauccugaguucuaauuugauugcacuguggucggagagacuguuuguuaugauuuccauccuuuugcauuugcugagguguguuuuacuuuuaauuauguguuugauuuuagaguaagugugauguggugcugagaagaaugggauauucugcugauuugggguagagaguucuguagaugucuauuagguccacuugguccagagcugaguucaaguccugaauauccuuguuaauuuucugucucauugaucugucuaauauugacagugggauguuaaagucucccacuauuauugugugggagucuaagucucuuuauaggucucuaagaacuugcuuuaugaaucugggugcuccuguauuggguguguauauauuuaggauaguuagcucuucuuguugcauugauuccuuuaccuuuaggcaaugcccuucuuugucuuuuuuuaucuuuguuggcuuaaagucuguuuuaucagagaguaggagugcaacuccugcuauuuuuugcuuuccauuugcuugguuaauauuccuccaucccuuuacuuugagccuaugugugucuuugcacaugagaugggucuccugaauauagcacacugaugggucuugacucuuuauccaguuugccauucugugucuuuuaacuggggcauuuagccuguuuacauuuaaaguuaauauuguuaugugugaauuagauccuaucauuaugaugauagcugguuauuuugcccguuaguugauguaguuucuucauagugucaauggucuuuacaauuuggcauguuuuugcaguggcugguaccaguuuuuccuuuccauguuuagugguucauucgggagcucuuauaaggcaggccugguggugacaaaaagcucucagcaucugcuugucuguaaaggauuuuauuucuccuucacuuauuuaguuuguuuaguuugguugccugugaaauucugguugaaaauucuuuaagaauguugaauauuggcccccacucucuucuggcuuguaggauuucuacugagagaucugcuguuagucucaugggcuucccuuuguguguaaccugaccuuucucucuggcuggagggcugcuuuucauuaaaggaaaauucuacuaagaucuuucaccuuuucuagcugccuaaaaauaauuucuuaauaacugcuguauuauuuguaacuuauuguucugcuauaaacaauccauucagaaugcaugagggauuauauuauaugcauauacgcccacuguaagugagaaugacaaaagcuauauuuaaaauauauuuuaagugccugucccuggucuucacacacagaucccccuugaccucuguacucacauguaaaaaugcgucugguaucugcauaccuggaaguuuuuauguguauugcuaaauguuucuuuaacuucuacaguguuuccaauucuuuaaacgcuacaggucaguuauuucuauuaaaacuauguguuggauuucucauggggucauuaacaaagggacuuacauggacaagugauuaauauuuuuaggggauuaaaaauauccuaccaggacacauauucccuccugcagagauggcguuucagauccugugguugguaaacccucagaugaucaaucaaaacuuucccuugguccuuuagcuaaauggcccaauuguuuuugagagaaccugaaguucugauaacauagugggcuuuuccccuugaauggugucaccgaagaauacacggcaccgugauuccguagcuaauaccgcaacuuucagcaacaaggcugcuggaaccggaaucuugcacuuccugucuacgagacagggagaaacuucaccuguuucugcuggcaaggguugggggaggcuaggggacaaauccauguaaagacagcagugacuggcaguucacaaguguucaagcucuagcucuuuccaagaaaacguugucuaaauagaaauccuuuucaaagccuuucaagcugguuuucuuccuguucacguuggagccccaggagagcucucauucucagccugcugggcccagcuucuccucaucccgcugaggugcugcgccucaugguggugggggcugcagaccuguguggugcaugaccaccuguucuccauggccucuacuauguugacauggccaguaggagcacugagaagaggcagggaguaacaucacuguugacaaaaggccagaagcugggucuaaguucugcugcuuacugcacagaaagccaaucacugagacagcgaguauugccagggaagaaggcuuucaucagaugcugcaggaaaggacaugggagauccaucucaaauccaucucccuggcaaacuaaaauuagagguuuauauagcagggaagaaauguaaccauguaugggaaaacagaaaugagggagcugugaggaagaggcggccaccaggaagcagaugauggguugggcagucagaguggaugugaggucuuuggucucauugucuagaugcagugaucuggugaauuggagcuccaugaugcuaucugggaggccugauggcugcuguccuuagaaaggaacucagauaagacagauguaacuuucucagguuucaagacuaggagggucaguuucuauguuuaucuaaagaaacccauaaacauccgcccuaugggacaauucagccggugucaucaccaucacucagcugaaacagagagccagaucuccugcaaagcccgcugcucacaguauggugagccugggugcucugccagagcaagaccacaggggaagaacacggucacgcuccuuacaguauggugagccugugugcugugccacagcaagaccucaggggaaguacacagucacagucacagggcugccgcaaagggucuuccgcccauaggucaugagggaugaacugaugcuuuggaaaucagugggucccacacaccuuuccuaugaaccaggaaaauauaucaucaagccaauaaacaaauauucgaaggccucuuucccaaaauaauuuucauugauuugguaugauuuaaggaauugaaagcccauuucauauaaucuccucuuacucuggcuuaagcccauuaguuaauagucccuuuaaacaguuugggucauggagugucaggguauaaucuuuaaaauaucuucugccaccaaaggcauuuugauuuuuuguuuuuaggaaaccuggaaccgccauaaaucuugcugaaauaagugccucuuucauugaauuuugcagugggcaaggauucugacgugcacucuuggacccgucucuuaaaugagaaaacacuagaucaggucaugagaaauaagguucugcuauguaaauggucacaaaaaagaaaacuagacucauuauaaccaacaacuggagaagcaucugaaucucaguucuaccauuuuucuugugggcugaugucaggaagagguuuaagcccauucagacuuccaccuucucuuccaagauaugcaaaugccaagaccgccuaccccacaagguuguucugaagcuuaaugaacugcaaaguauaacgugcuccacagagugccuggcacaugugugagugugggguguguguguacacacgugugagugugggcugugagugugugcauacaugugugaguguggggaaugugugccuguguguacacgugugaguguggggugugugcgcguguguacaugugugagugugggggaugcaugucuguguguacacguagugugggguguguguguguacacaugugugagugugggguaugacuguguguguacaugugugagugugggguguguguguguguauaccugugugagugugggggaugugugccuguguguacacauaguguggggugugugugcguuuguacaugugugugggggaugugugccuguguguacacagugugggggguguguguguguaugugugagugugggggaugugugccuguguguacacgugugagugugggguaugacuguguguguguacacgugugaguguggggugugaguguguguguacaugcacaugcgcacuccaaggugacuuuucuuucucauacugaagaaaugaaggggugguggcaaguuugcagcugcugcuggcauuuucuucucuccuuugaugguggagucggccagugcuguuuggggacccgguggugacagcgcccuuacugugcacccgucuucgccagcuucucuggaugcuuaucuccgcuucgugggacgccggacaccgcagagcacccucagacagagggaaggcaguuucuccaagaucacaugaugacaugcuuucaugucugaagcaagaaagauugauuuaauagaaccagaaagaagugugugagauuucccuguccacagauuuugcaggaaaggaccgagaagccccccuuucccuugcgcccugagcguaaugguuaacuucgacucacaggggagguuuggucugacagcugugacuugccugugagucuguggauccuguaagugaaacucaacugcagggagugguaaaaaucaucucaagauauuaaaucaccagaggaaagcagagcaaaacaagcguuccagcaucacagcgcauguuuugauuuagaggaagagagaacggcagaauggucauuugcuguuucugccagaagguaaauaguuugaggaaaacuccaugacgcuuguaaagaaaagaagaagucaggccguauccccagagcacuaaugugaccagucgguucagcccccagaggagccugcagaccgcuggggaaauccaaguaaaguuugcaguauccuuaugccagagaauagugguuuuguugaugacaacugauccacugauaccaaacccuccuccaccagggcugccuuucuagagcugaggcugugggugcgggcacagcagcaucagcauuucuguaggacaggccaugcccacuggccuucccguggcagcguuggugcaucuacaggacaggccgugucaccuggcccuuccugugguggcaucggugcgucuacaacacaggccacgucuacuagcccuucccgugguggcauggguacaucuaggcacaggcuauguccgcuggcccguccuacuccugcuucccaggagcagcuccauccaucucaaggcacggccaggcucacccccaggaagcuucuuucaaccccagucucucucugggcaucccuagucucugaugcugcacccuugguucucaggacggccuuuucagugugauuauggagcacacuggggccaggcucuuaggcucuagauaaaugcuuccugaaaucagcgaaucuuacaauguuguauccaccagugaagcuugccaggcacuuuacgucggugcccaacguggaagaaagcccagggucuucagcccccuuaucaauggucucuggaaaacccauaugguaacagcaaccauauggacauucaguucgaccuggacauucaguucaauauugcagccuugcugauaacggugaaaaacaauacucuuucacaaaguuccaaccacaacuuuuacgaaagucagucagugauaaucccuguaucacugcagcacagcuaauugcuucaaaccacguuuucguuuuagugguuuugagaacaaccuggcaggcaugugcacacacacuuagaaagagcaucaugucuuucuuuugucauccaggaaaaaucacugugugugcccugccagguagaguguaguaaauucuucuuuuuguacgcuggaggugaacugcuccuucuuaaucuguuuguuuuaaaaguguggcaugcaacuacauuuuuacaaagaaaucaguuuaaaaaaucauuucaucagccuguagcaaacacauuauaaagugagaagaugugguaugugacuuuccugugaucauggagauaagucauaagcugccccauacauuuuuuuuaauuuacgagauauuccauacaagaaggaagguuuacuuguuuugugaaauuuuucagacucuuuaaauuuuacuuaaauacacuuagugaggucugugauuuugaacaguggcgacagaccuuugagaguaacuaugaaacacauaaugagccaagguggggaugaauuugcaugcauuugcucaaauuuucugggcaggucacuaacugauuacuuccucccuguugcauuugccugugacauguugugacaugguuaugacgcuugauaugugccaucguucacugcuuaggugaaccucgcugggaaaauccaaccaauuuggcguguuuaauaucaccuuucugcucaucucaaacuugccaaagaaaaauauaauaaggcagaugucacauuuuaaucuauauucccgcgucucucuguugccuuugauuuuuuacuaccccuauugcugggacucaaaacuucuucggaaucaauauuucugcuuaagagaagcaacgcagagccagcuuugccacuggagaggucauugagagcccccguccgcagucucgcuccagcgcgcagcggacaccgggccugccuucggccagagccguagaaucugaagacgugucauugaugauaaagauucuguuuucuguaaaugacccaugacaaauggguuaccaugaaaacagccgccuacucuccagggcugucacguggaaaccccuuuaucgaugagcccuccucacaucuccacccgcgggcucucugaccauguguccaugucgcacucaacacccuugauaaaucagcgcugugaaacacugccaggaaaggcgucaucagaagcaaguguuuaaacggaccucaucccugccaaggugagaugaaugugcaguccccaacgcgucccacccggaaaaacgaaauauuuccuaacccaggucucuccccggcacuacuggccuuugggauggagaagucuugggaacuuucugagucuccuaaauagugccuugaaucuugucaguuuucaauaauuuugcuuaaggcauugauugacguuagagggaaaagucaggaacaaaagaaaaaaagacaggauuuugaauguuugucugguaaaagagaagcucagcacccgauugauuucauaacaucugaucauccuuccucaguuuucuaggcuucagauucucuuuccaaugcaugcuuuuuacaaauguauccacuuugggcuggaugugguggcucacaccuguaaucccaguacuuugggagaccgagguggguggaucaucugagguccugaggucaggaguuugagaccaggcuggcccacauggugaaacccugucucuauuaaaaauacaaaauuuagccaggugugguggcaagcgcuguaaucccagcuacucgggaggcagaggcaggagaaucgcuugaacacaggaggcagaggcugcagugagcucagaucgccccacugcacuccagccugggcaacagagaaagacuccaucucaaaaaaaaaaaaaagucuccacuuuguaaauguuaauauguaacauuaugccuuaaagcacaggucauccugaauggcaggcuuguuuugucguuuguccuuguuaacucgggaugacauuagaggucagaguggauuaggaaaauccacucauggguuaaaaaugauuggaggaggugagggaugggaaguguccugcagacacagaaaggauguguuuccaccugcagcagccggcagcugcucucgggcaccgugucuggacauccuuggggaaaacugcugcucggucuguccucacagacggcgcucagaccccuccaggagacgcccacgugcgcacucaccuacgucacaagcagccuggcagugccucccacuguguguguguggcaggggugggguggugguugcuuugcacucugaugaggggagcagauucccuucaagaagcacuuuuaucagcucuuccugugcacuaaaggaaaauaauugacuguaacggacaaccaauuccuguugagggagaguguuagggaguucauccucucuauaaaaauaaguuauagccugaguccaggccaaggugccucaugcauuuuugguagguucuaagaguuauuuaauacagucaucaucuccggaugcauuuauuuugcuuugguggccuguccagcuguacagccggugguacagaaugccccaugcaacucgaguuugggaggagacuggcuggugacggccacaggugagcguggccuggcccagcucagaugcauagagcuggccccuuuccgguggucuuccuacaacuuaaaccuauggagccuguacuuauagggaagcaaguaaguuucugcuauuauauauuuucuccguuacagaaacaguagcuauucguuauaaugauuuuuagaaaaacacacaagcccaagagcagacagugcccauccugucacucaacagccgcgauuaacaucuucaggugcuggugaccucuucucacacacagguuuccuguacaaauagauuccaucuugaccuaugcauaguuuagcauccggcgugcuucugaaccuagugugauagaaucagcauuuuccacgaugacaugaccugcguagaaaugacgccaugccugugcgcuguccugcggggacacaccuugccuagcugugucucugcugcuggguuugcugguauuuuuaaaugaugccaugccugugcgcuguccugcggggacacaccuugccuaggugugucuccgcugcuggauuuguugguauuuuuaaaugacgccacaccugcgcacuguccugaggggacgcacguugccuagcugugucucugcugcuggauuugucgguauuuuuaaaugaugccacgccugcgugcuguccugcagggacgcaccuugcuuagcugugucucugcagcuggguuugcugguauuuuuauaauccugcacuguuacagguauauucaugugugcugucucacuguccccucauuucacgcuauuuuuuuaggcuagacguccaggaacagacuugcuccgucaaccacagggcaugggcguggggaaacaguagaccacaggcugacggggaagaacacgccuguugacuugggacuuucuuuucuuacagcugucucauauacaaauuacaagaaaacgcccccaccggugcccccucggaccaccuccaagccucugaucucggugacggcgcagagcagcaccgaauccacccaggacgccuaccaggacagccgcgcacagaggauguccccguggccccaggacagccgcggccucuacaacuccacggacagccuggacagcaacaaggccaugaaccucgcgcuggaaacggccgcugcccagcgccaccugccagagagccagagcagcucugugcggaccagcgacaaggccauccugguguccaaggcggaggagcuccucaagagccgcugcuccuccaucgggauucagguagcugcucuuggccgcccgucagggccucgcuccacucaguccugccaauagccuagaauaagccaaaacccaaccagcggcccuggguccuuagcacugacuguaaccccagcagggcuguggaaucugagagcagggcugugcguucgccuugcagaccugccagcgcagugaguaggugggagacccccgaggugaugcggaccccagugcagggcugaaggaaacccagggguuccagcucccuguccccugccacccugaaaauacacuccgggccacuuguuuuccaagggccaaaggcugccuagagaguauggagauaacacuguuuugaugcuuuaaaggggaggguuucuguugaagucugauuuuucaaaagcuuuucgguauuguggccaaagaauugaguggggaaaccaaaaggugcugggaaugaagagguaaaaggaagggcaugcucuccucucuacagaaauuggacgugcucacagcaacuucaggugcuggcaggccccucagcuggggucacagauguugcauccaugguuucagaccacagacgguugacccgccguccaucugggcccccagaugucuacccaugauauagacguggcagacgguuccuuuccccgugaauggagagcucuggccggcuccugcccacgcugcaccucccucugcaagucuguuuuaggugcaguguugugcacccagggaggccgggagauuguccugugaucugggucagguagcgcaucccuccgggaucuggcggacgugguugagcagggcuggccgucaagcccucugccaacacggcccaccuccugcuuccuuuuaccccuucauucagccugcguuccucggagcuuuaacagucagauucuugauugccgcuggggcggcccagggaggagggugaguggagcgugcugagagccgggcccgugcggcgcugguagcuaggcaugcgggcggagagagcaggggagccgcccgcugguccagggccuccgaaccaggucuccacacuguggcuucauuguuuuguuuaggauucugaauucccagagcaucagccauacccaaggucagauguaaguaccgaaaugugcuccaaagccgcguccgcaugacuuucauuuucucucccuuuuuuggauguucaugcgaccgcucuugucgccucuguccugauucuaugugccaggcacuaugcugggugcucccaucugucccccuuagaugaggacaaggggcucaccagggucccuaaccugccugcagcccugggccucgcugggcuccggcgccgguaagcaggaaagcuagggugccaucgcccgucuccgucuccgucuccagggucacgucugcaguagagacuggagaggcccccaaauuagccaggugacuucccauugccagacacucccacccucucucuuuucuccucagccaccucccacaggugcccuccaggauauccacccagccacgacugaggcagugccaacuucuaagcacgugcaguaccgacuuuaucugaaaugagugggacauaauuuuggaaacucauacaguuaagucagcacgcucggcacagugccgccgcuuccugccccgcccacagccaggaccccacaccccuccguggucagcccucuuccgcucccagcucccaccccuggcauggcagccucugcugaguacaggcuucuccucauccccccagcuuccccugcaaagcucagccugugccuuuaccccuucccggaggccucucuggaccccagccccacacacuguguccugugagagggaacugcacccccagccuguugccacccugcacccagcacugugccuggcacauagggagugcucaguaaauguuggguaagcgaguggacggaugggucgcugggugcgugcugggugaggauggaugcaaagacaggaauguagguggaugacgaagucaccuuucauggcaguaagaaaaaaaaacgcacaacauccuguguguuuucugugcauccugugagcuggcggucucacaauuauccaaaggaagugaauugaaaagcuacagagaaaauguaguuggagcagcuccagugucaggauaaggaaaacagccaaagaauugaagccacugcaggaguaaaggggaggaaaagaaggaaucgagcagaugaaagacggguuccuucuuucagggaggcgucaggaggggagcugcagacggcagccuugccagggcaggaggugacaggcugggacaagagugagcaggcuguggacagguggccacgucccugccaggcaccauuuaauccuuacaauaacccugugugcugguuguuaauugugcccagacuauggaugggaaaacugaggcucagggagggucagugacuugccuaagggcucacggccaaggccaugagugaaggcagcggccgagacuggagccugcacuccacuccaccccucucugcucugcuucucaaagaggagaaaaucccagaaugauuccgugcccucaggagccugcccugguucuguuccuguucugggacacagggcaggugucacgcuguucugcagcucauagacaaagcuggcuagcccguguuccaccagcauucaaugggacuggcuuccgggaccuuugggcacaguuuugucugagugcagauagcaggagaaucuguguucugcgaaugucauuccuacaaaugaacagcguccacgucacugaacacaucuucuguggagcucacgcccucugugagucacuggcucauggagagacagcuccaggaggguccugucccggggugggggguccugucccacaaugcaacucccuuguucacagugcauugcaugaccuuuuacuaucaggguuugaauucaggauucucauuauaauuacugggcuacgucuaacgugaucccuaaugagugaggguccucagcucacaccuccuauggcccccguccuccuucccugcccagcuuagagcagaagccagcggcaaguccccuguuccucagaugucuggccccggccaccugagucuggcccuuacagcaggacucacagacaggucucaucacagcuccagauuugcaggccagaugcccguaggagagaaugggcuccagccuuggcacucauaggccaguccuaggauaaggaggagagcuugugggcauggcugagcuaccucggagacguccucugacccggucuggccugaccucgcuuuucuucauuccaauuggaccauuuguguauucacuuucguuuuuauccuuugcgguuugucucuccugcuaaguuuuccauucucuuuugugugcauguguguguuuggggaacucugggaaauguuuacagcucccagauacugcgguuaggagggacggaggccuggucuaacauucaggguccuucugucccuggugccuugugaaucccaccuuuauaaaugagaucaguuuuuuuguuguuguuuuuuauuuuuaauuuuuuuuuuuuuuuugagauggagucucacucuguugcccaggcugaagugcguggcacgaucucaggucacugcagccuccgccuccaccuccugaguucaaaugauucuccugccucagccucccgagcagcugggauuacagacaugugccaccacgccuaauuuuuguauuuuuaguagagaugggguuucaccauguuagccaggcugcucucaaacuccugaccucaggugauccaccugucucagccuccccaagugcugggauuacaggcaugagccuccaugcccagccaaggagaucaguuucuauucugugaucucaccagguugugagaaggcaggggcagccuggaaaagacucugcggcuguccauucugaauguccugccugugauaaaagugucugccugauucuccaggcacacaggcagcugcucuuccucauggcugccccagagcuccaagccucacaggcagcugcucuuccucauggcugccccagagcucaaagccucacaggcagggccggccacucaccuguagcucugggaggcagagcacgucucagagggaaauaaacaggaguuugcaucagauucagggcaccugcccugcuaugugugagguguugaaggaagagcggaaaaugagcuuguugggagagcaaagauuacagauuggcacccuggcccaguauuacuagugagcgguuccugcugccagccccgcccacuuucauuuucucagcagcccuacagaagcugggcucagaggaggcugguuggcuuugacgccgcugcuagccugggacugcaugggaggugggacagugauuuugcucauucaucuuuuuuucuugcacccauauauuuuucaaaacuuuaagagaugagggcuugcuguguugcccaggcuggagugcaguggugcaaucaaucacagcucacuccagccucaaacucgugggcucaagugauccuacccccucagccuugcagagcacugggauuauagaugugagccagugugcucccacugcaauucuagucagaauuuccuuuggaaaagacucuugaguuaccuuuccauuguauaaaauaauuuauuuucuuugucccagacuugcuuuucugucucacaugaagccucucuaugcccaggauuucugaaauugauaaauacuuagcuccuccuggccaaguaugauuuuaccauguccccuucagacuuuaccauccagcaauggagaacuucauuuuacuuagaaagauuucauaaaagacagccaggguaaaaucugcacaguucaucauaugcgugugccuuuaauguaauauacauaccacuauucacgugaccguccuuaaagcugggaugagagaacagggaauuugcauuugcuguggacgaaccuacuugagucaggccucaggcugagaguuuuacaucaguuaacugaggcauuggguguccccucuuugaaacaaggaagcaaagauucaacaaaauuuaaaagaguuuccuaagaguugcauggccagcaaguagcagaaucugaccagcuccaaaaacuguauuuuucaaauucacuauaaaaaauaacaaaaauauauuagaggaaauuuggagacagaggaaggaaggaaaacuuccuuuuacuuuuguuauauuuuucuuuuucaugguacacaaacaugccugugacugcgagugucucuaugcuugugcaugccccuggucauuguuguccauggcaccugucaaccuguguucuuuaaagucuguauuauaagcauucuugagguuaucuuuagaaccaucuuuauuuuuuagagacagggucucucucacuuuauugcccaggauguaguacaguggugcaaucacagcuaacugcagccucaguguccugggcucaagugauccuccugccucagccucccgaguagcuugucccacaggugcuaccacucagcuaauuucuuuuuuuguagagauggggucuugccauguugccuaggcuggucucuaacgccuaggcucaagugauccuccugccacagccucccaaagugcugggauuacaggcaugagccaccaugcccagcuccauuguuuucacugcuguguaguauuccgugucacaaguaaaucaugacuuacugcacauuccuaucccacuguaucacccucauucuccccaggugcuacuuuauaaauaaugcugcaaugaacaccucacacacuggucagaauuuaagguccuuuguuuaggcuggauuccuagaaauagaauaagugagagagacaaauauucuccacauuuuuaugauaaaaacgaguguuccuuuuacaaaauaucuuuaaaaguauucauuuauuucacucauaucagauuuggcaauaucuaccaaaauuauaaagugcaaauaccucugacccagaccucccgucuggugaauauauucagagaaguuuucacacaaguacagacauguauuuauauagcagcaucauuuauaauggcagaaaacuagaaauaaccaaauuuccccugcacugaaggcucauuaaaugcacuaggcuauacucauaaaauggaauccuuugcacuuaaaacacgaggcagcuccauauguacagacauggaauuuuaaauguauuaauuguauuacaauccuuugcguaaaauaacacugaucauguuuaugucgagcaagguaagguuuaauaaagucgugacccacuuaacacuagaaacgggaaugguaaauucugacaggaaggccaggaucuucacucaagaauguucuuccuccuguagcccgucucacccagcuaucagaacacgcaucccagucuagggucagcuucugcaaacacgcaucccagucucgggaccgcuucugcgccugucuucagaauuacacccggugaaaguggacgucucuguccguuccccuggauccacggcggcggccgagagcuccaggguuuucucgcgcucugucuucugugcggcacccggcucuggggucagagagaucccggcaagagcccuagcccugaccccaaccagggcgcgcuccugagcaagucaccccccuccucugauccgccagcucucuccuggggcuggaaacauccuugggguuauuguguggaguacacgugauaacgcuggaaccucagccuagugccuggcgcaggguacgcaccaaauaagucuucgcuguuaccaucaguaccucucuuagccacaaaucugagccaguccucguugacacaggcuuaaccuuaggauagucacaaagggcaacucaaauguuaacgugcagcuccucucucuugccucacaggggacagggucagaaauauuucaugcuuugcaccuuuuccuuguagugaucaguaauauuuuuaagaagggagagauuuuauaacuuagcuaugacacuucagagagggcucaaaaguccuuuugauacaauagguaauacuuuucuggaaagaggaaugacugagugccuggaaucauaucaauggcuuaacuaaccuuugguuucacaguuuuccuacuugguuugguuuuguuuuuuuuuuuuuagagaacguacuguacuagaauucccuugugggauaacuucacauagcugaugaucauugcaaggcuuguuggguuuguggggacuuuuuggcaaauacagccacaaucagaauucucuguggaauacaugauuucuguucugaucugacgucacccugcuggccauccucuuagcagacgugagacagcucuauggagaugaagguggagaguuugccucuguuucugaucagugcugaaauuccuuucugugucuuucuguacguggaugcagccaucaguauaagucuuuuaaaucgcuuauuuguugucauuagcuguguuugguucaugcuguacuuucuucaccauagggcgugauaagagcuuuuaaguccuguuauaaugcaguucaacaacaccuauuuuuugccugagcugaacuaagcaguuuuauuugcauacauuuagaagaccaaacugcagccuugaguucagguaguuauguaaaaugugaugagacgcaggagugauguaauuacuccagugugaaugcauuucccucucugcgguuuuacugggucaagugcaccgcugcauuaauuaaacaaaugcguaauuaauuacagcaaauccacaacaacaacaaaauagucccuugcccaggccccauguuucaguucuaaaauaagacguucucuguugaauuagguggaaacggccacagauucugacacggagagccgcggucugcgggaauaccacucugucggggugcaaguggaagaugagaagcgguaacucagccccuccugacacgcggugacccccgagcgagggcucuuugucaaaggccugauggaagcuccuagauccugccggcccucaaucaugccuguccuuguggaaacagggccauacguuuauacuuuuccauugauaacccucaaguaugaauuaacacccgccuaugucuuguuuuugcaagaggcaagggaguaauucuuuccaaaguaauuuaucaccucugaaagcagagcagcugacggccugaaagucagaguccuugauccaaaggaaagaaggacgggcugagggugacgccaaugcaggccuuacgccuugucauguuacacguaaaacgauagaaagacagcaaagcacguucaaggccuucauacaccgugaaauuguuucacuucaaaaauauuaccuagaaacaaaaaauacaaagugauauccauuaguguuauuuuuguaacaaggcaggacgaucauuuuaguuuauauuuaaaauagcauguauugucuauuucauaaaaacaaauuuugaugagaauauuacauggugagggcucagccaaugugugacagggacaguguuggguggccucccucaucagggagcguuuuagcacccacccuauggagauuuugauugcaaagaaauuccgaccccagcuuauggcuuccccaguuuccaagagaccuccuagaaccuggccaucuucugcaccugggagccgggcaggcugccuuccauccugcucuguggcucagugucccucccugugcccccagcaaagggaacacguggcaacgucacuaaccagcugcaugcacagcugugugcuucuauggguucagccugcagagccacagggauggcugcaguagcugggacuauguagacacagagagacacacacacaccacacaggcacacgauacagagcauacccacgugcacacacacgcucacaguguucucacccagcauacuggucuccaacuguaagcccccuccuaucaacuauuuuggugaucagcuauguggaaaagaugacauuaaaauauagacagugaaaaugauuuuccaacaccugccaaagucagaauuuggagucauuauuuugcauacagggguuaauggggacauauuaaauuauccagacagaaguggcucaggcccugaaacacaauuuggaagccacuacaacucaguaugauguuacuauuguuuacauaaaagaagcaacccauggcuuuggcugcauaagcucguagcauauuucugaaagggagguagccauuugcuaauggugguuucaagaaacacguuaacucucauuguaucauucaauaaacuuaaaucccaaguggguguuauuuaggccugagacuuaggcagauguuaaaguauaaugauuugcaaaaccaaauguucuuccacagacaaaacaccagcauauuucacaaacaaaacacuaccugcccuugagccgccaggcuguugagcucaggugcgcuccugacaggcgacauguaggacuuuguugcaugaaguccucucagaagggcuaccaucugucuuccuucccuccuuuugcagacacggacguuuuaaacguucuaacagcgucacggccgccguccaagcugaccuggagcuggagggguucccaggccacaucaccacggaggacaaaggccuucaguucggcucauccuuccagcggcacuccgagcccagcacccccacccaguacagcgcggugagaacuguacggacccaggggcucuucagcuauagagaagacuaucggacccaaguggacaccuccacccugcccccuccagaccccuggcuggagcccgccaucgacacgguagagacugggaggaugucuccgugccgcagggauggcucgugguuuuugaagcugcugcacgcagagacaaagaggauggaaggcuggugcaaagagauggagagagaggcggaggagaacgaccucucggaggaaaguaagagcucaggcuucccuagggccucuuaaauaucauuucucaguaaugcaaauaugcacaucacagcauuaguggagaaaaguuccucccuuugguauucaagugaagggaaauaaaugugcuuucuaguauaucccccucaauucuaagaaaagauauaaauuacaugaaaagagaagcagucacuacgauaucgaaggaaaauuguguguguuuugucagguaaguugaauagaaaaucaacugugcuaacaguuuucuugggagcauaguugaucucauauuccacuuagcaguucucuugaauuuuggcaaaaacuuaauuugcagcauuuauguuauuuucuagaauuguuaccagcucaugcuuuacaagaaaaugccuuggcauuaugccaaagagaagucgaugguaaguaaaagauuaaguuaguuaacugugugaugaugugcucaaaggucucacuccuggguggaaugggaaggccgugucauuccucuaccagagucaccaccaaaggucucacuccuggguggaaugggaaggccgugucauuccucuacgggagucaccaccaaaggucucacuccuggguggaaugggaaggccgugucauuccucuaccggagucaccaccaaaggucucacuccuggguggaaugggaaggccgugucauuccucuacgggagucaccaccaaaggucucacuccuggguggaaugggaaggccgugucauuccucuacgggagucaccaccaaaggucucacuccuggguggaaugggaaggccgugucauuccucuacgggagucaccaccaaaggucucacuccuggguggaaugagaaggccgugucauuccucuaccagagucaccaccaaaggucucacuccuggguggaaugggagggccgugucauucuucuaccagugucaccagggcagaucugucccagucccguugguacucaccuaugccucugcuucuccacauggaaggggacagccccuuauucuccgccuuucucccaucugccuagagaaaccuaccaucaagaccguucaggccaggcacgguggcucacgccuguaauuccagcacuuuaggaggcugaggcggguggauggccugaggucaggaguuacagaucagccuggccaacaugguaaagccccauaucugccaaaaauucaaaugagccaggcgugguggcggguaccuguaauccuagcuauuugggaggcugaggcaggaaaaucacuugaaccugggaggcagagguugcagugagucaagaucgugccauugcacuccagccugggcaacagaaugagacucugucucaaaaaaaaaaaaaaaaaaaaaaaagagcucagaagcagcacccauuauaaauugcuguauuugauugacuucuaagcuaauaccaccugucuuuguuuauagaccaauuacauaauugcacaauaccuacaacuaaugcuuauguuuaacacaguacaauuucacaaagcuauuucugaaugucuugacaaauuacggucuaaguauuuuucuuuuucugugaauuuauuuguacauugacaagaucauuauaaaugcugaacuucaaaaggauagcugagauccuugggaauuugucccugacauuucauuucuagauggcuguuuuaauagggcauucacuaauccuagaaauagaagugcaacaaugaaacuacauugacuaugacuuacagagaauaacggccuuggagccucggcagucugagaaaaucaauggcgugcugauuuuuuauuguuaaaacuuaaggucugaaccuaugaagaaagaaagacauugccuuuaauugacuaagccuguucuuccacauuugucucuuaaucaucaaaucccaccuauucuuuacaggaggugacgauggacgccgaauguuggggagaugcugccuuccacgugacccacaguccccgcagcacggcugcauggggcuggugcaagucagcacagccguguuccgaucguucacacggcguuugcauuucucaugguuaggguacauuuaacagaguaacuucacaauuuugauaucuaaaaaucacucauuuucugcagcaucuuccacccuuguuaguauaugccucaacuuggccaaauugucuuaauuauaaaagggauuuauaaucuuuagcacaaagauaaaacacagaaaaacugcauugccuaaguugacgccaaauuaaauugccagcucugguuuugugcaugcugacaggggcagcguagggcuggggugccuuccuuccaggaugagagcaggugaugagaccugcaugucacucaaucaagcuguguuuucuacaccauguguuuccucaaaagaacaccuuugaggaggaggagagaggaaaaaauuuaggagagaggaaaaaauuuacaaagaggucauguuuguuugucagggcuuagcccauaaaaugccuauaaaauuguauccuauuaucauuugaguuuaucccauucgggacacauucagaaaguuguagucuucuuuggaagguguaagacauugagacauuagccauuacuguguugauaacacagagacuacuucuccugucaucauuuuccauguuuagugcauacuuucaauuucauuuuuucaaggauuaucauuuuugaaaagauaucuuuuaaaaaaaaauagaauccucagcugggcacaguggcucacaccuguaaucccagcacuuugugaggcugaggcgggaggacugcuugugcccaggaguuuuagaccagccuggacaacacagugagaccuugucucuaccaaaaaaaauaauaauaauaauaauuaacauuuuaaaaaguagcccggugugguggcacaugccuguagucucagcuucucaggaggcuaaggugggaggauugccugagccccagagguggaggcugcagugagccgagaucucaccaucacugcagaacaagacccugucucaaaaaagaaagaaagaaagaauaucuagaccaguucucccugaacacauaugauaugucaggcccugugccgaaugcacugcagaccucauuaaugcucaucccaauggacuaggugaguaguauuguaagcauucuacagauaaacuggggcucugagagauuaagaucuugccccaaaucacagaauaguagcggugacccgggacugggagucacggcccucugacguugaaggcucugccuucccagcagugaucugggacugggagucacggcccucugacguugaacgcucugccuucccagcagugaucugggacugggagucacggcccucugacauugaaggcucugccuuuccacccacgguccaaaggcaucaagucaagaaguucccuuaugggaagcacccccuccacugccugcuuccaugcuggaugugcaucccauccuuucaccugcuguuucagacaagggugugucccaucccugacccuucaccucauucugguccuccacgacugugacccacgugugguccacagagucccucagcugcgaagacagaggccaagguucucccgcguuagccauuggaaaauaaguggcaggagcuguaaggaggcaaauuauuucucaaaccaagaaugaaagucccuacaaagggcuuuagugcugaggcccugucaugguaaguccugguuuucugucacuggaggcauuccagaauauucuauaaauuaugccauaaaaauacuacauacaaaauugaauuugaugacguauagggacccaaaucaacaguaagauuccaaaaucuuaggauauauaguauuuuuuuuuuuuugagagggagucuugcucuuucucccaggcuggagugcaauggcacgaucucagcucacugcaaccucagccucccgaguucaagugauucuccugccucagccucccaaguagcugggacuacagacacgcaccacagcaccuggcuaauuuuguauuuuuaguagagauggaguuucaccauguuggccaggauaaucgugaacuccuggccucaagugaucugccccccuugcccuugcaaagugcuaggauuacagguaugaaccaccaugcccagccaggauaucuaguauuucagugucacuuaccuuauuauuaggcaucugaaaaacuauuuuucuucaguaagguaggguggaaaauuaauuuuugcugacuccaaauuauauuccccuaaacauauguuugguuucguggugggauuuuuguuuuguuuugucuuguuuuuuaccuuuuuugagccaucaggauccuccucuggacucucucagugaugucuacauuccauagauauuuauugauuacuuacgacgaagcaagccacucuccgauagacaaaaaugaugcaacaaugaguaagacaugguaaaggaccuaacugauuaccuaacagugggagaagaccagguacaggaaguggaaacuguugagugucauaagagaaguacagauaaaguacuuaaaaacucagaggucucagcaaugcuuucaccugggaagauucucagaaggcuuccuggagaagguggcacugugcugggccuugacacgcgguuggauuuggucaaggugguggaugguggugacugaaaaggagauucaagaguccacgcagaggcagagaacuggggaacagaggccccuuugucuccuuccucuggaggaagaucuucaugucagcacugcccuucauccugccuguggggagggucugugcuaccugaccucacagagccuucuguggccggggcauuccccauacccugggggaugauggaacuugccuaaagcuccgcaccucugcugucauuugagauuuuaggcuccuucaaugaaguggccacauuugacauuuaucauccacagacagugccucacacaucgccuggcacagagugccagacaauaggaauggggaggaagagagggaagcaggaggaugggcugucuuagcgaacaggaugccacacuccugcucacaccuuuauaaaagcagaacaucuagacucccagagaaucaccucgccauccucaguuauggaggcugggaguagcuucaacacuucccauucuauagacauccacugaaaugauccugauuuuccuugucuuugcuccacuauauauauauauauauauauauguguguguguguguguguguguguguguguguguguguguauacacauauauguguauauauauauguguguauauauguguauauauauauguguguauauauauauauauauauauauauauauauauacuuuuuuuuuuaagacgaagucucacucugacaccaaggcuggagcgcaguggcgcgaucucagcucacugcaaccucugccucccaaguucaagcaaugcuccugcuucagccuccugaguagcugggauuacagcugaaugccccuacacccggcuaauuuuuaaucagaaaauguaacugcauugcuauaaacuuugaacacaaggaacagagaauggaugaacuugauacuuuuugugauuuucuuaauuucuuaaauugcccagauaccuucaucuuuuuguggacagaugucaaaacacuuguuaugccccucaucuguguguuuuguccauaaaacuagcacaauauucaucaaguucagauauuucccuaaauguuuaaaagguaagaugauaaccuuaauuuccaguccuaauuuuaggagcagauacaggguuauugguuaugguacuuuuuaaaauaaagauuaaauuaaaugucuuaugagacuaaaacucugaucucugaauauugaaauuuccauuauaugaaguaauuuuugcccaaaauauaauuucauaacacaguuccccgaacugauugaaugaaucuagauucagucagucuucuaugguuaauaaaaucuauagugaacccaaagaaaugcuggucugcauaaagucacauuaaugcaggcugccuauuguuaauaaaaguacuuucaagauauuaaaucauuaguaauguuuuaagauuuuuguauuaugucaaaccaaauggguaaauacauaaaggaaaaaucaaaaaugugcauauuuucuaaaacaaaagaaauccuucccaagcuaagacuuuauugaauaauuccauugagaugcaacucucaucaagaacucaccaagggagcacauguacacacaggaucuuucaaacgguaucggaaacuuccuugccccaaaugacuccucccgaaguaacgaauaaccuacauguucaccgggucagaugcacauucaaggcaaacacuaaugcugggaggaacauagggauuugcucacuaaguucuccuuuuacagccagaaugaccacaaguccuauuaacacaagagccggggucagaugugugacuuuguaucuccugggccaucuuccaugcugagacaaaauggucuggauggggagaagcaccccggcaguuggcacucacacagcggucagcagcugacaaagagcccagagagacucugagaaugagcagaacacaugcuccaugcagggcacgaggaugacauggccacagagaacugugccuguguccaugguuggcccaggugguaucagaccaacagagaagauugaggaaucagaaauacugaugacguucugagcacagcagaugccugugcacauauuggcagcuaccagccuuaggggucaauguaucacacagcuuaauggaacguccacugcuuccagaccuccugggagaugcaggucauagacuguguccauuuuguggaucagacuaagagaaucaacccacugaccaggccucugcuaagcaccuaugaagauguugccauacaacccaacuaaauggucauggggaaaucagacaauaaaaagacauggaugcuugucagcacaggaaaaggaaacagcagagugaaaagacaacucacagaaugggagaaaaugucugcaaacugcccaucugacaagggacuaagaaccagaauauacaaggagcucaaauaacagaaaaaaaaaaaaauucaaaaaugggcaaaagaccugaauaggcauuucucaaaagaagacauacaacgggccaacagguaugugacaaaagauucaccaccacuaaccaucaggaaaaugcaaaucaaaaccacgaugagaugucaccucaucccagcuagaauggcuauuaucacaaagacaaaaaaacagcaaaugcugucacaggugcggaguaaggggaaagcuugcacacugcugguuggaauaugaaguagccacuauggaaagcaguauagagauuucucaaaaacuagaaauagaaccaccaugugauccagucauuguccugcugggcauagacccaaacaaaaggaaauucauaugucaaagggauuucugcacccacauguuuauugcagcauuauucauguuagccaagauauggaagagaccuagguucccaucaguagaaaaauggauaaagaaaaugugguaagaaaguaaugugugugaauaauauucacaguggaauauuauucagccauaaaaaaaggaauuaagucuugucauuuggagcaacauggauggaauuggagguuauuauguuaagugagauaagccaggcacagaaagauaaacacugcguaaucucacucugauguagagcucaggcgggcgcaguggcucaugccuguaaucccagcacuuugggaggauaaggcaggcagaucaccugaggucaggaguuugagaccagccuggccaacauggugaaacccugucucaacuaaaaauacaaaaguuagccaggcaugguggcgcacgccuguaaucccaaucccagcuacucaggaggcugagacaggagaaucgcuugaaccugggaggcagagguugcagugaaccaagaucacgccacugcacuccagccugggcaacaagagggagaccccauccaaaaaaaaaaagcagagcucaugaagguggagaguagauuggugguuaccggaacaggagagaggaggaagagaaguugauucauacuaauggguacaaaaauacaguuagguggaagaaauaaguucuaguauacaauaguacaguaagaaaacaugguuaauaauguaucauguauuucaaacuagcuagaagaauuguaauguucccaacacacacacauaaauguuugaggugaugcacgucccagucauccugauuugaucuuagcacacuguagacaucuguucaaauaucauaugugcccccaauaauauguacaacugugauaaauccauuaaaaacacacagaaacgugcucaaaaacaugaaaaucaugaggcucgagaucuugaaaggagauuucugggagccauagcuuaggcagaccccacuacaaaauuaguuacaagggaaucucaggggaucacagggguuacaaauacucaaaugaucauuuccgacucucugcaaauuuuauaaaaauccaucucaaauauuagaacaccagaauagugugaauuauguuacuucauaccaaauuuagauagaauuggaauuauagaaaaaauaaaagagccaaguguguuaaucaaauuucuuuguacauggaaggcaaggguucuagcagguucuuugugaauuugcauucugaugagaauuaguccuuaguauagcuccugcaagugucuaaacuauggcaaaauuagagacauauacugggagagaauaaauugaauuuucacuucaacuucuuugcaauuauaggaagcuacuuacauuauaggcaucagauaggaucauucucacucacugaacagcaaaauucuccuaccauuagcaggcaugucauuagcuacacuuuuugacauucauuaucucucccuagcaauauucaauuuauucccuuuauaauaacucuccacuacauuaaaucgauaccaagauuuugcccauguguucauguuguguuaaagaguauaaauugaaguacuuuguauuaacaguucaguugaauuccauuuuaaggggaaugugaaaauugggaauuaaacuucaaauuuuaagaaacugauugacuuuuaaauuacaguuugaggaagcauagaguuggcaaaauaaauucauuuauucauccacuucuauauauuucugcagcaacgacuuacuuaaaauagucccuuuaaauaucuucauuaauuacccagguuuuagaauacaaaagaaauagaaauucaacauuucaaaagcaaagaugauuccuccccucgucaucagcgaguccagggcugcagaacacguucauuuugggggcaguggaaugcacaggaaggaugaggagcuuucacugucaccccugucaagaaaccacucaaaccccaccgccuccagcugcuucucgaccgacugcagcggccccuccacuccccucacccccagacucaccccaacucagagcccugccagcuccaucccgugccauguggccaggggcuccuggcuuccuucuccaguccuccccucccuucucuguucccaggcuggcugguaaaucagauccaaggaagagcagccugucuugaaguggauuugugaacggcacaaggccccgguguuaagaugcccgacagacaaccuuccauccuucuuuucaagacagaaacaaugccaaaguguuauccgaguuacuugcuuuuauuaaaaguuaugcuuuuuucaucuuuuucauacccuagaagcaauggagaauuaggugauauucaggaacuauugucaccuucgugggggugacaguggcccugggucuacaagguggucgcagguaaaggccucaggaagagagaacacaggacaacacuuacugccgucuccacggaauggggagggagcuguggguuauacucuucuuucccauuuucugcaugugugaaagguuucauaauaaaacuuuggggagcaaaacaaucuucauuuuagaaaaauaagacaagacagaaaaauagguuuuuaaguccauuauccuacccaggagaaaaucacuuugaagaacacaugguacagauugccagaccuucauguucuaaaaaaugagggaggcaccgcacacacugcuguguaguugacuucugggucacggcgugccauaagcccuuucaaaucaagguuaucucugcaacgucauuuucaacuggcucauagcauuuuauuacaugaacauuaagacccuuugugcccaugaaaugcgguucuuuuucccgaaagucgggcuaaggaggagacacugcagcacccuggcuugggcagcaggaugccaguuucuggaucgugugcaaugaaucucaccaguaacugucucuaggacugacuguuaaggaauguuugggggaagagcuguuguggaagaaccuacacgaggauuggguucacuucccuggaccucgguuucgacuucuggaaaggcugucuaggcuuccacagucaggugugcccugggagccagcaggggcaucuccuaaacguagaaagaaacggacuuucuggcccgacccggaccccgugagucaggccaugcccggcacaagauccccaggugaggcacaggugggucugcaaggccccuugagcuccaagcaccugcaugugucuaggcaaaaccuccagcacaucgguauucccuugugaaguacguaaagccacagauuaaguggggauggaucucucgccucugcguucaagggggcaaaucuccaggauaaaugcccccuuuuccuacaccauuuuccaccagccuuggagagucagcuucccauggcuuccuuccaacggaagcaggagaaagggcugggcuaguuaaaccgcagcacuuucaguuuuagggugugucguguagguuagugauuugugcucugcagagacucuccagggagagcaaaaagagcagguggaaucaucagcuuggccagaagacgcagaugacgccccgugagccagcucaggaaagacggccccaccuugaagggcccacgcugaaagccagugauggggagacguggugugaacugagaggugaugagaugcguagaucaucugcccccugccuggugggcagcccuggccccacgugcugacccaggcacagaaaagccacauacguguacugggcacgcucuauggaagaacggugaauuguugcucuggcaaauaauauccagcagagaucagugggcccagggugcacugguaagaaauggguuccagucgauuccugugugguuuugaggaucauggugagcuaggaucuaccaaagcagcuguuuacaaaguggugaccaugcugacagcagacucaagagaggguguggggccgggugcgguggcucacgccuguaauccuuggccuugggaggccaaggcgggcugaucaccggaggucaggaguucgagaccagccuggccaacauggugaaacgcugucucuacuaaaaauacaaaaauuagccaggcaugguggcaugcaccuguaaucccagcuacucgggaggcugaggcaggagaaucacuugaauucaggagguggaggcugcagugagccaagaugacgccacugcaguccagccuaggugacagagcgagacuccaucucaagaaaauaaauaaauaaaacaaaauaaacacacacacauacaguauauucuuuuaaaaaacuuuacagccaggcacgguggcucacgccuguaaucccagcuuuuugggaggcugagauggguggaucaccugaggucgggaguucgagaccagccugaccaacauggaaaaaccccaucuauacuaaaaauacaaaauuagccaggcaugguggcaugcaccuguaaucccagcuacuugggaggcugaggccagaaaauugcuugaaccugggagguggagguugcagugagccaggauugcgccacuccacuccagccugggcgauaaagggagacccuaucucaaaaaaaaaaaaaaaaaaaaaaaaaauuaguauuugauuaaccaaauaaagucauugcaauuaggaaccauuuguagauuaauucuuccuacugaacuguggccugcugacucauagcacacucagaaauguagcguuagcauuacacauauacuggguacauggauuggugaguuuaguagcugugagcauauucaguaacuugugacccuuuuaccaucuccaggagggaagccacaucuuccuacgugcuacgaccuuccugugaggccucuguccacgcagccucuuccuacguaacacacaccucacagcacugccaggagauaacugcccacaguucauuagaaauuauuuaauugaauccaaugagagaacccauauggauguguuuuuucuaaaaaugaaggaauucacaucuaaaagaguucacuaacauguuagaguccauaaaaauaggaagaacucgauguugcuuucacucacacguguucuugugucuuccagcucauccaaacagcagcacugaaauaaucucgaugccaaaauaaggaaaacucccugagguauaggccgccuuucuaaacuaaguuucucccaguacccaaggagaauguccucacagugacaucuggucaucucuggauuuccuucaugaguuggggacgagcacacuaaggcacgagucaccagcgaacacgcucggcacgaugaagucgucaguuuucaucuccagugggacucgcucccuuggugugauguuucugcuuuuguguaauugacccaguuuugaaguuguuguuuuuuuguuuuuguuuuuguuuuaaacaguucucgguaaaaucaggagugcuguugggagugcccagcuucucaugucccagaaauuccagcaguuuuauuggcuuugccaacagaauaugguaagugaauccucagugaaccccuguucccuguaaccaagcuaaugggcaucauuccacagauucucauuguuuucuuccuugucaaagaguucccaucgguaugcggaauaucacgugcacuuacuacagaagaggcuucccgcccuggggaaagagacgauucggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggaggcggauacggcccugguuuaaacgcgguaccgaggcagggagguggauauggcccugguuuaagcaguaccgaggcagggaggcugcaagggggaguggaggacaggaagaggcgggcugcagcagcgcggcgugacacugugucuuugcaacuggaugccccaccagagcaucuuagaagaggagaaacaagggaaauuucuauuacgucuaaugucacaaaugaagaaaaugaucuaaggugccuggaaauaaaaauacauaaacaacuacaaugaagagauuaagaagagauuuugcaaauaauuuagccuuuguauuuuauagucgguagugaaacgaauauaccaugaacuagaugauuaauacaguugacguuaaacuugguuauuccugacaagcaaacaaaaagaaaaaccacauauauauuuacauauacuuacauauauacauguuaauauauacuuacauaugcuuauauauaaauauauauacacauauuaauauauaaauauauauuugcuauuucuggcagagcagaaaagcucauauauacaucucauauauauuagauguauacaagauuauaaucauaugcaucuauauguuuauauauacaccuauauauaaacauauauagguguauuuauauauaaacauauauauuaacauguauaugaaauuuuacuuauguauccuuauauauacaugcuaaacauuaacauauaacaaauauauaacauuaacuacauauuuuauauauacaaauauauaguauauauaaaauauauaguauguguguaggcaaauauacaguauauauaaaacauguaaguuuacaugguaauauauuuuauauauacauuugccuacacacaugcauacauauacauucuauauauacuguauaucuaaguuuacauauacauguuaauauauuuuauauauacuauauauuugccuacacacauacauguauacuuuuccuuggcugacuaaaguauucacuauuuugagaaauaguaaauaauaguuaugcuacuuaauaaguuguuuuauaauacauacaucgauuucuuuucagaccaaacauuuucagucaaaugcaaauaggucuucucuaggccucgcguagcaauggugccagguguuuugaugauguuuuccuuggcuuuuucacgugcaaggagacauaagaauauucuuacacaucaaaggaugcacaagcaagccagaguugccaucucaugucuuuuccuuaggaucauuaaaaaguaugccuucucuaauacuuuccaaucaaccccacugaaguucacggcgauuuuaaagagucaccaacacaucacucugacaaaguuauaaucaucauuuaaaagagggaaauagaaagguuuugagugccucgaaagaagccuguaacuguguaaacauucagcugccaugucaccugugaacguucuugccuccuccauaguaucuauuugauuauuaccuuuaaaggaauugauucgggccacugacgaacucuguguaacauuaugcagacucgggugagccuaggcaggcacugucuuuaggaaugcucauccaaagcuucccacacacagcccaaggugcauauucagaccugcuaaauguuccuuucugcucugccagaaauagcuaauauuuggcuuaaaauuguucauccuaauauuuguuaugccuuuugaguuuuaaaauagcuggcuuggcuacauccuuuucuuucaacuucuauucaggauuaguagaaaaacacuuugacacguuuggggcggaagagugguacagggagggguggugccugagacaggccuggcaggagaggaguguugacuuguuaagagaugcuucgcucaucaaagccaaaugguccgcagcgcaaaguagcaccgcugucugcuggaaguuguugguagguaacuaagcuuuaagucaaagagcgacccuagaaaaugucagaaccccagcccgagauugaggacugaccacagggagcggagccuuucgggacggaccgcggggggcagagccucucagggucgggaugugcagguggcuugugacacaaccagaaggcacauaauaccggaaauaacuuaaccucaaagcguguggccugauugcugugcuugugggaccagcaguuugguguccccagaaacuuagucucauucacacccacugagccugccucugaauuuuaacuccauccaaccccggggggugugugccugagcaggugccggcgcacagagagcugccccaggccacacggggcaccgaaguuccuauccaauggacgccggaugccagagccacagagcugugugaauuuaaaagacggcaauuucacaaggaaagaggcccugcaugaguuugcugggggaaagggaauggcauggcacaaccauugacuuuuuuuuuuuauuauaaacaccuuaucaucucugaauguucaguggauucagaugcaaccaccuccccaaccaaaagagaacagaagacaaaaccaaacccugaccaugccaggcugugcccguccggccccagcauguggucugggugagcccaaaggacggguguguuguugccgaggagaggaggggggcacgggaaggcgaugccugcucucaggcagccucugccacaguggccggccauguuccuccuucaucccccaggagaugugaccaggaccacccagcugcgggcgagggaggagaagccacuccgcuucccccacaccaucaggcacagccgugcccggcccuacagaaagaggggcacagccaugaccggcccuacagaaacagggggcacagccaugcccggcccuacagaaagagggggcacagucaugcccggcccuacagaaagggggcacagccaugcccggcccuacagaaagagggggcacagccaugcccggcccuacagaaagagggggcacagccuuacccggcccuacagaaagagggggcacagccauguccggcccuacagaaagagggggcacagccaugccuggcacuacagaaagagggggcacagccaugcccggcccuacagaaagggggcacagccaugcccggcccuacagaaagagagggcacagccaugcccggcccuacagaaagagggggcacagccuugcccggcccuacagaaagagggggcacagccaugcccggcacuacagaaagaggggcacagcugugcccagcccuacagaaagaggggauguucuuagguuggcgaagacuucuggaagccagguaggaaccaccccuacagccucugagcagccuccccugcugcuugucaccuggccuggccugcccugaggcugcagcuccuggcaucccucgacugacuucggugcagaacguggccuccuugccaggcacuuuaguuauccccacccacagaggcugaguucgggcucccagccgcuggccagggccgcccuccuggggagcuccucaagugccugggggggcuuugaguggccaaggcugcccucguguggcugcagagaagaaugggcucagccgcgcggagggcagcugggggccccagguccuggcucugggugaggaaucgcagagcuguccguucagcaugcucuucacugagcaugcugagugugcacugcugaaaccauaagcaaauccaguugaauguugacccaccagaaccuccucugacucuuuuaaauccccacugaaucaagggagccacaccuggaaaaaucauucagauuucaauguagggagcaagccgggcacgguggcucacccuguaaucccagcacuuugggaagcugaggcaagaggguugcuugagcccaggaguuugaggccacccugggcaacacagccagaccccauugcuacaaaauuaaagaaauuagcuggguguagugaccuaugccuguggucccagcuacuugggaggcugagcaggcaggaucccuucagcccaggagguagaggcugcagugagccaugaucacaccugugcuccagccugggcgacagagaaagacccugucucaaaaauaacauacauaaauguaggcagcugguggaaaucauguaucugucaggcacugggcagagaaaccaagcacgucucugggccacucggcccagggcugcagcccagcagcgucaccugugccuccuaagugugggcgccgguuggugagagcauccuguuccuuggcgcauuacauuuguaaggugucaucaccguaagaacgagagcuaagagccgucagagaacaagcagguauagaaugggcuccaagcugguuccccacugccaccaccaggccaauaccacggcaggcucacggagcccugucccuuccgaaucauccacaggugaccaaaaacacaggcuccuacugcuuuuaugagcugugaagcauuuagaaacucucccaucugccccauucccagcauuuucaacguggaacaaugaacagcugugcuacguguuuuuaggccgacagcaaauacgugugcuaaaguaaacugucauggaagcauggccuucccaaguaucugccucaggcuggaauuagccaggcuucucccuaauccgccucuugaaaggcaugcguggggaggaguggccuccccagcccugugcccgcaggagacucuccuggcucugaacacccuguguguguccccaggaccccagcgccaugccgaggccgacgucgcaggaccuggccggcuacugggacaugcugcagcucuccauugaggacgucagcaugaaguucgacgagcugcagcggcugcggcucaacgacuggaagaugauggaguccccggaaagaaagguaagggcauccaugcagggccggcucccagcaaacccccuuucucacugcacuaacgaccugcugcagauagagcaugacaacgggguucucagucuuuugcuggcaacacacgagcaaauuucccucuauguaugugugcacauguguauacgcacaugugugugcgugugugugcaugugccgaaaauggggcagaauugaagccuugggcaugggugguaaauaauagggucuccccugcucugucucuucuauauaagccuuucagagagacacuagccaagaucacaagcaaaccugcagccucauuccugacaggggucucaccuaugaauuaucuuuaucaaacuuguucucauuguguaaauauuaagcuggcuucccacagggaaaguuuuaggccugguuauggacuaucuccuauucaauauaccuucuaguauggccacuauaggcaaggcgacauuuuauaccuuauugaaccguuugaugaauuaaucuuccuguagauccaucagccucaacccuuaaaauaggcugaaauuugccauuaaaucugaacccuggcauuucacuucuuccgugaugcugucaucagaagaacuaguagauaguucugaguuagcagcaaagacauagauuuccucacacguuuuaaagacguccugaggaaccauaaauggauuuuucuagacaaauguuauuaauuaaaaugauaaagaaaaucaagucagcauccuuuggggaagugguguuugguauccagcaaggaugcacaccugggucaugagaacgagagccagaucuaguggucaucaucaucggcuccucccagaaggugcccuggccacuaguggaguuccaggccagaugcaauggauccacagguucccucucaucccagacgacaggggagugaggugggagugcacaggguccacguaagccaugcgugggacagguccacauaagccaugcaugggacuaggcagguccacuuaaaccaugugugggacagguccauguaagccaugugugggacuaggcagguccacguaagccaugcaugggacagguccacguaagccaugcgugggacuaggcagguccaaguaagccaugcaugggaguaggcugguccacguaagccaugcaugggacagguccacguaagccaugcgugggacuaggcagguccacguaagccacacaugggacagguccauguaagccaugcaugggacuagacagguccaaguaagccaugcaugggacuagacagguccaaguaagccaugcuugggacagguccauguaagcccugcaugggacuagacagguccaaguaagccaugcgugggacaggucaguguaagccaugcaugggacuaggcagguccacauaagccaugcaugggacagguccacauaagccaugugugggacuagacaaguccaaguaagccauguuugggacaggucuguguaagccaugcaugggacuaggcagguccacauaagccaugcaggggacagguccauguaagccaugugugggacuaggcaggucugcguaagccaugcaugggacuagacaggucccaguaagccaugcaugggacuaggcaggucugcauaagccaugcaugggacagguccauguaagccaugcaugggacuaggcagguccacauaacccaugugugggacuagacagguccguguaagccacgguuuggaucugaggugaaggagaugaucagugaugcuccugagggagaaggcuguucaaacggaacguacugaaguuagcccaggugcacacgaugguuccgucuagucuccauucuuuggucauugagagcaaacgugagcccaucuacccaagcugcgcauagaguaugauucucaaaauggaaacgucuuugggaggccaagguggguggaucacgaggucaggauaucaagaccauccuggcuaacacggugaaaccccaucucuacuaaaaauacacaaaauuagccgggcacaguggaucacgccuguaaucccagcacuucgggaggccuaggcagguggaucaugaggucaggagaucaagaucauacuggcuaacacggugaaacccugucucuauuaaaaauacaaaaaaaaaaaaaaauuagccaggcgugguggugggcgccuguagucccagcuacucaggaggcugaggcaggagaauggagugaacccggaaggcagagcuuguagugagccaagaucgugccacugcacugcagccuaggcaacagagugagacucugucucaaaaaaaaaaagaaagaaaauggaaaugguuucucgcugagggcagagcacgccaguccagaaagcgagcagaucuccagcacagcagaggcuccgugccugaacaggaggcccugccccuccugaacacggcgucuuaaaaauucccugggaugggcccugcacagcaucugcuggacacuccuacagugccacacccacaggccuggaagcuccuuugauuggggaacccccacaggaaauacugauguguacaucucacaggcucacaguucaggggacaccaaaagaggaaacagauccucuucucuccuuuucucuuggcauccccugaacuaugaggacaguuaugugcugaaaaaaggaauuacuuguuaaaguagcugaagguuucaaugaacugaucccccccauuguuuuagauggaugccaagaagucagguaagagucauugcuucuggccuagucacguaaaacaagccgagggaacaaaguuccagacaccaaagcaggcuucuugccacaggccuccuccguacucacacaacugccugucuucccccaaucuacaagcaccucugggcucccuuuggaauuuuucagaggcugaagagaaaaagacaugaguggaguuuuccuguuuuucucccccaaaacuagauaucugcuuaggaaagugguucugacgccuucugccgugugcccuuuccugggaaggaaacagcuggcuacggagagucccugucauggcucuguccagaaggggagacggggcaggucccacugucuuuaggaacaaugugaaucacggggcaggucccacugucuuuaggaacaaugugaaucgcagaguuagggacacagaccuuuugugggaacaagugcaagcauuacccuuugcauguguugcauaauugugagauuuaucuaaaacggcauacacguauuuuagcgugacuuaucugagagucugagcuaagggugagaaauacuugcgucuuuuuacaaagcaggcaagugaauagugguuuuauaaauaucguccacgucaaugggauuuuaggccaauuagcgaaucgggccaguguuuccccgcacacccauucacguaagaugguuuucaugaacauacuggaaucccagagucugcagaaaacccugcaguguugaauagggauguccagcgaugguguccaaaacccucgcgaugcucggagaugacacagggcuuugggaagcgcaggaaucgggcgacaaugucagacuagcgcagugacugcagagacgcaaggugcgaaucugcagaauuucuuuccugauuuguccacgcugccccugacgccucugcccccuuuggagagugcgagggagcuuccacaaaucccauccugugcagaaggcaggccuguggccugggagccggggaccagggcagacgggggacgggagugaaggaugcggcccugggggcugcggucgggaagggucaggccaggccccagggccgcugagcucgcgagcugcugggacccuccuccgagcaccugccaacggugacuugcgcugcuuuucaggaagaaagaaaggucccgccuccaauaccaaagaagccucccaaggggaaguuucccaucacaagagaaaaaucccuggaccugcccgacagacaacgccaggaagcccggaggcgccucauggccgccaagcgagcggcguccuuccggcagaauuccgccuccgagcgcgcggacagcaucgagaucuacauccccgaggcccagacccggcucugagggcggaggccggcgccuuccccucgucgcuuccgcuuucccggacgcuugugcagcgcggcgccgcccuggugguuucugucuccuccucccgcugaacacguccucgcucccgcgcuccccgcgccccggacacagcgggacgcggccggcggccucagaguccacggagcucgcggcgaggacgacuucugcuuuuguuguuguuguuguuguucacggguggccuggcucacacuuggcucugagggacagguguggcgagaccugauuucuccugcguguucucagaggacggcgagaaaugccucuggagcuggaacccagcuuacauuuuguuauuucuauuuuuauaaauugugugauaauuagagguaagaauaacaaguaacuauaaacgggugcaucccaccacucccuggaggcauuagacacccaaguggaaggugcuacaaccugaagcgcaggaaagaaaggcccauuccccucgcacagccgagcuuuuacucccugagcacgggccgcuccgcuccccugcuccugucugucucggacagaaaacacgaggcuccuugugucaagcuuccugugauggaaagcgaccucuccaaccaccacacuccccgccguacaguucuccagaaucccaggcgaugacaagucugaacccacgaaaauacccagcgcagcaucuacacauucaaaagauaagcugaguguucccaccaggaagucacgcgcagagaggagagucuuacggagggcugggagcuuaaaaggaaaacaauguccuuacuuguaaacaguuauuguauuuuuuauuucuuucuaacuuaaaauacgacacccaguauuuucuuuaaguuucaccauuuacgcuacaugugauuuuuuuaauguauguauauauauauauucucaaauugcucuaucagcugacuuuucaggguauccuuaaaaaaaaacacacacgaaaaacaaaaguuugcuuguuuaaaaugacaguugugauguaaaaaguuuaagaaauaugaaugugagugguaaguauaucucaguuuaaaugguaaagaagaaauguaguuuacauuuguauuuuuccagaauucuuuuguccuaugcaguauugcuaaagucgagaauauauuccuugccuguguuagacaugaagggaaaaagaggucacauauugugauuuccagcuguagcauucaaaaaaaaaauugguguucaugacucuguggucggugccagaggaaaauaggaacgacucuaauuaauaggcuuucuguguauauaauuaaauuuagcugcugcaaccauuguucugacacgacuucuguuucacaguucagaccggucuucaaaggaaaagccuguccgauuuuuccauggguuccaguuucagaguucucauuauuacucaaaguaaaagcggacugcgauuuaagauguuuccaccccaauaccuggucuuccuucccggcuuaaggaguaccauguacuuagccacaggcagaauagcuuucgaugaccccauagcacuuuguuucuucgccuugauuugcacuuuacaauguccccagccccucugcagcccguggcuggcagggcguucgaugugcgguuggcccccagcgcgcccuccagagcugcggugucucccugccucauuccccacaucccacugagcaugggaccauugggagcagagcugauauuaaagcauguuuagcuucgaaguuuuacuuuuuuaaagcugaguaguuaagaauucccuguaaaaacaaaacccuguaaauugagccucaugucugguauauauuuuaccaaacagccuuaaaauauauuuggaagcaaaaaucaguacgaauguaucuccuugaaaaaugcaaaaaaaaaaaaaucccugaaauauucuucuauaaaugaauccuauuuccccagaguguucaaggcauuuuucuaccuaaaugaauaccuaaaucuugaguaguguacgguaaugacgcuucuuccuauauccacucuuauuauguuaaaacaaauguauuugcgaguauuggcauuuuagacuuuaaaaaugcuguaugauuucagaugaacucugcuguuuagaaguaaccacagaaaagcaaagucaguguacacucugagugaaaggaaauguaauguggauaaaggcccgccaccuccucacauuggucuaucuacuggcagcugauacguuuaacucauuuccuugagcuuauacaaaacauagaaaagcaaacuguuaaaguagucaauaauuauuugucucagaucccagauucuaugaucccugcuuaaaagaaaauguucacugcauguagguugauuucuuauguuuuguagacucauuguuauuuuucaauccccaaaagucuuggccuaaaccaucccuaggggagcagauuaaccuaccacuacauugcacaggguuggugacucgacguggugaaugugcacacgcccugccugguccgccauguuccaaagaagaugauuuaaugguagaacggauaccugcugcuagaccugauggaauguuaccuguccguguuacauaaucaagugcaauauacucaguucucaugcaggugacauucuaccaugaaacgcagaagauaagccauguuucuguauuguacauguaaagaaaaauaaaacuguuuaugauacuuguguuagucacucgagcuagcuuauuucagccacuucuagcagaucaugccauggagcucacgacgugugaccauuucgucauauuuaaaauauaacuucaagaaaagaguaaacauccauuggagaacacggcugaaaauuauugugcuguucuaggaacaucauccuagagagugugauguucacuauaaccccauaccuacauucccuaaugauacagccaaugacaggugaaacccagacacucuccuuagagccgacagguugauccugcuguguugaaggcugugguuaauaaaacacaaguaugauaaacaggaccuagcguuuagcccgggaaaggagaaugcugcuugucaccuagagugcuuuccuugugaugcgucucucgcaucuucacguguuguuguguuugaaguaaaacuaguuguuaucgaugacaauuuuuaccauaguuuucucagcaaauuuauaucaccaucuuagaaugguauauaaaaaaauugaacuguuuaugauaccaaaaaaauuacaguuuuguuuaaaaggaaauguugauguuuucaacuccaaaucaauucuaaaaacuucaagcacuuaauggaaagguaaauggucagauaaaaauauaauuaccuguaagguuaucugguuuuaaaagaaaaaaaaaaagccuacaaacucagugaccuacuacgcagagggaauuuuucccugcugcuucuuaugaaaguggccagguuuauuauuagaagacacaguggcagagcacacaugugcacagguucugauuauuucucuuggagcauauguccuugucuugauuuuugccuuuucgaugccauauuaagcagccaccguuuccaccccuuucauuagaaggcccugcauccguaaauucgcgcaucucuguuuuuguuagauccuuguaagcaucgcuacccgaguccaggauggaauuucacaggaaagugaagggauacugcaggccuguguuugcagcgccugugguaacuguggaaugagcucuguuagggacaguugucugguuugugccaaaccuucgaggggcgaguagggagugggggagguggguccaagucucccucaggaaggccuuuucuaucggcagcaauuccaucaagccaagccuccugugguccugagcaugaaggggccaggggaccuccugggagaugcagcuuuuguuuccgcugcguuucaucagucagccuugcuuggaauucuggcagguuccccgggguguuucaguggacaggaggcccccgugccguggcugagucagccuggguaccccagucaccagcagggccacccuugaugacagggccccccacgaaccugggaaaggcagcgggaaaugugugagagggugugcgcugguacggacauaaaagcauuguccaaaacagcgcugguucggggagggccccuggauacugccuuuggcccacacugaaaacugaaauugccccaccugugagcacagaaacacgcuucuccaacacgggccgaaauaacuaaacuccacaugguuccugccugcucauuucccagcccucuucuucucaagccugaacuucauuuuuuuuuuuagcugcaaauuuaacaggcuaauuuaaaacugcaguuuucagacgacagccccugggaauguuccaggguucucuuguuuugaucugcaugucuguuuacacuucucuguaggcguggguugaauacaaguuuccaaaacuuuaaaauagaaaaccacgagcuuaagaggugaaaaagaugaccccuuucugauuaggaucuguaacucugugggcugggucaaugcagugugcuucauucagggccauguggcagccaugacacacaccacauaaggucagcucagagcccauggcuucccugcaggagccccaucuugucgcuauuaguugggaguugcaauacauuguuggccauaaacaaagugcuaaaggaaaggguuugcuucuacacauucggcugaaugucccccagugcaggguggcagcagaauguucuggaaaugaaggagauauugcuaggaaucucuaggcuguuaggcaaccuggcuuuuauucauccucagccggcaacucaucucaaguuuaugucucaguuuuuuuccucuagaaaggggauuacaguuccugucccugucuuccuccaggacacacugugaggauuaaugacauauuggcucuaaaguccuuugagcuccugggaacagguggugaaagugugcguuacugcuaaggauuagucccuggccucuucuagaaugccgcccucccagcucugcagggcacgcugccagaauccaggcuggucguaaacaucucagagauaaucagggaccaccagaggcagaggccaugagacugucuuuggaaagguuuggaaaugcagaaauaacuacaagggccauucuccuuagcuucuggcuuucaacuguuucuagaugcuuccaagaacaagaacccagcaccaaccagaauuaggccacguuuucaccauuacuuaagcucaaucgccucuuagaugaaaugaggagauaaacuaaacauuaaaaugaugaaggaaaaaaaauuauuuggaagccgaaaaccgcauggguggggaaacaucaggaacgaaaucagacacacugacucaaaccacgcaaggguuugagaagcccaccccucuaauuccaggcguuuguaauuuuucuacuucgcacuugagagaaggcagaggugguccgugggaaagcuccgggaaacagccgucuuucauccuugccacauugaaaaauguccacaauuuuaugaauugcuguccuaacccuggcguuuuuauccaguguuaaaauaaauuauuucaaguuucaauguaaacacuuaacagaugacuucuuugcagaagaaauguucguuaccuacuaucaaacuacuuuuuaacagauuuuguauauacacacacaaguugacagagguuuaccucccuacuuucuuagauuuuauguaacucuuuucauuggugcuuauucagaaccugaaagccuugggcauccaagcuuucaccuacucaauggaggagaggugauaaugaaugaaaagauugacaccagguuucuuggacaaauuuaaguucaaauuuaucucuuucaaguagaccauggucucccuagagaguguguuggcuugugucugccaguacgacaaaggacgcucccagcuugaucgugguaccuuauggaagccacucacgcauucucugauuuacccccaaaacacuaccaugccccagccccacucauuuaaauaauacaaucauaucacuuucaaagggcucagcacgaauguuccccucacuccacuuuuuaacucguuugcugaacucgacaaggcuuccccuuacgagcagugagaccuaggcuacuuucgaacgcuuccuuccgaacgguaagccacuucgcucucgggcaggacagguccucccugcagagagagacaacucaucccccgaccuuccauacuacagaccaaaauacccagguguggccuaaggacuauauuaaaugccuccuauagaaauucaaggaauguuagaaccaggaaacuagcuguuuaaaguuuuaaagaaguauauaaauauauauauaaauauaaauaugaaaucauaucgagugugaggaugagcagagugccaaauauucagcaucuguacaaagucauucacuggaauucaacuauuuuaugucauucucuuucucacgcuuuuaugguucuuuugauaaauucuauuuaguagcaugcaggauaccuaaucugaaugugcaauaugcuauucaucaccacgacaauuucuuacuuccucuuaauaacuuaccagaauguuggucauuccuuuaaggcaguuaaggauugcuuuauuuguguucuuuuuucccaugacuuuuuuucacucucagcugacuguaagaaacugugcaccguuuccgccauaaccguccugugacgaugccuccauuugacuucuguaucgcugauguucaccuccuguaaauaguuuggcaauuaaauuuuuugagaaaaguaauguuuacuuuuuuauuggagugaauucucguguuauuuuaaucucagaaaaauuauauagaccaaagaguuuuauccgaaaaaaaauuacacucuuccuccauuauauauuucauuguugaaauauccucaauuucucuauauuuuaagaaguaauggacauuuauuaagguuacagauuuaauauguaugcaaaaugguauagauuaaaugaguuuuuaauuaauaaauccuacaguauuuaguuaa

SEQ ID NO: 191843 - RNA, 40828 nt, Homo sapiens
gcaugcccagugcccgcgcgcgccgccaggcucgcaagcaccgcguaggccagcuggccggaucccgccgucugucauggcggcccccauccugaaaggugagguacuuccugcugccugcuccagcagcgggaguuugaggaccggcaccccucgucgcgggcgcacucgggggaucccgugggaggagccccgcucgccccucccucgcugccugucucccccagacccccugccgccuccuuccucccccgcugccugucccaccaaaacccccugcuccugcucucucccccgcugccuguccccccaaaacccccggcugccugcuucgucucccgugcucccuguccccccaaacccccgacugccugcuuccucccccguacugcuugugccccaacccccgugcugcuaguuccccucaaucccccgcugccugcucccucccccaugcugccugucccccaaaucccgccuuucccccuaccugcuuucaccccugcugccuuagucccuggaucuggggcucacuggcaggcagaguccugcccuccggaaguugguguggggcccuccugggucugguccuguucgacccccucugaggcccaccuggaggagcggcaguugaguuucuaugcuaauuguuccaauaauaggagccgccuuuuacugcggagucuuugugugccaggcgcugugcuuaggcuaguaugguauugucugauuuuuuuaaccgcucuaucaacucucuuauaucauuuuacaggcagaaacuaaggcaucggacguuuaggugacucucccuguguguggcuagucagugcugacagggccuuagaccggagcugcuguccuaaccaguauaugauaccgcacgcagucccacccucugugcaccuggaagagcccaggagaggggaauagcggacacgugucuuguagaguuugaccgugagaaaaaaggggccuguauuguggggccuggagucauaaaaccucauagccaaaaguaaagacuagaggcuuuauacaaagucuguaaucagauguggcuauuuuucuaauguuaguauuuuguuaaauuaaccugguuuucuuuuagcguuacccccaaucauugaccaacggcacaccuggaaaaugcuuuuaaacaucagguuuugagaagaggauauccacuagaacagggguccacucacuaugccccccaggccauaucuagccugcugccuguuuuuguaagggucuacgagcuaagaaugucuuuuacauuuuuaagugauuuuaaaaaaaggucaaaugaaaaauuauaucacauucacauuuccuucuccauaaauaaaguuuuauuggaacacaggccggcccguuaauauauuaccuaugguuauguuugugccacaaccgugaaguugaguaguuguggcaaauacuguauuggccacaaagccugaaauauuuaccaucugucucuuuacagaaaauagguuucugcacuggaaaaauuaagcguaagaauuuggggaaagcaacuaauuuuacaaauguaaacucucauguauuguauggguacaguuguucuuugcuuaaaauuuuaauaaauuccacugaagcuauuuugaaaaggcuuucaguagaaauuuauuuaugagacagagucuuacucucuugcccaggcuggagcgcagugaugugaucacauaauagcucaagcaauucugcuucagccuccugaguaacuugggacuacaggcacuaccacgcccgguuauuuuuauuuuuauuuuuuaauuuauuauuuuuuuguagagccagggucucacuauguugccuaggcuggucuugaauuccuagccucaagcaauccucccgccuccaccuugcaaaaugcugggauuacaggcaugagcuacuuuguucagccaguagaagaaacuucauuuacuuuucuuauuuuugaggcaaggucuuucucugcugcccaggcuggagugcaauggugcgaucauaacucagcuucuaccuccugggcucuagggauucucccaccucagcuucuccacccuacccacccccauuucccacccaguagcugggacuacagccacucgccaccauuccuggcuaauuaaaaacaaaauuuuuuuuagagacaggguuucacuauguugcccaggcuggucucaaacuucugugcccaagugaucccacugccuuggccuuccagagugcugcaauuacagcaugagccaccacaccuggccaguagaguaaauuuuuguuuuacuuuuuucuuuuuuuuuuuuugaaacgggucucgcccugucacccaggcuggagugcaauggcgcaaucucggcucacugcaaccucugccucccggguucaagugauucuccugccucagccucccaguagcugggauuacaggugcccgccaccaugcucggcuaauuuuuuguaucuuuuaguagagaugguuuuucaccauguuggcccggcuggucucaaaccccugacuucguggauccacccacuuccgccucccacagugcugggauuacaggcgugagccacugugccggccucgguuuacucuuaaauguaaauagaacaaaaucuauugggcaggggaugcuggaauuucaaauguauguuucauguucauaucuuguuuucagauguaguggccuauguugaaguguggucauccaauggaacagaaaauuauucaaagacauuuacaacacagcuuguggauaugggggcaaagguaagacacuuauuuugcuguugauucauaugacagucuucugauugguaaaaaguuacauuugcauuuucuuauuuugggaguuuuuacuuagaaucuggacgaagcaauggguaagcggugggagaaaaaagagccaaagugugaagaauuuagaacaguaggacuuucagaacucaaugccugugggcauugagugaggaggaggaaccuaggaugaaaugcuggauucuuacacugguuacuugaaugcauagugcuauuaagcaaagugaggaauacaggaaaaggaacagguuucuaagggaaaaauuguaaauuugggcauacugaaaaauaucuguuagauauuuggauauacaagucuggagcuuggaguguucaaggcuagagaugaugaucuagggggucaggaccauaggggucaugugaagucacagguguggacaucgucccaugucaggcaugguuaggaugaagaguggugacagaggagcguuguucaguauucaaggacaggcgaugggagcagggacccagugacagagggagagaagaaugccaggagaaggagaaaggaaguguggaagucaaaguagggaguaauuuuuuuuuuuugagacggagucucgcucugucgcuaggcuggagugcagugacgcgaucucagcucacugcaaucucugccuucuggguucaagcgauuguccugccucagccuuccaaguaucugggacuacaggcacaugccaccaugccuagcuaauuuuuuuuuuuguauuuuuaguaaagacgggguuucaccauguuggccaggauggucucaaucuccugaucucgugauccgcccaccucggccucccaaagugcugggauuacaggcaugagccaccgagcccggccaggaguaauuuuuuaauugccuuucagaacuagaauggaguaauuuuaaagauagaauuuuuaaaaacuacagaaaguucaagaaaaauaggaugggcaaauguacuuuggauuugaacacuguaaggucauugcugaacuuagugcaguuuucagugaaaugggcaggaaucauugagcuaugaggaaauggagauagcaaacaauuugccuuauucaagguuucuuaguauagccaucucuguuaucagauuuacuaucacguacugcuuguguucagguagccucuauuugacuuaauaauguccuugauaccaaauagguaucuuuugcccacgcacacuaaaccgaucacuuugaugacggguuuuacaaaagggaaaagauucauucacggggaagcccagcuaggaggcagaagaguacucacaucuucauucccaaagauaaggcuuagggauauuuaucaguuagggaaguagggugaucuaagcuguggggaaaaaugaaguacaugaucugcacaagcauaguugggauucauggaaugcauguuuagaaaacaggcauuauuaggaggccaaggcaggcggaucaccugaggucaggaguucgagaccagccuggccaacauagugaaaccccaucucuacuaaaaauacaaaaaaaagccaggugugguggcacacaccuguagucucagugauucgggaggcugaggcaggagaaucguuugaaccugggaggcggagguugcauugagccgagauugcaccacugcacuccagccugggcgacggaguaagauucugucuccaaaaaccaaaaaaauaggcacuaguaggauccgauggugaagauuuuggccugaugucaaaaggucauuucuugggcauuuacacaggccugguugaagaguuggugguugcagccuguuugaacuguacgggugcugccccaaguuccugaaaaguaacuuaagcaacuguuaccguggugacauauccaccagaaguuuuuaucuuauaaggaagccagugaagguuauagcauuuaguaguaugacuugcagcuauauagaaauaaauaaauaaauaacaaaaagcaagugaccaaaagcaagcaaggcagguuaaauuuggcagaacuaauuuucagccguaaagugcaagagugaugaugcuggcaauucagauaugccagagaagccuuaaggugcuuuaagugaaaaggugaaaguucuccacuuuaaggaaaggaagaaaauuguguguugaaguugcuaagaucgacagugagaacaaaucuucuaaucuugaaauugugaagaacuaugcuacuguugcagucacaccaaacugcaacaguuacagccacagugcgugauuuuuauuauaauacauugcuacaauuacccuauuuuguuaucauuauuguuaaucugugccuaauuuguaaauaaaacuucauuguauauguauguauaggaaaaaacaguauauaaccuguucaguacuagcucaggauucaggcauccacugggagggguugggggcgggacgcgggcaugucuuagaacuuaacccccguggauaagggggaacuaaugugcucuuauagggaguuuaguuaugaacaaauccuguuuauguccuugucuggcauuugggaggggcugacugauaggcugagugaaagagaaccauuaaaaaugggagaaaagauaaucgaaggcagggcuagguuaggguggagcaagagagcugcuguggguauaaaacuuaagaggcgcucaccaccaggcaaagagugggugcuacugaauacccuaagagccuuguuugaccucccuaaugccugucuugaguaagaggucaguggagaggaauccgaauauaggagcagggccugcacugcaggaggggagacaugcccacuguaauacacuggaauguaggaacccgagggagucugcauguugcacaugccuaacauuuacuugggaugaggaggaacuacugugaauaagaaaaaagccguuagacaagugaguugacaaggugguuugaggguagcauuaagaucuuagaucuuuuagaacuuuuugguuucaccuuuuauuucaaaaauuggcaaacaguucaaagaauagugaauacagaucaauagucguuaacaucguaagauuuggauauuuguaguacucguaauccgggauuaucuuaagccaauuucaggauuugagaugauuuaaaaccagacuacaggccugugagggucauuauaacuucugauucacccuuaaucuagaugcagcucuuugggucucagcgcaagguguagggguuuuaccagacccccuugucucuuugaggcuucucaauuuucguccuguuuaguguguacuaaauuugauaaaagccuugugggaagauggucucaaaugcuagacucaucucucuaggugucagucuuaaucuagaaucucagcccgguaauucuuaauugccuugauagcucccauggacuugauggggguguggaaauugagagagagagagaguuauaaaaguaauacauauuuauuguuuaaaaagacuaacgggcagugccaugaaauucacaaugaaaagaaagagaaaccagcaacgcuuugcaguacauuuccuuuuccauuuuucaaagacagcuacuuucaaaucaucuguuucuuuugguauuuaccuucauauuuccaagcauuguacauauauuacuucaguauaauugaaugcuauaaaaauuaugcagaugaguucugcuucuggaaaggauacauaaaagguaaaauuuuugacaccaugagugucugagcaugccuuuauuauacuguuaccuuugacuaauauuuuagcugaguguaaaaugcuagcacaaauauuauuuuuccuugaagguauuucccauuguuuucucaauuccagacugcuguugauaagacugauucaguugucacuuauuguuugcaugugaugugucucuauccucuucaccuugauuacccacucuuuuaauauuuuucccuuucgccaaccaugcuggaauucugugauaagcuugguguagugcuguuuucguucuugugcugggccuuugugggggauucuuuugaucuagaaugcauauccuuuaguuugagaaacuuuucuuugauuauuucuuuaauaauauuuucuccauuuuguguauuccuguauucuuuaacuucuguugauuggcuguuggaucuccuggucugagcuucugauguucuugccuuuugucuccuguuguccgucuucugguucuucucuucuacuaccagugagcuuuacucaacuucauugucugauauuucuguagaaaauuuuuuuacuuaugucaucuuuucuuaauuuccaagagcucuuuaggauccuauuaaaaaauaaucuucugaucauguugcgugaauacaguaucuuuuuuuuuuuuuuuuuuggagauggagucuugcuguguuacccaggcuggagugcaauggcacaaucuuggcucacuguaaccgccaccucccggguugaagugauucuccugccucagccucccgaguugcugagacuacaggcacgaaccuccacgcuuggcuaauuuuuguauuuuuaguagagacaggguuuuuccauguuggccaggcuagucuuaaauuucugaccucaugauccaccugccucggccucccaaaguucugggauuacaggugugaaccaccacacccaguuuccuuugguuuuaauuagcugaauuuuuccaacuuuuugaaugauugcacuuauuuucaaccuucuuacuuuguauuuaugcauuuaagauuacaggcguccgccaccuugcacccggauaauuuuuguauuuuuaguagagacaagguuucaccagguuggcuaggcuggucucaaacugcugaccucaggugauccaccugccucggccucccaaagugcugggauuacaggcaugagccaccaugcccagccauggauacaguaucuuaagauaugagguauuuuuaauuuugguuaaauauguguucuguuuucucuguugccucugaauuucauuugguuuuauuuuuuugauguagaaagcuuuucugaaauguccauuauuaucugacucuuuccaucuuuaaaaauguggugccuucucauggccacauuuucucuucuguccucuuuauccuugcagggcuccaacucuauucuuucaguaacacuucagaggguuuuuagagggaguagaugugaacuuguguguaugauucaccguuguaacuggaacagauauguuuuaagcagcguuaugcauuccuuugaguguuucucugucagauguugagaaacagaauugcugggguagagguuuuuugaucaguuguaguuaaguugugaaugaacaguaauguacauuuuguuuucugcauuuugucuacagguuucaaaaacuuuuaacaaacaaguaacucacguuaucuucaaagauggcuaccagagcacuugggacaaagcucagaagagaggcguaaagcucguuucggugcucuggguggaaaaguaagcaguuucucucuuacuuuuuuuccuuaaguaucuaguauugaaaauguguggagauauuuuucacagaucgcagaaccagauaaaguuugauuuucaucuuuucucugccucuuaccucaccuaguaauuugaaauccuccagccucaauuucugugguucaaaaauggucaugcuauaauaccuaacucugccuagggggaaaaggagccugcagguccugaagcuggguaugcaagguggacuuaggaagcaagagggaaugugaugaagcagauuguguuagucagcaagcgcugcuguaacaaaggaccacagaaugggucgcuugagcaacagaaaaggacuuucucacaacucuggaggcaggaaguccaguaucaaguugucaacaggguugguaucuucuuuuuuuuuugagacaaagucuugcucugucauccaagcuagagugcaguagcuggaucuugggucacugcagccucagccuccuaggcucaagugauucuuaugccucagccucccaaguagcugggauucaucucaaccuuugccuccugggcucaagugauucuccugcuucugccucccgaguagcugggauuacaggcacgcaccaccaugccuggcuaauuuuugcauuuuugguagagacgggguuuuaucauguuggccaggcugguuucaaacuucugaccucaggugauccaccugccucggccucccaaagugcuaggauuacaggugugagccaccgugcgcggcccacacaguuuugauuacaguaaauuuguaguaaguuuugaaauugggaaguacgaguccuguaacuuguuuuucauuuucaagauuguuuggcuauuuugauuugaguuccuugcuaagauuguuuggcugucuugauuggguuccuugcauuucuauaugaauuuuaugaucagugugucaauuuauucaaaaacaaaaaaggcagcugggauuugguaggauuguauugaaucucuaauuagggaaguguucauaauauuuaaucuuucaguccaugaaaaugggauguguuucuuuuucaggucucaaauuuccuucagugacacuuucuaguuuucaguguacaaguuuuuuacccccuagguuaaauuuauuccuaacuuuuuuguucauuuucaugugaaugaaauuguuuucuuaauuuuuuuaaguuguuagcuguuaguguauagaaaugcaggugauuguuguauguugaucuuauacccugcaaauuugcuuaacuuguuuauuaguucuaaauauauuuguggguuccuuagcauuuucuauaugcaauguuguguaauuuuguaaauagagauagauuuacuucuucauuucuagucuggccgcauguuaugucaugucaugucaugucaugucaugucaugucauguuauuuguucuggccagaaccuccagcacacuguugaauagaaguggugagaauggacguccuuguguuguugcucaucuuuggagaaaagcuuucaguauuucauuauuucguaugaugguaacugugguuuguguaaauguccuuuuuuaggcugaggacguucccauucccuucuguugcagguuguuuguuuguuucugauuauuaaaggaaguuagauaugguugucagauguuuuucugcaugacugaucaucaugugauuuuuguccuucauuauauuaaugugguguaauugagggguuuuguguguugaagcaaccuugcaguccuaggauaaauccuacuuggucauguuguauacguugucaucuugccuuuuuaauuguuggaacaggccggaugcgguggcucacaccuguaauuccagcacuuugggaggccgagggggguggaucaccugagauuaggaguuugagaccagccugaucaauaugguaaaacccuaucucuauuaaaaauacaaaaauuagccagucauguuggcgugugccuauagucccagcuacucgggagauugagacaggagaaucacuugaaccugggagacggagguugcagugaaccaagaccacgccauugcacuuuagccugggcgacaagagcggggaaaaaaaaaaaagaguaagggguccuucucuggcuuuugucaagauuuucucauuaucuuucacuuucagaaauuuaagugucucgauaugguuuuuuaaaauuuauuuuguuuagauuuuacagaacuuguugaauguguaguugccuguguuucuacauaugauucguuuuuggccauuauuucuucaucuaucuuuucugccccguuuccuccucauuuuuucugauuagcuguauaucuuuuucuaauuagcuguauaccagggauugguaaaguuuucuguaaagggacagauagucaauauuuuaggcuuugcgggccauauggucucugcucaacagcucagcucucuuguggugugaaaggcguaauagaaaauaaguaaacaaaugcuugugucuguguggcagcaaacuuuacuuauaagucuggcaggaagccagguaguuucccaauccuuucuguguaauacaccuuuuaaacguuugcauuuguccauagugcucuccuucuucuucauuauuguucagucuuuuuuuuucuccucagauugaucuuuuuucaaguucauugacuuuuuucuccaucaaauccauucugcuacuuaguaccuuuauuugagauauuuuugauuucuaacauuucuaguugguuuuuguauacauucuuuuuauuucgguuucaugugagauuucucaccuuugguuuuccugucuucgguuaugaguguauuuucuauuaccucgaugaguguaguuauaaauaguugucuuaaugaccuugucugauaauuuugagguugguaucuguuuuguuuuuguuuuucuuugauagugugucacauuuuucuggcucuucauauggcaaauaauuugagguuguauuuugcacguuguaaauacuauguagacucuggauucuuuucuauugucgcaaagagcaugagguuuuuguuuuagcaagcaguuaacuugucguuaaaaugaaacgcacacugucauuaugugggcaguugcuuagaugcgcccuuuaagccucaggugcaggcugauuuguuugccucaaacacauguuguucaggggucagccagagacuugaacuucuauacucagaauuugggguuucuccuaugguucucuuacuuccugaguccuuaccucauuucucuaguagcccuagcugcccagucuccuuccccuggucucuucagcgagaaaggaggccggagcuucugcuugagugcuugcugcgccacaccagcucccucagagacuguggcugccuuuaggggacagacagaaaaaguggugaugcccagauucuuuugcuuccuuuuaaaauuugccuguucuuucuuuuucuuuuauuucccuccagcuuucaaagcucucacauaguugguuuauuuuauuuuauuuuuccuguauuuccaggacguauagcuuauaguucaccuauauuuguauauugguuuguuaggcauaaacagaaauggaacuuaguauguuauuuuugaagcaucugaugccagucuaauucuucuucccuucaacauuauuugaucuuuuuggagacuccuuagggauauuuuuuauuuuaucauuuuuuuuuugagacggagucucgcucugucgccaggcuggagugcaguggcgcgaucugugcucacugcaaccuccuacucccugguucagcgauucuccugccucagccucccgaguagcugggaucacaggcacgugccaccacgcccagcuaauuuuuguauuuuuaguggacacgggguuucaccauguuggccaggaugauccugaucuucugaccucgugaucugccugccucagccucccaaaguacugggauuguaggcgugagccacagcgcccggccaggauuuuuuuuuuaagacucauggcuuuacuguaauauguuuugaauugaucauuccaguucuggcuuggccuuuucaacagauucaggucuauauuucugcaaaaguuucugggauuauaguuuuaaauauucugcuucguuguuuugcuuuucuucugggacuccaauuauguuuacguugggccugcuuagcuaucuuuuauuucagucaacuugacuucaacccuuuuauauuuauauacacauacacacacacacacacacacacagacacacacacacacacacacacacacacacacacacgcauuuuuaccccaaauacuuauuugacaguauuuguuuuuguuuuuugaagacagggucuugcucuguugccgaggcuggaaugcaaugacucaguugcagcuuacugcagccuugaccucuaaggcucaaucaguccucucaccccagcccucccuaguggcugggacuguaggcaugugccaccaugcccagccauuaaaaaauuuuuuuuuucuuuuuucuuuuugagauggagucuugcucuguggccuagugcaguggcgcaaucucggcucacuguaagcucugccucccagguucaugccauucuccugccucagccucccgaguagcugggacuacaggcgcccaccaccacaccuggcuaauuuuuuuuuuuuuuuuguauuuuuaguagagaugggauuuuaccguguuagccaggauggucuugaucuccugaccuugugauccaccugccuuggccucccaaagugcaacccggcauuaaagaauuuuuuuuauagagaugggaucuuacuauguaggccaggcugggcucaagugauccacucacuccagccucucaaagugcugggauuacuggugugagccacugcacccagcugauaauauuugauucaaguucaaggguuuuguuauauucuucaguuuuguguuugcuuuuauuuuagggagugugauggguuuuccucagcugaaaugauuugcuuuuucuuuguuuuuuuaaaauagauuuuuaaaauggauguagucuauucuauuuccauucauugcauaggccaggcuuguggccagagcguccucuucugucaguucugcugucuugcauaguuucuuuuauaggugaugcuggugagggagggaggagggaggggcucguguaucucguuugcguuuuguuucuauaggauccuuaaauguuuuucucuuaguuucuucuuuuuuucacugccauugguucaagggcugccacuccccccagaacugauguuuuucagagccugccuguccuagucuugcucccauucagaccccuucccuggagugggugcugugagcuguguggguucucuguuguggcaguugugcuggguguccucuuucugagacuucuuuuaccugugcuucauguaaguucuccaggcuguacuacuuuuuauggagucuuaagcguauucuccccgacuuucugcauccauagacuugcagcuguguuggaauuugauuauuuuucuacuuauaggucaucugaauuugcgcuguuaucuccgugucagugagaauguaggucauaugugucuuuuauuuaaguuucuuuuuuauuuucugcuuuuuuuucggggagggaaugggguaagacucaguaucagccagccaucauuguuuucucuaccucaucuucuuauggaguccauugaaauggcuuauugauuuuuaucucaaaaucgaucucucauagaucuuuaucucugcuguuacagucgagacaaguaucaugucuugcuucaguuacuguagcagccucaugccugucuguuucauuuuguuucuuauacauaagcaaauguaaccccuuuuguuaccaguggaagguauccaaguuaccggcagcaaacacguauggguuugcagcaacuucaguucuugcuuccucaaaagaaagaauuccacggaggagcauaaggcaaaagaagagacugacgcaagggucagagcaggagcagaaguuuauuuaaaaggcgucagaacagaaagaaaggaaaguacacugggaagagucccaggcgggcauggaggucuaauuugauguuuaaccuugauccugggauuuguaggcucgcccuuuuccgcaguucuucccuuagggugggcugcccgcaugcacagugcgggaauugagcacaggcagcuuguuuaggaaguugugugggugcccaucugaagcuuucuucccguuucuccgccauuuugucucuuaaugugcaugcccgggaaauggccucucccuggcgucugcauucaguuaacacuuuagcacaacagguguggacugucaggaaauggccucucccuggcucuggcugccaauuuaucacuuuuagagaggcaaugugauaauuguugagcuaucacccaacauuccuagugggugguagaggccucuccugccgggcuuaugccuaacuaccuguaauacuucaacacauggaucagcuuuauccuucugacaaaauggcuuagaguucaguggucuauagcagagaauggccaacuaucaucccccagccaaauccacccugccauacuguuuauuuuuuuuuaauggcccaugagguaagaaugguuaagagaaaaaaaaaauucaaauguuuacuauuucaugauauuuacauuauaugaaauucaauuuuaguauccauaaauaccguuuuauuggaacacaggcauguucaucugacgauguagucaguggcugccucuguacuacagcuguagauuuggauccuguggcagagaccuuacggcccacgaagccuaaggcauucacuacuuuccccuuuacagaaguuugcugacccagguccagugugcugcaugaugguccccuucccuuccauugucagcugcuccccucucccuuguuugcgucuuccaaaugcucugggcuuccacguccccaaggcuacacucuuucugccuuuaguucuuggccugugcugagaacucugccccgucuuccugauucuaaacccaguuuuguagucagcuccuuuauacauguugcauugcaaggucgcuuuaucagaagagcuuccucuguccccaguucacaguucaagcccuauuuguuauucucugucucagcuccuuuuuuccuguguguacuauuaaaacuuauuuuguucauuugacugcuuuaucugucuguguaucuaaucaugcauuuugucuuucuauuguaauguggauuccaagagcagcuaccugucugucuuauuuaugguuguguuucuaguaagucuaacauucaucuggcucauaguagaugcucaguaaauauuuguucuaacaaauuaugaacaaaggaaaauuuaguuaaguggcguagagauacuagagaaaauaucaugggggaaaaugauuugaaaaaaaacuacauuuuaaaagucguauagaaauguggaggggagagugcagaaacagagaccuuuacuagaagcuugaaguaaauggagaugcauggacaaaauuaaaauaguagccauuucuguaccuaauagggccucucagcuaacccuacaauggggauggucacugguaguguguucugcugagaguuagggauucuuacucugcuuugcuggcccagccccugacucauucucuauccccuuucucucucucucuauuucugcccaccacuaaccccagccuuucucaaggggcucaugcagaccccauaauacuuguaacuucguuauccaaaagcaaaguuuucuuuuucuuuucuggagacugagucucacucucuugcccaagcuggagugcaguggugcgaucucggcuuacugcaaccuccgccuccuggguucaugccauucuccugccucagccucccgaguagcugggacuaccggagcccgccaccacgcccggcuaauuuuuugugguuuuaguagagacgggguuucacuguguuagccaggauggucucgaucuccugaccuugugauccgcccuccucggucucccaaagugcuaggauuacaggcgugagccacugugcccggccaauuuuuauauuuuuaggagagacaggguuucaccauguuggccaggcugguuuaacuccugaccucaggugauccgcccaccuuggccucccaaagugcuaggauuacagguaagagccaccgugccuggcaaaagcacacuuuuaagguccucagaagcucaaaagugaacuuaaucuuuuggcauuuuucuuuucuuuucuuuuuuuuuuuuuuuuugaaacugagucucgcucugucgcccaggcuggagugcaguggugcaaucuuggcucacugcauucuccugccucagccuccugaguagcugggacuacaggcgcccgccaccacgccuggcuaauuuuuuuguauuuuuaguagagacgggguuucaccguguuagccaggauggucuccaucuccugaucuugugauccgcccgccucggccucccaaagugcugggauuacuggcaugagccccugcgcccggcccauacacuuuagucaacuuuuuauuacaggucauuuuuuugccuguacaugcagaugcaucccacuuuauauauauaagaauauuuuguaguagcuguccaguaauuuauguaagcaguguccuauuggugauugaaguuuuucauuucuuaguuauuuuuuucaauuagaaauauuacagcauugagcuucuguauguauuaccuuuuugcgggugauaaaucuuuccauagguuuaaauccccaaagugggcuguucauuucugagaguuuacauauuuaaauaugauagaugcugccaaauuaucuucuggaaggaguguacugguuuccauucucacuggaauuaucaaaaaaaugcauguuucccaauaccuuugcuaauguugugaguuaucaguucuucuuucuaauuuguagaagaaaaauaauaguuuuuauuugcauuucucugacuuuuagugagcuugaauuuucuucagcagagcauagagauaagagccaaacugaccugcauuuuuuaugucacgucuguccuuucuuggugaacugccugccuuuccaaugcaguagcucaugguuuccacugaaaaugugaacauuaacuucauaaggucacuaggugucacuagaaucccauucuguuggguuccuucugggaguguucauuuuaagaucagauggcaauugauaaaauucugacauuuccuuuggauguagaaauuuuuaccuugaagaaagaauacauaaaguugaaauaaaggucagcuuggcccccacucuaaguucuguugaagacaauuuaucauuuuuaaacaacugcaaacuaacagcuagguggggaauacgguucacaggcuuuguccuugcuaggcugagaguugguugcugaccgaaggccaucacccccugcauuuaguguuugcuggaaacagggacauauuccugcauaaccacaacacaggccgacauuaggggcuuaccacggcuccuuuccucccggaauccucagacuccauuccuauccuaccagcagccagcuccacuucccgccuccucagccuucucacccugcagccauuccuuagucuuucacuggcuuuugugacuuugacacuguuuaaggucacugaccagugauaggaacgucccucaguuuggaacggucugauguguccuccuaauaucacaucaauguguaacaguggauguguagccauuuaggacugggcaaauuacucaacugcugggcucuagguuccuccaguagcuccugaguuaacuuccuacgguuauuuagugcuagaccacagaaguucgcucucugcuggcagagcacuguugugcagacuucucugagucuccuguguucuuccuugugugucagggacacacgugaaggauagcgugcuucgcggcuggaaucuucaaggagaugccauucacuuuuuuaccucacuaacacagugccguuuacaaaaaagauuaauguacuuuuccugaauugacuuacugacugggccuagagaauaagauacuggugcugggcaguuuggcacaagaguagcauaaagaaugcaggauuggcccaggugaaggcaucguccuaaggguagaaugagagucggugguuccuggccgaccuagcagguguacugugggaagugcuggagugaaucggcucucuggggagaauaagcucaucacagcacggcuucccgaggagaacguugcugcuuugauuucuguuggcucugaggcagcagcaggucaaauaguugguucucuguuuagagacaucucuugaaacacuuuucguuuugaccacuagauggugggauaauguuaucauuuuacauuucugaagaaaaauagaaaucuaacuggaagcuuuuuugucuguucaguagauuuugguuggaccccugguaaacauggguuucaguguagcagcuuuaauguguuaccacgugugcuaaagcauagcuguuggcaugcagaacggcauuaccagcaguaagugccacuuacuucuucauagugagugaugauaguuacacccagguagaugaaauucagggagagcaucucugugcaccuuacaucuuaucacucugaaggauaugugguugggaagcuucucccaaaggaacagaacacaucuuccacaacuguauaaccuaugucaggcacacguuuuccuggguugaaucaagcccuuccuuaaacugcuaacuuaaagaauacuuacugguuuuguaaaguuuggcaaaugaucuucucugcuccucgguuuucuguguugugcaauaggaggcaaugguaguggcuuuuccagcacgguuggugugaggcuucucaugagcugggugaccuuuguccugaugaugguggugauuuuaauacuguguauuugauaacacgauuaucuagggucuccucuacgucuuucguccagaugcaucucagccaccccccuuuugcuguucccuuaggcauaauagugguaaaucggugacauuuugcuugaguaagaagaagcugcuaaaaacuucucaugcuuaaaauugguaauuaaggggacuuuuuaaaaagaagcacaguuaaaaaacauuuccuuccucguucucuuccacccgccucccuuucccaucacuuuuauuagauacagcauucugcucaccccauuauugcaggcucagauaguugguuuguuuuuuuaaaaucagcuuuauaaaaacauuuacauaaaauaaaauggacccauuuuaaguguacauucacggguuuuuuguguauaccugugucaccaccacaaccaaaauacagagcauuuucaucaccccaaaaucuccuucguguccauuugcugucggccucccugcccccuccucccaccccagggcagccacagaucugguuucugucauuaaagauuagugucaccaauucuggggcuucagaucaguggaaucauccagcguguacuauuuugugccugacaucacugaaggugauguuuuugcgaucuguccguguuguuuguagcagugguuucacuuccuuuuauagcugaguaguauucuauuguaggcauguagcuuggugccaccaguugauggagauugggcuaguuugccauuuuagguuauuaugaauaaaguuacaauggacauuuacauuugugucuuuguaugcuuucauuucucuugggucauuacccaaacuuuuccaaggugguuauggcacuguauauucccaccagcaguguuccuuucacuccacgucuucaccaauaguugaaauuuauccaucuuuugaauuuuagccauucaagcagauguguagugguauuucaugguuuuuuuuuucccaacauuguuuuaagaucuaauucauaugcuacacaauuuguccaauuaaaguauacaauucagugguuuuaaauauacagucagguauugcuugacgacagggaugccuucugagaaacgaauaggugauuuuguuguuguggagacaucacaguguguauuaacacacaccugcaugacauagcuacugcacaccuaggcucuguggcacaaccuguugcuccuaggcauaaaccucuacagcaugugcaguugugaaacagugguaaguauuugugucucugaaauacuuaaacauagaaaagguagaguaaaaauaugguauaaaagauaaaauaugguacaccuacauagggcguuuacuaugaauugagcucgcuagacuggaaguugcugugguugagucguugagugaguggugagcgaaugugaaggccuaggacauuacuacuauacaguacuauggacuuuauacacgucauacaguuagguuacacuggauguauauuuuuuggagcaacuguauuaacugauacuauaacguuuuuuuaaagacaaggucuugcuuugucucccaggcuggagugaaguggcacauuuauggcucacuguagccucaaccuccuaggcucaagcaauccuccugccucagcuuccugaggagcugggacuacaggcgugugccacuaugccuggguaauuuauuuuuauuuuuauuuuuguagagacggcauucuugcuacguugcccccacuagucuccaacuccugaccucaaacaguccuccuaccuccgccucccaaaauguugggauuacacaugggaguuauugcacccggcuccucccauaaguaaauaaucuaucucucuguuacuuguggugggaggaaaagaaaaaaaacaccuagguuauguauaauaccuaauacgaguacuucguaaguaguuauuauacuguuuuuuuuuuuuuuugaaacggagugucgcucugucgcccagacuggagugcaguggcgugaucucggcucacugcaaccucugccucccagguucaagcgauucuccugacucagccuccugaguagcuggaauuacaggcacgcaccaccacgcccggcuaauuuuugcauuuuuaguagagacgggguuuccccauguuagccuggauggccuugaaccacugaccucccgccucaaccucccaaagugcugagauuacaggugugagccaccacgccucgccuauacuguauuuuuuuuuuauuuggccuuacuauagcuuuuuuacaugauaaacuuuguaauuuuuuaaauuuuuuuacucuuuuguaaugccuuaaaauacauuguacaacaguauaaaaauaccuuauaucuuuaucagcuuuuucuauguuuuaauuuuaauuuuuacuuuuaaacuuaaaaaaaacuaggacacaaagacacacauuagccugggccuacacaggguuaggaacaucaguaugucgcuaggcgauaggaauuuuucagcuccauuauaaucuuaugugaucacuguuguguauguggucugucauugaccaaaagguuguuaugcggcauauaacuggauucacagaguugugcaaccgucaccacaauuuaaaaacauuuucgucaccucaaaaugaaacuugcaccccuuagcccuauccccuauucucccgccagccaaggcagccucuaguagucuacuuucuuucucuguggauuuuccuuuucuggacauuuccaauaagcggaaucauaugauauacggccuucaugucuggcuucuuucucuuagcauaauguuuucaagguucaguauguugucaucuguauuagaauuucauuucuuuuuaugguggaaucauguuccauuguauggacacgugcgcacgcacacacacacacacacacacacagaagaacuaaauauuacaaggcuuaucaugaaaaacaauggucucuuucuugacccuuuucacccucaauuccuguuccccagaggcagcuccuuucacacuuguggcugcuucugcagauaagcuguucggugaccuccauauuucuaaauacuguggccguauugcuguuucgguuuuucaguuucagguauuaucuagugacuuucugauagggaagugagaauuucguuuuuaauccgccccucugagugcaccucacucccacauacacucaucugcuguuugcauggacacauucaugugcaggcucuuuccacucuugauugcaguguacaugauacauuuugguuaaaucgguaguuuauguuuacaucauuaugaauguggaaguuguguguuaggcugaaucucagagugaaccaugaauauauuuccuuucauggaaaacuuuuuguuuucccugagcuuggccugguguccuuugaguccagagcuucucaggcuccacuuaugugaacauggacccagugcccccauuggacacaggguggcagugagugggcacaggcaaggagagaaggagagucgcucccucuuuucagccuuccacccucugcccucugcacuuugcccccugccccaccccagacugcuguggcuucaccugcgccuccugcccuugagggguucugagcuccagguucugagcuccagauggacuccucccccgccccagcugccaggcuuggguuucccuuuuuuuuuuuauuuguuugauuucauuuccccagacagcucuuaucuacucuuuauuuuuguugguuuaugucuuuuuguuuuccuuuacuaucauuuuauugggguuuugggggucaagagaaaagcaugugcuaaguccaccagauuuaaccagaggucaaaaaccuuccauuuuuauugucuaaauauuauucaguuaaggauucccccuccccaucuuaguccccaacugccuuugcugaaucuuuagcgucuccugccacaguuauugcaguauucccugacuggccuccuccuccuggaccagugaucugcccacgaccccucccucacaccuguccccaugccccagacccacaggacaggguccaagcucauuagcuuagaaaguacaacccuuggaaucacaugaauucuuuuuuuguugcuagucuccuaaguugcauucauucacucagucauacaaaugguguauguuuuccccacaaugucacccuguuugcugcacugugcuugagucuaugcucugcuuccagauggaagaucuguguccucccacaucugccuccuugucagaguugagucuggugaucaucucugaccugaagcuuucucugaaccauacucguuaugcaaccuguugcugcuuuucugccugguuguacuucucuuguuacaauuacugcacuguguucuuuuuuaaauuuguacauuuuugcagauuucucugaugccuggcuuaauagaagacaguugccuucucauaucugccucugcauucaguguauugggguggcacaugucguuuugcuucggaaaauuccacugcauuguauacugaggggauaaugcgagaugagaaaggaaaaucacacguuaguguuguuauaaagauaguauugacuuuacacacccucagaagggggucagggaugccaggaugacauucacuacccuagugucacuuaccacauugcauagaccauacugugccguacagaggcacauauuucugaaacuuccuuuauuccuaauauauuuuguagaaauuucuauaucaauauggauauguguuuuuuauugcaguguacuuuauuuuuucaaauaacuguucguguguuagauguugaacggugauaggccugugagggauaguuggagaggugaguagaggccuuauaaaaacacuuaaacagcagaugagugagaauaugcucuaaacaugggagugacagaagguuuuuaucuagguugggaagaaauuuaagauuaauauuucaggaauguaugagugaauuagaagaggagaaacaaauaguagggcaggagaucauuuagaaaaucauaauuauuuagacuugagugacagaaugcuaagaaggagauaagggucacaggaauccagagauacgaagguggacaggagaaauggcagguguguccacagggcaggaggaggaggcuuggcaaugcggagcauugguugcacaccugggccuuggggcugaugguggugucuggacagaaacacaaaaaggacaacccaauuuuggaggaaagagauguccucugacuucaauuucuuuacgucccuucuaccucugaauuaucuguuuuauggccuguuuacuauuaaaugauccauuuaauagcauuuacccuuagcuuuaugaguaccaugcacuaauaauuuugaaguaugcuacaagucaaaaauuguuguguaaaaauuguacuuccuuuaccugccucuugcuucuguuauacuuaaauaccagauagagaugauuuugggaaguuugauuuauacugacuuuuguauuugcaguuguauuuauuuuuuaaaagucuguuaaaaugaccuagcuauggauuucuuaaauugcuaauacaugugcagauuuagugcugugucaauguauaauagaagcaaauacucauuagacuaccuuaauuuaauuauacagaugcaggacagcuggagcacacauugaugaaucauuguucccugcagcuaauaugaaugaacacuuaucaagccuaauuaaaaaaaaaguaaguacaugauuucaauguagauaauggcaauuaggaauuuauucguuuuuauuuuuuauuucuagaaaauaaaacuucuagaaauauauucaagaguugucuuaaauaugcuauugaugauauuguucuuuucacauagcauuuuuaagugaauuacagagauuauuuuauccuaugacuucuucgauagcauuuguaugaaauggaaaagccugugguuggccaugggaagacuaaaaggugccaagagacaagcaaacauuuaggugcuuugguaauuacuucagaaugaaguuuguuauaucuguagccaaaauaccugcauucuguuuagccagauaaaucucaaaaguccgauggaccuacauccaagugugcaaagucauuuauuaggaaaaucugcuguacaaauacaguuguccuucauuauccacagaggaucaguuccgggacccccacagauaacaaaauccacugaugcucaagucccuuauauaaaaugccauaguauuugcauguaaccuacacaaauccucccguauaccuaagaaagaauuguuuguagagacagggucuuucuauguugcccaagcuagucucaaacuccuggccccaagugauucuccugccucaaccucccaauugggauuacaggcgugagccacugcaccuggcuccucccauguacuuuaaguaaucucuggauuauuuaaaauaccuaauacaaugugaaugcuuuguaaauaguuguuacacuguauuuuuuuuuaauuuguguuaaauuuuuuuucuuuugaauauuuccaaucgcgacugguugaauccauagaucuggaacuugcagauacagagggcaaacuguagaguuaaagacauugcuuucauuugagauagaauucacauuuuaaccacaaccuuuucggcuuucuauuuauguaaaaguucuaauugugauuucuuuaucugaggguacuuuacucugaaacaucacagccagcuuguuuucacaugagauucucuguuagagggaggauuugaugacuuucuccaaacugaacuacauuuccuguagacuagaggagaaauaacugugaauuucacauuuccugaaaauaguaaaugauauuucuucguuacauuucaucucagacaagccauaguuugcccaugcagugauagaugaacuucuucagucuuaccugauuauaggugaacaaguguucagcagucucuggacucccugugacaugcuaaaaucaaguguuuauuguaaaaacacaucaguaguacauacauauuuucuuuguaaaacauuuaguaaacacagacaucucuuugauugcccucccucaauguaagcagcuuucaauuugaugaguauccuagguggcauuucuucaguacauuacacacauguacacacucacacaugcaugcuugacgugaaggggcucugcuaucuuauguguaucauuuggugaguugccuucucuuccccaauuaacaauaugguuuugaccauuucaugucgguagcuuugacucuacucaguuuucuguauugcauuauacauugugacuguuuuuccgguauucauguacuuuuagucacugucaguuuuugcuaaguauauuacuuaagccacauauuugaguuuauuucuccaagucagauaucuagagauaaaauuacuggguaagaauacauacacauuuugauuuuaccagcuccaccaaucauauacaagaugaccuauuucuuggccagauacaguggcucacaccuguaaucccagcacuucagaaggccaaggcgggcaaaucaguugaggccaggaguuugagagcagccuggccaacauggcgaaaccccaucucuacuaaaaauacaaaaauuagcccaaccugguggugcacaccuguaaucccagcuacucaggaggcugaggcaggagaauugcuugaacccaggagguggagguugcagugagcccagaucaugccacugcacuccagccugggcgacagcaaggcucugucucaaaaaaaaaaaaaaaaaaaaaaaaaccuauuucgugauacucugaccaauauuggauguuacuaaucuuuuuaauuuuuccuaaucugaagcauuaaugauugcuuguacacuuuaccacuuuaauuuucaugucuaaaaaccuucccuuuccuucucuuuuccaaauguaauugcaaauuaaacccgacucaaggccuuauucuuuuggguccuugagaugguucugugccucugucuccccccucacccugucugcugccugccugcccagcuugcuguuccucaagcaugccaaucguauuucuauuucagagccauugcguuaucuguucccucugucuggaacauucuucccccaaaauccuuacacaugacccguuuuccagccucccuauggcuuugugcagauguuacuuucucugugagaccuauccugccacccguuuauaccagcaguuccuucccacuugugccaacuaugcaagucucuuuucaucugcagugcugacuggcuccuccuaacacacuguaguaaugugggcaguuugauggaauacaguugcuagagaagauucacaggaccccaaaauaacaauguguccaaccugcaccguaccugagaaccaggaagcgcaagauggagugucuucuuguauacugcugacccugagucuauaugaaccagccccacuggcagagccuccaggcaaauccuucaucucacuacucauaaacaauguugacaggccagcacaaucuguccccaaacuucccggaccuguggcuauaaagcaccacugucuaauuaguacauuuugugucaugcagguacuuuagugaaagcagugcaggccgguuccaagccuguugaaaugaaccucccaagacacauacaauuuacuuauuuauuauguuuauuugcugucauuccuuaccagcauacaagcuccaugaugacaaggaucuuucuagguugcaagaccagcgccugacauaaagucauguuuuuugucaauaaaugagugaauaacuaacagagcaagauccccaguauaggcauuagccuugaguagcuaaaagaaguucuuucuaugagacuggagcaaaagaaguuagcguuuacguggguagcuagcuacccauguaagcaaauuugggcugguagcuucgcgcugaaaacgaaggaaccuagacagaugacuuaaauuucccugggguccuauaagaaagaagucaggcauaaaaguguuauagguaaaaucgaugugaaguucaguauguguauuugugcugauggcugggcuaaagacgggaagucaaugggcaguuccaagaacagaaagugggguggguaaggcugggaacgugagguguguuucaaaggaaacauuuccccugucugaggaugguuaagaguagaguuaacccaagaccuuccuguggauaucagccugggguuucauguguuugugaguguaguuacaguuuuuggguuuuacuggcugauuggaguuacugugauuuaaugacgguagggcaagcauaaucaugguucuuuucuuugguaauuauaaaauagaaauuguuuuauuacuguguuguggucuugcagggaggaugacgugagaauagugcuaccaagcaggcagugggcgugcugccaacccacauagaguccaagaucaugccacuuguuuugagaaaagaaaggcuuuauugcaaguugccuggcaaggagacaggaggaaacucucaaauccgccucccugaggugggggcucaggcaguuucauaggcagagaaaacaaagugugaucugauuggaucuugcaauggggugaugcugggaggugucaucugacuggguugugucacaaggugaugccagggcucaaucugauuggaucauggauuaugccaucagguguuuacuccuuaauuuggcccccguuccuuggucuaagugcuuagguucugcccgugguuacaugcuugguucaccugggcaugcucaagugacguaacuugcaacuucaggggccguggcaauuaaacaguucaccauuuugauacacaaaguugaacuagauugggcugguuuggugguaagaacagcaaaaaaucgaaagagacuggcuaaaaacuuucauggaaacuaagaaugcuaggaucaugaaaaugucucacaaagcauaauacagagccuuuuauacagucuuuuaaauucuguccauuuucuuuauaacugcacaaaaaaauaaauauugccaguucacauacagugcaagaaacaccucuuuuagaauuuuuuauuacugauguuauaaaagguaucagaaauguaugcgaaagggcuuuuucuccugccuuaagcaguugcaguacagcauuaauuuuuguguucuuuuugcacagcguaaauguaugcagcccaaagauuuuaauuuuaaaacaccagaaaaugauaagagauuucagaagaaauuugagaaaauggcuaaagagcuacaaaggcaaaaaacaaaucuagguaagcuaagaaauauaauacaguucuuugcauuuguguccauacaccuuguuuaauuugcaugaugacuagugggguucagcaugagagagcugaugaagacuaugauagcuuuacucuaugaaggagaaaacaaaaugucaggagccugcgggagacuuggcugggagccauaauagagccacgcagcuugagcuaaucgaccacagucuuaaccauucaucaagguggucgaacuuuuuauuuucgggaaugauuucagaagaaaagcaaacuuuggcuaauaagcauuauugaaauaaauaccuauuuauuucuucuuuauauauaacuuuguauuuuuaccuaauuggcauuuuuguuuuguuacccugaauaggcaaaucuuagaugauacauuauuuuagugauuugggaaaauacuuuagaauauuauguucuauaacaagaugucuuagaaaaaaauauauguauucuuauguauauauauuguuaaauaauauuuuuauauauaagaauauuaugggcugggcacaguggcucacgccuguaaucccagcacuuugggaggcagaggcgggcggaucacgaggucaggagauagagaccauccuggcuaacauguugaaacccugucucuacuaaaaauacaaaaaaauuagcugggagugguggcaggcgccuguagucccagcuacuugggaggcugaggcaggagaauggggugaaccugggaggcagagcuugcagugagccgagacugcaccacugcacuccagccugggcaacagagugagacuccaacucaaaaaaaaaagaauauuaugaaacauuaagaugcuuuguacguuuuugguauuucuguuuugccuuuuucacugucgucuaaagucaguauuuccuacuaauucugacacagcauugcuacagauaagcaauuauggucacuagaaauuccuaggaagcauuaauuccucuaguuuuuguuuucuuuguuuuaaucuauguuacuaugucacagauucucuauucuguguuuugaaauuauucaaauagaauugucgagauuuauuuuauuuauuuuuuugagauggagucuuucuccaucaccaggcuggagugcaguggugcgaucuuggcucacuacaaccuccaccucccggguucaagcaauucuccuggcucagccucccgagaagcugggauuauaggggcguaccaccacgcccagcugauuuuuguauuuuuaguagaaacaggguuucaccauguuggccaggaugaucucaaacucuugaccucgugaucugcccgcuucagccucccaaagugcugggauuacaggcgugagccaccgcgcccggccaagauuuauuuuaaaucugugacgauaaugcgacagaacuggguagaacacuuagcccacauagugcugccacauaauuuuccagaaacauggccugcaucauuuguuucaugcucagcccucccgcugccucaccuggugcguguccauccuuccuucacaccagcugucucgucuucgucaaagcucaagccagaaacgugcaaucguccuugacaucuccuucuuccugacacuaacccccaucaagaccauggcccugcuucugaaauaguuguuugacuucuucuguuuucuccuucccuccucucuccccugaugccuggaucaucccuccugcaccacugcagccacuccuuacgcugcccuccacugucuccuuacaguucaucucugugcugcagucacaauggugaaaacuuuaaaccagaaggacauccccucccugguuuaaaauuuccuggugucaucccaaggaaaaauauucaggauaaaauccuguauuuaacauauccuccaauuuacuaggugcuuuaugaucuggccucucuuucuagccucauagcaauauugcacacucuccuauaauucuuuauacuuuugucacuuuggccuucuuugcuaugucagugacaguguauuugaaaauacuuuggcaacaugguaaugauagauacaaaauuuucuucuuagaccaaauauguaucguaauuaaaaacuauauguauaaaguauuaaugauucaacuaauguacauuuguauauugucagaacuacaguaagggugauucaggcuuaagagucccaaaggagaauauauuaaaugauucuugguauuuuuuuguugggggugaguaucaaaguucugaagggcucuuugagcauaugcaagguagcauuccagaaaaaaacacaacucugcacccacacaaaacgagcucauaacuucaugguuccgggaccaugcugaucccacuucaugcagucaaguucaugucugggucugugaguguguuugaggguaggagugaugguucaugggggcaguuucugaaaccugagacaagaaacagaaacuaaauugcauuccagcuuuacaacuuuuaacuucugugucucagucuuugucuucaaguggggauacugauuuggguuuggauuugagguuggaugcacuaaugcauauauuguucuuagcacagugcuuggugagggcaguugcucagcagaugugagccagcagcuguagcagcaacaucacugccuguggaggugguggagguagaauauuagcaggaguagguaaugauguugaaagggaagaaggaaaacggggugugggggguuguucuuuaaaaggaaucacauuccugaaguaugaaggcacuuuuuggucuuaaaguggauuuuuuguuuauuuucagaugaugauguaccuauucucuuauuugaaucuaaugguucauuaauauauacucccacaauugaaauuaauaguaggcaccacagcgcaauggagaagagauuacaagagaugaaggagaaaagggaaaaucuuucccccaccuguaaguaauuaguuuguaaaaugaaaauuaugcaaauagccgauucaauuaugguggaaagcuucuuuuuucuuugccuagauauuuuaauguuuccugguaguaacacauuuugacuuauuucauggcuggcuuuguuuuccagaaaaucuuaugcaucauuaagauuuuugaagcauauguuggguguauaguauucuucaaguuuaaaauccuauuuguuguagcuccuuuguaauuucuauuaucuuuggaauuuuuucuuucuuuuuuuuuaaaaaaaaaugaaucaugucuuuuuuuuuuuuucugagauggaguuuugcauuugucacccaggcuggagugcaguggcgcgaucugggcucacugcaaccucccuaguucaagugauucuacugccucagccucccgaguagcugggauuacaggcgccugucaccacuccuggcuaauuuuuuuuuguuuuuuuguauuuuuaguagagacgggguuucaccauguuggccaugcuggucuuaaacucuuaaccucaggugauacacccgccucggccucccaaacggcugggacuguaauccaggcgugagccaccgcuccuggccgugaaucaugucuuuugaaggaauuugcuuuagauuaauguaucuaaggaaucaguuuguuuuucauuauuucuuuuaucuuuaaaauuuuuaauuacugaaguguaauucacauuuuaauaaaacauuuaucaaaguagcuaauaguaaaaguucaucuugauacccaucuaauuguacucuucuaccuggggguaaccuguauuuuaaguuuaaguguuuuuccagaucuguuucaguguaucagauaucuguguauacaugaaaaagauacggguuugguuucuguguggagguguaauuucuguuuuaccuaaauuagauaaugacauauguauuauuauccgcuuuauuuacuuaagaguauccuggaggguuuguuugcagcuuaguuguuguagaccuauuuuuguuuuaagaugcucaaaguagucuacaguuuugauauugaaaaucuauugguggguauuuuuuucccaguuauuagaaauuguguugcaguuuuuauucuuuuuuuaaccauaugguuugguuguucuuguuuuuuuguuaagccauuuuccuuucucuagacauaagucuuuccagcuucccaccccgacuuuuuacuguuauaaccccugcaugugccuacgugaauccuuguauuucugaguacuucguguauuucaauaauacuaauucauacaugcagaauuugauuuuuuaaagacauagagucucccuguguugcgcaggcaggacaugcacuccugggcucaaguacuucugccucacccucucaaguagcuaggaauacaggugugugccacgaucccuggcuuauugauagauauagucaaauuauccuucaaaaaauuugagucaucuuauugucaccaguuguuuauaagaaugccccuuucuccauacuuggaaaacugaauggcauuagccuguagccuuuuucagucggaagcuugaaaaacuggaucuguucuugaaguuacuuuugauuagaagcagguuuaagugccuuuucauauuacugacugacuuaccgaaugcagcuuuuaaugugaucaacuauuaccucgcuuaauuuuauguccuuuguccauauguaucaguuaagguuaguuucggcugcauauaacaaagacaaaaaccaauguguuacaaucgauagaauugccuuucucugucuugccuaguucagaaguaggcagccagggcugggaugccauuccauggugucuuuaagaaacuagguucccaucuuucuguuguaccugccuggcuuuucuugcaaaaugugugugccucccagcuaagccaucuccuuuugacagccuuaccagacgucuauccaauauuccugucuaauuccauuggcuggaauguggucauauggccaccccuuuugcaagcaagacugaaauguagucuugacugggaugcauugcuguccugauaaaaucaaaguucuguuguuaagaagaagugagaauggacauugagguagauaacuagcugugucccagguggacauccaaauuguuucagugugcaauuauguguauaaacuaauuugccuuaaacuuuacuuuuucuauuacuuggcaguguuaauucugcuacuuuacugcguccaguacaguuuaaaacuuaacugaaaauuuuaugugugcuucccuuccuuaucuugguuuauucucuuuuuuugcugaaguuuucucagaaaaguauccuuuugagucucuaaaaaauaucuuuggauauaagauccaaacauuucuuuuguuucuugacuauuguaugaaccgccuuugaagauaauacuuacgaucuuauuuguuaagucauugacauccuaaguguuuucuaugaaaccucuaggauuucucaacccagcacagcugacauuugggucuggguaauucuuuguugggggcacugcccugugugugguaggaagcucagcagcaucccugccucuccccacuaacacuagcaguguaccuacugcucucccucacuggcgauauccaaaaauguguccagacauuaccaaauaucugcugggaccccaacgucaccucugguugggaagcagugcucuaguuuuagagguaacuaugaugagcauccuugaagaaaaauccaugauuaucaaauaagaagacuagaacagacuggaaauguucacuuaauucuguugagcuucugauuagauucaggcaaguugacuuuaagaucccuucuaacuuugugauuauaggauuuaauagaaucaccuaugauuaauaggaggacuuccugcuggcuucaucugcuaagaaauacugaaacuuuaucuaaugcagugucuugguccuguuuuuagcuucccaaaugauucagcagucucaugauaauccaaguaacucucugugugaagcaccuuugaacauuucacgugauacuuuguguucagguaaaauuuuuauuuuccuuucugugauauguuuaaguuuugagaauaauaugauuuucugauuuagaauuucauguagcaacuucugaugaguaaaauaauuaguuaaaacuagaacuucuaaauuucccccugaaauuagguauuauaauaaaauuaaggcaugaguuaaacuuccuuuuugguuccuauagguuuuuuuuccuaggcauuugcuuucuugcuacagaauccauugcucuauuuaaaaaauuauugugaacguauaugaacuaaucuguaugcaguuuaaacuacauagaacugaggucagagcuaaggaaauguuguuucacacaauguauaauuaacacaaggaaccuguuauugaacggggucagugaaguauguaaagaucgucaauugaggagauaaauagaggauuucuaauuagaagcagaaagaacacugguaggaauuagugcaguuaguuccauguuacgcacauacauguuuguaaugugggagcccuaguuccacuuaggaugguaauuuuucauggucauaucuucuucguaccaaauuucuuacaguuucuucaccuaguccccaguggggcucaaguaaguagcagugaucccugaaaguacuauguucaaaagugcuugagauguuauggaaaauuuaucaugaaagccacagcaaugacaaagcgcaagauggcaucaagauauuagaaguuucaaacaaagccuccuuucagcgcaggguuaauccuuguacucucaccucugugugcuggaauuauuuacccauuucucuuaaacagucuccaucuuuuuauuuuacacuuguuacauuuauuuccuagaaguuggaaacaagugauaauaauagcuaacauugauuucauuuuuguuguuguaggcacuccucuaagugucuuauucacuguuaucucauuuauucucccauuagccuuaagagguagguuccaucaccaucccauuuugccagugaaaaaccaggacacagaggucaaacagcuuguccaaggucaugugguuugugaauggcaaacccaagcuucuaacuuaggcagucugacaucacagauuacacucuuagugacaugucacauugcuuaucggguuuuugaaaagugugauaaaacauaaaacaauuuuaggugcugaauaagauauauugagcaucuaaaauuaaaagugaccuuauuuccaacuacugccuugaagacaccuggggcacaguuggaagggaagcuuuggugguuaccuguguucuuccuuuuuaaaguagaacuucagugauuucagacagagaguucuaacacuuacgugaccuccagauugagugauuucuacaaaacacaggcccuccaccagcaagugcugagccccuauugagggagccagcacgggacuagagacuucuucauauucauuccaguagcuuauagcacagugacgggcagaugcccacguaaccauggggcaguaugaugcaugaugguguguagcagagggggcaaggccagggagagcuggcaagggcagugggagggucccagggauguugacaacccagguggguuuggaaggaugaauuguauuuacccagaauaaaguguggaggaaaggggaaggcccagaggguacagaggaguauagaauauuuaggagguagcagcagcuuagcauuacucucaggaaaugaguaauccauauaagaguugaaacauuaaagccuaccaaauggcucacuuuugaauaucaguguaauacgaggacuuuacuggaagacagggaagguaagggugagcuguguucauugagggaauguuucaugcaagucuagaacuuucccuagaucuuacaacaguaguucuuagguuuuagaauuauugaucuccuggaaaauuuagugacaaacuauggaugcucuuuuggaaaaugugcacaugcauauggaaauuugccuaaaauuuuuagaaguuuguuacaccucuucucuauccccacugcuaucccauacacccaucaaagcccagguucucuaguuaaaaauacuggccuaaaauguacccuuaaguggaaaugagaagaacucaagugugguuaauagucuucuuaacuaauagcuguacuuuaaaaguuguuuuauuggucaacugaaaguugaauauagaauaauuuaaaccacuuuuaaaaguuagcucuccguuaauguuuuccagaugaauacuuugcugguggcuuacacucaucuuuugaugaucuuuguggaaacucaggauguggaaaucaggaaaggaaguuggaaggauccauuaaugacauuaaaagugauguguguauuucuucacuuguauugaaagcaaauaauauucauucaucaccaucuuucacucaccucgauaaaucaaguccucagaaauuucugaguaaucuuucaaaggaagaaauaaacuugcaaagaaauauugcagguaaaguagucaccccugaccaaaagcaggcugcagguaugucucaggagacguuugaagagaaguaucguuugucuccuaccuuaucuucaacaaaaggccaccuuuugauacauucaagacccaggaguuccucaguaaagagaaaaagaguaucacauggcucccauucaccuccgaaggaaaaaugcaagagaaagaggagcaccaggagaucuaucaugccgaggcugcagcugugcaggucggaagacaggcugcagcacguggcgggaccugcccuggaggcucuuagcuguggggagucuucauaugaugacuauuuuucaccugauaaucuuaaggaaagguauucagagaaucuuccuccugaaucucagcugccaucaagcccugcucaguugagcugcagaagucuuucuaagaaggagagaacaagcauauuugaaaugucugauuuuuccugcguuggcaaaaaaaccagaacaguugacauuaccaauuucacagcaaaaaccaucuccaguccucggaaaacuggaaauggugaaggccgugcaacuucgaguugcgugacuucugccccugaagaagcccuaagguguuguagacaggcugggaaagaagacgcaugcccagagggaaauggcuuuucuuacaccauugaggacccugcucuuccaaaaggacaugaugaugauuuaacuccuuuggaaggaagccuugaagaaaugaaagaagcgguuggucugaaaagcacacagaacaaagguaccacuuccaaaauaucaaacuccucugaaggcgaagcccagagugaacaugagccauguuuuauaguugacuguaacauggagacgucuacagaagagaaggaaaacuuacccggaggauacaguggaaguaugugaaucuccuuuuccaagucaccuucgcuaaauaaacauguaacagugcauccauauuuuaaauuuaucacaacuuuuucauaacuuauuuccccauuuacuccucuuuuuacuuaaagaaugugcauuugaucauuccaaugauaaacucuuuaggaauagaugacuugcugucuuguggaacuucuagacuuauugguuaagucuguuaggaaucuauuucuccaagacuuuuccuucuuauaggucaaaaggauaaguaguccauaguaugaauaacugaggggagugaagucuuuuuccuuauuccauuggagucuuggcgcugcagcguguguaaagauguauacgauagagaguuuuuuaaaaccuagguucuuaauagugaggcuauuuaaagaaagaaauuaagguagauuaagccaucgauuguaucauagagaaagugugaaaaacuacuuuuagaaaucuguugucaauauugauuuuugaagaaacuuuggucaguguuaacuaugaagaaacauuuaaacauuuuugaucauuuguaacaagccuuguuuaacuuguacuuauuuugcuugaagcaucacuugaaaagguuuacuccuauucauaauuuaauuguaauuauaauaaaccauaucauuuuauuaaaagucaaaacaauaaaaaauuuugcacuucacaguuauaagcacaaauagguuccagcaaccaaaauugaagaaaucuugaacuuugaccgucuuuaccuaaagauuagguuaaaauuugagugagaacgcauucucucugcaugauuucucugcucuacaaauguuuuaacugccucuuugaagguggagaagucaugguagcguuugaaaucaucacagacauguuacauaccuuuuccuugaguauacgcuccccaaaauuguuucacaaaaagaaugaaaauaauuuuauguuuuuggccugcuauuuauaucuuggcuuucugaacauauauuaaauuugacaagaaacuguauuuuauguuccauuagccuuaguauguguuuucaaaauauuuauuuuaaaauguugacucaaaaguuaauauaaaacaauagauguguaaaauucuuugguaguuaagaauauccuguucugagguuuacauucuccaucuuuccaguuuucaccuuguguauuuuuuaagcuuuugaauaauaaugacauggaaauguaaauuaaguaggaaaaagcugguagcaaacaguguggcauggccuaaaauccccguguugcugggagugugcuaguccucggaagcagguguguuauguucuagaacacugccccccugcgucgacagccuccgggguuggggguaaguagaagggggugaggggccagcacuaguugacucaaggcacccugguggggacggagagguuuuuucgcucaguggugcaggccaucaggcagggguguccaggcagggcccgggugcaagaaaacauucugugugcgcuagugcgagaggaucuucuacagucaccugccuucaugccauuacagacagacgggaagucacuggguucuaggacauaaaaagaccuacauguuggcuagccuaaaucgaacccuuuuauaguaauaaagauucaucaauguuuuaaacuguccacugucagcccccugggacucaggugaaccaacucucuuugggaaucuaucuuagaagaugaaaccauaaagccuucaguuucaaugucagggaugcacacucuauaucuggugaaauuauggaggggugaaaacuucuguacagcaaacuguaccuccaaaucuuuaaugucgaaauaaagggcuuuuugccauuucuguuuucaguuca

SEQ ID NO: 191844 - RNA, 53144 nt, Homo sapiens
cggagcccccugccccggcagggggauguggcgaugggugagggucauggggugugagcaucccugagccaucgauccgggagggccgcggguucccuugcuuugccgccgggagcggcgcacgcagccccgcacucgccuacccggccccgggcggcggcgcggcccaugcggcugggggcggaggcugggagcggguggcgggcgcggcggcccgggcccgggcggugauuggccgccugcuggccgcgacugaggcccgggaggcgggcggggagcgcaggcggagcucgcugccgccgagcugagaagaugcugcugucccuggugcuccacacguacuccaugcgcuaccugcugcccagcgucgugcuccugggcacggcgcccaccuacguguuggccuggggggucuggcggcugcucuccgccuuccugcccgcccgcuucuaccaagcgcuggacgaccggcucuacugcgucuaccagagcauggugcucuucuucuucgagaauuacaccgggguccaggugagccgccucccgcucccgggucucggcguccacccgagcucccgggggcgcggaccucuccgcucccccacagcuggcgagggucacccggccggcccggcggacccagcacggagagcacgugccgccuccccgccuuccucuccgcaugcuuccugccguucugccgagaucgcucucuaggaagcuguggcugcgucguccugaggcuacgagugggacccgccgccccuuuccccgccccucgccugggucugaugcugcuuagcaaagugggugcagaugcacguuuuaaauaauagggcacgcguuuagcaguuucuggccuuugguccaaagagguggucauguuggaacagaucggagacgucuacacuccgaagugcgcuuuuacagugaccucuugaaacagaaguacaauucggucuuguguucuuuccccuggacaagugaaagcugggcgaagaaaugaauacauuuguuaaccguagaagccuaacuagauacauuucuugccaacuuuaacugggcuugaaugugugggugaucuguugucugauuacuuucuuucuguuacuguuucucuguagagauuggauucguagauuaaacuugagaaacaaaccauaaaaguggaaggcccucuuuaacaguagguauuugaaguguuauaaaaaaaaaaaaaaggugaauuuuucuuuuauuucucaguuugaaagaacagcuuuauucuugguuauuccuaauguccaccuaguccucuuuuacuuuucuugguaggguuaggguggcauggggaaaugggacgguaucauuuugucuuuuuaacuuuuuuuuuuuccaccuacagcagcuguuuuuacccuguggucagucagguacuauauuuaguuugcaguugcacugcugaucgacccuugauggccccaguuggaaguuguuuggggggaaggaacuaggagaggccagggccuccauuuaaaccagugucuguaagugucuccuuggaaagaaaaaaagauacuguuccaggucaugguuuccugguaguugacguuuaaaaugggccucauuuaaaaauuucaauaauucaggcuaauuuuuucccuuuauaugguaacuccaccaaguuugucuaaauguaugauuuuuaucaugauuaaguuuuuacuuccacaucaugugacaacuggccugggaugggauauaagcucagaacacaaagucauucaccucuuaaaaaaauaauucuaucuguggcggguuauguuauuuuuguucaaagaggacacaauaugaugcagaauacaccauugaaggauuuuuugguuuggcaaguucuuauuuuuuuaaauggcuguaaaaccuagcaguguuucugaaauugcauaccuuaccugauguucagagauccgauuuacuucuugauuucccagcaagugauuuugaaaacauuuaaucuaaucauuccccccaccgucuguucaaaucaaaggaaguggcauccagcacuaauuuucaugcauuuaugaaaggaugccugaggacccuuaaguauaauucaaaauuuuguuuaauguguguuccuugaugaaguucuuuaggagucguagaacgaacugauugcccacugaucaucaaaugcaaguuaugaacauuuaauaaaaauuuaaaaccaagaguuucuuguuccugcauuuuuauuuuuauuguauggaggggacaaauaauuauuuucuguuuaguaacagagcaggguauuuugaauuuauuagggucuuuuucugcaaucuggguuuccuguguacacaaagcuaccuuucaauauuuuuuauuguuucuguuaagauuaaaucaauagaggaauaaauagcuaucuucaaacauaagacccaaaggaaaaagauuuauagugauguucugucaccuuauuuuuuaccugugacuuuguaccauuaacuuugucacugagauguuuugauuaaaauuuuuagcuugcuuuucuuguuuuguuaggacacucuuuuuuucuugaauuguuuuuaucagcuuucguuugcaaggcuagugaugauucucuuguucuguauaaaguauuguugacucauuucugaagggaguuuuaguaauuuaagagguuauaaguuuuuaaauaaaagguuuauuaauuuauauauauuaaagaggcauuuuaaaauaaaauuuuuuuuaaaugacauuuuuacaccuuucaacucuagguuuaaaaaauaagugguucacaguaguucuugcagaagaauauuuucuuuuacauagaauuuuuaagcugaagagaaguaguaguagguccaugagauuuaugaucugugcuuggcagguaaaccugcuuccaacaaauuuaguuggauuuuucuuggauucuggguaaauaccuuuuucuuccccaauuucacuacuuuauuuucauauguaucucugagauagagaaauauuucagucagugcugcuaaaauuguuccuuauaacucguuuauccuuuuagguccuuccagaaucucucauugguacugaaacucaaauggguacuuucuucaccauuuauuucuuuagaauaaguaauaagaauuuuauaagcuuuuuuauauuucacguaauuugagacuauugaaaauccaguuaagucucucuacuguguugagaggcauugauucaaguaccuguguuacuuuccugugcugccaaaacagaucaccucaaacuaagcggcuuaaaauaauagaacuuaaguucucgugauucuggaggccagcacuuugaaaucaagguguaggcucaauuuuacucccucuggaggcccuagggggaauccguucuuguggguuucaacuucuggugacugguggcauuccuuggcuuggggccccaucacuuuaaccucugccuuacaguccuugcugccaccucuucugucucacaucucacucucccuuucucuuagaaggaugcuugucauuggguuuagagcccaccuggauauuccgggaugaucucuucaucucaagauccuuaauuauaacugcaaagagccuuuuuccaaauaagaaaacauucacagguuccagggcuuaggauguggacacauuuuuugaggggcugcccuucauucccccacaacaaugaacuccauaguucugccuauucaguauuuuguaguuauuucguaguuuaacuugccuuauuucuuuagguauuuacguauuaaagcauuuuggucucugcuuucuuuaacagagaaccugguuuucuguaauaaguuuacuuacuuucccauaaucuuuuaguuucuuauuuacagauuuaccuucacauaucccuuaaguagaacauuugauuaacuguuuuauuuucggaacaaaucugcauucuguauaauaaccaacuuauucauauuucgguauucuuuuaauucuuaucugauucugaaauuaccaucuugugauuauauauauauauauauggaaauaacugaaauccugauaaauuaaaggugauauaacuucuaagacaauuaauuauguaugauguggugaauauacugguguuugguuuguuugccacuuaaaagcccuaucuauaggauaggaaguaacuugaauguggaaugcuuagagacucagaguaagaggccguauauauauccuugagcuggaguuuaaggaaaacuuaugggaaauuaaaaggaaaguuggaguacugacagaggauuggguaggacucaugaaaaaggaaugaaguuaccuuaaauucuaucaucgugaguuaacgugaaacuagauuuauguuaguuuauagccuagaauucuauccuaggaaucuagauauauccuaaauguugagauagcugcauaaacaauaacuguaaucguuaugauaaauaaugacaaaucuuuuuagcauguucugugaagcugauaaauguuaauaggaugucuucaaaugucagaauucuuuuuucuuugcuucuuuuuuaaaaaauuucuuuucccccauuccuaugcaauacacugaaaacugaucauugaaauuuguaggccaaaaaauuaaucaacacguaauagauugggguuuggguuuuuuugagucagggucuucuucugucacccaggcucuggugcgguggcaccaucauugcucauugcagccuugaaugccuggguucaagugauccuccggaguagcugccgugccauuauuucuagcuaauuuuuaaaaguuuuuguagaaauggggucuuucuguguugcccaggcuggucuugaauuccuggccucaggugauccuucugccuuggccucccaaagugcugggauuacaggugugagccaccaugccuagccccuaauaaauauucuaauuaccgauuuaucuugcuuaaaucaguugguaacacuuggaauuuacuucagaauauauuuuacauuaguggcucugacugcuaauucccccuucuccaaaugcuaauguaauauaacaauaaaaugcacaguucuuaaguuuauauaaaauaaacagguuuucaguugaccugcuuuaaguguaaaauagugugaaaaacacaagaaagaagauaaagaauuuaagauuuugacauuucucuaauaugcccuuaacuucuccaaggauucauacuuuuuuuuguaagacagaaucucacacuguugcccaaaccagaggugcaguggugcagucuccacucacugcaaccucugcccccgggcucaagcgguccucccaccucagccuccugaguagcugggacuacagguacacagcaccaugcccagcuaauuuuuuuuuugguauuuuuuaguggggguagagacgagauuuugccauauugcccagucugguuuugagcuccugggcucaagugauccguccuugauccaccaugcuuagcugauucauacucuuaacugaaacauuguuccaaguuucucagaaacagucaaggcuuuuuaucuagagaacauuuauaacuggaucuuucuuuguguagcacugauucaucaaacuaauccuaaacuccuaaugaguuaaauuuauauucugaaucuugcuguaaaagcagccauucauuagaaugaaacauguuuacuuagaauuggagaagggagcuuauaagucaucuagucuacucccuuuuaugacacuucuacauucuuucugcacuucugccaaaauguugcccagcgucgucucugauaccuauaguccuaacaagaauaugaaucauaccuuguauccuuaauuuuacucuucucugcuuauuugccauucaugugaagaccuuaaauagaucuuaaauugcuuccuucacuuuagcugagagugacaggacuguguagguguggguguguuucugcauuugcuuauuuaagcaggauaauaaaaacuuuuacuauaggaaauuaaacauuucccaaucaaauacaauuccagucuaacacaauuaaauucugguuagggaacugcuuaacuuacuagacuuauaggaaaauacuaaaaaaauguaacuagaacucuauuuuuacacuuuauaaauauaaaccucugugaacaaaccaguuauuucagguugcauuuguguauaguuuuuuaaugccugauuuuucuauuuuaaaaucacagaugcaauuauacauucaaacacugccacaauacuuugagaaaguuaaaguuuccccuacuccuacacugcguacaccuuuccuagguacaucccaguuugguguguaacuuuagauuucuuccaagagcuuuugaguaaguguuugaauugugggaagguucuuuaguuaaaugaacuucuuacagaucaguuuuuuaguacaguagcacgaaauauaccugcauaccuauggggauaccucugugccauuacgauggaaggcacgggaaaacagcacuccguauauaccuaguuuacuuucccucuuuuguauauuugucugauuuuguggagcugaugcuucucaaguggaaucagaaguuaacuuuuccuuuacuauuuucucauuuuauuaugguuucuuaacuagagguugauguuagugguuggaccauucaauaguaaguaaugacuuuucaguaagggaucucuagaacccagaucccuuaauuccugcaauauucccguguguacauuguuccaggugcuguccuggguaccaagggguacaauguuugauagacaauguaccugccauuauggaggucacauucuagugugggaagacaaacaauaacaagaaaaugaaaauuuacugugccaugccagguuguuuagccuggugggugagagguagggguuuggaaaaucuuacugagcaagugacauuuguguggagcucuguaaaagggccagcuuggaagguaauguagucauccaggugagaaaugaugguuaggggaguggaaagaguggauguuaagauugaaaagaauuccaaaucuauuuuagugguagcugauagggcuuugugauugaauguggaggaaaaagaagaggguggguuaguaacacacucagucgcaguuagugagugcugcugugugcaaguauuguucuauuauguaaauaauuccaucuuuacaaaguaggcaccauucuuccucuuuuacagacaaggaaaagggaacacccaugguucacaucuguaguagccuagccaggaguuucaggcacuuauuuucugaagaugcucugccuggcaaugugguuauauugguugaaaugagacccccuacuuucaagguauucaucuaggaaagacaugaacugccaauuacaauauaggauaacacugaaauuagagacguguuuauuaacuuugccauacagagguaaaguaacucuuuaaaguaacucuuugcuuggguuaguggagaaggcuauaaaaauuacuuggaguuuuuacuuugaacaugcguaauuaacauggaauguuuagggaaaagagguuuucaauugauaacauaauaaacaugaggaguuugaagcauggcauucaagguuuucuaaauucugccccgguuaacuuuuccauucguugguuucauucuagucuagcuuuuccuucugggccgccccuccccacauuagaccgcuccucucuggaauuccaacucaagcccuugcuuuucuccaucugucaugauguuaccccaucucauugucaggguaacuuuuauguaauauuaacauauauaauacugauauaacauuagcauauuuuaauguauggaucaucuccucugcaacauuguaaccucuuggagauggcaauaaugggaagaaugacuugauuuuacuuuuucuuuuaacaaaaaugguggaguagucugggcacgguguggcucaugccuguaaucccagcauuuugggaggccaaggaggguggaucacuugaggucaggcauucgagaccagucuggccaacauugugaaaccccaucucuaccaaaaaaauacaaacacuuacugggcaugguggugugugccuguaguccuagcuacucaggaggcugaggugggagaaucacuugaacaugggagguagaggcuccagcuugggcgacagagugagacccugucucaaaagaaaaaaaagguaaaagggccaggugcggaggcucacgcugguaauccaagcacuuugggaggcugaggcaauggaucaccugaggucgggaguucgagaucagccugaccaacauggagaaaccccuucucuacuaaaaauacaaaauuagccgggcgugguggugccugccuguaaucucagcuacaugggaggcugaggcaggagaaucacuugagcccaggagacagagguugugguaagccaagauggcaccauugcacuccagacugggcaacaagagcgaaauuccgucucaaaacaaacaaacaaacaaaacaaaacagagagaaaaggcagaguacucuagggaauucuagucuguguuucuguggaaauguauaugaaucucacuuuuaagggauggagauuuuugaauggcauaacuaguugauaaguuuugcucuaacaggguacccaagucuagugaguccgauucauucuuuccuuaaauagaugaaggaggaagaaacaugacuccacccucaagaguaaggcagaaugagcaaagucagagaaguuaaaaaagaauucucacgcagccagcagugcagagaaaccuugguuuaguugugaaucaaaaccaguacuuuuuguaauuuuugagccuaugcaauucuccaagguuuuauguuguuucuucuguuucucuguaggcaccagaaaucaaaaccccaaauaagaaaguguuacuugaagauuuuagaguacuuauuuguguauaaguguaaguaauauuuggaagacgacuuuacugcgcuccuccagcuuggcaugagaauuccaggggcggaaagaaaggagggugaugguaccuggaaaggagagucauguuaagucccagccacauauuaagugcuaaccaccuacuguuaaaagguguaauguucuagacugacaaaauacauagucucuaccguaaaguaacacauaauuuagcagugcagaaagaugucacuuaaaagaaaacuugaauauaugcugagauaguucacaaauuaaagaaaugaacaaagaacugaggaaauaaaggaggaauacaacuguguccaaaugaauacuuaacugggugggagcuguugcauauguaagcaggugguucaccuaaaaguuggauguaacguaguuaacgccagcucuuggugcacuuacauauugcauugcuuccgggcuuaauuuguguucauauaggaauaaauuuuuuguugguuuuuaauuuuacuccuuguaauuccguaguugauauucaaagugaaaaaaauuacauaagcuucuaauauaugagaagucuucucacuugacauuuuuuauuuggaauuuuugcagagaguaguuuugucacagucaaaagauuuugggaucuugcagugagaaaccuagguguaauuccuauuucucugccauuccguaugucaucuggauuaagugucaacuucucagucucaagauucucguccuuaaauggaauacuuuuugucaugcuauuuugaagacaaaaugagauaauacgugaaacugccuagcucagugaaugguacaucauagauacucagaaaaaacacacccucuaaaauaagaacaguaccaaaagacaggauguaaaauaagggcaguaccaaaagacacaugcaugcugaguguaugagaaagaacuuuguggccuucuuggguggcacaggccauggcaguuccacagcaugacgugguugcugugggugguagagcagacaugccgcuccccgucacugccuggcuuugaugcuugcuuucuucagcugagaggacgcagcugugauaugaaggucuuguguguacagucgugaccucacauuuccaauuuccugcuggcagaacccacagucuacaacguacgagcaccagaguugacgugagacagacagcauacagaggcuuguaacauccuucuggaaaacacuguguaagcuuucagugcgaauaaacaugaucaguggcaaguucuguuagauguagucugcaagcauccugauuuuacugggcaagacuauguugauuuacaggcggcugaugauuccauggauagcccacuacuaguauuuuuacaaauuucacaagacauucuuacuggaagauugcccuguucuuaugauacugcugcccuuuuagcuucauuugcuguucagacuaaacuuggagaguacagucagucagagaacuugcuaggccaccucucagguuauucuuucauuccugaucauccucaaaauuuugaaaaagaaauuguaaaaauuacaucagcaacauauaggcuuauguccuugagaagcagcaguuaauuaccuaaacacagcaaguaccuuagaacucuguggaguugaauugcacuaugcaagggaucaaguaacaauaaaauuaugauuggaaugaugucaagaggaauucugauuuauaacaggcuaugaaugaguaccuuuccauggucgaagauuguaaaaauuuguuuuaagugcaaacaguuuuuuauucagcuuugaaaaugacuugcauaaaucuggagaaagauuaucaggauuuaauauggugaauuauauggcauguaaacauuuguggaaagcaaguuuagaacaucacauauucuucuguuuggacagaccacuuccaacuagaaagaauuuuuuugcacauuauuuuacauuagguucaaaauuccuaaugcauggugggagaacugaaguucaguuaguucaguauggcaaagaaaaggcaaauaaagacagacuacuugcaggauccucaaguaagccauugacguggaaauuaauaguuugggaaguaguaggcaggaauucaauaucugaugaaaagauuagaaacauaaagccuuccaucacaauucccacccggaacaggaauuccuacucaucaaaauucugcauucauacaagagggaaccugauuaugaccaucuucuguuggucauuugguagauuaugugguucacacuucuuccaaauauuugcaaaucagacaucaccauuaucagcacaagcuaauagcaucauucgggaaucaucacuauuacaggacaccccuggagauggguagccuccagcuuuaccacccaaacaagcuaagaaaaacuguuggaaccaaauucauuauuuacauuuucaacaagaucuggaagaucauauuaaugaaacguugauguucuaucuucucuuaaaaaaucugcuccuaauggugguauucuacaugauaaucauguucuaauccgagugaaccugacgaaaauggaagguuuggagucaaugcaaagggggauaugaucagaagaugucugugaucguguccugagaagcaccaggaacaccuuugaccucagugacucucgauugaagagaagaccaaguuguauugaucagugguugggacuuuacagaacacacccaugauuggauuguccugcuuuuuaaagccaacugugagagacauucuggggaacucaugcuucuaguucuaccuaugcugcauaugauguaguggaagaagugcuagaaaaugagacagacuuccaguacauucuggagaaagccccacuagauaguguccaccaggaugaccaugugcugugggagucagugauccagcuaaccgagggcuuaucgcuggaacauucuggacacaauuugaucaacuuaucaaaaaaaaaacuuggaaugacaauuucuggugccagauuaccuuagaaccuuugcaaaaauagauagagauaguuuuccuuaugauguuacauggguuauuuuuaaagguaaugaaaacuacaucaguguaauuccagcaucauaagucagaacagugcuugucaaggggcguuaccacacacuugaacagauuuuuggcagaugacuugggaacaaggcuccuccauguuuguaauguugaccacacaaguugaauguggcagaguuaaaugaccccaauauuggccagaacccacaggaaguucauccuauggaugcuaccaagccuucugccacugagaagaaggaagcacugucuuuaucuucaggaagaucacacugcuguuuaaccaagagaaaaauuagagagucaucaaucacgcagauccaguacagaggguggccugaccauggagacccugaugauucagugacuuucuggauuuuguuuuucauaugcaaaauaagagggcuagcaaggaaaaaccccuuguuguuucuugcagugcuggaguuggaagaaccagcguucuuaauacuauggaaacagccaugugucucauugaucucauugaaugcagucagccaguuuauucacuagacaugguaagaacaaugagagagcagugagccgugaugguccaaacaccuagucauuacaguuuugcgugugaaguacuauuuugaaagcuuaugaagaaggcuuugcugaagaaagcaaaaggaaaaaaagaacuuugucaucuguuagguuccauuuauugcaugauaauuguguuuguauugauuauugggcaaguagcuguuugcuauuuugaucuuauuucagaagggcauaauaauuuuacuauucaaugaaacguuuuaaacgggguagaaaaagacuaguuuuuguaugcuuuacagcagaaaucuuauaaugauuaacugguaauauauuucguuggcauaaaaauacauuuaaaaguucaaguaauuauaaacauuguaaauuguauauguaaucauauugaaauugaaauucuuuauagcuguacuucuguguaaucaaagacuggggagagauagacuagcuagcucuuucucuuauccauuaaucacuuaacagaguuuugaauaaaaaguuccauuucaugggauaagaauaaugacagguuaaccuauuuuaguugguuacuauguucuagguguuguaugaaguaguuuacauaguuucacugauuucacuacaaucccaggaggaguaguuacuauuauuacacucauuuuacaggcaaagaaauagguuuggagggguuggguguuuugcccaaguucucaucguaaaaugacagaugaggauucaaauucaagucuuaauugaaguccauuacuuuagaaccuaccucuuaguggcucuuauguuacaguauaagggagagcagacuguuccuuuacccuuguaggguagcuagggcuugugaauuaagagacugauuaacaggagaagaggcauacacauuuuuuugacguuaguauuuuuacaugcacagggaaggaggguuuuauuuuuauuuuuauuuuuaucuuuauuuuaaagagacaggggucuugcuguguugccagggcuggacucaaacuccugaagccaagcgauucuucugcuugagauuccugaguagcagggacuauaggugugcuccucugugcuuggcuaaagaagggguuuguaugugauuuuuaacaaaggcugauaaauugugaaaaagugacuagucaaaggagaagaggauuucagcucccaggggugguaaauugugggaagaugacuaggaaauguauaguaauaagguuugcuaugcagguuuauuuugccaguuucuggucuccuaauaagggacagggaaacaccuuuacagauggaaauucauaucaccuuuccacagggaaauuuauguccugccuuaggcaguuaggggaagggcagagaauucuuccuguaucugcugugucucaggugccuucagcucaaaauaauccuuaugccaaaguagcauauuuggguguggcauauucucugaucucuuucaacagcaucaucuauacuuaacaacagcaaaaguuuuuuuuaaaaaaucauguuucaagauuugcauguggaagacaaauggacaugauugagauaaaugaagaauauauauuuuuuaacaaagaaugcuguauauuuaugucucugugacauuguguuauggaggcuaagguguuaagcaugugauuacuuuagaugccguaugacuaccuguuuuuaagauuaaaaaagaaucaauaggcaguuuauaugucaugggagcaaguuaaaaacaacacagaugugaugaaggcgaggugaaacugguccgcaucuaauucaggccuucuccugaaagccagugugugcaagauaaauaaguuuuuuugacgaaagcagaauaacuaguuuguccuuugugaugaagauaguuauucagaaaucauuuuuauuggcuaccucugaauuaauaaaugaaaagagaaauuuuuuuuucuguaggggaugucugaugaguucuuaaaaaguggaugaaccugaaauuaucaugaacaagcaaucauaaugaacuuaaaauuacuuaaagaguuaugaaaaacaaaaagaaaagccguauguuuucuugugccuuauuuugaagugacaaauuauuugcaggguacauuuguagacggaacuaaugugauuuaaaaaaugaguacuagauuuacagaaugaagccuuuaaaaagucacuggugcacuuuaauuauuuuauuuauguuuauucugaaacuaccuuuauuuugaaaaugagguauagcuuugccuacuggugacaaaaguguaaauaauucaguaaacaucuguuaaaaaccagcuuggugcuaggcucuugggguagaaaacugaucaggccauugaggagcucauagucccuaaggggcuggggacuugucauuaggugugcaguguguucuggaugcuccugaaggagugugggcaggugcgcaccaccaugccuggcuaaucuuuuuauaauuauguagagacagggucuggcugugcugcccaugcuggguuugaacuucugggcuuaagagaucuucccucccugccccuaccgaccccgcccgcccacuccaccucagccuccccaaagcacugggauugcaggcaugggccacuaugccugggcugugcaaaacuuuuaaaucagugcauacucaauggucuugaugcaauucuggcuuguugguaagagaauggggauuuacucacaagccacgaugucacuuuuaacucugaacagaucaagcuauugguauuacucauuuaugucaucgauaaacuuuaugaauaaaaacucauugugcaaauguuuaaacauacuacauacauagcacugugcaguuucuaaggaaaguaauggaaaccuuugucacaucccuggcuuccagaacuuuauguuaucuaagugcauuugucugcaaaguuguuggguuaauugccccuuucuuucuucucuuuuuaagauauuaauaaauagugucaugaccaaaagauaauccuuauggacaagauagaucuaaaaagccuuagcuaauuuauaaucuugcauaauccaugaugacaagaugcagaaacaaaaaugcccagaauaaaaacuuagcaccauuagcagccauuuccuuuuaagucuuuacaaguauacucccaguuucuugaaaaauuuauucuaaaauauguaagacacacaaaacagcagaaggacuaauacagguacaucgaacaccugugugccuaccgcccaguuuaaaaauaaacuggaaugauguuucucucauacuuacagaauaaaguuuuaaucuuuagcauggaauucaaaagacuucugccauuccaguucagagccacccuucuggucuccuugcuccucagccgcgacacugcccauguucccaacaggccuccaggguuacugcuuccauucguucuuauucucaugaacauuuuccuucaucucaucugccagaauccuaccuaauaauacuccugcucugcaguuuacaguucuuuaaaauuaaaaaagguuguguacccuuuaguguccugaaaaaagaaaaaacaaauuuaaaaccuuaaaaagguaccauauuuucauaguauuugcguuaugucucauuacaguuccuguggacaugucugucucuuuuacuagauugauugugggcucuuugaaggaagauauaucuuaugaacaguguuuuauauauuguuagcaaucaaugaaugcuugcuauauuuuucucaugaggauauugauuauucuauuuuaauuuauuaccguuaaccuguacuauacauaacugcuuucuguaccugcgcuauuuaugaucucugaggcuccugugagaaaucuaauuuuuguuaaucauggauggaaauauucacaacaucauucgucaguuucuucacauugucuuccuuuguauauuacagauguuuuaaaauaucaaaguaauguuuuuuuguuuuaucuuuuagauauugcuauauggagauuugccaaaaaauaaagaaaauauaauauauuuagcaaaucaucaaagcacagguuuguauuucauuugcaugaaacauagguuuuucuacagauggcacaugggcauucaaaauaccguucuuauauuuaaaugaaguggguuuuuuaaaacagcaauuuucugugcagauauuacaccuguucuuguauuuuugugauuuuacuuuuuggaaagucagaaacuugaaagcuaugaauuuuccuaaacuuaccuucucccucuguuggauguaaguaagcuaucuucuuacuugcuugcuuuguuuuuccuuuguguagcucuuuaaagaguguauucauucuuuuuguaagugauguuucuagaaguagcauuggugggucgaaguguguauacauuuuacauuuuugauugcuaagcugcagaaaagcuguauugguauguaaguacucguuuccuuacuaugcucgucauuucuagugucugcucuuccuuuccuucuucaaauggguuugguuuaauucuaguugcuacuguuccaucagaggaauugcagagaacuggucuucaaaacagugcaguauauacuuuaggugaagauacuucuaaaaaccuuuguauuuugagguaauucuagagucccaagaauuugcaaaaagaguacauugucagcaauauuuuucccaauggugacaucuuaauauaacuguagcacaguagcagaaucaggaaauugucauuggguaagguacuuuuuaauucuccaaauaauucagcccuccaaaaaaaucccacuucuuauguuuucaaaccuguagcuacuuuugaugcguacuuccuaaauugcauuuuuauuacuuuaaaaaauauaauaccuagaagcucaaagcuggaaacagccugaucaauauaguacucuuaagcuaaaaacaaccugaucaauauaguacucuuagggaaaucacuuaugccuguggcuuuuuuuaaauuuucuuccugucagcugucucuucaugauuuugugguuuuuauuacugcuuauaccauagaugagguauagaaaguaaaagaaguuaaaaugcauuuuucucaauuuagugaauuaaugauuacauucagauuuauaggacaaggguugaagcuacaagggguugauaggaaucuugauguaucugaguauuuuccccaacuuuauuacaugacugguucagacuauuuuaucuaauuacauuucacucuuggcaaaaauagcaaaacagucaaccaauggucaaugcugcugagaacucuggccugugcagacauauuggcuguuuuacuucuaauaccauucugcuuuuccuguccugcugcugauggauguuucuuccagguuuuaaauaucaaacaaaagggaucugugggcccaguacagggaauggcucuugauagauuugauuuuccugcauuuccuuuauuuugauccaguguuaauuucauguagaguugucuguuuaacaggauucucuuaaaauuccuucuucaguuuaccugccagcuuuucuuuguccagguuucaguaugaacuccacucgauuaauagagcucucuaguagugacuuguggaguggguucucugaacauuucuggaaguguugcugauagugauaauauugaucacuaguacuguuaauuugugugcuuacuacauguuggcuuuuauauguauuccuucagauuaaggacuucuagaaaacauccaugaaaaaacagauuaaaaaaaacaauucugcauguauuugggacuagaagguacuaugggaaggauaaucuucauacucagaccauacugaccugaauuucauuuaucaguuuagagaaccacuuccccuucccuucacccuaccuccgagugccugugacuuuguaucaccgcucuggcaccacauccucaucccagcaggauuugggaaggcugcuuuuugaaagccuuuuaaaauucuguaaguugagaaaauacuaggggaaugauuuuaaauuucuuuagaauuacaggcuuuagucaguauaugacagagccuuuuccuagaaaaaugugcauauaaaaauuugcauguaguuuuaggguuucagagaccccuaaagccuauccauagacgugguucauugucugauuguguuuagguacccuucuaaaacccuuuugagauguuaggaaucacaacagaguaucucugaaaauguaauuagcggaaagaauauuucaaagacuguuguucugcuuagacuuucuaguuugucuucugccaggcuugccggaauaaaugaguuuccuggccugauacucaaaagaauugacauuuaaauuagucucucucuucccuuguuuucgcuugacacauccuugucucuacauucugucucugucucuguuagcuuauuucucucucgagucagcaggauauaguggcuguuauuucuuccccuuauccuucaacuaucuacuuuugacaacacuuugccuuuuuuuuuuugagauggaguuucacucuuguugcccaggcuggguguaauggugcaaucucagcucacugcaaccuuugccucccggguucaagccauuuuccugccucagccucccgaguagcugggauuacagacaugcaccaccacgccuggcuaauuuuguauuuucaguagagaugggguuucaccauguuggucaggcuggucuugaacuccugaccucaggugaucugccugccucggccucccaaagugcagggauuacaggcgugagccacugugcccugccugcuauuugccuuuuuaaucucaugaaauguucucuuuucuuggcugaagugucacuuuucuuguugaacagcaugcguggugaguagaauguuauaaaaagggauggacuuuggaguuagagagacccagguuccuguucggcauugcagaaaugcuguucugcaauaggcugugugucagugggcaaauuacuuaucucucagagccuuauugguaaggugugagugauagcuccuuucaggcaccuuacagaggcugucuccuaauccugguagcguaccuggcucauagauggcauuuaaaagugguugugaugacagucauagcucaccauuagcauagcgcuggauccauggcagggaagcgcugcacaugcaguaucucuuggacuacacagggcccucaugaauuaggaacugcuguuucaugaggauagggaugaggaaauuagacuugcugccccucacugccuuccacuccucuccuccaaguuaaugggaacuaugacucugcuuuggcuugauugccauggaagauucucacacagccaaauuuauugcuaucuuaguuaaauuaugccagaacacaaaauaugaaguuauugucaaaguaauauaaucucagcuguaacugagauagucagaaacugucuguaaucugauguccuaucugaaagguagcugagaauaaacaagaaauaaagagaauucaguagcaaauauuggugacacaaagcuuuuauauuuugacuaguuaagcuaguucuuaaauguuuccacuaaaauauucaaguuuaagggcauagcccagggcagcuuauuaugaacaugauguauuuuggaaaucuuacacuuucucuuaaaaguucuugggaggggcaugugaggccauaauauaaccauaaaaccauuuguuuuaaaauaaaacccauuuuuaaaauucuuccaaauaaaaaaauuauugcaggaaaaaaugcuaaaccugguuuuuaacuuuguacgccaacuauauuuccaagaugugcuguagccugguaaccauacagaaccauacagaauuaguucucagaauuuauugucugcuuacuuuugcauuugguacagguauaacagggucgauuauaugguuucuaagacaugacuagaaagaaauauguuuaucaguuauuauuucuuccaucuaaauuagaaggggcuagggagagggcuucaacaggaauuuauauacuuuagagaaaagugaucauugauagcccaauaguauagauaucucaacccaauaacacagguugugucugucucugggaucauacacuguaggggagaaucuuugcaagcaacauucuacuuauagggagccauaacaaaaguuucauauguauaauaauuauaagucuuaagucaucaagaaaaaguuaacuugugaaugauaaucccugauuaaaaagagagauguauaauaauggauaagagauuuuucuugguuaauuuuuaguauuaaaauggcuaaaucuuuuuugggauauucugacuaguauggugcauugucuaauagauuucccauagcugagagcuaaucaucuuguaaucuguggaaaacuguccucuuuggcuaaaacuuuauuguaauuccucuaaauccucagcuuuuauuuucuacagacuuuuuuuuuuuuuuaacauuuccuuccucugacucacuccuuuuguucucauuuucauggccugagaacaugggugaugauagaauuauucuuuucacagauuaacaguuuucuuuucgaguaucguugagcucauguguguauuaacuagagaagucucccuuacauuucauuuuuauguuuucuuucucaucaggagauaguuuguagccauuuacuuucaaauccaaguuucugcgguucuuaagaccuguaucauuugucuccugaauuucacuucauuuccucuuuaaaccauguccucuguuucccaucuucugcacccacuuugccacuuccuguuuguuuaauuggcaagggccacucucuguguuggaaauuuuuucuuuuugaaagcucaacuaacaacuucuaggaaguuuuuuauugcuacuguuaucaauucauaccaucuuacccuuguuuuugcaacccuuuguuaauaacauauuuauuuaacuauaguuauuagcagucugagaucauuuuacuugguuacauaaggagcacauauaucuacccagcaucauuguaaggcaugugagaccuuuguuugauugcuguccuaaccuaguaccgaguccuaaaaacucauuaguagaagaugaaguguccuugccuuuugcugaacauauauauacacacugaauauuuaguggcaauucauaguugcauuuggccauuuuuuguuuauaauuuccccuuucucauuaaaaaaacuuuguuuucuagacuuuaggauuuagagaagcucauuuuguuccauacacaugcugcuguuggauuauuuagguauuuugugacuguauuuuaucuuugaaauaaaaagccuuucaagaaaugcaaaaaaaaaaagcucaaaaaacagaaaauguauauuuuuuaaauaucucagauagauuuaaagaaauuuuaaacauccuaaucauaggacuuuuuuuuuuuuuuuuuuuuuuuuuuuuuuggagacggagucucgcugucgcccaggcuggagugcaguggcgcaaucucgguucacugcaggcuccgcccccugggguucacgccauucuccugccucagccucccgaguagcugggacuacaggcgcccgccaccucgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccaucauaguacuuuugaagcccauucauaguacaaccugugaagagccucauguacgcgcuaacuggguccugucucugcaguugacuggauuguugcugacaucuuggccaucaggcagaaugcgcuaggacaugugcgcuacgugcugaaagaaggguuaaaauggcugccauuguauggguguuacuuugcucagguaacuuguuuccaugcuuuucucucuauauauguaguuuauaaauuuuuuuuuuuuuuuuuggagacagucucacuuuauugcucaggcugagugcaguggugugaacacagcucacugcagccuugaccucuggggcucaagugaaccuccugccucugccucccaaguaguugggaccguaggugcccaccaucaugcccggcuaaauuuucuauuuuuuguagagaugggggucucgcuguguugcccaggcuggucuuggacucaagcaaucugccugucucagccuaccaaaaugcuggauuauaggugugaacugccauacccaacccuauaaaaauguuauauuuuaaaauuuaacaauauacuucaugugaauguaugguuuuuaaaauggguuuaauaguuuauucucaguugaaguaauuuuguuuggcauuuuuagugguguguauuuauauacgucugauuauccauaugcgguuuuccuucagcaucuguggggauugguuuuagaaccaccacagauaccaaaaucugagguguucaagacccucauauagaaugggauaguauuugcauauaaccugugcacuacuuuaaaucaucucuagauuacuuauaauaucuaauacauuauaaaugccauguaaaugguuguuauacuuuauuuuuuauuuguauuauuuuaauuguuauauuauuuuuaauuuuuauuuguucacauauuuuugaucugugauuuguugaaucugcagauguggaacucauggaugugaagggccagcugcaguaaaaugaaagagcaaaaaugcaaauguacaaaguucaaacaaauaggaaauuuaaaggcauagaauuugauaggcaauuacauuaaacuguugauaacaguaauuagugaucuguaugauauuaaaaaaaaaaagcaaacuguauauauaaaacuuacuuucuccaguucuggaggcuagacauccaagaucaagguguugacaggguuaguuucucccaaggccucucucccaggcuugcagacagcauccuucuuccuguguccucaggugguuuuuuucccugugcccaagcaccgcuggcacugcuuccucuucuuagaaggacuaguuacacuggaugacuaauccuucuacagagacugcuaaggucccacucugaggcccuuuuuuaaccuuaauuaccaccucuaagucccucucucugaauacagucacagugggaacuauuagggcuuuaguagacugauuugggggaacacacuucuguccguaacagugccacauaaauaucuuuagcaggauugauuuuuuaaaaucccuaaagaucgugagacauguuaaggacgcuuuuuagugacucuguaauaaguggguggaagaauugggaguuaaauccaucugauggaucagguuuuuuauuuuuaaaaauguguauuuaagaaagaaagcauuuucauuuuaacugccaacaaaacuaaacuucauguguuuuccaauacagugucacaugcaguuuuuuugaauuauguugagacaaggcaauuuucagcuaaauguucuuuagaagcuaauguuugaagauauuaaauauagauuaaauucugaaauguaguuuucauucuguacuuuuugcaagagaaguugccuuuuugaugacucuggccaauuguuauuuuaaaaguaaaugcucuuucucccgauuugauuguggcagcauggaggaaucuauguaaagcgcagugccaaauuuaacgagaaagagaugcgaaacaaguugcagagcuacguggacgcaggaacuccaguaagagccuacccguuuuuauuuuucuuaccagcucucaguuucuaaauuuaagaauuaaauuaaaaucuaagaauuguuuugacaauguauuuucccauguguaauuacuaauucaggguuaugcugagguaacagaaacccucuauguacagguaggcagguuuuucagccaucagaaagauugcuguaaacaacuagguccuuugcuggucaguggaccuuaaagaggaauaaaaagagcauuuggugucguucagagucuauaaauagaacuaacugcauuuuaaccugacauuuaagcuaguuuacaagcucaucuuacuucuugucuucuuuaguaucagauuugguuuuagaagcagcaacuguuuucuguuagugcaaauuuugaaugucuuacauguacagaaaaaccaaaaaaggaugaaucucuacaaauguuaaaucauucaguguaaauaauauuuuauaaaacuuuauuccacaaaaguggggagaguucaaucugcuuuguauagaaugcugauugcugccaaaggcuuuuccccugguucccuccggagacaaagcaccaugaucaccggggcgacuugggcuuucucuuucaguacaugacaugugcucagaagcuuagcucgugugcacaggcuuucccuuuccuuucuggcucccucccucugucuucccuccucuccuccugcccuccccucaccagggguccugggcagcagcuggagcucauggugaaggaagaauucuucacggucagcuggcgaagugccuggugugagcauuguuuauucacaugccucuucuagguguuuuuacauuagaacauugcaucuguuuugggcauguguugggugacagaagcagaauggaaugagaugaacagugacccuuuauccuguuauagcuaacccuugagaaccaagcuuggugucuucaaagggucuguuuagucugaaacaguguggugaauuugggcagaauuguggucauugcauguaggucuccaaaagacagaauaaguugguaauaugguuuaucgacuuuuuacaaaaaaaauuuaaaaaucaugaauuuauaccuuaaaauguccaucccacuucucucccagcuguccagucaccccagcaauggaugacugcuguggaguuccuucuguguccugcugugggcauuguauauaugaagcaaaugaagauagcugccuuuugggugauguuggcauccuaugcacaguggccccuugcuuuuuugcccccaugaauauagcugccaguggcgcuagggcugaaaaaaucagcucuuuacacuugucaugugucuuguuuauguggcugccuucgugaguuucuucuuguuuuugguuugcagcaguuuaaguaucauauaucugagugucauuuaaaaauuuuuaccuggauugguccucugagcuuggaucuaugauuuggugucuguuauuaauuuuggaaauuucuuugcucuuauuuccuuaaauauuauuccuaccccagucuuucuucuccaguuauguuuguguugguucauuucucgcuguucuuuaguucuuagaugcauuauucguuuuuuguugguuuuuuuuuuaauuuuuuuuuuuacgcccccucccuuuuuucuuuuuguguuacauuuuggauaauuucuguugacccaccuuugaguucauggauucuuccuuuggcuguguugagucuacuggugagccaguuuaaggcacucuucaucucugcuacugcguguuucauuccucacauuucccuuugacccuguuucauaguuuccaucucugugcuaguguaucuaucugaucauaaagcuuagucacguuuuccaguugaaccuuuaucauuuuauuauacuugcaguucucuuaaauucccugcuugauaauuccaacaucugggccauaucugagucugcaaauuuugauuacuuuaucucuucagauugugcuuuaucuugccuuugucauacuuccuaagauuuugccuaacgcugggccuuuuuuguaagacaggagaaauggaggcaaguugucuugauaccuggaaauggauagacuugucuuucugcuuggccuuuaguguugaggaguggagucaguccacugaggaggugcacugcauuuggguuuugcucaugugcuuuuucucacagcuucagguuucuguagaacucauuacuuuguuuguagguuggggauguccucccgcuagagcuuuuccucagugucuauuucacacucagcguuuucacauagcaccuuggaguggcucucuucuuuaugccuuuccccacuauacuucuuggauacuuguuacugaacucucgcuaguuuggugguagaaggagagggaagggaagugucuuuucauucuuagggagaaucucagggguggagccuucucugauccugccuugcuucuggcuguaagucugugcccaguauguauuccugccuuuacuaagaguuuuucccuguucucuucacccagccucaucgaguauucauccgugccccauggguagcaggguuuuguugccccuguucaucaguuucaggcugcuguuccauaggaaagguagaaagaaggaugugggcugggcccugagcccuucccacagggcugcuuuucccucccacaagccuacauccagucuucccugaccgcaguguguuuuccuuuuucuuugucuugugaguacacaggaggucugugggucgagccugugaaaugugcugcauucuccuugugucuguagcccagggguucgucuguuccacuggcucauacuuggcuuucugcaaaauuguuaaaauuuuuagcuaaauucuuuuuacugguaucuguuacauuggcccccaacuaaacaaccacuugcaucuuguuucuccuuugaguuuuccauguuuccuuagacuuuuggguuaguugguugccuugcaaccuugcagcucucugaagggucuaagaaaagucaugaaucuacagcuugucaguguuguuguuguuguaggguuggcaguaguauuccuucagcauucuacauacuuaauggaagccgccucccauuuuugguuaauaaauuucaaaacuuggaacaauguuagauuuacaaaaacgucagaaagaacagaguguuccuguuuauucuuuauauagccuuuuuuuuuuuuuuuuuuuuuuugaguuggagucucggucugucacccaggcuggagugcaguggcacgaucuuggcucacugcaaccucugccucacggguucaagcaaucuccugccucagccuccugaguagcugggauuacaggcgugcaccgccaugcccggcuaauuuuuguauuuuuaguagagacaggguuucaccauguuggccaggcuggucucgaacuccugaccucuugauccgcccgccucggccccccacagugcugggauuauaggugugagccaccacgcccagccuucuucaucuagcuuuaacaucuaauguugacaucuuacauaacaugguauauauuugucaaaacuaagaaauaaacauugguaccacacuauuaauuguacuacagauuuuuauucagacuuuaccagguuuuccacuaauguccuuuuucuguucuaaaauacaauccagaauagauacaaauccauucaacuucaguguuuuaaauuauuguuuuucauuauaugaagugcugugugguuuuugucaaaucuguuauuuugguuuuaaucuucaagcuugucuuuguuucuuuaagugauaaaggcauaauuuaaaagguguguuggguuauuucagugccuaaagucuugucugagucacuuguuuucugcuguucuugcuuaugguacuuucuuuccuuguuugcuuuguuaucuuccuuugcugcuggcuguguuugguuaaguuauuuguggaaaucaguugaagccucaggugggagugucuuucuccggagaacauuucuaccuguuuuagcugggccccuuaaggcuccucuagcgugggccccacccaaacgagauucugaguugaaggugaacugagccauucaggcagugcagccaggguugcagaugcacgugagaccugcucaccucucauuuacuuucacccugagaguagagccuuugguguuucguucacuugucugauucucucuucacaguucuauuagaagguccauggguuuugguuucugugcccuucaucuuaugagucuuguaaaucaaaguucuguuuuaugcuuacuucugcuuuacuguguuugcuuaauuucagucuuaacaucuugccaacucuuggguacuuuuaaaauaauguuauauccagcuuuuuaaguuguuuucaguaggaagguugauucaaauaaccuagucugguuaugggcuacgagaauagccucccuguuuuuugugggcaaaauuccagccuuuuauguuccuagcgcaguguggauaacagacuggcagguucaagaggccgugcugagcagcuuucacuguaaggucacugucccaggucggguuucuaagaaucuggaugguuguuucauuucuuaauauguacgcccugugagagcggauacaucuugcucagguucuuaugauucuuuuguuucugaaggugaauuaaguaagugacaugguagaauauguuaagucaacuuucguguggcuuacuaguucucaugaaucuauuccaugauuguaucaguucuuauucgguauuaguauuuaagaaaugcagaauuuuguuucaaaaaauauauuuguauuauaaguugugaagaaauacaucuccauaauuauugcugggacaauacaguauuuucuuaaggaacuuauugguuguggaugcaaaugaagcauauuugugauaaaaauaacuaauagaagucauuuuguuagacuaugagcuaguaaaacuuauggcacaaacauggagacuuaacacuuuuucuuccagcuuucacuuaaguuccuuuucagauaggaggcagccugguggauaagaguauugguuuugaaauuagauucagguuuaaaucccagaucuucuguuuaaucuuuauuuuauuucagguagauuuucuggauaacuugcuauagcuuauacaucaguacuugccacuucaauuuuauguuauggagagacggcuucuuuccuuaaaccucacgaaccaaccucugcuagcuucuaaguuuuuuccugccacuucuuuaccucucucagccuucagagaauuaaagggaguuagggccuugcucuggauuaggauuugcuuuaagggaguguuguggcugguuugauguuuuaucuagagcacucaaacuuucuccauaucagcaauaaggcuguuuugcuuucuaaucauucauguguucagugaaguagcacuuuuaauucucuuuaagaacuuuuccuuugcauccgcaacuuggcuguuuaguggaaaggaccuagcuuuugaccuaccuuggcuuucaacauaccuuccucacuaagccauuucuagcuauugauguaaagugagagacaugcaacucuuccuuucacuggaacgcuuagcagccauuguaggguuauuaauuggccuaauuucaauauuguugugucucagggaauagggaaacccaaggggcgguagagagaaagagagacaggagaacaggccaucauuggagcagucagaacacacacgacauuuaucaauuaaauuugucaucuuauaugggugcaauucauggcacccccaaacaauuacaauaguaacaucagagaucacagaucacaauaacagauauaauaauaugaaauauugugagauuaccgaaauaugacacagagacgugaggugagcacauacuguuggaaaaauggcaccaauagacuugcucgaugcaggguugucauaaaccuucaaugggaaaaaaaugcaauuuccgugaagcucaguaaagcgaagcaugauaaaaugagaugagccugucacuccuaagaauguuccuguacaaguuuuuugcaucuguuacuuaccuuuuccuauuugugaauaguaucuuuuuugaguacguguguuuuuuuauuuuuauacauuuauauguaucuuuugaagaacauacuuuuaagcuuaauuuauugauuuuuuuucucucauaauuuccacuuuuuguauccuauuuaagaaguccuugccaaacuuaagguugcuaagauuuucuccuuuguuuucuucuggaaauuuuagaguuuugcuuuuacauuuaguucuaggauuuauuuauaauuaauguuuucauaugguguaagaucgaaguucauauuuuuuuaauauagguaaccaucacuauagaaaagauuauuuccccccaauguuugaaauaaguagacugaauauagaugggucuguuaucccuagaucaauggagcauuuguucuguuauauugaucuauauauauauauccuuaugccaauaccauacugucuuaauaaugcuugcuuugcaguaaguuuuuaaauaguguaguugucuucuaaauuuguucuuucuuuucaaaguuguuuuggcuauuuuagguuuuuugcauuucugugugaauuauagaauuagcucgacaauuucuacccaaaguuugugggcuuuucauuuugauuguauugaagauauagaugaauuugggaagaauugauauaacaggauugaaucuuuggauucaugaacguagccugcauuuguuuacuuaggucuucuuuauuuaucucaguguguuuuguaguuuaauguacagauuugcacaucuuuugccagauauaucccuaagaauuucaguuuuugauacuauuguagaugacauuuaaaaaaauuucaaguuuuuguuuguugaccuaggcauauauuugacuuuuuaauauacuaaccuugcuaaacuuauuuaucaucuaguaacuuacaaaauauauuccuuaggauuuccuacauaaacaaucaugucauuguuauagaaauaacaguuuuacuuuguccuuuuuaaucuugauggcuuuuauuucuuuuucuugcuaaauuuucuggcuagaccuccuaguacagccuugacuagaacuggugugagggaaauccuuuccauauuccucaucuuuagggaaaagcacucauucuuuuauccauucuuuaguuccuagccccauugcccuuccuaaauuuuuucucaucauuuuccuucaucacaccuuguucuuuuucuuugcaaucauaucaugauauguaacgacauguuuuuauuuaucuguuuaauguauuucuuuuccucacuuguccaugaagggaaggaccauauguguuguuauccuuugugcaguuccuggaacauaauaaguauauaagaaauaguuucugaauuagcugugaaugaauucaugccuuccugcugucugucaauguucuuuuaaauuaaacaucuaagacagcaaauaauaccacaugaguuauuaaccugagaaauaaucguuuuauuuauaaaugacugaguugaaagcugauagcccacaguaauugcuuucauggcuuugaauauaaaccuuacuguuacaaaacacauuuucaugaaaaugaaugugugguguuuggaacuagcuuuaauguuugucuuccuguuuuuccuucuaguugcuauaauauaauaaggaauuuuguauguuuuuccuaauuguacccacuuuucuacauuuucuuaacagaucuggugaaucuucauuauuaaauauaauuauacauauaaauuauuguuuaauaauaauauuaauuauuaaaaauaauauaaauuauuaaauauaaagauacauauaauauuaucuguuaauuucuaaguuagguguggguucugaagacuauuauaugaaugaacaaaaagcuugcauauuugcguggaagcugaaaguacgaaauuuuuagauaccauuauaccaguaucuaaagaaaaaauucaguaccacauagguuuuuaaguaggagcuguaugaucauaggucauccagaugaaggaaggcuucuguaccagacguacagagguagacaguguugucugaguacugucugagaucuggcaagaaugaauccaauaaacguaguuuucucccaugagcuccugucuuguuuccuguauucuguuuguauuugaaaagauuuggugugcauaacuuauuuuugucuuuuggcugucaaucaaaguuauuaguguaguuuuuguaacucaguucucaagcuaggaguuuuugcuguauaauuuuaauguuucuguuuuuacuuuccuaagcagauaagcguaaaaacuuagacuaauugauuacuuauuaaacguccagcuugauauucuucuuuauauuauuuuaguuucaguuuauauaacaaaugagguuucuuauaaauaaaauuuaaaaugcacuaaaggagcugugugaaauaggaauucugugugaagcuuuugaaugugaacauuuagaacguuucacauggugggaauuuacuauaugauuuucaucaaaugagguacuuuuuaguguugguacuuaacgauacugauuucuaaaauuuguauuucuaaaaaugacguauuacaggaucugaaagggcaaaaacucauugaggcuuuguaugagucagcguuucauggccuauuuuuaauuagugaauuauuagcauauaauuagaaauguuuuuagauucuucauggcugaccuaccaaugaauguagcacugcauuuaaaauauaguucacguuauguucauauuuaauuguugcauuuuguuugccccucuugaaacgaaggucacauguaaauaaauauacauuuucuccuacuguaggaaauacucuguuagcauuaguagguuuagcuuuuuuagguuaacaauaacaaaaacaaagcucacacaaaauaaaccaaauuugcucuaugucccacagauguaucuugugauuuuuccagaagguacaagguauaauccagagcaaacaaaaguccuuucagcuagucaggcauuugcugcccaacgugguaaguaaaaauuugaguguuugaacaaauaauuuucaaagauaauaacauuuuuaguuuuucuuccuggaaaagauacuuuuguuuuacaguugaaggaaugaauguauucauuccuugaauuaguguacauauuaucucuuaggaaaugaaguuucuucuccuuaauucacuuucaugcuauuauuacauauaucugagaaauuaaguugaagugcuuguuacgauacauauucuugugccauggauuuauuuaaaaucuaucuaaguacaugauuauguagauggaagcuuuuucuacaguguauggguuauauguaauggagcuucuguuuuguaagaugacagaccuaaguuggaguccaaacucguacuuuuauuagcuguaugguugcaacuuggaaguuguguaauguugcugagcuugcuucuucaucucuuaaaagaacauaugccuuauaaguagaucuaaaucugugugaggauuagauuagaaaauaugucaaguuucuauuggagaaguuacacaaaguugguccacagugcuuggaagcuguuaaugucuucaacaaugguaauguucuuaauauccauauuuuagaaaauugaauaauugguacaccaauaagcuaugcaauuuaaccaaauugggaaguauacagaaaacaguggcuaugcuauguucuuagaggugucuuugaagcuugacugugauuuagugugugaucuccauauguugauagucacucacugagcaaauaccuuguuggugacauuacagcagggccuaugacagugcugucuaauggaacuuucugcaauaaugguaaaguucuucaucuguucuguccagugugcuggcuccuaccaaugugguuuuugagcauucaacaugugacuagugcaugaaacuaauuuuuaauuuuauuuaauuuuaguuuaauuaaaaauaagggggaguuuuuacaaggugcuuacaagagcagauaugucauagguauaugacaucauuuguaacaguacuuuuaaaaaaugccaguuuguuuuuaaacacauguccuauuaaguaaggaguguuucagaauaggaggguucaguuggucuccccaucugccagcucucuuuugacuuucauugcuuccucugucuaauagacaugacguucugucauuucaguugcucuuuugcaaugccauugucucuuuugcccuuuucacauuuauuaaacagaacaaaacaaaaaccacucucgaaucuguagucuaccuuuguuguaagcacuuuuuccaguacucacucugcccucaauuuguuuuggucugauuugaaauucucucccuagacuucuguggggcuguucuccauuauccucccaacucucuggcgauuacuuccuagccuccuuuccagccucuuucugcuucauuucucccugcuacauguguuauuuccagugucagguuuugguguuugauuaauuucacuuuuuguuucucaugguggccuuccucuaaauccauggcuuuagccaucguuuccuugacugcugaugacucgcaaaagcuuccuccccuccaugucucucugccuaacucuggacccauuuguacaauuguccauuagagagcuucgcuugacuggcccaaaaggaugucucaaacucagcauauugaagauagaauuuauccuuccaugcauacacucauauuucuugucuugguaacuccaucauucaguuuuuuugccuaaguuuuauucacaaaaagaacaaauugauagcaguugcauaccucuuauaggaaacuuagacauggaggaagaagcuguucagaugggguccugcagaagugcaggcacugugguaauauuuaaacuuuucucagcuguucgaaggguuuuguuuuaacuaauuuuccuuagacuuguuuuagguauuuggcuuucuaaugguuauaagggauguggaauuaaauguaucuuaaucugccaccuggacccauuaaaguaagccccuauggugguuuuuuuuuuuuaauugccaugguuaaaaccauaguugcuagcgaaggugacauacuuaagcuuuuugaacucucuuaaaagaaaacagaaauuuaaugaugugucuauaauggcaaaccagauaccuagaauuuccauguuauucauagggugaauaacacuggcgauuguagagauuugagaguucuuucaaaacaggagaacaaagggaauaagcuacaaagcaauuuuuuucuuuguagacuuaacugaauaaaaauuauuuuuaugucucaaacaucauaugaacaaauuuaguuggcaaauggcaagcuaauaauauuuuauaauauaggauauuaauauacuuaauauuacaaaagugcuucauaauuagaaaagacauaaacuagaaaaaugggaaaagggcaugaauaagaaauucaagagauacaaaugacccacacacuugaacaaauguuuauucuuucucauaaucaaagaaguagaaauuaaaugaauacuuugaagccaacuucugagaaagcauagcaaacaagaaagcuagugcucagcuuugugugguaacggcacucucgcucuuaagaagguguguuugcucccuguggcugcucucaggcagggccacaaacuugguggcuuaaaacaccacagauuucuucucuuacauuugagaagucugaaaugggucuuacucagcugaaaucaagguguuggcagggcugcaguccuuuguggaggcuuggggggaucuuguucuccuguacgggguccugugcuugguucgggguccugugcuuggucugggauccugugcuugguucgagguccugugcuggguccagugcucugcuuuuaccaccuugaaguucaucuggaaauggcacuggcucgcccacaccauauagcugacucugguucucccuccuccucacucgcucuaaaccuguguuuuuggcugauuucuaaucucucuuuccuuggcccuucugcagcuugcagggccuucugcagcucuugucugccccagccccggggucugcccaucccagugcugggcuguucuguuccugcccugccuuuccucagcccuuggcaacccuguuuguuuucucccuuccuuagcaguggagaacaucguaagaucaaugcugacugccuucugcagccaagccaggccauuucauuucagccgagccaagucuguguggagcaguucuuuuauuuuucuccuuuugacuaccucaugguuuucacggauuuuuguucucuucacauucaaggauuuuuugcuuucagaaaguuauauuucucuggaaagagugcacccaauaucccuuuugauuucaaaaucuuaauguggagucucuugacuuggauuucuuuggaagaaacugcugaagcugccaugucuaagaagaaaacuuuggagaaaaauuuucuucuuagacauggcaacgucaacaguuucuaagcucuugauuccgucuacccugucuccaucguugccucagucaucugccuuacuucucugcagggguuucucccagcuugcaaauguacuccaauucugaaauaacuaagucuauagcugugcaaagagaagucugggccccuugcuuucuuguguuugacuccauccacucuccagaaaugaaucccacuucucacuuaaccacugaccuccaaagcaucguaucauuugugucaguugucauauuuguuaacuuucacauaacuuuugacauuauuuauaccuuuauaaccaggaaauaauuuuaacuuuauuguagaaauaaacaauggaguauaauuuuucuuguugaagauaaauaucaccuccucuuccuuuaaacaucucuucccuuuguuuuuguauuacauugguuuccccccuuuuuuuauuuccuggguugucguauucccuguuauuauuuuuaccuuuuuuuuuuuaauguggauguuuccggagucuguauuucuugccuuuucaucuucugcccuuuauuauucucagccacugccauuacuucaguuauccauucccaugguuuccacaugcuuagcuucgguugauucuugccauuuuacagaccauauuuccaacuacuucuagaauguuuuguuccuucagccucaguaugcccaauuugaacucauguucucucucccccuucuuucuuccuucuuucuuucgcucucucucccuuccuucuuuucuuucccucccucccuuucuuccuucccucacucguucucucuugcuugcuugcuuucucuccucucucucuuuucuuucugcauucuucucccucccucucuuccuucucucccccacuccccaacuuccaggcuaaagcaguccuccugaguaguuaggacuacagacauacacgugccaccgcgcccggcuccguguucucuuuguuucccugccuccugcucuuccacuuaucuuugcauggcaggugggugcacgcaggcaugcucugcaugucuuccucuuggccauuccccuucuaguuaugguguggcuuuaucuacgcguucuggagcagaagccuagucacaaagcuauuuuuuuaaaacauucaugauaauucauuuccuuuuauguuuuaaaaauacuagcuuucugucuuuauuuccuuacuaacuuacuuggaugccaguaauuaguuguuuuagugaacaccacagagugauauuuugaaacuuuggacuucauaaaguuggaugagcuccaguagcaaagaaggaaguguuaacuaguuuaacugacaaauaaaugcuucccagcuuggugugcgauugagauuuuuguugcaaguuugugaaucaauuuaacugccccugcccuggggacuaaagucagauacgugcuugugggaaucuuugucuuucccacaccacccugcauuuuaaaaccucuugugugggacagucccaccauguaauagcuguucuuccuuacucagcuacuuucccuccagagaggccaguagaaaaucuagacuaguuuuuuauagucuauuuucaugucacuuauugagagcuacuguuuucuguuaaauugucaguaaauauuuuaaucaaggaaaagggagguaauaggaaggagagaagaacaaauccuuaacccuaguaggaaccuaaugaaugggauuuguucuggauaauugcaguagucccccagcuaaagaaccuuuuaaaaauaugucagauauacccaagaggauugaaaucguauguucauacaaaagcuuguucaccugcagccuucauaugcaauuccuaugaauguucauagcagcauuauucauaauagccaaaguauggaugcaacccaaauguccaugaagcaauuaauagguaaacaaaaugugaucuguucacacaguggaauacuaacuauucagccauaaaaaggaaugaagcacugaguccugcagccacacagaugaaccucagauccaugcugagcgaaagaagccagaaacaggaggccaugugcugugugacuguauuucuaggaaaucuugagucaccaugggcaagaugcuaucaccuuuguucaguggccagaagcgagggcacuaauauuuacccuugccggggucuacuagauugaagcguuuccgcuaggccauaaacuuccaacacggugacuuguacauguagauauuugaucaauauauagcaaaugaauauugauuuaaacagaaaaaggcaagugagagugcuuucuaaacuuagagcccuaaauauaugagguuguggaauuaauagauucuguuguguguguuugagggaauuuaaaaauaauuuagauguuaaacaguauauuguggagguguuuuguaacuaauuaaugacggcacugaauugacuucuaggccuugcaguauuaaaacaugugcuaacaccacgaauaaaggcaacucacguugcuuuugauugcaugaagaauuauuuagaugcaauuuaugauguuacggugguuuaugaagggaaagacgauggagggcagcgaagagagucaccgaccaugacggguaaguguguucacgcaccugaaaugccuguacacgguauauacagugcacauguuuauguagaauucaguuuuacaaaguagguuaaguguacuuuuuuccuucauuacauuuacccgguauauuuuucaagauguuauuaagauguaacaguggagauuucauuaguccugcaaagugugguauuucuuggcugucgugugaguccuguggacucaccaauuaucauuaauccagccucuuucuacucaaaguucacacuuaaaaggaaagcucuguaaaagggaggaagacgugaagaaggagcacgcccggcaguacugagugcacguuauuagucagugcugcccuuuugcuguauuuuucguaaaauauuuauuaaauuugggugucauugugacaagaagaaaugcaguuaagugugaccuuuuuuuuuccccaaacauguuagguuuuaagaaccuuugagcuauugucagauauaaccagaaaaaaauagaauuuuaagugagcaggauaacuuaguuaaacuaaccaaacauaguguuagcuguuagagaaauguaaacauggaaauaggcaaacagggaaguguguggaguuucuguuuccuuuucaaaauaucuguuugagcugggguugagagagaacacuaggcuucaugggguuuuuuuguuuuucguuuuuuguuuugagacaagaguuucgcucugucgcccaggcuggagugcaguggcgcaaucuuggcucacugcaaccuccgccucccacguucacacgauucuccugccucagccuccugaguagcuggaacuacaugcgugugccaccaugcaugacuaauauuuguauuuuuaguagauaugcgauuucaccuuguuggccaggcuggucucaaacuccuuaccucaggugauccacgcaccucggccucccaaaugagcuuuguguuuuuaccucaucagcuguuugggguugagccacuauguaugucagugugcuuguaucaguaggaucuacugagggcagauguucaaaauaugagccuccagcacguuuuacauggaaacccucaccugaagcauucgucugaaguugaugugccuuggaaauuuuauagaguaauauuuuuaacuacaacaaaacauuuauaaaaguagacauuauuaaagcauucagaagugagcaaggauagaaauuauucugcccaaccuuacacguaggccuucuagacguaguacugugcaccguuacauuaucuaacacugucugugugucaucuuuggauguuagggauuuuuccaaaguucagugagauuauaguugucaaaugauuagucuguuaaauaaugauaagaugagggucacucagguuuuaaaagaaaagcucuuugacugaaagagagagcagcugucuacugcagaaaguuagggagggaggcuggaggagugaggcccaggggcuagcuaguauaaaaauugguuauggucgaaggaaaaaaaaauguaacauauuuauaucugaaagaugauuguucucauaauuguauauaacacagaguaauuguaaaguagaaaacuaagguguuuuucauuuuagauguaaauguuuagaauauguaaugcaucaguuuaaaaauuaaaacuguacgaaaugcacagugaaacgucuuccuugcuuuccacccugcuaccuggccuucccuucuccuuccuagcgauaaccaguuuucuuaauuuguugugcguuguaugugcaaauuuaaguauaucuucuuauucuaccaucccucccuucuuacagaaaaguggcauauuaauauuuuucucuuuuaaacuaucgaaggaguuacuuaccuauuuuugcauuugaaaacagacaguucaucaagauugucguugguuuauuaaacauaguuuaagauuaaacaaguguuuauaaccaaugaaaaacagauagacuccccauaauaaccuuguuuaaaugcugcuacuuuuaucauguccccuccugucuaagaaccccuugguucagcagagcucauggguaaggccagccucuguugccugccaucggaggaaugcguuccagccgugaucucugccuugccuucgcuuccuccugugcugugccgugaagccucggccguggugaagcuggcugacugaguccuccugcaccccaugcauauucaguaguugaaggcuuuguguggccaauccugcuuuccacaggaaaccacccucucuuuuguugcccucauccaaggcuacuguucucccacagugacaggcggcaccuuucccagcauagcacugugccuucuccugccccugcucuugcaguacugcuguggcacugauggcguguguuacagugcuggcacuuagcacagggcucugccuuucucucuucccagccgcaucauaagugccuugaggaagccaaaaccuucugugaguugcauugccuggguuccaaccucccacugcccugcuuauccucugcuacaugugagcugacuguggcuuugggguggucacugccuauguguauucauuacaaauugucuccuuuugaaagauugaccuuucugacuuacccagauaccauaaagaaaauaaaaucuuaucacuucagucaaggauaaaguauuucugaauuaaaggaaaaauacaccagaguaaaaucaagacugaaagacaaacugggaaauuauuuacaaccuagaucauagaaaaggggucauuuccuucuugcguaaagugcacuuacaaauugauaagaagaugacugauaacuagaaagaaaaauggguaaagaacaacaauagacauuucacauuuaaccucauucaugauaagguaagugcaaaugaaaacuacaggggauaccuuuuuuuuuuuuaauccauuagauuggcaaacaucccaagguuugaucauaggcucagugggugagauucaaguauuaucaggcauuuuuauacuuugcuguuaggaaugcaauguaguacaaaccuuuguagaaguugcuuuggaaaugucucucagauguacaaaugcauucacauuuuagauuuagcauucccgcuuucugagacauuauucaacauguauacgugugcacauaagauauaauaauaacacguuuuuccuucuaguguguugcuuuuaaccuguagcuugaaaaaacucugcuuucauuguuuuuuuuuguuuucugucacuggcucagcccugcuuucaauuguuuauaugaauugauggguguucuggucugguuauaaucuacuuuaguuuaagagucacuuuaaauuauaugacaucugauauaaguuguguuagguagaaaauucuguaacuuggaauacuguaaguacuuuguggccacauuucauuaguauuaaauauuaucucuauauauaguaggcuauuuaauauucauauuuuaugaugcaauuaagaaauaauuuuuuucugaaguugguagauuguugauaugccauggcccaguguuucucaaagcauucugggggaucacuguuugucagaauuagcugcagugauuguugaacaugcagggccucugcuccacuccacguugcuaccaggacgcucugcaggugagagcugggaagcuguagaagcugcagugcuaacaaaugcuacaggaauucuuguagucaccuucaugaggucuuauguugaggagaggcagccaguagugucccuuguccuucccguuuuaugguguaaguuucauuuuaagggagguauaaaucaaagcccaccugggcauucucucaugguucacugcuucuuguaaucauggaagaugucauugcggcagagacgaaacaguguaguuugauuacuauugauuuuuuuuuaauuauuuuucugaaguggcuguuguaauguaauaaauugugugcuuaaggacaaccuuugguauucuauuugaguauuguguaugauccuaguuaaguuuuuucuaccaguauuuucauauuacaacauauuuacuuuccauuucuauuaauauuuuuauauuuaaaguauggaggccgggcacaguggcucacgcguguaaucccagcauuuugggaugcugaggcggguggaucacaaggucaggaguucuagaccagcgugaccaacacggugaaaucccaucucuacuaaaaauacaaaaauuagccgggcacagugguaggcaccuguaauuccagcuacucaggaggcugagguaggggaaucacuugaauccgggaggcagcaguugcagugagcuaagaucgugccacuggacucuagccuggcugacagagcaagaauccgccuaaaaaaaaagggaucagggaagaggggauuacagauaacccaaagaagaaggaaaaaucuccacaaguucaccuguccagcgguaaccccaauuuggauauuuuccuuuaacaauuuggauauuuuccuuuaaauccucuuuuuuauaaugucuauauguuggagagaguaugugccuuuacguauuuuuuaaagaugagauuucugugugugucuauaucuccuguucuucauauuuucuuguguguuauaaacagcuguacaugucaguauauauacuuccguaacuuuuuuuuaaaggcuauauaguguucauugaugugauuuaacagcaguuaucuccccggcuucaucuuguuggaauguggguccuguguguugccuucagagcaaauggggcuugguuuugcagcaaguagaccugugaccuguacgaauaguuggaagacuuucucuauuacccaaguguaucaguauacuuuagugccuacuagaaauuuauggguagaaaaacaauaauaucuuagaguauuuuuuccuagauucccuaaggugcuauagggugauuuuuacucauguaacaugaacuauccuucaacuaagauaguuuuugcaaauguggauauauaaguacuuuauuaaaccuauaggaaguauuuauaccacuuauuuccucccuucaguguuagaaccuccuaaauggcauuugacauugaacugcuuuccacuuugucgcaugcuccucucauugucccuaccuggguccugaaccuuagggacuuggcuguuauagccccaccauggcuacgcugggccuuggucgucucugagacuuaguuucuucaucuuacaaggagauaauaacagccccugccugcguagaauugcagagaucaaaugaaauaauuaacauacucaaaagcaugccguaaacacauucugagcacauguacguuuuaggaaaaacaaaaggacccaugcacauuucggagugcuuuugucucagcagcacugccucuucuuccaaagcugacgucuuaguagaggcccugccacguccugagcacuguacuccacgaagcauucuauuucugacauucgaaaugcagucuguuccaucuuccuuacaaucuguaugccagcacuugaaauaccggguaucugcaguguugaccaggugauuacuuaauuauggaaauguugagguggagaucuagauaauucagugaaggcaggaaaauuggugucggaaucugucuuuuuaugugucagaaauagaaauaagauagggugagaaguaauuuguggcuaaaacacuauaauagcuaacacauagugcauacugugugccaagcacuccuguaggugcuugaaaucuucuauuauuauuaucccuacuuuauagacuugcacccuuaggcacagagaggcggacaguuguccaagguuaccccagagguggagauccaggcuaccugacuccaccaugugugcucuucccuagggcacaguugugcugcuaaaaauacuuuuuaagcaguucuuugauuauucagaugauaguacuguaggaaaauuaagacaaaaauaaugaaaaauuaaaaucuuuauuuuaguguuuugcacauguauuauuaaagccaguuuacuccuggaaguguguaagaauacaggguauuuuugaucaccuaaaugcugcauguuacuaagagcucgacacugaagucaagaagagcaguugcagagaguacuuagcaaaaacgggaagugugugggguugaaggagcaaagacaagucuuccucggacgguggaguguagaauucaucauuucucagaacacgucuuugaacgcauuuucaauuugaggccaaaggucucagccucccacucggcauaccucccuaccuuagucagcucuuaaaucuuaggaauauuucuuuguucuucaaggaacuuaaauauguuaacauucuuaccuguccacagggagcccccuacaaagaagggaguuucuagucuccguucuuucuuggaauaaauaauagccucauaccuugugcaaucgaggcugaaaaagacugucuccuuuuuucaaauaagcaagucuuagaaacuacaguuguuuacagggcucauggcuauuccacaguaauaauuuugguucuuuuaccaauuauauaauauguuaaaauauggcaaguaucaggaaagcaaggaguggcaaugauuagaaaccaauggccaaguuagagaggaggggcaauugcucccccaaguuuguuguggcuguguagcagucagugacgagaagcugugugucaggcgacaagcaaaguugaggauuaucaggcgccugugagugcccagcugugugccaggucaggaggugccaucgugagccagaccagcuuccucucggccccuguggagcucgcagucugguggggaggcagcagucaccauggugacaggugacacacuaggauggggcugguggugguaggcauuugcgggucccuucagagaggugaguauggacuuagaggaggcuccagcuuccuauuccugggcugucuauagcacuaaaaguugucacaugaaaaauaacauuugguacuauugauuuaacuuaaugacuuauguaauuguaguugacuuagaaauuauaacaugcucuucuacuucagcuugaaacccccaaccaccaguuuauaauccuuuuuuuuuaacuuuuguuuauuuuuccuaaggaaucuguacuuuuucuucauuuuacaacuuuuuuuguccuguuaccuuauuuucauuuuuacuuuauaugaccaugaguucuaaaauaguaaaaaaaaagaauuauuuuuguucuuuguuagaauuucucugcaaagaauguccaaaaauucauauucacauugaucguaucgacaaaaaagaugucccagaagaacaagaacauaugagaagauggcugcaugaacguuucgaaaucaaagauaagugaguaacaacaguuccagcacuuccggaacuucgguucaacuagauuucaguauagucaacaauuugaaaccaauguaaaugguuauauugucucaagaauacauuuuauaaauucaaaucaaauuuuaugcaugucugaucguguuuuaaacuuuacuuguacaaaucagucuaaaagaacuuguuacagugggcccaucuacuugcauugauaguauuucuuggacaauacuacgugauaacauagcaaauuaaauuaaaaacaacaacaaacacacaaaaaaacuuuccagugucagaugcccggaccuaccugucaggucacauaaagugguguuacugugugaggucuggcuguugggccagugugcgcagaaaagcaagggagggguagaggacuaugcggacgugcagguggacaugaugcuguuauauuuguuggaaauagaagggggcaguugacagcguuauauccaaagugucuucugugguuaauuauauucagaaauuuuagccaauuguuuuauucucuaaauauguacuuucugcucaagaaacuaucauuguucuucuuuuccuuguuuuacaguacaguguuuuuaauuaacccuccuggguuaacuuuaccaggugaaaaugauuaaaaguguaauagguuaacaaugaaacuuuaagcuucuauuuuucauugacucuuaacuguacaugauguaauguauucagcgagccauucaggaccacuuuggcccauggaagaaauuuaaaaguaagaucuacauguauugacaugaaaauauguucucagaaaaaagacuaauguauuuaauguccuacuuauuuuauaaguauuuagaauaccucuggacauuuuaaaacaaugauuauugcuagggugugugauuuauaaagcaauagaagcgcuuucccuuucuguuuguguuuuagauuauuauaucggguauguucugcuaucauaacuuuacaaaucuuauguaauaugggaaaaugaguuaacuaugcuguuuuccuucuuuuaccugccuuucuaauucugugggaauaaaggcguuuuugagacagcccaggugcagugagcaguccauauccauggauuccacauucauggauuccaccaagcacagaccaaaaauacucagaaaaaaagggggcuggcugugguggcucaugcauguaaucccagcacuuugggaggcuaaggcaggcaaauugcuugagcccagaaguucaagacagccugggcaacauggcaaaacccugucucuacagaaaauacaaaaauuagccaggcgugcaccuguagucccagcuacucaggaggccgaggugcgaggaucaccugagccuggaagguugagacugcagugagcuaucauugugccaacuccagccugguaacagagugccuuuuuucaaaaaaaaaaaaaaaaaaggauuugggaggauaugcauauguuauauucaaauacaugccauuuuauucauauaucagggacuugagcauccuuugaucuuggucucugccggguauccugggaccagcccccugucgauacagagggaccgcugucuaagaaccgcugguccuaucuuugacuucuggcggaauaggagcuccauguaaaaaggaggagaagcugcagcggguuauuagccauuugugagucaggucacuguaaaacuuuaucaaaaguuuaaaagacaaaaagcauccucauaaaaugccuuaaaaccaccuguugaaauauuacauauacaauucauguauacuaaucauagagcauauuaaagauauuuuagaagacuagaaacuucuauuaaaccaaguuucuggauguuuccguauucauccuuauuuuccagggaccugcauaacuuuuccagcguguaauagcuaccugauugauauuuuuugaauugaaauacugaagugacuaaaaucuaaacuuuuuccauucuggccauaggaugcuuauagaauuuuaugagucaccagauccagaaagaagaaaaagauuuccugggaaaaguguuaauuccaaauuaaguaucaagaagacuuuaccaucaauguugaucuuaagugguuugacugcaggcaugcuuaugaccgaugcuggaaggaagcuguaugugaacaccuggauauauggaacccuacuuggcugccuguggguuacuauuaaagcauagacaaguagcugucuccagacagugggaugugcuacauugucuauuuuuggcggcugcacaugacaucaaauuguuuccugaauuuauuaaggaguguaaauaaagccuuguugauugaagauuggauaauagaauuugugacgaaagcugauaugcaauggucuugggcaaacauaccugguuguacaacuuuagcaucggggcugcuggaaggguaaaagcuaaauggaguuucuccugcucuguccauuuccuaugaacuaaugacaacuugagaaggcugggaggauuguguauuuugcaagucagauggcugcauuuuugagcauuaauuugcagcguauuucacuuuuucuguuauuuucaauuuauuacaacuugacagcuccaagcucuuauuacuaaaguauuuaguaucuugcagcuaguuaauauuucaucuuuugcuuauuucuacaagucagugaaauaaauuguauuuaggaagugucaggauguucaaaggaaaggguaaaaaguguucauggggaaaaagcucuguuuagcacaugauuuuauuguauugcguuauuagcugauuuuacucauuuuauauuugcaaaauaaauuucuaauauuuauugaaauugcuuaauuugcacacccuguacacacagaaaaugguauaaaauaugagaacgaaguuuaaaauugugacucugauucauuauagcagaacuuuaaauuucccagcuuuuugaagauuuaagcuacacuauuaguacuucccuuugucugugccauaagugcuugaaaacguuaagguuuucuguuuuguuuuguuuuuuuaauaucaaaagagucggugugaaccuugguuggaccccaaguucacaagauuuuuaaggugaugagagccugcagacauucugccuagauuuacuagcgugugccuuuugccugcuucucuuugauuucacagaauauucauucagaagucgcguuucuguagugugguggauucccacugggcucugguccuucccuuggaucccgucaguggugcugcucagcggcuugcacgcagacuugcuaggaagaaaugcagagccagccugugcugcccacuuucagaguugaacucuuuaagcccuugugagugggcuucaccagcuacugcagaggcauuuugcauuugucugugucaagaaguucaccuucucaagccagugaaauacagacuuaauuugucaugacugaacgaauuuguuuauuucccauuagguuuaguggagcuacacauuaauauguaucgccuuagagcaagagcuguguuccaggaaccagaucacgauuuuuagccauggaacaauauaucccaugggagaagaccuuucagugugaacuguucuauuuuuguguuauaauuuaaacuucgauuuccucauaguccuuuaaguugacauuucugcuuacugcuacuggauuuuugcugcagaaauauaucaguggcccacauuaaacauaccaguuggaucaugauaagcaaaaugaaagaaauaaugauuaagggaaaauuaagugacuguguuacacugcuucucccaugccagagaauaaacucuuucaagcaucaucuuugaagagucguguggugugaauugguuuguguacauuagaauguaugcacacauccauggacacucaggauauaguuggccuaauaaucggggcauggguaaaacuuaugaaaauuuccucaugcugaauuguaauuuucucuuaccuguaaaguaaaauuuagaucaauuccaugucuuuguuaaguacagggauuuaauauauuuugaauauaauggguauguucuaaauuugaacuuugagaggcaauacuguuggaauuauguggauucuaacucauuuuaacaagguagccugaccugcauaagaucacuugaauguuagguuucauagaacuauacuaaucuucucacaaaaggucuauaaaauacagucguugaaaaaaauuuuguaucaaaauguuuggaaaauuagaagcuucuccuuaaccuguauugauacugacuugaauuauuuucuaaaauuaagagccguauaccuaccuguaagucuuuucacauaucauuuaaacuuuuguuuguauuauuacugauuuacagcuuaguuauuaauuuuucuuuauaagaaugccgucgaugugcaugcuuuuauguuuuucagaaaaggguguguuuggaugaaaguaaaaaaaaaaauaaaaucuuucacugucucuaauggcugugcuguuuaacauuuuuugacccuaaaauucaccaacagucucccaguacauaaaauaggcuuaaugacuggcccugcauucuucacaauauuuuucccuaagcuuugagcaaaguuuuaaaaaaauacacuaaaauaaucaaaacuguuaagcaguauauuaguuugguuauauaaauucaucugcaauuuauaagaugcauggccgauguuaauuugcuuggcaauucuguaaucauuaagugaucucagugaaacaugucaaaugccuuaaauuaacuaaguuggugaauaaaagugccgaucuggcuaacucuuacaccauacauacugauaguuuuucauauguuucauuuccaugugauuuuuaaaauuuagaguggcaacaauuuugcuuaauauggguuacauaagcuuuauuuuuuccuuuguucauaauuauauucuuugaauaggucugugucaaucaagugaucuaacuagacugaucauagauagaaggaaauaaggccaaguucaagaccagccugggcaacauaucgagaaccugucuacaaaaaaauuaaaaaaaauuagccaggcaugguggcguacacugaguaguuugucccagcuacucgggagggugaggugggaggaucgcuucagcccaggagguugagauugcagugagccauggacauaccacugcacuacagccuagguaacagcacgagaccccaacucuuagaaaaugaaaaggaaauauagaaauauaaaauuugcuuauuauagacacacaguaacucccagauauguaccacaaaaaaugugaaaagagagagaaaugucuaccaaagcaguauuuuguguguauaauugcaagcgcauaguaaaauaauuuuaaccuuaauuuguuuuuaguaguguuuagauugaagauugagugaaauauuuucuuggcagauauuccguaucugguggaaagcuacaaugcaaugucguuguaguuuugcauggcuugcuuuauaaacaagauuuuuucucccuccuuuugggccaguuuucauuacgaguaacucacacuuuuugauuaaagaacuugaaauuacguuaucacuuaguauaauugacauuauauagagacuauguaacaugcaaucauuagaaucaaaauuaguacuuuggucaaaauauuuacaacauucacauacuugucaaauauucauguaauuaacugaauuuaaaaccuucaacuauuaugaagugcucgucuguacaaucgcuaauuuacucaguuuagaguagcuacaacucuucgauacuaucaucaauauuugacaucuuuuccaauuuguguaugaaaaguaaaucuauuccuguagcaacuggggagucauauaugaggucaaagacauauaccuuguuauuauaauauguauacuauaauaauagcugguuauccugagcaggggaaaagguuauuuuuaggaaaaccacuucaaauagaaagcugaaguacuucuaauauacugagggaaguauaauauguggaacaaacucucaacaaaauguuuauugauguugaugaaacagaucaguuuuuccauccggauuauuauugguucaugauuuuauaugugaauauguaagauauguucugcaauuuuauaaauguucaugucuuuuuuuaaaaaaggugcuauugaaauucugugucuccagcaggcaagaauacuugacuaacucuuuuugucucuuuaugguauuuucagaauaaagucugacuuguguuuuugagauuauuggugccucauuaauucagcaauaaaggaaaauaugcaucucaa

SEQ ID NO: 191845 - RNA, 53144 nt, Homo sapiens
uugagaugcauauuuuccuuuauugcugaauuaaugaggcaccaauaaucucaaaaacacaagucagacuuuauucugaaaauaccauaaagagacaaaaagaguuagucaaguauucuugccugcuggagacacagaauuucaauagcaccuuuuuuaaaaaaagacaugaacauuuauaaaauugcagaacauaucuuacauauucacauauaaaaucaugaaccaauaauaauccggauggaaaaacugaucuguuucaucaacaucaauaaacauuuuguugagaguuuguuccacauauuauacuucccucaguauauuagaaguacuucagcuuucuauuugaagugguuuuccuaaaaauaaccuuuuccccugcucaggauaaccagcuauuauuauaguauacauauuauaauaacaagguauaugucuuugaccucauauaugacuccccaguugcuacaggaauagauuuacuuuucauacacaaauuggaaaagaugucaaauauugaugauaguaucgaagaguuguagcuacucuaaacugaguaaauuagcgauuguacagacgagcacuucauaauaguugaagguuuuaaauucaguuaauuacaugaauauuugacaaguaugugaauguuguaaauauuuugaccaaaguacuaauuuugauucuaaugauugcauguuacauagucucuauauaaugucaauuauacuaagugauaacguaauuucaaguucuuuaaucaaaaagugugaguuacucguaaugaaaacuggcccaaaaggagggagaaaaaaucuuguuuauaaagcaagccaugcaaaacuacaacgacauugcauuguagcuuuccaccagauacggaauaucugccaagaaaauauuucacucaaucuucaaucuaaacacuacuaaaaacaaauuaagguuaaaauuauuuuacuaugcgcuugcaauuauacacacaaaauacugcuuugguagacauuucucucucuuuucacauuuuuugugguacauaucugggaguuacugugugucuauaauaagcaaauuuuauauuucuauauuuccuuuucauuuucuaagaguuggggucucgugcuguuaccuaggcuguagugcagugguauguccauggcucacugcaaucucaaccuccugggcugaagcgauccucccaccucacccucccgaguagcugggacaaacuacucaguguacgccaccaugccuggcuaauuuuuuuuaauuuuuuuguagacagguucucgauauguugcccaggcuggucuugaacuuggccuuauuuccuucuaucuaugaucagucuaguuagaucacuugauugacacagaccuauucaaagaauauaauuaugaacaaaggaaaaaauaaagcuuauguaacccauauuaagcaaaauuguugccacucuaaauuuuaaaaaucacauggaaaugaaacauaugaaaaacuaucaguauguaugguguaagaguuagccagaucggcacuuuuauucaccaacuuaguuaauuuaaggcauuugacauguuucacugagaucacuuaaugauuacagaauugccaagcaaauuaacaucggccaugcaucuuauaaauugcagaugaauuuauauaaccaaacuaauauacugcuuaacaguuuugauuauuuuaguguauuuuuuuaaaacuuugcucaaagcuuagggaaaaauauugugaagaaugcagggccagucauuaagccuauuuuauguacugggagacuguuggugaauuuuagggucaaaaaauguuaaacagcacagccauuagagacagugaaagauuuuauuuuuuuuuuuacuuucauccaaacacacccuuuucugaaaaacauaaaagcaugcacaucgacggcauucuuauaaagaaaaauuaauaacuaagcuguaaaucaguaauaauacaaacaaaaguuuaaaugauaugugaaaagacuuacagguagguauacggcucuuaauuuuagaaaauaauucaagucaguaucaauacagguuaaggagaagcuucuaauuuuccaaacauuuugauacaaaauuuuuuucaacgacuguauuuuauagaccuuuugugagaagauuaguauaguucuaugaaaccuaacauucaagugaucuuaugcaggucaggcuaccuuguuaaaaugaguuagaauccacauaauuccaacaguauugccucucaaaguucaaauuuagaacauacccauuauauucaaaauauauuaaaucccuguacuuaacaaagacauggaauugaucuaaauuuuacuuuacagguaagagaaaauuacaauucagcaugaggaaauuuucauaaguuuuacccaugccccgauuauuaggccaacuauauccugaguguccauggaugugugcauacauucuaauguacacaaaccaauucacaccacacgacucuucaaagaugaugcuugaaagaguuuauucucuggcaugggagaagcaguguaacacagucacuuaauuuucccuuaaucauuauuucuuucauuuugcuuaucaugauccaacugguauguuuaaugugggccacugauauauuucugcagcaaaaauccaguagcaguaagcagaaaugucaacuuaaaggacuaugaggaaaucgaaguuuaaauuauaacacaaaaauagaacaguucacacugaaaggucuucucccaugggauauauuguuccauggcuaaaaaucgugaucugguuccuggaacacagcucuugcucuaaggcgauacauauuaauguguagcuccacuaaaccuaaugggaaauaaacaaauucguucagucaugacaaauuaagucuguauuucacuggcuugagaaggugaacuucuugacacagacaaaugcaaaaugccucugcaguagcuggugaagcccacucacaagggcuuaaagaguucaacucugaaagugggcagcacaggcuggcucugcauuucuuccuagcaagucugcgugcaagccgcugagcagcaccacugacgggauccaagggaaggaccagagcccagugggaauccaccacacuacagaaacgcgacuucugaaugaauauucugugaaaucaaagagaagcaggcaaaaggcacacgcuaguaaaucuaggcagaaugucugcaggcucucaucaccuuaaaaaucuugugaacuugggguccaaccaagguucacaccgacucuuuugauauuaaaaaaacaaaacaaaacagaaaaccuuaacguuuucaagcacuuauggcacagacaaagggaaguacuaauaguguagcuuaaaucuucaaaaagcugggaaauuuaaaguucugcuauaaugaaucagagucacaauuuuaaacuucguucucauauuuuauaccauuuucuguguguacagggugugcaaauuaagcaauuucaauaaauauuagaaauuuauuuugcaaauauaaaaugaguaaaaucagcuaauaacgcaauacaauaaaaucaugugcuaaacagagcuuuuuccccaugaacacuuuuuacccuuuccuuugaacauccugacacuuccuaaauacaauuuauuucacugacuuguagaaauaagcaaaagaugaaauauuaacuagcugcaagauacuaaauacuuuaguaauaagagcuuggagcugucaaguuguaauaaauugaaaauaacagaaaaagugaaauacgcugcaaauuaaugcucaaaaaugcagccaucugacuugcaaaauacacaauccucccagccuucucaaguugucauuaguucauaggaaauggacagagcaggagaaacuccauuuagcuuuuacccuuccagcagccccgaugcuaaaguuguacaaccagguauguuugcccaagaccauugcauaucagcuuucgucacaaauucuauuauccaaucuucaaucaacaaggcuuuauuuacacuccuuaauaaauucaggaaacaauuugaugucaugugcagccgccaaaaauagacaauguagcacaucccacugucuggagacagcuacuugucuaugcuuuaauaguaacccacaggcagccaaguaggguuccauauauccagguguucacauacagcuuccuuccagcaucggucauaagcaugccugcagucaaaccacuuaagaucaacauugaugguaaagucuucuugauacuuaauuuggaauuaacacuuuucccaggaaaucuuuuucuucuuucuggaucuggugacucauaaaauucuauaagcauccuauggccagaauggaaaaaguuuagauuuuagucacuucaguauuucaauucaaaaaauaucaaucagguagcuauuacacgcuggaaaaguuaugcaggucccuggaaaauaaggaugaauacggaaacauccagaaacuugguuuaauagaaguuucuagucuucuaaaauaucuuuaauaugcucuaugauuaguauacaugaauuguauauguaauauuucaacaggugguuuuaaggcauuuuaugaggaugcuuuuugucuuuuaaacuuuugauaaaguuuuacagugaccugacucacaaauggcuaauaacccgcugcagcuucuccuccuuuuuacauggagcuccuauuccgccagaagucaaagauaggaccagcgguucuuagacagcggucccucuguaucgacagggggcuggucccaggauacccggcagagaccaagaucaaaggaugcucaagucccugauauaugaauaaaauggcauguauuugaauauaacauaugcauauccucccaaauccuuuuuuuuuuuuuuuuuugaaaaaaggcacucuguuaccaggcuggaguuggcacaaugauagcucacugcagucucaaccuuccaggcucaggugauccucgcaccucggccuccugaguagcugggacuacaggugcacgccuggcuaauuuuuguauuuucuguagagacaggguuuugccauguugcccaggcugucuugaacuucugggcucaagcaauuugccugccuuagccucccaaagugcugggauuacaugcaugagccaccacagccagcccccuuuuuuucugaguauuuuuggucugugcuugguggaauccaugaauguggaauccauggauauggacugcucacugcaccugggcugucucaaaaacgccuuuauucccacagaauuagaaaggcagguaaaagaaggaaaacagcauaguuaacucauuuucccauauuacauaagauuuguaaaguuaugauagcagaacauacccgauauaauaaucuaaaacacaaacagaaagggaaagcgcuucuauugcuuuauaaaucacacacccuagcaauaaucauuguuuuaaaauguccagagguauucuaaauacuuauaaaauaaguaggacauuaaauacauuagucuuuuuucugagaacauauuuucaugucaauacauguagaucuuacuuuuaaauuucuuccaugggccaaagugguccugaauggcucgcugaauacauuacaucauguacaguuaagagucaaugaaaaauagaagcuuaaaguuucauuguuaaccuauuacacuuuuaaucauuuucaccugguaaaguuaacccaggaggguuaauuaaaaacacuguacuguaaaacaaggaaaagaagaacaaugauaguuucuugagcagaaaguacauauuuagagaauaaaacaauuggcuaaaauuucugaauauaauuaaccacagaagacacuuuggauauaacgcugucaacugcccccuucuauuuccaacaaauauaacagcaucauguccaccugcacguccgcauaguccucuaccccucccuugcuuuucugcgcacacuggcccaacagccagaccucacacaguaacaccacuuuaugugaccugacagguagguccgggcaucugacacuggaaaguuuuuuuguguguuuguuguuguuuuuaauuuaauuugcuauguuaucacguaguauuguccaagaaauacuaucaaugcaaguagaugggcccacuguaacaaguucuuuuagacugauuuguacaaguaaaguuuaaaacacgaucagacaugcauaaaauuugauuugaauuuauaaaauguauucuugagacaauauaaccauuuacauugguuucaaauuguugacuauacugaaaucuaguugaaccgaaguuccggaagugcuggaacuguuguuacucacuuaucuuugauuucgaaacguucaugcagccaucuucucauauguucuuguucuucugggacaucuuuuuugucgauacgaucaaugugaauaugaauuuuuggacauucuuugcagagaaauucuaacaaagaacaaaaauaauucuuuuuuuuuacuauuuuagaacucauggucauauaaaguaaaaaugaaaauaagguaacaggacaaaaaaaguuguaaaaugaagaaaaaguacagauuccuuaggaaaaauaaacaaaaguuaaaaaaaaaggauuauaaacuggugguuggggguuucaagcugaaguagaagagcauguuauaauuucuaagucaacuacaauuacauaagucauuaaguuaaaucaauaguaccaaauguuauuuuucaugugacaacuuuuagugcuauagacagcccaggaauaggaagcuggagccuccucuaaguccauacucaccucucugaagggacccgcaaaugccuaccaccaccagccccauccuagugugucaccugucaccauggugacugcugccuccccaccagacugcgagcuccacaggggccgagaggaagcuggucuggcucacgauggcaccuccugaccuggcacacagcugggcacucacaggcgccugauaauccucaacuuugcuugucgccugacacacagcuucucgucacugacugcuacacagccacaacaaacuugggggagcaauugccccuccucucuaacuuggccauugguuucuaaucauugccacuccuugcuuuccugauacuugccauauuuuaacauauuauauaauugguaaaagaaccaaaauuauuacuguggaauagccaugagcccuguaaacaacuguaguuucuaagacuugcuuauuugaaaaaaggagacagucuuuuucagccucgauugcacaagguaugaggcuauuauuuauuccaagaaagaacggagacuagaaacucccuucuuuguagggggcucccuguggacagguaagaauguuaacauauuuaaguuccuugaagaacaaagaaauauuccuaagauuuaagagcugacuaagguagggagguaugccgagugggaggcugagaccuuuggccucaaauugaaaaugcguucaaagacguguucugagaaaugaugaauucuacacuccaccguccgaggaagacuugucuuugcuccuucaaccccacacacuucccguuuuugcuaaguacucucugcaacugcucuucuugacuucagugucgagcucuuaguaacaugcagcauuuaggugaucaaaaauacccuguauucuuacacacuuccaggaguaaacuggcuuuaauaauacaugugcaaaacacuaaaauaaagauuuuaauuuuucauuauuuuugucuuaauuuuccuacaguacuaucaucugaauaaucaaagaacugcuuaaaaaguauuuuuagcagcacaacugugcccuagggaagagcacacaugguggagucagguagccuggaucuccaccucugggguaaccuuggacaacuguccgccucucugugccuaagggugcaagucuauaaaguagggauaauaauaauagaagauuucaagcaccuacaggagugcuuggcacacaguaugcacuauguguuagcuauuauaguguuuuagccacaaauuacuucucacccuaucuuauuucuauuucugacacauaaaaagacagauuccgacaccaauuuuccugccuucacugaauuaucuagaucuccaccucaacauuuccauaauuaaguaaucaccuggucaacacugcagauacccgguauuucaagugcuggcauacagauuguaaggaagauggaacagacugcauuucgaaugucagaaauagaaugcuucguggaguacagugcucaggacguggcagggccucuacuaagacgucagcuuuggaagaagaggcagugcugcugagacaaaagcacuccgaaaugugcauggguccuuuuguuuuuccuaaaacguacaugugcucagaauguguuuacggcaugcuuuugaguauguuaauuauuucauuugaucucugcaauucuacgcaggcaggggcuguuauuaucuccuuguaagaugaagaaacuaagucucagagacgaccaaggcccagcguagccaugguggggcuauaacagccaagucccuaagguucaggacccagguagggacaaugagaggagcaugcgacaaaguggaaagcaguucaaugucaaaugccauuuaggagguucuaacacugaagggaggaaauaagugguauaaauacuuccuauagguuuaauaaaguacuuauauauccacauuugcaaaaacuaucuuaguugaaggauaguucauguuacaugaguaaaaaucacccuauagcaccuuagggaaucuaggaaaaaauacucuaagauauuauuguuuuucuacccauaaauuucuaguaggcacuaaaguauacugauacacuuggguaauagagaaagucuuccaacuauucguacaggucacaggucuacuugcugcaaaaccaagccccauuugcucugaaggcaacacacaggacccacauuccaacaagaugaagccggggagauaacugcuguuaaaucacaucaaugaacacuauauagccuuuaaaaaaaaguuacggaaguauauauacugacauguacagcuguuuauaacacacaagaaaauaugaagaacaggagauauagacacacacagaaaucucaucuuuaaaaaauacguaaaggcacauacucucuccaacauauagacauuauaaaaaagaggauuuaaaggaaaauauccaaauuguuaaaggaaaauauccaaauugggguuaccgcuggacaggugaacuuguggagauuuuuccuucuucuuuggguuaucuguaauccccucuucccugaucccuuuuuuuuuaggcggauucuugcucugucagccaggcuagaguccaguggcacgaucuuagcucacugcaacugcugccucccggauucaagugauuccccuaccucagccuccugaguagcuggaauuacaggugccuaccacugugcccggcuaauuuuuguauuuuuaguagagaugggauuucaccguguuggucacgcuggucuagaacuccugaccuugugauccacccgccucagcaucccaaaaugcugggauuacacgcgugagccacugugcccggccuccauacuuuaaauauaaaaauauuaauagaaauggaaaguaaauauguuguaauaugaaaauacugguagaaaaaacuuaacuaggaucauacacaauacucaaauagaauaccaaagguuguccuuaagcacacaauuuauuacauuacaacagccacuucagaaaaauaauuaaaaaaaaaucaauaguaaucaaacuacacuguuucgucucugccgcaaugacaucuuccaugauuacaagaagcagugaaccaugagagaaugcccaggugggcuuugauuuauaccucccuuaaaaugaaacuuacaccauaaaacgggaaggacaagggacacuacuggcugccucuccucaacauaagaccucaugaaggugacuacaagaauuccuguagcauuuguuagcacugcagcuucuacagcuucccagcucucaccugcagagcguccugguagcaacguggaguggagcagaggcccugcauguucaacaaucacugcagcuaauucugacaaacagugaucccccagaaugcuuugagaaacacugggccauggcauaucaacaaucuaccaacuucagaaaaaaauuauuucuuaauugcaucauaaaauaugaauauuaaauagccuacuauauauagagauaauauuuaauacuaaugaaauguggccacaaaguacuuacaguauuccaaguuacagaauuuucuaccuaacacaacuuauaucagaugucauauaauuuaaagugacucuuaaacuaaaguagauuauaaccagaccagaacacccaucaauucauauaaacaauugaaagcagggcugagccagugacagaaaacaaaaaaaaacaaugaaagcagaguuuuuucaagcuacagguuaaaagcaacacacuagaaggaaaaacguguuauuauuauaucuuaugugcacacguauacauguugaauaaugucucagaaagcgggaaugcuaaaucuaaaaugugaaugcauuuguacaucugagagacauuuccaaagcaacuucuacaaagguuuguacuacauugcauuccuaacagcaaaguauaaaaaugccugauaauacuugaaucucacccacugagccuaugaucaaaccuugggauguuugccaaucuaauggauuaaaaaaaaaaaagguauccccuguaguuuucauuugcacuuaccuuaucaugaaugagguuaaaugugaaaugucuauuguuguucuuuacccauuuuucuuucuaguuaucagucaucuucuuaucaauuuguaagugcacuuuacgcaagaaggaaaugaccccuuuucuaugaucuagguuguaaauaauuucccaguuugucuuucagucuugauuuuacucugguguauuuuuccuuuaauucagaaauacuuuauccuugacugaagugauaagauuuuauuuucuuuaugguaucuggguaagucagaaaggucaaucuuucaaaaggagacaauuuguaaugaauacacauaggcagugaccaccccaaagccacagucagcucacauguagcagaggauaagcagggcagugggagguuggaacccaggcaaugcaacucacagaagguuuuggcuuccucaaggcacuuaugaugcggcugggaagagagaaaggcagagcccugugcuaagugccagcacuguaacacacgccaucagugccacagcaguacugcaagagcaggggcaggagaaggcacagugcuaugcugggaaaggugccgccugucacugugggagaacaguagccuuggaugagggcaacaaaagagagggugguuuccuguggaaagcaggauuggccacacaaagccuucaacuacugaauaugcauggggugcaggaggacucagucagccagcuucaccacggccgaggcuucacggcacagcacaggaggaagcgaaggcaaggcagagaucacggcuggaacgcauuccuccgauggcaggcaacagaggcuggccuuacccaugagcucugcugaaccaagggguucuuagacaggaggggacaugauaaaaguagcagcauuuaaacaagguuauuauggggagucuaucuguuuuucauugguuauaaacacuuguuuaaucuuaaacuauguuuaauaaaccaacgacaaucuugaugaacugucuguuuucaaaugcaaaaauagguaaguaacuccuucgauaguuuaaaagagaaaaauauuaauaugccacuuuucuguaagaagggagggaugguagaauaagaagauauacuuaaauuugcacauacaacgcacaacaaauuaagaaaacugguuaucgcuaggaaggagaagggaaggccagguagcaggguggaaagcaaggaagacguuucacugugcauuucguacaguuuuaauuuuuaaacugaugcauuacauauucuaaacauuuacaucuaaaaugaaaaacaccuuaguuuucuacuuuacaauuacucuguguuauauacaauuaugagaacaaucaucuuucagauauaaauauguuacauuuuuuuuuccuucgaccauaaccaauuuuuauacuagcuagccccugggccucacuccuccagccucccucccuaacuuucugcaguagacagcugcucucucuuucagucaaagagcuuuucuuuuaaaaccugagugacccucaucuuaucauuauuuaacagacuaaucauuugacaacuauaaucucacugaacuuuggaaaaaucccuaacauccaaagaugacacacagacaguguuagauaauguaacggugcacaguacuacgucuagaaggccuacguguaagguugggcagaauaauuucuauccuugcucacuucugaaugcuuuaauaaugucuacuuuuauaaauguuuuguuguaguuaaaaauauuacucuauaaaauuuccaaggcacaucaacuucagacgaaugcuucaggugaggguuuccauguaaaacgugcuggaggcucauauuuugaacaucugcccucaguagauccuacugauacaagcacacugacauacauaguggcucaaccccaaacagcugaugagguaaaaacacaaagcucauuugggaggccgaggugcguggaucaccugagguaaggaguuugagaccagccuggccaacaaggugaaaucgcauaucuacuaaaaauacaaauauuagucaugcaugguggcacacgcauguaguuccagcuacucaggaggcugaggcaggagaaucgugugaacgugggaggcggagguugcagugagccaagauugcgccacugcacuccagccugggcgacagagcgaaacucuugucucaaaacaaaaaacgaaaaacaaaaaaaccccaugaagccuaguguucucucucaaccccagcucaaacagauauuuugaaaaggaaacagaaacuccacacacuucccuguuugccuauuuccauguuuacauuucucuaacagcuaacacuauguuugguuaguuuaacuaaguuauccugcucacuuaaaauucuauuuuuuucugguuauaucugacaauagcucaaagguucuuaaaaccuaacauguuuggggaaaaaaaaaggucacacuuaacugcauuucuucuugucacaaugacacccaaauuuaauaaauauuuuacgaaaaauacagcaaaagggcagcacugacuaauaacgugcacucaguacugccgggcgugcuccuucuucacgucuuccucccuuuuacagagcuuuccuuuuaagugugaacuuugaguagaaagaggcuggauuaaugauaauuggugaguccacaggacucacacgacagccaagaaauaccacacuuugcaggacuaaugaaaucuccacuguuacaucuuaauaacaucuugaaaaauauaccggguaaauguaaugaaggaaaaaaguacacuuaaccuacuuuguaaaacugaauucuacauaaacaugugcacuguauauaccguguacaggcauuucaggugcgugaacacacuuacccgucauggucggugacucucuucgcugcccuccaucgucuuucccuucauaaaccaccguaacaucauaaauugcaucuaaauaauucuucaugcaaucaaaagcaacgugaguugccuuuauucgugguguuagcacauguuuuaauacugcaaggccuagaagucaauucagugccgucauuaauuaguuacaaaacaccuccacaauauacuguuuaacaucuaaauuauuuuuaaauucccucaaacacacacaacagaaucuauuaauuccacaaccucauauauuuagggcucuaaguuuagaaagcacucucacuugccuuuuucuguuuaaaucaauauucauuugcuauauauugaucaaauaucuacauguacaagucaccguguuggaaguuuauggccuagcggaaacgcuucaaucuaguagaccccggcaaggguaaauauuagugcccucgcuucuggccacugaacaaaggugauagcaucuugcccauggugacucaagauuuccuagaaauacagucacacagcacauggccuccuguuucuggcuucuuucgcucagcauggaucugagguucaucuguguggcugcaggacucagugcuucauuccuuuuuauggcugaauaguuaguauuccacugugugaacagaucacauuuuguuuaccuauuaauugcuucauggacauuuggguugcauccauacuuuggcuauuaugaauaaugcugcuaugaacauucauaggaauugcauaugaaggcugcaggugaacaagcuuuuguaugaacauacgauuucaauccucuuggguauaucugacauauuuuuaaaagguucuuuagcugggggacuacugcaauuauccagaacaaaucccauucauuagguuccuacuaggguuaaggauuuguucuucucuccuuccuauuaccucccuuuuccuugauuaaaauauuuacugacaauuuaacagaaaacaguagcucucaauaagugacaugaaaauagacuauaaaaaacuagucuagauuuucuacuggccucucuggagggaaaguagcugaguaaggaagaacagcuauuacauggugggacugucccacacaagagguuuuaaaaugcaggguggugugggaaagacaaagauucccacaagcacguaucugacuuuaguccccagggcaggggcaguuaaauugauucacaaacuugcaacaaaaaucucaaucgcacaccaagcugggaagcauuuauuugucaguuaaacuaguuaacacuuccuucuuugcuacuggagcucauccaacuuuaugaaguccaaaguuucaaaauaucacucugugguguucacuaaaacaacuaauuacuggcauccaaguaaguuaguaaggaaauaaagacagaaagcuaguauuuuuaaaacauaaaaggaaaugaauuaucaugaauguuuuaaaaaaauagcuuugugacuaggcuucugcuccagaacgcguagauaaagccacaccauaacuagaaggggaauggccaagaggaagacaugcagagcaugccugcgugcacccaccugccaugcaaagauaaguggaagagcaggaggcagggaaacaaagagaacacggagccgggcgcgguggcacguguaugucuguaguccuaacuacucaggaggacugcuuuagccuggaaguuggggagugggggagagaaggaagagagggagggagaagaaugcagaaagaaaagagagagaggagagaaagcaagcaagcaagagagaacgagugagggaaggaagaaagggagggagggaaagaaaagaaggaagggagagagagcgaaagaaagaaggaagaaagaagggggagagagaacaugaguucaaauugggcauacugaggcugaaggaacaaaacauucuagaaguaguuggaaauauggucuguaaaauggcaagaaucaaccgaagcuaagcauguggaaaccaugggaauggauaacugaaguaauggcaguggcugagaauaauaaagggcagaagaugaaaaggcaagaaauacagacuccggaaacauccacauuaaaaaaaaaaagguaaaaauaauaacagggaauacgacaacccaggaaauaaaaaaaggggggaaaccaauguaauacaaaaacaaagggaagagauguuuaaaggaagaggaggugauauuuaucuucaacaagaaaaauuauacuccauuguuuauuucuacaauaaaguuaaaauuauuuccugguuauaaagguauaaauaaugucaaaaguuaugugaaaguuaacaaauaugacaacugacacaaaugauacgaugcuuuggaggucagugguuaagugagaagugggauucauuucuggagaguggauggagucaaacacaagaaagcaaggggcccagacuucucuuugcacagcuauagacuuaguuauuucagaauuggaguacauuugcaagcugggagaaaccccugcagagaaguaaggcagaugacugaggcaacgauggagacaggguagacggaaucaagagcuuagaaacuguugacguugccaugucuaagaagaaaauuuuucuccaaaguuuucuucuuagacauggcagcuucagcaguuucuuccaaagaaauccaagucaagagacuccacauuaagauuuugaaaucaaaagggauauugggugcacucuuuccagagaaauauaacuuucugaaagcaaaaaauccuugaaugugaagagaacaaaaauccgugaaaaccaugagguagucaaaaggagaaaaauaaaagaacugcuccacacagacuuggcucggcugaaaugaaauggccuggcuuggcugcagaaggcagucagcauugaucuuacgauguucuccacugcuaaggaagggagaaaacaaacaggguugccaagggcugaggaaaggcagggcaggaacagaacagcccagcacugggaugggcagaccccggggcuggggcagacaagagcugcagaaggcccugcaagcugcagaagggccaaggaaagagagauuagaaaucagccaaaaacacagguuuagagcgagugaggaggagggagaaccagagucagcuauauggugugggcgagccagugccauuuccagaugaacuucaaggugguaaaagcagagcacuggacccagcacaggaccucgaaccaagcacaggaucccagaccaagcacaggaccccgaaccaagcacaggaccccguacaggagaacaagauccccccaagccuccacaaaggacugcagcccugccaacaccuugauuucagcugaguaagacccauuucagacuucucaaauguaagagaagaaaucugugguguuuuaagccaccaaguuuguggcccugccugagagcagccacagggagcaaacacaccuucuuaagagcgagagugccguuaccacacaaagcugagcacuagcuuucuuguuugcuaugcuuucucagaaguuggcuucaaaguauucauuuaauuucuacuucuuugauuaugagaaagaauaaacauuuguucaagugugugggucauuuguaucucuugaauuucuuauucaugcccuuuucccauuuuucuaguuuaugucuuuucuaauuaugaagcacuuuuguaauauuaaguauauuaauauccuauauuauaaaauauuauuagcuugccauuugccaacuaaauuuguucauaugauguuugagacauaaaaauaauuuuuauucaguuaagucuacaaagaaaaaaauugcuuuguagcuuauucccuuuguucuccuguuuugaaagaacucucaaaucucuacaaucgccaguguuauucacccuaugaauaacauggaaauucuagguaucugguuugccauuauagacacaucauuaaauuucuguuuucuuuuaagagaguucaaaaagcuuaaguaugucaccuucgcuagcaacuaugguuuuaaccauggcaauuaaaaaaaaaaaaccaccauaggggcuuacuuuaauggguccagguggcagauuaagauacauuuaauuccacaucccuuauaaccauuagaaagccaaauaccuaaaacaagucuaaggaaaauuaguuaaaacaaaacccuucgaacagcugagaaaaguuuaaauauuaccacagugccugcacuucugcaggaccccaucugaacagcuucuuccuccaugucuaaguuuccuauaagagguaugcaacugcuaucaauuuguucuuuuugugaauaaaacuuaggcaaaaaaacugaaugauggaguuaccaagacaagaaauaugaguguaugcauggaaggauaaauucuaucuucaauaugcugaguuugagacauccuuuugggccagucaagcgaagcucucuaauggacaauuguacaaauggguccagaguuaggcagagagacauggaggggaggaagcuuuugcgagucaucagcagucaaggaaacgauggcuaaagccauggauuuagaggaaggccaccaugagaaacaaaaagugaaauuaaucaaacaccaaaaccugacacuggaaauaacacauguagcagggagaaaugaagcagaaagaggcuggaaaggaggcuaggaaguaaucgccagagaguugggaggauaauggagaacagccccacagaagucuagggagagaauuucaaaucagaccaaaacaaauugagggcagagugaguacuggaaaaagugcuuacaacaaagguagacuacagauucgagagugguuuuuguuuuguucuguuuaauaaaugugaaaagggcaaaagagacaauggcauugcaaaagagcaacugaaaugacagaacgucaugucuauuagacagaggaagcaaugaaagucaaaagagagcuggcagauggggagaccaacugaacccuccuauucugaaacacuccuuacuuaauaggacauguguuuaaaaacaaacuggcauuuuuuaaaaguacuguuacaaaugaugucauauaccuaugacauaucugcucuuguaagcaccuuguaaaaacucccccuuauuuuuaauuaaacuaaaauuaaauaaaauuaaaaauuaguuucaugcacuagucacauguugaaugcucaaaaaccacauugguaggagccagcacacuggacagaacagaugaagaacuuuaccauuauugcagaaaguuccauuagacagcacugucauaggcccugcuguaaugucaccaacaagguauuugcucagugagugacuaucaacauauggagaucacacacuaaaucacagucaagcuucaaagacaccucuaagaacauagcauagccacuguuuucuguauacuucccaauuugguuaaauugcauagcuuauugguguaccaauuauucaauuuucuaaaauauggauauuaagaacauuaccauuguugaagacauuaacagcuuccaagcacuguggaccaacuuuguguaacuucuccaauagaaacuugacauauuuucuaaucuaauccucacacagauuuagaucuacuuauaaggcauauguucuuuuaagagaugaagaagcaagcucagcaacauuacacaacuuccaaguugcaaccauacagcuaauaaaaguacgaguuuggacuccaacuuaggucugucaucuuacaaaacagaagcuccauuacauauaacccauacacuguagaaaaagcuuccaucuacauaaucauguacuuagauagauuuuaaauaaauccauggcacaagaauauguaucguaacaagcacuucaacuuaauuucucagauauauguaauaauagcaugaaagugaauuaaggagaagaaacuucauuuccuaagagauaauauguacacuaauucaaggaaugaauacauucauuccuucaacuguaaaacaaaaguaucuuuuccaggaagaaaaacuaaaaauguuauuaucuuugaaaauuauuuguucaaacacucaaauuuuuacuuaccacguugggcagcaaaugccugacuagcugaaaggacuuuuguuugcucuggauuauaccuuguaccuucuggaaaaaucacaagauacaucugugggacauagagcaaauuugguuuauuuugugugagcuuuguuuuuguuauuguuaaccuaaaaaagcuaaaccuacuaaugcuaacagaguauuuccuacaguaggagaaaauguauauuuauuuacaugugaccuucguuucaagaggggcaaacaaaaugcaacaauuaaauaugaacauaacgugaacuauauuuuaaaugcagugcuacauucauugguaggucagccaugaagaaucuaaaaacauuucuaauuauaugcuaauaauucacuaauuaaaaauaggccaugaaacgcugacucauacaaagccucaaugaguuuuugcccuuucagauccuguaauacgucauuuuuagaaauacaaauuuuagaaaucaguaucguuaaguaccaacacuaaaaaguaccucauuugaugaaaaucauauaguaaauucccaccaugugaaacguucuaaauguucacauucaaaagcuucacacagaauuccuauuucacacagcuccuuuagugcauuuuaaauuuuauuuauaagaaaccucauuuguuauauaaacugaaacuaaaauaauauaaagaagaauaucaagcuggacguuuaauaaguaaucaauuagucuaaguuuuuacgcuuaucugcuuaggaaaguaaaaacagaaacauuaaaauuauacagcaaaaacuccuagcuugagaacugaguuacaaaaacuacacuaauaacuuugauugacagccaaaagacaaaaauaaguuaugcacaccaaaucuuuucaaauacaaacagaauacaggaaacaagacaggagcucaugggagaaaacuacguuuauuggauucauucuugccagaucucagacaguacucagacaacacugucuaccucuguacgucugguacagaagccuuccuucaucuggaugaccuaugaucauacagcuccuacuuaaaaaccuaugugguacugaauuuuuucuuuagauacugguauaaugguaucuaaaaauuucguacuuucagcuuccacgcaaauaugcaagcuuuuuguucauucauauaauagucuucagaacccacaccuaacuuagaaauuaacagauaauauuauauguaucuuuauauuuaauaauuuauauuauuuuuaauaauuaauauuauuauuaaacaauaauuuauauguauaauuauauuuaauaaugaagauucaccagaucuguuaagaaaauguagaaaaguggguacaauuaggaaaaacauacaaaauuccuuauuauauuauagcaacuagaaggaaaaacaggaagacaaacauuaaagcuaguuccaaacaccacacauucauuuucaugaaaauguguuuuguaacaguaagguuuauauucaaagccaugaaagcaauuacugugggcuaucagcuuucaacucagucauuuauaaauaaaacgauuauuucucagguuaauaacucaugugguauuauuugcugucuuagauguuuaauuuaaaagaacauugacagacagcaggaaggcaugaauucauucacagcuaauucagaaacuauuucuuauauacuuauuauguuccaggaacugcacaaaggauaacaacacauaugguccuucccuucauggacaagugaggaaaagaaauacauuaaacagauaaauaaaaacaugucguuacauaucaugauaugauugcaaagaaaaagaacaaggugugaugaaggaaaaugaugagaaaaaauuuaggaagggcaauggggcuaggaacuaaagaauggauaaaagaaugagugcuuuucccuaaagaugaggaauauggaaaggauuucccucacaccaguucuagucaaggcuguacuaggaggucuagccagaaaauuuagcaagaaaaagaaauaaaagccaucaagauuaaaaaggacaaaguaaaacuguuauuucuauaacaaugacaugauuguuuauguaggaaauccuaaggaauauauuuuguaaguuacuagaugauaaauaaguuuagcaagguuaguauauuaaaaagucaaauauaugccuaggucaacaaacaaaaacuugaaauuuuuuuaaaugucaucuacaauaguaucaaaaacugaaauucuuagggauauaucuggcaaaagaugugcaaaucuguacauuaaacuacaaaacacacugagauaaauaaagaagaccuaaguaaacaaaugcaggcuacguucaugaauccaaagauucaauccuguuauaucaauucuucccaaauucaucuauaucuucaauacaaucaaaaugaaaagcccacaaacuuuggguagaaauugucgagcuaauucuauaauucacacagaaaugcaaaaaaccuaaaauagccaaaacaacuuugaaaagaaagaacaaauuuagaagacaacuacacuauuuaaaaacuuacugcaaagcaagcauuauuaagacaguaugguauuggcauaaggauauauauauauagaucaauauaacagaacaaaugcuccauugaucuagggauaacagacccaucuauauucagucuacuuauuucaaacauuggggggaaauaaucuuuucuauagugaugguuaccuauauuaaaaaaauaugaacuucgaucuuacaccauaugaaaacauuaauuauaaauaaauccuagaacuaaauguaaaagcaaaacucuaaaauuuccagaagaaaacaaaggagaaaaucuuagcaaccuuaaguuuggcaaggacuucuuaaauaggauacaaaaaguggaaauuaugagagaaaaaaaaucaauaaauuaagcuuaaaaguauguucuucaaaagauacauauaaauguauaaaaauaaaaaaacacacguacucaaaaaagauacuauucacaaauaggaaaagguaaguaacagaugcaaaaaacuuguacaggaacauucuuaggagugacaggcucaucucauuuuaucaugcuucgcuuuacugagcuucacggaaauugcauuuuuuucccauugaagguuuaugacaacccugcaucgagcaagucuauuggugccauuuuuccaacaguaugugcucaccucacgucucugugucauauuucgguaaucucacaauauuucauauuauuauaucuguuauugugaucugugaucucugauguuacuauuguaauuguuugggggugccaugaauugcacccauauaagaugacaaauuuaauugauaaaugucguguguguucugacugcuccaaugauggccuguucuccugucucucuuucucucuaccgccccuuggguuucccuauucccugagacacaacaauauugaaauuaggccaauuaauaacccuacaauggcugcuaagcguuccagugaaaggaagaguugcaugucucucacuuuacaucaauagcuagaaauggcuuagugaggaagguauguugaaagccaagguaggucaaaagcuagguccuuuccacuaaacagccaaguugcggaugcaaaggaaaaguucuuaaagagaauuaaaagugcuacuucacugaacacaugaaugauuagaaagcaaaacagccuuauugcugauauggagaaaguuugagugcucuagauaaaacaucaaaccagccacaacacucccuuaaagcaaauccuaauccagagcaaggcccuaacucccuuuaauucucugaaggcugagagagguaaagaaguggcaggaaaaaacuuagaagcuagcagagguugguucgugagguuuaaggaaagaagccgucucuccauaacauaaaauugaaguggcaaguacugauguauaagcuauagcaaguuauccagaaaaucuaccugaaauaaaauaaagauuaaacagaagaucugggauuuaaaccugaaucuaauuucaaaaccaauacucuuauccaccaggcugccuccuaucugaaaaggaacuuaagugaaagcuggaagaaaaaguguuaagucuccauguuugugccauaaguuuuacuagcucauagucuaacaaaaugacuucuauuaguuauuuuuaucacaaauaugcuucauuugcauccacaaccaauaaguuccuuaagaaaauacuguauugucccagcaauaauuauggagauguauuucuucacaacuuauaauacaaauauauuuuuugaaacaaaauucugcauuucuuaaauacuaauaccgaauaagaacugauacaaucauggaauagauucaugagaacuaguaagccacacgaaaguugacuuaacauauucuaccaugucacuuacuuaauucaccuucagaaacaaaagaaucauaagaaccugagcaagauguauccgcucucacagggcguacauauuaagaaaugaaacaaccauccagauucuuagaaacccgaccugggacagugaccuuacagugaaagcugcucagcacggccucuugaaccugccagucuguuauccacacugcgcuaggaacauaaaaggcuggaauuuugcccacaaaaaacagggaggcuauucucguagcccauaaccagacuagguuauuugaaucaaccuuccuacugaaaacaacuuaaaaagcuggauauaacauuauuuuaaaaguacccaagaguuggcaagauguuaagacugaaauuaagcaaacacaguaaagcagaaguaagcauaaaacagaacuuugauuuacaagacucauaagaugaagggcacagaaaccaaaacccauggaccuucuaauagaacugugaagagagaaucagacaagugaacgaaacaccaaaggcucuacucucagggugaaaguaaaugagaggugagcaggucucacgugcaucugcaacccuggcugcacugccugaauggcucaguucaccuucaacucagaaucucguuuggguggggcccacgcuagaggagccuuaaggggcccagcuaaaacagguagaaauguucuccggagaaagacacucccaccugaggcuucaacugauuuccacaaauaacuuaaccaaacacagccagcagcaaaggaagauaacaaagcaaacaaggaaagaaaguaccauaagcaagaacagcagaaaacaagugacucagacaagacuuuaggcacugaaauaacccaacacaccuuuuaaauuaugccuuuaucacuuaaagaaacaaagacaagcuugaagauuaaaaccaaaauaacagauuugacaaaaaccacacagcacuucauauaaugaaaaacaauaauuuaaaacacugaaguugaauggauuuguaucuauucuggauuguauuuuagaacagaaaaaggacauuaguggaaaaccugguaaagucugaauaaaaaucuguaguacaauuaauagugugguaccaauguuuauuucuuaguuuugacaaauauauaccauguuauguaagaugucaacauuagauguuaaagcuagaugaagaaggcugggcgugguggcucacaccuauaaucccagcacuguggggggccgaggcgggcggaucaagaggucaggaguucgagaccagccuggccaacauggugaaacccugucucuacuaaaaauacaaaaauuagccgggcauggcggugcacgccuguaaucccagcuacucaggaggcugaggcaggagauugcuugaacccgugaggcagagguugcagugagccaagaucgugccacugcacuccagccugggugacagaccgagacuccaacucaaaaaaaaaaaaaaaaaaaaaaaggcuauauaaagaauaaacaggaacacucuguucuuucugacguuuuuguaaaucuaacauuguuccaaguuuugaaauuuauuaaccaaaaaugggaggcggcuuccauuaaguauguagaaugcugaaggaauacuacugccaacccuacaacaacaacaacacugacaagcuguagauucaugacuuuucuuagacccuucagagagcugcaagguugcaaggcaaccaacuaacccaaaagucuaaggaaacauggaaaacucaaaggagaaacaagaugcaagugguuguuuaguugggggccaauguaacagauaccaguaaaaagaauuuagcuaaaaauuuuaacaauuuugcagaaagccaaguaugagccaguggaacagacgaaccccugggcuacagacacaaggagaaugcagcacauuucacaggcucgacccacagaccuccuguguacucacaagacaaagaaaaaggaaaacacacugcggucagggaagacuggauguaggcuugugggagggaaaagcagcccugugggaagggcucagggcccagcccacauccuucuuucuaccuuuccuauggaacagcagccugaaacugaugaacaggggcaacaaaacccugcuacccauggggcacggaugaauacucgaugaggcugggugaagagaacagggaaaaacucuuaguaaaggcaggaauacauacugggcacagacuuacagccagaagcaaggcaggaucagagaaggcuccaccccugagauucucccuaagaaugaaaagacacuucccuucccucuccuucuaccaccaaacuagcgagaguucaguaacaaguauccaagaaguauaguggggaaaggcauaaagaagagagccacuccaaggugcuaugugaaaacgcugagugugaaauagacacugaggaaaagcucuagcgggaggacauccccaaccuacaaacaaaguaaugaguucuacagaaaccugaagcugugagaaaaagcacaugagcaaaacccaaaugcagugcaccuccucaguggacugacuccacuccucaacacuaaaggccaagcagaaagacaagucuauccauuuccagguaucaagacaacuugccuccauuucuccugucuuacaaaaaaggcccagcguuaggcaaaaucuuaggaaguaugacaaaggcaagauaaagcacaaucugaagagauaaaguaaucaaaauuugcagacucagauauggcccagauguuggaauuaucaagcagggaauuuaagagaacugcaaguauaauaaaaugauaaagguucaacuggaaaacgugacuaagcuuuaugaucagauagauacacuagcacagagauggaaacuaugaaacagggucaaagggaaaugugaggaaugaaacacgcaguagcagagaugaagagugccuuaaacuggcucaccaguagacucaacacagccaaaggaagaauccaugaacucaaaggugggucaacagaaauuauccaaaauguaacacaaaaagaaaaaagggagggggcguaaaaaaaaaaauuaaaaaaaaaaccaacaaaaaacgaauaaugcaucuaagaacuaaagaacagcgagaaaugaaccaacacaaacauaacuggagaagaaagacugggguaggaauaauauuuaaggaaauaagagcaaagaaauuuccaaaauuaauaacagacaccaaaucauagauccaagcucagaggaccaauccagguaaaaauuuuuaaaugacacucagauauaugauacuuaaacugcugcaaaccaaaaacaagaagaaacucacgaaggcagccacauaaacaagacacaugacaaguguaaagagcugauuuuuucagcccuagcgccacuggcagcuauauucaugggggcaaaaaagcaaggggccacugugcauaggaugccaacaucacccaaaaggcagcuaucuucauuugcuucauauauacaaugcccacagcaggacacagaaggaacuccacagcagucauccauugcuggggugacuggacagcugggagagaagugggauggacauuuuaagguauaaauucaugauuuuuaaauuuuuuuuguaaaaagucgauaaaccauauuaccaacuuauucugucuuuuggagaccuacaugcaaugaccacaauucugcccaaauucaccacacuguuucagacuaaacagacccuuugaagacaccaagcuugguucucaaggguuagcuauaacaggauaaagggucacuguucaucucauuccauucugcuucugucacccaacacaugcccaaaacagaugcaauguucuaauguaaaaacaccuagaagaggcaugugaauaaacaaugcucacaccaggcacuucgccagcugaccgugaagaauucuuccuucaccaugagcuccagcugcugcccaggaccccuggugaggggagggcaggaggagaggagggaagacagagggagggagccagaaaggaaagggaaagccugugcacacgagcuaagcuucugagcacaugucauguacugaaagagaaagcccaagucgccccggugaucauggugcuuugucuccggagggaaccaggggaaaagccuuuggcagcaaucagcauucuauacaaagcagauugaacucuccccacuuuuguggaauaaaguuuuauaaaauauuauuuacacugaaugauuuaacauuuguagagauucauccuuuuuugguuuuucuguacauguaagacauucaaaauuugcacuaacagaaaacaguugcugcuucuaaaaccaaaucugauacuaaagaagacaagaaguaagaugagcuuguaaacuagcuuaaaugucagguuaaaaugcaguuaguucuauuuauagacucugaacgacaccaaaugcucuuuuuauuccucuuuaagguccacugaccagcaaaggaccuaguuguuuacagcaaucuuucugauggcugaaaaaccugccuaccuguacauagaggguuucuguuaccucagcauaacccugaauuaguaauuacacaugggaaaauacauugucaaaacaauucuuagauuuuaauuuaauucuuaaauuuagaaacugagagcugguaagaaaaauaaaaacggguaggcucuuacuggaguuccugcguccacguagcucugcaacuuguuucgcaucucuuucucguuaaauuuggcacugcgcuuuacauagauuccuccaugcugccacaaucaaaucgggagaaagagcauuuacuuuuaaaauaacaauuggccagagucaucaaaaaggcaacuucucuugcaaaaaguacagaaugaaaacuacauuucagaauuuaaucuauauuuaauaucuucaaacauuagcuucuaaagaacauuuagcugaaaauugccuugucucaacauaauucaaaaaaacugcaugugacacuguauuggaaaacacaugaaguuuaguuuuguuggcaguuaaaaugaaaaugcuuucuuucuuaaauacacauuuuuaaaaauaaaaaaccugauccaucagauggauuuaacucccaauucuuccacccacuuauuacagagucacuaaaaagcguccuuaacaugucucacgaucuuuagggauuuuaaaaaaucaauccugcuaaagauauuuauguggcacuguuacggacagaaguguguucccccaaaucagucuacuaaagcccuaauaguucccacugugacuguauucagagagagggacuuagaggugguaauuaagguuaaaaaagggccucagagugggaccuuagcagucucuguagaaggauuagucauccaguguaacuaguccuucuaagaagaggaagcagugccagcggugcuugggcacagggaaaaaaaccaccugaggacacaggaagaaggaugcugucugcaagccugggagagaggccuugggagaaacuaacccugucaacaccuugaucuuggaugucuagccuccagaacuggagaaaguaaguuuuauauauacaguuugcuuuuuuuuuuuaauaucauacagaucacuaauuacuguuaucaacaguuuaauguaauugccuaucaaauucuaugccuuuaaauuuccuauuuguuugaacuuuguacauuugcauuuuugcucuuucauuuuacugcagcuggcccuucacauccaugaguuccacaucugcagauucaacaaaucacagaucaaaaauaugugaacaaauaaaaauuaaaaauaauauaacaauuaaaauaauacaaauaaaaaauaaaguauaacaaccauuuacauggcauuuauaauguauuagauauuauaaguaaucuagagaugauuuaaaguagugcacagguuauaugcaaauacuaucccauucuauaugagggucuugaacaccucagauuuugguaucuguggugguucuaaaaccaauccccacagaugcugaaggaaaaccgcauauggauaaucagacguauauaaauacacaccacuaaaaaugccaaacaaaauuacuucaacugagaauaaacuauuaaacccauuuuaaaaaccauacauucacaugaaguauauuguuaaauuuuaaaauauaacauuuuuauaggguuggguauggcaguucacaccuauaauccagcauuuugguaggcugagacaggcagauugcuugaguccaagaccagccugggcaacacagcgagacccccaucucuacaaaaaauagaaaauuuagccgggcaugauggugggcaccuacggucccaacuacuugggaggcagaggcaggagguucacuugagccccagaggucaaggcugcagugagcuguguucacaccacugcacucagccugagcaauaaagugagacugucuccaaaaaaaaaaaaaaaaauuuauaaacuacauauauagagagaaaagcauggaaacaaguuaccugagcaaaguaacacccauacaauggcagccauuuuaacccuucuuucagcacguagcgcacauguccuagcgcauucugccugauggccaagaugucagcaacaauccagucaacugcagagacaggacccaguuagcgcguacaugaggcucuucacagguuguacuaugaaugggcuucaaaaguacuaugauggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggcgugaaccccagggggcggagccugcagugaaccgagauugcgccacugcacuccagccugggcgacagcgagacuccgucuccaaaaaaaaaaaaaaaaaaaaaaaaaaaaaaguccuaugauuaggauguuuaaaauuucuuuaaaucuaucugagauauuuaaaaaauauacauuuucuguuuuuugagcuuuuuuuuuuugcauuucuugaaaggcuuuuuauuucaaagauaaaauacagucacaaaauaccuaaauaauccaacagcagcauguguauggaacaaaaugagcuucucuaaauccuaaagucuagaaaacaaaguuuuuuuaaugagaaaggggaaauuauaaacaaaaaauggccaaaugcaacuaugaauugccacuaaauauucaguguguauauauauguucagcaaaaggcaaggacacuucaucuucuacuaaugaguuuuuaggacucgguacuagguuaggacagcaaucaaacaaaggucucacaugccuuacaaugaugcuggguagauauaugugcuccuuauguaaccaaguaaaaugaucucagacugcuaauaacuauaguuaaauaaauauguuauuaacaaaggguugcaaaaacaaggguaagaugguaugaauugauaacaguagcaauaaaaaacuuccuagaaguuguuaguugagcuuucaaaaagaaaaaauuuccaacacagagaguggcccuugccaauuaaacaaacaggaaguggcaaagugggugcagaagaugggaaacagaggacaugguuuaaagaggaaaugaagugaaauucaggagacaaaugauacaggucuuaagaaccgcagaaacuuggauuugaaaguaaauggcuacaaacuaucuccugaugagaaagaaaacauaaaaaugaaauguaagggagacuucucuaguuaauacacacaugagcucaacgauacucgaaaagaaaacuguuaaucugugaaaagaauaauucuaucaucacccauguucucaggccaugaaaaugagaacaaaaggagugagucagaggaaggaaauguuaaaaaaaaaaaaaagucuguagaaaauaaaagcugaggauuuagaggaauuacaauaaaguuuuagccaaagaggacaguuuuccacagauuacaagaugauuagcucucagcuaugggaaaucuauuagacaaugcaccauacuagucagaauaucccaaaaaagauuuagccauuuuaauacuaaaaauuaaccaagaaaaaucucuuauccauuauuauacaucucucuuuuuaaucagggauuaucauucacaaguuaacuuuuucuugaugacuuaagacuuauaauuauuauacauaugaaacuuuuguuauggcucccuauaaguagaauguugcuugcaaagauucuccccuacaguguaugaucccagagacagacacaaccuguguuauuggguugagauaucuauacuauugggcuaucaaugaucacuuuucucuaaaguauauaaauuccuguugaagcccucucccuagccccuucuaauuuagauggaagaaauaauaacugauaaacauauuucuuucuagucaugucuuagaaaccauauaaucgacccuguuauaccuguaccaaaugcaaaaguaagcagacaauaaauucugagaacuaauucuguaugguucuguaugguuaccaggcuacagcacaucuuggaaauauaguuggcguacaaaguuaaaaaccagguuuagcauuuuuuccugcaauaauuuuuuuauuuggaagaauuuuaaaaauggguuuuauuuuaaaacaaaugguuuuaugguuauauuauggccucacaugccccucccaagaacuuuuaagagaaaguguaagauuuccaaaauacaucauguucauaauaagcugcccugggcuaugcccuuaaacuugaauauuuuaguggaaacauuuaagaacuagcuuaacuagucaaaauauaaaagcuuugugucaccaauauuugcuacugaauucucuuuauuucuuguuuauucucagcuaccuuucagauaggacaucagauuacagacaguuucugacuaucucaguuacagcugagauuauauuacuuugacaauaacuucauauuuuguguucuggcauaauuuaacuaagauagcaauaaauuuggcugugugagaaucuuccauggcaaucaagccaaagcagagucauaguucccauuaacuuggaggagaggaguggaaggcagugaggggcagcaagucuaauuuccucaucccuauccucaugaaacagcaguuccuaauucaugagggcccuguguaguccaagagauacugcaugugcagcgcuucccugccauggauccagcgcuaugcuaauggugagcuaugacugucaucacaaccacuuuuaaaugccaucuaugagccagguacgcuaccaggauuaggagacagccucuguaaggugccugaaaggagcuaucacucacaccuuaccaauaaggcucugagagauaaguaauuugcccacugacacacagccuauugcagaacagcauuucugcaaugccgaacaggaaccugggucucucuaacuccaaaguccaucccuuuuuauaacauucuacucaccacgcaugcuguucaacaagaaaagugacacuucagccaagaaaagagaacauuucaugagauuaaaaaggcaaauagcaggcagggcacaguggcucacgccuguaaucccugcacuuugggaggccgaggcaggcagaucaccugaggucaggaguucaagaccagccugaccaacauggugaaaccccaucucuacugaaaauacaaaauuagccaggcgugguggugcaugucuguaaucccagcuacucgggaggcugaggcaggaaaauggcuugaacccgggaggcaaagguugcagugagcugagauugcaccauuacacccagccugggcaacaagagugaaacuccaucucaaaaaaaaaaaggcaaaguguugucaaaaguagauaguugaaggauaaggggaagaaauaacagccacuauauccugcugacucgagagagaaauaagcuaacagagacagagacagaauguagagacaaggaugugucaagcgaaaacaagggaagagagagacuaauuuaaaugucaauucuuuugaguaucaggccaggaaacucauuuauuccggcaagccuggcagaagacaaacuagaaagucuaagcagaacaacagucuuugaaauauucuuuccgcuaauuacauuuucagagauacucuguugugauuccuaacaucucaaaaggguuuuagaaggguaccuaaacacaaucagacaaugaaccacgucuauggauaggcuuuaggggucucugaaacccuaaaacuacaugcaaauuuuuauaugcacauuuuucuaggaaaaggcucugucauauacugacuaaagccuguaauucuaaagaaauuuaaaaucauuccccuaguauuuucucaacuuacagaauuuuaaaaggcuuucaaaaagcagccuucccaaauccugcugggaugaggauguggugccagagcggugauacaaagucacaggcacucggagguagggugaagggaaggggaagugguucucuaaacugauaaaugaaauucaggucaguauggucugaguaugaagauuauccuucccauaguaccuucuagucccaaauacaugcagaauuguuuuuuuuaaucuguuuuuucauggauguuuucuagaaguccuuaaucugaaggaauacauauaaaagccaacauguaguaagcacacaaauuaacaguacuagugaucaauauuaucacuaucagcaacacuuccagaaauguucagagaacccacuccacaagucacuacuagagagcucuauuaaucgaguggaguucauacugaaaccuggacaaagaaaagcuggcagguaaacugaagaaggaauuuuaagagaauccuguuaaacagacaacucuacaugaaauuaacacuggaucaaaauaaaggaaaugcaggaaaaucaaaucuaucaagagccauucccuguacugggcccacagaucccuuuuguuugauauuuaaaaccuggaagaaacauccaucagcagcaggacaggaaaagcagaaugguauuagaaguaaaacagccaauaugucugcacaggccagaguucucagcagcauugaccauugguugacuguuuugcuauuuuugccaagagugaaauguaauuagauaaaauagucugaaccagucauguaauaaaguuggggaaaauacucagauacaucaagauuccuaucaaccccuuguagcuucaacccuuguccuauaaaucugaauguaaucauuaauucacuaaauugagaaaaaugcauuuuaacuucuuuuacuuucuauaccucaucuaugguauaagcaguaauaaaaaccacaaaaucaugaagagacagcugacaggaagaaaauuuaaaaaaagccacaggcauaagugauuucccuaagaguacuauauugaucagguuguuuuuagcuuaagaguacuauauugaucaggcuguuuccagcuuugagcuucuagguauuauauuuuuuaaaguaauaaaaaugcaauuuaggaaguacgcaucaaaaguagcuacagguuugaaaacauaagaagugggauuuuuuuggagggcugaauuauuuggagaauuaaaaaguaccuuacccaaugacaauuuccugauucugcuacugugcuacaguuauauuaagaugucaccauugggaaaaauauugcugacaauguacucuuuuugcaaauucuugggacucuagaauuaccucaaaauacaaagguuuuuagaaguaucuucaccuaaaguauauacugcacuguuuugaagaccaguucucugcaauuccucugauggaacaguagcaacuagaauuaaaccaaacccauuugaagaaggaaaggaagagcagacacuagaaaugacgagcauaguaaggaaacgaguacuuacauaccaauacagcuuuucugcagcuuagcaaucaaaaauguaaaauguauacacacuucgacccaccaaugcuacuucuagaaacaucacuuacaaaaagaaugaauacacucuuuaaagagcuacacaaaggaaaaacaaagcaagcaaguaagaagauagcuuacuuacauccaacagagggagaagguaaguuuaggaaaauucauagcuuucaaguuucugacuuuccaaaaaguaaaaucacaaaaauacaagaacagguguaauaucugcacagaaaauugcuguuuuaaaaaacccacuucauuuaaauauaagaacgguauuuugaaugcccaugugccaucuguagaaaaaccuauguuucaugcaaaugaaauacaaaccugugcuuugaugauuugcuaaauauauuauauuuucuuuauuuuuuggcaaaucuccauauagcaauaucuaaaagauaaaacaaaaaaacauuacuuugauauuuuaaaacaucuguaauauacaaaggaagacaaugugaagaaacugacgaaugauguugugaauauuuccauccaugauuaacaaaaauuagauuucucacaggagccucagagaucauaaauagcgcagguacagaaagcaguuauguauaguacagguuaacgguaauaaauuaaaauagaauaaucaauauccucaugagaaaaauauagcaagcauucauugauugcuaacaauauauaaaacacuguucauaagauauaucuuccuucaaagagcccacaaucaaucuaguaaaagagacagacauguccacaggaacuguaaugagacauaacgcaaauacuaugaaaauaugguaccuuuuuaagguuuuaaauuuguuuuuucuuuuuucaggacacuaaaggguacacaaccuuuuuuaauuuuaaagaacuguaaacugcagagcaggaguauuauuagguaggauucuggcagaugagaugaaggaaaauguucaugagaauaagaacgaauggaagcaguaacccuggaggccuguugggaacaugggcagugucgcggcugaggagcaaggagaccagaaggguggcucugaacuggaauggcagaagucuuuugaauuccaugcuaaagauuaaaacuuuauucuguaaguaugagagaaacaucauuccaguuuauuuuuaaacugggcgguaggcacacagguguucgauguaccuguauuaguccuucugcuguuuugugugucuuacauauuuuagaauaaauuuuucaagaaacugggaguauacuuguaaagacuuaaaaggaaauggcugcuaauggugcuaaguuuuuauucugggcauuuuuguuucugcaucuugucaucauggauuaugcaagauuauaaauuagcuaaggcuuuuuagaucuaucuuguccauaaggauuaucuuuuggucaugacacuauuuauuaauaucuuaaaaagagaagaaagaaaggggcaauuaacccaacaacuuugcagacaaaugcacuuagauaacauaaaguucuggaagccagggaugugacaaagguuuccauuacuuuccuuagaaacugcacagugcuauguauguaguauguuuaaacauuugcacaaugaguuuuuauucauaaaguuuaucgaugacauaaaugaguaauaccaauagcuugaucuguucagaguuaaaagugacaucguggcuugugaguaaauccccauucucuuaccaacaagccagaauugcaucaagaccauugaguaugcacugauuuaaaaguuuugcacagcccaggcauaguggcccaugccugcaaucccagugcuuuggggaggcugagguggagugggcgggcggggucgguaggggcagggagggaagaucucuuaagcccagaaguucaaacccagcaugggcagcacagccagacccugucucuacauaauuauaaaaagauuagccaggcaugguggugcgcaccugcccacacuccuucaggagcauccagaacacacugcacaccuaaugacaaguccccagccccuuagggacuaugagcuccucaauggccugaucaguuuucuaccccaagagccuagcaccaagcugguuuuuaacagauguuuacugaauuauuuacacuuuugucaccaguaggcaaagcuauaccucauuuucaaaauaaagguaguuucagaauaaacauaaauaaaauaauuaaagugcaccagugacuuuuuaaaggcuucauucuguaaaucuaguacucauuuuuuaaaucacauuaguuccgucuacaaauguacccugcaaauaauuugucacuucaaaauaaggcacaagaaaacauacggcuuuucuuuuuguuuuucauaacucuuuaaguaauuuuaaguucauuaugauugcuuguucaugauaauuucagguucauccacuuuuuaagaacucaucagacauccccuacagaaaaaaaaauuucucuuuucauuuauuaauucagagguagccaauaaaaaugauuucugaauaacuaucuucaucacaaaggacaaacuaguuauucugcuuucgucaaaaaaacuuauuuaucuugcacacacuggcuuucaggagaaggccugaauuagaugcggaccaguuucaccucgccuucaucacaucuguguuguuuuuaacuugcucccaugacauauaaacugccuauugauucuuuuuuaaucuuaaaaacagguagucauacggcaucuaaaguaaucacaugcuuaacaccuuagccuccauaacacaaugucacagagacauaaauauacagcauucuuuguuaaaaaauauauauucuucauuuaucucaaucauguccauuugucuuccacaugcaaaucuugaaacaugauuuuuuaaaaaaaacuuuugcuguuguuaaguauagaugaugcuguugaaagagaucagagaauaugccacacccaaauaugcuacuuuggcauaaggauuauuuugagcugaaggcaccugagacacagcagauacaggaagaauucucugcccuuccccuaacugccuaaggcaggacauaaauuucccuguggaaaggugauaugaauuuccaucuguaaagguguuucccugucccuuauuaggagaccagaaacuggcaaaauaaaccugcauagcaaaccuuauuacuauacauuuccuagucaucuucccacaauuuaccaccccugggagcugaaauccucuucuccuuugacuagucacuuuuucacaauuuaucagccuuuguuaaaaaucacauacaaaccccuucuuuagccaagcacagaggagcacaccuauagucccugcuacucaggaaucucaagcagaagaaucgcuuggcuucaggaguuugaguccagcccuggcaacacagcaagaccccugucucuuuaaaauaaagauaaaaauaaaaauaaaaauaaaacccuccuucccugugcauguaaaaauacuaacgucaaaaaaauguguaugccucuucuccuguuaaucagucucuuaauucacaagcccuagcuacccuacaaggguaaaggaacagucugcucucccuuauacuguaacauaagagccacuaagagguagguucuaaaguaauggacuucaauuaagacuugaauuugaauccucaucugucauuuuacgaugagaacuugggcaaaacacccaaccccuccaaaccuauuucuuugccuguaaaaugaguguaauaauaguaacuacuccuccugggauuguagugaaaucagugaaacuauguaaacuacuucauacaacaccuagaacauaguaaccaacuaaaauagguuaaccugucauuauucuuaucccaugaaauggaacuuuuuauucaaaacucuguuaagugauuaauggauaagagaaagagcuagcuagucuaucucuccccagucuuugauuacacagaaguacagcuauaaagaauuucaauuucaauaugauuacauauacaauuuacaauguuuauaauuacuugaacuuuuaaauguauuuuuaugccaacgaaauauauuaccaguuaaucauuauaagauuucugcuguaaagcauacaaaaacuagucuuuuucuaccccguuuaaaacguuucauugaauaguaaaauuauuaugcccuucugaaauaagaucaaaauagcaaacagcuacuugcccaauaaucaauacaaacacaauuaucaugcaauaaauggaaccuaacagaugacaaaguucuuuuuuuccuuuugcuuucuucagcaaagccuucuucauaagcuuucaaaauaguacuucacacgcaaaacuguaaugacuagguguuuggaccaucacggcucacugcucucucauuguucuuaccaugucuagugaauaaacuggcugacugcauucaaugagaucaaugagacacauggcuguuuccauaguauuaagaacgcugguucuuccaacuccagcacugcaagaaacaacaagggguuuuuccuugcuagcccucuuauuuugcauaugaaaaacaaaauccagaaagucacugaaucaucagggucuccauggucaggccacccucuguacuggaucugcgugauugaugacucucuaauuuuucucuugguuaaacagcagugugaucuuccugaagauaaagacagugcuuccuucuucucaguggcagaaggcuugguagcauccauaggaugaacuuccuguggguucuggccaauauuggggucauuuaacucugccacauucaacuuguguggucaacauuacaaacauggaggagccuuguucccaagucaucugccaaaaaucuguucaagugugugguaacgccccuugacaagcacuguucugacuuaugaugcuggaauuacacugauguaguuuucauuaccuuuaaaaauaacccauguaacaucauaaggaaaacuaucucuaucuauuuuugcaaagguucuaagguaaucuggcaccagaaauugucauuccaaguuuuuuuuuugauaaguugaucaaauuguguccagaauguuccagcgauaagcccucgguuagcuggaucacugacucccacagcacauggucauccugguggacacuaucuaguggggcuuucuccagaauguacuggaagucugucucauuuucuagcacuucuuccacuacaucauaugcagcauagguagaacuagaagcaugaguuccccagaaugucucucacaguuggcuuuaaaaagcaggacaauccaaucauggguguguucuguaaagucccaaccacugaucaauacaacuuggucuucucuucaaucgagagucacugaggucaaagguguuccuggugcuucucaggacacgaucacagacaucuucugaucauaucccccuuugcauugacuccaaaccuuccauuuucgucagguucacucggauuagaacaugauuaucauguagaauaccaccauuaggagcagauuuuuuaagagaagauagaacaucaacguuucauuaauaugaucuuccagaucuuguugaaaauguaaauaaugaauuugguuccaacaguuuuucuuagcuuguuugggugguaaagcuggaggcuacccaucuccagggguguccuguaauagugaugauucccgaaugaugcuauuagcuugugcugauaauggugaugucugauuugcaaauauuuggaagaagugugaaccacauaaucuaccaaaugaccaacagaagauggucauaaucagguucccucuuguaugaaugcagaauuuugaugaguaggaauuccuguuccgggugggaauugugauggaaggcuuuauguuucuaaucuuuucaucagauauugaauuccugccuacuacuucccaaacuauuaauuuccacgucaauggcuuacuugaggauccugcaaguagucugucuuuauuugccuuuucuuugccauacugaacuaacugaacuucaguucucccaccaugcauuaggaauuuugaaccuaauguaaaauaaugugcaaaaaaauucuuucuaguuggaaguggucuguccaaacagaagaauaugugauguucuaaacuugcuuuccacaaauguuuacaugccauauaauucaccauauuaaauccugauaaucuuucuccagauuuaugcaagucauuuucaaagcugaauaaaaaacuguuugcacuuaaaacaaauuuuuacaaucuucgaccauggaaagguacucauucauagccuguuauaaaucagaauuccucuugacaucauuccaaucauaauuuuauuguuacuugaucccuugcauagugcaauucaacuccacagaguucuaagguacuugcuguguuuagguaauuaacugcugcuucucaaggacauaagccuauauguugcugauguaauuuuuacaauuucuuuuucaaaauuuugaggaugaucaggaaugaaagaauaaccugagagguggccuagcaaguucucugacugacuguacucuccaaguuuagucugaacagcaaaugaagcuaaaagggcagcaguaucauaagaacagggcaaucuuccaguaagaaugucuugugaaauuuguaaaaauacuaguagugggcuauccauggaaucaucagccgccuguaaaucaacauagucuugcccaguaaaaucaggaugcuugcagacuacaucuaacagaacuugccacugaucauguuuauucgcacugaaagcuuacacaguguuuuccagaaggauguuacaagccucuguaugcugucugucucacgucaacucuggugcucguacguuguagacuguggguucugccagcaggaaauuggaaaugugaggucacgacuguacacacaagaccuucauaucacagcugcguccucucagcugaagaaagcaagcaucaaagccaggcagugacggggagcggcaugucugcucuaccacccacagcaaccacgucaugcuguggaacugccauggccugugccacccaagaaggccacaaaguucuuucucauacacucagcaugcaugugucuuuugguacugcccuuauuuuacauccugucuuuugguacuguucuuauuuuagaggguguguuuuuucugaguaucuaugauguaccauucacugagcuaggcaguuucacguauuaucucauuuugucuucaaaauagcaugacaaaaaguauuccauuuaaggacgagaaucuugagacugagaaguugacacuuaauccagaugacauacggaauggcagagaaauaggaauuacaccuagguuucucacugcaagaucccaaaaucuuuugacugugacaaaacuacucucugcaaaaauuccaaauaaaaaaugucaagugagaagacuucucauauauuagaagcuuauguaauuuuuuucacuuugaauaucaacuacggaauuacaaggaguaaaauuaaaaaccaacaaaaaauuuauuccuauaugaacacaaauuaagcccggaagcaaugcaauauguaagugcaccaagagcuggcguuaacuacguuacauccaacuuuuaggugaaccaccugcuuacauaugcaacagcucccacccaguuaaguauucauuuggacacaguuguauuccuccuuuauuuccucaguucuuuguucauuucuuuaauuugugaacuaucucagcauauauucaaguuuucuuuuaagugacaucuuucugcacugcuaaauuauguguuacuuuacgguagagacuauguauuuugucagucuagaacauuacaccuuuuaacaguaggugguuagcacuuaauauguggcugggacuuaacaugacucuccuuuccagguaccaucacccuccuuucuuuccgccccuggaauucucaugccaagcuggaggagcgcaguaaagucgucuuccaaauauuacuuacacuuauacacaaauaaguacucuaaaaucuucaaguaacacuuucuuauuugggguuuugauuucuggugccuacagagaaacagaagaaacaacauaaaaccuuggagaauugcauaggcucaaaaauuacaaaaaguacugguuuugauucacaacuaaaccaagguuucucugcacugcuggcugcgugagaauucuuuuuuaacuucucugacuuugcucauucugccuuacucuugaggguggagucauguuucuuccuccuucaucuauuuaaggaaagaaugaaucggacucacuagacuuggguacccuguuagagcaaaacuuaucaacuaguuaugccauucaaaaaucuccaucccuuaaaagugagauucauauacauuuccacagaaacacagacuagaauucccuagaguacucugccuuuucucucuguuuuguuuuguuuguuuguuuguuuugagacggaauuucgcucuuguugcccagucuggagugcaauggugccaucuuggcuuaccacaaccucugucuccugggcucaagugauucuccugccucagccucccauguagcugagauuacaggcaggcaccaccacgcccggcuaauuuuguauuuuuaguagagaagggguuucuccauguuggucaggcugaucucgaacucccgaccucaggugauccauugccucagccucccaaagugcuuggauuaccagcgugagccuccgcaccuggcccuuuuaccuuuuuuuucuuuugagacagggucucacucugucgcccaagcuggagccucuaccucccauguucaagugauucucccaccucagccuccugaguagcuaggacuacaggcacacaccaccaugcccaguaaguguuuguauuuuuuugguagagaugggguuucacaauguuggccagacuggucucgaaugccugaccucaagugauccacccuccuuggccucccaaaaugcugggauuacaggcaugagccacaccgugcccagacuacuccaccauuuuuguuaaaagaaaaaguaaaaucaagucauucuucccauuauugccaucuccaagagguuacaauguugcagaggagaugauccauacauuaaaauaugcuaauguuauaucaguauuauauauguuaauauuacauaaaaguuacccugacaaugagaugggguaacaucaugacagauggagaaaagcaagggcuugaguuggaauuccagagaggagcggucuaauguggggaggggcggcccagaaggaaaagcuagacuagaaugaaaccaacgaauggaaaaguuaaccggggcagaauuuagaaaaccuugaaugccaugcuucaaacuccucauguuuauuauguuaucaauugaaaaccucuuuucccuaaacauuccauguuaauuacgcauguucaaaguaaaaacuccaaguaauuuuuauagccuucuccacuaacccaagcaaagaguuacuuuaaagaguuacuuuaccucuguauggcaaaguuaauaaacacgucucuaauuucaguguuauccuauauuguaauuggcaguucaugucuuuccuagaugaauaccuugaaaguagggggucucauuucaaccaauauaaccacauugccaggcagagcaucuucagaaaauaagugccugaaacuccuggcuaggcuacuacagaugugaaccauggguguucccuuuuccuugucuguaaaagaggaagaauggugccuacuuuguaaagauggaauuauuuacauaauagaacaauacuugcacacagcagcacucacuaacugcgacugaguguguuacuaacccacccucuucuuuuuccuccacauucaaucacaaagcccuaucagcuaccacuaaaauagauuuggaauucuuuucaaucuuaacauccacucuuuccacuccccuaaccaucauuucucaccuggaugacuacauuaccuuccaagcuggcccuuuuacagagcuccacacaaaugucacuugcucaguaagauuuuccaaaccccuaccucucacccaccaggcuaaacaaccuggcauggcacaguaaauuuucauuuucuuguuauuguuugucuucccacacuagaaugugaccuccauaauggcagguacauugucuaucaaacauuguaccccuugguacccaggacagcaccuggaacaauguacacacgggaauauugcaggaauuaagggaucuggguucuagagaucccuuacugaaaagucauuacuuacuauugaaugguccaaccacuaacaucaaccucuaguuaagaaaccauaauaaaaugagaaaauaguaaaggaaaaguuaacuucugauuccacuugagaagcaucagcuccacaaaaucagacaaauauacaaaagagggaaaguaaacuagguauauacggagugcuguuuucccgugccuuccaucguaauggcacagagguauccccauagguaugcagguauauuucgugcuacuguacuaaaaaacugaucuguaagaaguucauuuaacuaaagaaccuucccacaauucaaacacuuacucaaaagcucuuggaagaaaucuaaaguuacacaccaaacugggauguaccuaggaaagguguacgcaguguaggaguaggggaaacuuuaacuuucucaaaguauuguggcaguguuugaauguauaauugcaucugugauuuuaaaauagaaaaaucaggcauuaaaaaacuauacacaaaugcaaccugaaauaacugguuuguucacagagguuuauauuuauaaaguguaaaaauagaguucuaguuacauuuuuuuaguauuuuccuauaagucuaguaaguuaagcaguucccuaaccagaauuuaauuguguuagacuggaauuguauuugauugggaaauguuuaauuuccuauaguaaaaguuuuuauuauccugcuuaaauaagcaaaugcagaaacacacccacaccuacacaguccugucacucucagcuaaagugaaggaagcaauuuaagaucuauuuaaggucuucacaugaauggcaaauaagcagagaagaguaaaauuaaggauacaagguaugauucauauucuuguuaggacuauagguaucagagacgacgcugggcaacauuuuggcagaagugcagaaagaauguagaagugucauaaaagggaguagacuagaugacuuauaagcucccuucuccaauucuaaguaaacauguuucauucuaaugaauggcugcuuuuacagcaagauucagaauauaaauuuaacucauuaggaguuuaggauuaguuugaugaaucagugcuacacaaagaaagauccaguuauaaauguucucuagauaaaaagccuugacuguuucugagaaacuuggaacaauguuucaguuaagaguaugaaucagcuaagcaugguggaucaaggacggaucacuugagcccaggagcucaaaaccagacugggcaauauggcaaaaucucgucucuacccccacuaaaaaauaccaaaaaaaaaauuagcugggcauggugcuguguaccuguagucccagcuacucaggaggcugaggugggaggaccgcuugagcccgggggcagagguugcagugaguggagacugcaccacugcaccucugguuugggcaacagugugagauucugucuuacaaaaaaaaguaugaauccuuggagaaguuaagggcauauuagagaaaugucaaaaucuuaaauucuuuaucuucuuucuuguguuuuucacacuauuuuacacuuaaagcaggucaacugaaaaccuguuuauuuuauauaaacuuaagaacugugcauuuuauuguuauauuacauuagcauuuggagaagggggaauuagcagucagagccacuaauguaaaauauauucugaaguaaauuccaaguguuaccaacugauuuaagcaagauaaaucgguaauuagaauauuuauuaggggcuaggcaugguggcucacaccuguaaucccagcacuuugggaggccaaggcagaaggaucaccugaggccaggaauucaagaccagccugggcaacacagaaagaccccauuucuacaaaaacuuuuaaaaauuagcuagaaauaauggcacggcagcuacuccggaggaucacuugaacccaggcauucaaggcugcaaugagcaaugauggugccaccgcaccagagccugggugacagaagaagacccugacucaaaaaaacccaaaccccaaucuauuacguguugauuaauuuuuuggccuacaaauuucaaugaucaguuuucaguguauugcauaggaaugggggaaaagaaauuuuuuaaaaaagaagcaaagaaaaaagaauucugacauuugaagacauccuauuaacauuuaucagcuucacagaacaugcuaaaaagauuugucauuauuuaucauaacgauuacaguuauuguuuaugcagcuaucucaacauuuaggauauaucuagauuccuaggauagaauucuaggcuauaaacuaacauaaaucuaguuucacguuaacucacgaugauagaauuuaagguaacuucauuccuuuuucaugaguccuacccaauccucugucaguacuccaacuuuccuuuuaauuucccauaaguuuuccuuaaacuccagcucaaggauauauauacggccucuuacucugagucucuaagcauuccacauucaaguuacuuccuauccuauagauagggcuuuuaaguggcaaacaaaccaaacaccaguauauucaccacaucauacauaauuaauugucuuagaaguuauaucaccuuuaauuuaucaggauuucaguuauuuccauauauauauauauauaaucacaagaugguaauuucagaaucagauaagaauuaaaagaauaccgaaauaugaauaaguugguuauuauacagaaugcagauuuguuccgaaaauaaaacaguuaaucaaauguucuacuuaagggauaugugaagguaaaucuguaaauaagaaacuaaaagauuaugggaaaguaaguaaacuuauuacagaaaaccagguucucuguuaaagaaagcagagaccaaaaugcuuuaauacguaaauaccuaaagaaauaaggcaaguuaaacuacgaaauaacuacaaaauacugaauaggcagaacuauggaguucauuguugugggggaaugaagggcagccccucaaaaaauguguccacauccuaagcccuggaaccugugaauguuuucuuauuuggaaaaaggcucuuugcaguuauaauuaaggaucuugagaugaagagaucaucccggaauauccaggugggcucuaaacccaaugacaagcauccuucuaagagaaagggagagugagaugugagacagaagagguggcagcaaggacuguaaggcagagguuaaagugauggggccccaagccaaggaaugccaccagucaccagaaguugaaacccacaagaacggauucccccuagggccuccagagggaguaaaauugagccuacaccuugauuucaaagugcuggccuccagaaucacgagaacuuaaguucuauuauuuuaagccgcuuaguuugaggugaucuguuuuggcagcacaggaaaguaacacagguacuugaaucaaugccucucaacacaguagagagacuuaacuggauuuucaauagucucaaauuacgugaaauauaaaaaagcuuauaaaauucuuauuacuuauucuaaagaaauaaauggugaagaaaguacccauuugaguuucaguaccaaugagagauucuggaaggaccuaaaaggauaaacgaguuauaaggaacaauuuuagcagcacugacugaaauauuucucuaucucagagauacauaugaaaauaaaguagugaaauuggggaagaaaaagguauuuacccagaauccaagaaaaauccaacuaaauuuguuggaagcagguuuaccugccaagcacagaucauaaaucucauggaccuacuacuacuucucuucagcuuaaaaauucuauguaaaagaaaauauucuucugcaagaacuacugugaaccacuuauuuuuuaaaccuagaguugaaagguguaaaaaugucauuuaaaaaaaauuuuauuuuaaaaugccucuuuaauauauauaaauuaauaaaccuuuuauuuaaaaacuuauaaccucuuaaauuacuaaaacucccuucagaaaugagucaacaauacuuuauacagaacaagagaaucaucacuagccuugcaaacgaaagcugauaaaaacaauucaagaaaaaaagaguguccuaacaaaacaagaaaagcaagcuaaaaauuuuaaucaaaacaucucagugacaaaguuaaugguacaaagucacagguaaaaaauaaggugacagaacaucacuauaaaucuuuuuccuuugggucuuauguuugaagauagcuauuuauuccucuauugauuuaaucuuaacagaaacaauaaaaaauauugaaagguagcuuuguguacacaggaaacccagauugcagaaaaagacccuaauaaauucaaaauacccugcucuguuacuaaacagaaaauaauuauuuguccccuccauacaauaaaaauaaaaaugcaggaacaagaaacucuugguuuuaaauuuuuauuaaauguucauaacuugcauuugaugaucagugggcaaucaguucguucuacgacuccuaaagaacuucaucaaggaacacacauuaaacaaaauuuugaauuauacuuaaggguccucaggcauccuuucauaaaugcaugaaaauuagugcuggaugccacuuccuuugauuugaacagacgguggggggaaugauuagauuaaauguuuucaaaaucacuugcugggaaaucaagaaguaaaucggaucucugaacaucagguaagguaugcaauuucagaaacacugcuagguuuuacagccauuuaaaaaaauaagaacuugccaaaccaaaaaauccuucaaugguguauucugcaucauauuguguccucuuugaacaaaaauaacauaacccgccacagauagaauuauuuuuuuaagaggugaaugacuuuguguucugagcuuauaucccaucccaggccaguugucacaugauguggaaguaaaaacuuaaucaugauaaaaaucauacauuuagacaaacuugguggaguuaccauauaaagggaaaaaauuagccugaauuauugaaauuuuuaaaugaggcccauuuuaaacgucaacuaccaggaaaccaugaccuggaacaguaucuuuuuuucuuuccaaggagacacuuacagacacugguuuaaauggaggcccuggccucuccuaguuccuuccccccaaacaacuuccaacuggggccaucaagggucgaucagcagugcaacugcaaacuaaauauaguaccugacugaccacaggguaaaaacagcugcuguagguggaaaaaaaaaaaguuaaaaagacaaaaugauaccgucccauuuccccaugccacccuaacccuaccaagaaaaguaaaagaggacuagguggacauuaggaauaaccaagaauaaagcuguucuuucaaacugagaaauaaaagaaaaauucaccuuuuuuuuuuuuuuauaacacuucaaauaccuacuguuaaagagggccuuccacuuuuaugguuuguuucucaaguuuaaucuacgaauccaaucucuacagagaaacaguaacagaaagaaaguaaucagacaacagaucacccacacauucaagcccaguuaaaguuggcaagaaauguaucuaguuaggcuucuacgguuaacaaauguauucauuucuucgcccagcuuucacuuguccaggggaaagaacacaagaccgaauuguacuucuguuucaagaggucacuguaaaagcgcacuucggaguguagacgucuccgaucuguuccaacaugaccaccucuuuggaccaaaggccagaaacugcuaaacgcgugcccuauuauuuaaaacgugcaucugcacccacuuugcuaagcagcaucagacccaggcgaggggcggggaaaggggcggcgggucccacucguagccucaggacgacgcagccacagcuuccuagagagcgaucucggcagaacggcaggaagcaugcggagaggaaggcggggaggcggcacgugcucuccgugcuggguccgccgggccggccgggugacccucgccagcugugggggagcggagagguccgcgcccccgggagcucggguggacgccgagacccgggagcgggaggcggcucaccuggaccccgguguaauucucgaagaagaagagcaccaugcucugguagacgcaguagagccggucguccagcgcuugguagaagcgggcgggcaggaaggcggagagcagccgccagaccccccaggccaacacguaggugggcgccgugcccaggagcacgacgcugggcagcagguagcgcauggaguacguguggagcaccagggacagcagcaucuucucagcucggcggcagcgagcuccgccugcgcuccccgcccgccucccgggccucagucgcggccagcaggcggccaaucaccgcccgggcccgggccgccgcgcccgccacccgcucccagccuccgcccccagccgcaugggccgcgccgccgcccggggccggguaggcgagugcggggcugcgugcgccgcucccggcggcaaagcaagggaacccgcggcccucccggaucgauggcucagggaugcucacaccccaugacccucacccaucgccacaucccccugccggggcagggggcuccg

SEQ ID NO: 191846 - RNA, 11376 nt, Homo sapiens
ucccgcgcgcccggccccgacuccgggguaaagagccccggagcggagcagcgcuggccgcgugccgccuccggagccggcagcgugaguggccccgcguccccgcuucucccgguccccggcggggccgcgucacccggccccgccccgcgccgcccgccccgccccggacgcggggguaagggggguggccgcccgccugcccucggucccgugcgguccccgaaacuccgagcacccgcccggucccggcgcggagccccucggcgucgcguggagcugcgagucgcccgcuuccggaagcgcacacgggccaguugcggcggcccaucugccggggcggcgggggcucggcgggaggguugaggcugaaucacgcgcagccugcgggcggcggaaacgucccuagagccucgccgcccugggacccgggcugcuuccugggagaggauuacauuuucucccugcuccacuugacuuucuuccggaaggagcaggucucgcaggaucggggccaagacuggaagaguucagguuugggagucguguguauaacagccccgcgccuccacgcccaggccuguguggcuuuggacaaguuauauaaccaccgccgccaccccaguuucuucuccuguaaaauggagcuuuagugccgcccagcaggguuguugggauaauucagugacucuguggacugcccagcaccugugaauugcuuuccuggauguugggugaaggccugugagcuuguauguacccuuuggcuucagaauaccaagccuuuaguguuucagagggaugagagaaagaaaucccauuuuuugaugcagaggauuuuguuguaagggacucuaggaacuaagugguuccaaugugaauuuguaucaaaguaacaaaguucuaagugagagacaaaaaugauaacauucaaggcacgaugacaagcgguggucaauuuuagaaucaccuagacgugacaucaggaacccaaaaucacgacacagauuuuaaagcuuaugauacagugaccuagucccuagaaaaaguaguucucggcugggcacgguggcucacgccuguaaucccagcacuuugggaggcugaggcgggcggauugccugagcucaggaguuuugagaccagccugggcaguauagugagacgacccccaccccacccccgucuuuaaaaaaaaaaaaauaagaauuacccaggcaugguggcacuugccuguauucccaacuacuugggaggcugaggcaggagaaucccucgauucugggacgucgaggcugcagugagccgagaucgcaccacugcccuccagccugggugacagagugagacccuguuuuuguaaaaaaaaaaaaaaaaguaguucucauccuaaaaguuugucaaucuaaaaccaaccccuaguuguaauauauuggcaaguuuauauacucuuguuuacuugagacuuaauucagcccauccuagccucuccuuacugaaauaguucaagcauuacauuacaggaaaaugugaaaaauggugucuugcuuuagauuccagaggaaggcuguggugguaugcaguaagcacgcagcagguguauguguguacacuugguuacacuguggcaugccggggaggaggggacggggucauaguucaggcugccugugggcugugggucuguacugugacucaggaccagagcacuccuuacuccuggcagccuuauaaagucaugccauugaucaugauugaggacugggcgggaaaggccuccccucugcaaaucuuucacaacuacacuccuaaaaauaacucaagugcaugugccuggaagcgcagaagagugacuucaugacauaccaaucauguuguauaauauagguuguauaauucacguuaaaauuuuaccguucuaugucagcaguaauuagaaauuuuuuccuaaguguaauuaaagaccugcauauuuggggcaggaggaaguagcgcuuuugaguaggaauauaccauuuacugaguggcacaugaacagaaucuugugaaaaauuaaaguaagaaauuaaccugguucugauccauuuugucauuagaaaauaggaaacauuuuuuaauuugucagauaaaugacacccgugaaauguucuaguggccagugcuguaugguuccccguuucuugccuaauuuguuaauaacucucaauccugaaagcugccucccuugcugcauaauuguccugggccuucugcagcaucucaaaucagacacauaaagucaucuuuuuuuugccaaacacggugguggugguugcuauuuuacacuuuggcaccaacgaaguuugagauuccauaaauuauaaagacaguuauagugucugggcuuccaaaaguuuccaugucuaaaguaggcugauuacuuacuauaaaccauaaaguuacauucagaggaacucuggaauuuaguuuugaggaauaagaauugaaacucucaauaugucaaauaccggccgggcgcgguggcucacgcuuguaaucccagcacuuugggaggccgaggugggcggaucaugaggucaggagaucgagaccauccuggcuuacacggugaaaccccgucucuacuaaaaauacaaaaaaguagccgggcgcgguggugggcuccuauagucccagcuagucaggaggcugaggcaggggaauggugugaacccgggaggcggagcuugcagugagccgagaucgugccacugcauuccagccugggugacagagcgagacucugucucagggaaaaaaaaaaaaaaaaaugccaaaugccaaauaccucuguaccucucacucaaaaaaauccacagccagucuuuaguaucuaggaauuggguauagucuaguguuuaaacaauauuuagauagugcaucugcaaauuuuuacaacuuaauuucuguuuuuauuguucucuggcuaauuuucacgagacaaaucuuuauauucagcagacacccauaguuaguuuagucaaaucacuccugcccucagugugaagaguugaaguuaaauggcuguucaugauacucacuuuauucuaaaggaguacaguauguccccaaacaucugacaaagucacguugucagaaaggcagaaacaugccauguggcuuaggaacagaccucuccugaaauuucauuuuucucauauagaggcaagcuaaaagaaagaacucugcccucaaaacauguauauuaacuagcuggccaaaucuacacuaaugaacacuuuggagguuuacagcauggacuccugcaagacauuuuagugaaagaauuuuuguaaugccuucauuguuguaggcagcguagaaaaaaaucaccaaacaacuuuuuagacuguuuuucuugguauuagaaaaugacugauucucagaaacuacagugcaacuaucacuuauauuuguccauuuuucuccuguauauagagugucuaaaacaacacuucuggauuuucuuuacauauuaggucauuuuacuuagacuuaccuuuuaugucccaacacaagggaggaacucucuuuaaagaaaaauucaguuaacuucucaaacacaaagaagaagucauuacuuuuacuugcuguuugaugcacuugcugugaccacucuaacuuucugugggaauguccaaagaaugcauuuccuaggguagaugucacagcugugucaauagcaaaauguaucuuuucaucccauagcuucuuucaaccaaauuuguccagcaggccaaaacuagauaaagcucuaaacguuucccagugugggaggcaugcggggugagagagccauguucuggcugucacauccuugcuaggcugcugugcaacacuuuuguagcagcacagccagguguugagucucugugguuuuuguuuuuugagauggagucccgcucugucacccaggcugcauugcaacugccugaccuccgcucacuguaaccuccgucucccagguucaagcaauucuucugccucauccucccaaguagcugggauuacagucacccgccaucaugcccagcuaauuuuuuguauuuuuagagaaacaggguuucaccauguuagccaggcuggucuugaacuccugaccucaggugaucacccaccucggccucccagagugcugggauuacaggccugagccaccacgcccagcagagucucuguuuuaaaguauucuguuacuuuccucuggguguuacaauuuggaaacugcaauaacauuucaagcucaguccuuuuaguaauauuauuuuuuaucccaaguuucuuaaagggccagauuguaaauauuuuagguuuugugggcuuugaaacaaaaucaauauuguguaggugcaguccuugguauuugggagauuggugccaggacccccucagauaucaaaauccguagaugcccaagucccgauauaaaauggcauaguauugcauauaaccuaagcacauccucuauguacuuuaaaucaucucuaagcacuuacaauaccuaauacaauguaaaugcuauguaaauaguugguauaauguauuuuuuaaaauuuguauuuuuucccaaauauuuuccauucacaguugguugauuauguggaugcagaaccgucagauagagagggccaacugcaccauuuaaaaugugccacuuagaaauguaaaucccauucuuggcucaugggccgcacacaaacaggugguggacuggauuuggccagcaggccauauguuugccaacccuucuccagacagugcuaccaucauuaauuaaaagaaacccugcuuucuuuucucucuuacagccccauggcuggggguuauggagugaugggugacgaugguucuauugauuauacuguucacgaagccuggaaugaagccaccaauguuuacuugauaguuauccuuguuagcuucggucucuucauguaugccaaaagguaaauuuuuguuucucaggguagauaaaaacugugcauuuacaaguuuugcuaguuuaagaaauaugaaaugaaugcauaaaaguaauuucaucaggcuggacgcaguggcucacaccuguaaucccagcacuuugggaggccgaggugggcagaucacgaggucaggaaauugagaccauccuggccaacauggugaaacccugucucuacuaaaaauacaaaaauuagcugggcaugguggugcgugccuguaaucccuguuacuugggcggcugagacaggagaaucacuugaaccagggaguuggagguugcagugguguacuccagccuggcgacagagcaagacuccgccucagaaaaaaaaagaaagaaauuucauuauaauuuuuguucuagugcugaaagacacugucuacucuggucucaagcauugguggccaagguuuggcucugaaaaccccauugcuggccagacacgguggcucacaccuguaaucccagcauuuugggaggcugaggcugguggaccuccugaggucaggaguucaagaccagucuggccaacauggugaaccccgucucuacuaaaaauaaaaaaauuagcugggcgugauggcgugagccuguaaucccagcuacuugggaggccgaggcaggagaaucacuugaacaugggaggaggaugcagugagacaagaucgugccauugcacuccagccugggcgacaaagugagacuccaucucaaaaaaaaaaaagaaaaccccaucgcuuuaagaaaugaagaguuaaguaccacucucagcccccaggccagcugcacuaaacucucaauucugcaauuucuaauauagcccaauuuuaucauccagccuggguucauugucacccuucauugagcacauuuuuuuuggcuuaagucccugaaugcagaaacacugacuccuguguauucagcagaucucccuuuagccaguauaagcuuuuccuuguuuuuugugcaugacuauaucauagcacuuauuaaacaauguuaguuuuaucugauuacuugucuguccauuccacaacaugucuuuuuugucuuuuacuuuuggguccuuggugugccauauaguguaaaucuucaauaaguauuuccugcuuuaauuccagauguuguagcuuaauuuaacugcuuuuccacauucccuggcuccuuucccagaaguacaguaaaaagggggaggugcagggaugcuuuaaaaagaggaagagcaguguuagauugggaugcuucugcagacacaugcuuuacagguauccugucccaagguaaaaaggcauucgagaguucaagguaauuaguaauccagaaauaauuuacguuuggccugaggaaucauucagagcccgcacuugcgcccagaucucagcugaacccuccuggagcagcuggccuguuggcugcugaacucuagggguggugagaggaggcacccugaccaucacugaucaccuggcaggugaccgcuuuccucuaaaaacagccaccgccgccuccccauguuucuuuuaaaagcagaggcacgcuguucuuaauuuuaaaaagaugucuccacuaagcccauccuauuguauuuaagaaauauguuuauucauuacuuuccaaaauuaggaucugcucacauucaguuuauucuccagcccagucauuuagcuuuaucuggaugucaugaaagggaggaaaaaucagcuguuuucuuguuugugauuuucucauaggauauuuggcuuuuggaggauugaggagaaucacaauggaggaacuucacuuuguuguguuaaauggauguguucagcuacuuuucucacagccucauacuuuuuagugaaagaaagaauacuuugagccaaggaagcagcucucaaagacaaaauagaaaguaaaauggucuugucauuuaaguccuuuuaccacagcuucugaugaccaggaucaugagcauauuacaacucuauagacauuaauacaaacaucucuucugcauggauuuuguguuuaggaacaaaaggagaauuaugaggauauucagugugccaccuacagaggaaacuuugucagagcccaacuuuuaugacacgauaagcaagauucguuuaagacaacaacuggaaauguauuccauuuguaaguauauucugugcugaaagauacacauaugcacauuuaaaauagauuuucuggaauugaguucauuuagcaaaauguuauuagaaaucguaaguaaugaaaacuuaguacuucuuucagauguuuaauauguuuuucagauacuuauccuuuguuccuuuuguauuuuauaccauuugcauguguuacuggcucaaaauaagacauauaacuuaauucaacauagcagcauuauucacaauagccaaaagguggaaaucacccauaaguccucagcccaugaaugaauaaacaaaguguggugcauacaauagaauguuauucagcccuuaaaaggaaggacauucuggccgggagugguggcucacaccuacaaucccagcacuuugggaggcugagguggguggaucacaaggucaggaguucaagaccaggcuggccaagauggugaaacccugucucuaccaaaaauacaaaaauaagcugggcacacuugcgggugccugucaucccagcuacucgggaggcagaggcaggagaaucgcucgaaccugggaggcagagguuucaguggccuaagaucacaccacuggacuguagccugggcgacagagcaagacuccgucucaaaaaaaaaaaaagaaguacauucugacaugcuacacauggaugaaccuugaagacaguacacuaagugaaauaagccagucacaacaggacaaauauuggauuauuucacuuacgugaggcaaaucacagagacacaaaguagaauggugguugccuggggcuauggaagaggggaauagggaguuuaauggguccagaguucaguuggggaugaugagaagagcucuguggauggaugguggugauagucccagcaaugcaaauauauguaaugccacugaacuguacacuuaaaaaugguuaaaaugguaaaguuuauguuauguauguuuuaccacauuaaaaaaaauccuuuuaaagaaacauaaguauuguuuaaaaaaaaaaguacagagccuuggggccaggugugauggcucacgccuguaauccuagcacuuugggagucugagacagguggaucacuugaggucaggaguucgagaccagccugccaacauggugaaaccccaucuuuacuaaaaguacaaaaauuagcugggugugguggugggugccuguaaucccagcuacucaggagguugaggcaagagaauugcuugaacccaggaggcagagguugcagugagcagagaucacaccauuacacuccagccugggggacaagagugaaacuucgucuuaaaaaaaauaaaaaaaaguacagagccaggagcucuguaugaaaaauucuaaguaaagaacuaaguuuuuauugacacguacacaaaaguuauuugcugucaguaauaugcucaguaacauagcagauacauuacaaacccacaguuuauuucuuuuuugauggaaaugauauaaaauaaaauugauccaaauuucuguuugcaagguguaucaguuuucuauugcuacuguaacaaauuaccacaaauguaguggcuuaaaccacacgaacauguugucucacgguucgguggguuagaagcuccacagcagcugcaccgugcuaacuucagggugccugcaugguucuguuuuucuagagccuccaaggaaaaucccugucuuugccuccuccagcuucucagggccauccacacuccuugggucacagucccuuccuccaucugcaaagccaggagcauugcaucuuucugacuauuucauguccacaucuccuucucucagaacuuaggcaggaaaaaagcucuguaauuuuaacggcccaucugauuauguugggcagauaauccagagucaucuccccaugucaaggucccuaccuuaaucacaucuucagagucccuuuugucuugugagguaacauaggcacagauuauggguuaagauguggacaucuuugggggccauuaugcuuauaagcagugagcacauguguggauuugcacauuuaaugaaucccagcauaauggguccuuaguguucgugauguauuuuguccugacagagucuggugguuccaaagacacaggcaacagaauucuuuuuuaaauagaagacucccgaaguuguaagcuuugggcuacaaaaaucuggaucuacccugaguagcauaaacaaauaguaucucuuucuuggcuaguaaaaaacuuagaagagauuggccaggcgugguggcucacaccuguaaucccagcgcuuugggaggccgaggcggguggaucaccaggucaggagaucgagaccauccuggcuaacacagugaaaaccugucucuacuaaaaauauaaaaaauuagcagggcaugauggcgggcaccuguagucccagcuacucaggaggcugaggcaggagaauggcaugaacccaggaggcagaacuugcagggagcugagaucacgccacugcacucuagccugggcgacagagcgagacucaaaaaaaaaaaaaaaaaacuuagaagagauugaaaguuuuaaagcuaagcaguggaugacacaaagauuuuuagcccuguauuuucucuaguuucaaguuaagacaguuuuucuucaauuaacguuucuuagaaguacaaaaagaagacagaauugcauaucuauuuuuucuucuaguuuauauugaagacauuuauuauauguuuaaucaacaauaagccuguuagguuuuuaaguuaaaauauagucaaauuccuuauguguggacaaaagcauuauuauuaacuuuaagauggaaaugacagguaauaaaggaagaaauuacuaaacauuaauuuuaauagcuuaggucaggcaugauggcucacaccuguaaucccagcacuuugggaggccaaggcaggaugaucguuugagcccaagaguucaaagaccagccugggcaacauggugaaacccugucuauacuaaaaauaaaaaaaauuagcuggguguggugauguccaccaguagucccagcuacuugggaggcugacguggcaggauuguuugagccugggaggucaaagcagcagugagccaugauugugccacugcacuccaacuugggugacagagugagacacugucucaaaaauaaauacaguuuugaaauuuuaauagcuuaauguuuauauuuuaaagcuaugaauaauccugauacaugaauaauaauaauaaacauauaaaaaugggcaucagcaguguugagaaauuagaggaucaugaaguguaauacaucuuuuccaaagaaacaaaauuguuuuaauucuagacuaauuacuuagcgggguacaguggcucacaucuguaaucccagcacuuuaagaggccaaagcaagaggaucacuugaggccaggaguucaagaccagccugggcaacauggcgagacccuaucucugcaaaaaauaaaaaauuagccgggugugguggugucugucuguggucucagcuaccugggaagcugaggugggaggauugcuugagcacaagagguugaagcugcagugagcugugauugugccacugcacugcagccuggguaucagagggagacucuaucucugaaacaaacagacaaaaacuaauucuucauugagaaucaugacuugacuguaauguaauauuguuaaguaguaaucauuuugcaguuuuauuaauuuuaucucuucuuuuucuuguugugaauagcaagaaaguacgacuaucagcagccacaaaaccaagcugacagugugcaacucucauuggaaugaaaccucagaaaaagagcaacagaaguaauuguuucaagcuccugauucuuucuacuaaaucaugaacagcuuuaaaaacauuucugucugcauaaaauuauuuuacuuguaacuuuuccccaauuguucugugcauuguuuugccuuuuuaaauuacaucuccaaguggcucaaaaggccuugacacagggaaccugcacauauccaggauauguguaaccagcgauggugacuugaccuugccaagaccugugauuccuucaggauacaaucagugagaaauaaaaacacaucuugggaagugggaauccuggaguuuaugccauuugcaauauuaaaaaauaaaaaugcaaguuauuauuucaauaauaacuuccuguuucauugua

SEQ ID NO: 191847 - RNA, 123076 nt, Homo sapiens
gcuuccggaagcgggcgacucgcagcuccacgcgacgccgaggggcuccgcgccgggaccgggcgggugcucggaguuucggggaccgcacgggaccgagggcaggcgggcggccaccccccuuacccccgcguccggggcggggcgggcggcgcggggcggggccgggugacgcggccccgccggggaccgggagaagcggggacgcggggccacucacgcugccggcuccggaggcggcacgcggccagcgcugcuccgcuccggggcucuuuaccccggagucggggccgggcgcgcgggaaacgguuaccgagcggaccuggacgcccucugccuucgucauuuccugccggccggucgguuuccggaugaaacgaggagccaggucuuuuuuuuuuuuuuuuccuuuccccuuuucaguuuuuugagccggagagacgcagcggcggccccagugccgcccccgggcgcgugaguggagccgggcuccuuuccccuaccgcgccgcgacccccgcccgggcugcgcgcgccgccucccgcgagcccccggcccgacucccgggcucccgcgggugggggccagggcuggucggcgccggcggggcucgcggcggcggcggguugcgucccccgcgccugcuggcccacguggaccuggccgucgcuugccgugcggcgccuuugcgaaaacucgacggaaguggcagggaccgggcauuaccugcgagugccgggcgccuccugcuccgcugugcgcgcuuggggugggacucggcgggggaggggucguguacauugucccaccaggcgcaauguagccgggcggcgcagaggauuucuuuuuuggucuugagagcauagagucccuuuucauauucacguguacucuuaagaaagcgucuguucuccaaacuggcuuuccauucuccccguccuaaauggugcguggcugacaccguaguguuuucaaaacuggauauggccaggaugcuauagcauugucaguguaagucccuuuuggguauuuuuauuuaauuguguagugacuugacagaaguguuucccagcuugaccuaaguaaugaauuugcauaggauuucagcaucaguauggaagugaucagaugucaguggcuggugccaccuugcagauaaauggccacugguccacguaguucgucuuuacuauacauuuugauuaaguucucuaggaccagcugacugguaauuauaagucacaugaaacccugcagagaugagagcuuacauugaacacuucuuaacaaguuuucuauucuuuguuucaucuguuacaauuaaacucaccuucgucuaggguaagaccauuacuuuacgcaauaacauacuagcuuaauuuacgguauuuauauguauuuauauauauuguauauacauaaucauacauauaauucuauaacauuuaguuugacucuaaaguuggaaaaucaggaaaauaacaggugauguugaguacugauuguuugccgggccugugccaaauggugugcaugcuuuauguaacuuaaucuaaaaaaauuugaauacgugaguuugauuucaguguguccaaaugugaaacguguacauuauuguuauuguuuuguuuuuuuugagacgggguuuugcucucguucaggcuggagugcaauggcacugucuuggcucacugcaaccuccgccucccggguucaagcgauucuccuuccuuagccucccagguagcugggauuacaggcgcccgccaccacgcccagcuaaguuuuguauuuuuaguagagacggaguuucaccauguuggcuaggcuggucucgaacuccagaccucagguguuccgcccgccucggccucccaaagugcugggauuacaggcgugagccaccgcgccgggcaaacgugugcauuaaaugcuuguuuaugccuuuguaaaauaagaguguuggcaauauaaaauguuacccauagaguaaauuaauguguuuuucaaguuggaagauggcuuuaaaaauucauagaaguacaauuagucccuuuauuuaggugcugaauaguuuccaaagccccgugucucuuauuuaucagaguuucuauuauauaacauugucacccagugaacaggcuaugcuaggacauuggaaaaagguaaauauugagaaagcccuaaugguccuuucuuaaauggcccccucuuuccauauuuaauuucuaagugacauuccuaauuaaggguaaacaaacauaaugaaacaaggcuaauuuuccaauaccaaacuaaaaaaauaaaaaacaguggacuggcuauuacuuuguugaugagucuagcacaguuuuacugggcauuuaaauguuaaggauguuauuuacauuguagcuaguugugaaagauuugugugucuaaguuuuuaguuugccuuuaaaugucuugaacauaugcuuaguauugaguccaguacuuugugcauuaauaguaaguuuuuugauuggauuuaauugaacaguuuuggcuuccuuaauuuuauuuugaagauagaauuuaaugauuuguguaggcauaacaguuacaauuaacagugauuccgagaugagcguaggguuuaacuuaacaguucacauuuucuugcgaguugaaaggacuggagaguuggaugugugucuucuuugugauuaaaaaagcaugcuggaacuuagcuaucagaagauucuggugguccaucuuugggaagaggaaaagauuaagaaugcuuugcuagucaguauuuacaagaggguuucuuuacuuaaaggcauuuucucuuuggggaggggaggaguugagaguugucauuaauggaaggaucuuagaauaaaaaagauguauacauguuuuccuuuggagugaauuugugacuggagaugggguuucacuguguuagccaggauggucucgaucuccugaccucguuaucugcccuccucagccucccaaagugcugggauuacaggugugagccaccgugucuggccuaugugcuuuuuaaagauggaacugauuuagaaugcaguauauuacaguacaugaaaaaauuuuggaauuucuguauguuuuucacuguuggaaagccauagugaguguaauaacagcauuggcuccuguucauaaggcauuuaaaugauguguuuccuaugacaggaagacaagcguuucucauuccuucaaaauuuggcucucagauggagugcccuuuaagcucccugaaugcagggacuucuucuguuucacucauugucuuuuuucuggggccuagaacagaaccuggcaaacugagagugcuauguaaaccuuuguagaaugagcacuuucccuggggaauccucucuccacuuuccacuagugaagaucccaccugcuuuuaggugcagggccacuccagccugacuuucucugcaaucugcagcccacaaugauucuuugaacauuaacuguguauaccacacucugugacagugaaucuuuuauagcuuuauauugauacaugaguguuucauguauuuuguuuccucacccaaaauauaagcucuucaaggcuacaggauauccuauuuuugagaauugccuugguauccaguauaauauauaauauuauauaauaccuauaauauauaauguaauauauguaauauauaauauauauaauauacauguauauauacagaguagguuuauauuuaccuauuaaaugaauguuacauaccguggggaaacaucaaagauacucaaaaugguagguuauauuuuaguuaggcaaaccuaguguacacaugugaaacaguacuagaauuuggagcuaaauaagaguuaauacuuaugucgugcuuaaaaugugaaccucacaacaauccuuugaaguagguacaauuauuuccucauuuuucagaggaagaaauggagacacagcaaaguaauuaaguuuguugcucaagaucguaccggaaaucauaaguaggcagucuggcuccagaggcggugugguuucucuggggagcuuuacuuuauacuucgaagggacaucuaagcacuacuuuugcagcuguaagagaugcucuuuuaaaaauuucaaaguagcguaagagauugcagugucucuaaacugcagaaggaaugcuggauuuucuauauagaggacauugauaauggaaugguuaaggggacauuauauauugaaaugacuaaagaugguggagagaaacugaaguuugaaucucaaagcugaggauuaugauuuuuuauagauacugaauucuagaacagugauucaccaggacauaggacaaugauugcuuguuacuaauuuaguaucaaaaaacuuaugccaaauaaaauaauauugaaugacacuggauaucuuacugcauuucuuuuuuuaaacacuuaccagauuugaagcccuagugguaguaauuuaccuuaauguggguauuacuaaagguuuccuauacacuucuguccauuugcuuuaucuuuuuguggaaucuuuuuuuuuuuuuuuuuuuuugagacagggucucacucugucgcccggguuagaguacaguagugugaucucacugcagccucugccucaagcaauccucccaccucagccuccagaguagcugggacuacaggcacgcaccacugugcucagcuaauuuuuaaauuuuguguaaagaugaggucucacuauacugcccaggcuggucuugaacuccugggcucaaacaacccuccuccugccucagccucccaaagugcuggguacgucagugagccauugugccuggccuuuuuguagaaucuuuuuuuuuuuuuuaaacagacuccggcucuguugcccaggccggagugcagcagcgcgaucuugccucacugcagccccugccucccggauucaagcaauucuucugccucagccucccgaauaguugugauuacaggugcuugccacuacgcccagcuaauuuuucuauuuuuaguagaagacgggguuucaccauguuggccaggcuggucucgaacuccugaccucaggugauccacccaccuuggccuccuaaagugcugugauuacaggugugaaccacugugcccaaccuuuuuguagaaucuugauucacuuuuucagguuguauugagcaauagagaaugcuguuggggucaggaggucucuucaaaccaaguaauacuccuuugguggaaaaaaauguaaaauugugugauugauuuggugacacaccuggaauaaagucaguuugaagcuguuuagaauuagaugagggccuauaaauuucagcaagaugaagaacagugguauuucucugaaagucccaguaugucucccuuuuguugggagcugacaguaugauuuugggggcaucgggcaucaacagucacugaaucuaaauggcuccacagauaggggaguguauacaucaccacaccagcuguccaggaauuaggaggaagugcccuugaaugaagccugggcugcaagccugguuagcagccagggaggacacacacacguugcagguacaguauucuguauuacacagauuguuucuacugggaaggauaucauaucauuuaucuuggggguagcuucagaauuugagucagugaugaaaugacuugcugcuuucguuaugcucccuuaagaagaacaucauauauuucgggauggccugcauaaaagaaacuuguaauaaugaauauugaccuauaccuuguguucuguuuaaguaucugaggaaguaauuuggaaaacuugaguuaaaauagucuauauuguaguuuuuauccaauuugcacguuagcccuaaucuucauuucagacucuucccugaaugggaaacuuuuagggaaagagagaaugauacacugauuaauuuauuuucagccuacgaagcuaggauaauuuaaugaaaucucuaccagucccauguuaugaauuuuaggguuggagagcuggauucuggacgugaucuauucuuuaacuaggaauguacagcagaaugacccaggguuuauccugaaaguagcagaugucuucacuuaacuccugagacgcaaauuugguagagcugcugccacaggccccggacaucaguauuaaaccauccuuaagugauucuggugccuuuucuccaguaagaagaaccagcccuguauuuuauauuuaagaaaaccugggcaaacaaaugacuugccuagauuugguucagugguaccaagauuuagucaccagauaauacaguuucagaauccuauggcuggaagaaguuuaccaagucaucaauucaguaguucaucuuacagcggaguguaaaccaugcuuuucaauuauuugcgguucuuuuacuguauacccugugaugcccuuuuaaguuuuuuugaaaauauuguauacuuaaaacugaagugaaacauuaaaauuucuuauuagaauuauuuuucagucuuagcugaaauacaauauuguaugaaaauuugcacugcauuauuaguuuuuuuuuuuaaucuaguugauuuucaacuuuucuuuuuuaaaggcaucuccuuggaaacaaugccaucuuugaaugugagagauaaaccuaguuucagcaugucugcagcagagaccaguacaucaggcuuauucccacaggaagccuccuaaagccuguggcgcggcaaccauuuccaggacuaaauaauaaugugucagaugccugugaguggacugccuggccaaaugacucaugaagauauucacggaagaauagucaaaaaccaaagaaaaggcauauucuagaagcaccuucaauuccaucgaggauuuuugagcagcugaagaagaaaguucugaaaauaugagugacaggacuccagcacauuuuuuuuaguuguuucuuacauuaucuuuguuaacccauccgcuuuuguguauaauauuaaguuauuuuccacuacugcaauggcuaguaauuuacuuaggcucagaguuuuacucuguauggacagagaaauaggagguaacaacagugggagaacaaauaggaacaguucacugggauguugguccccagaaauuggcuuucauugaauaauuccuaaagggugucgugugcugaauugcuuuuucauagugaugugcugcuucuuguucauacucuuaugacuuuaauuucaccuuuaucuacucccagccucuguauaugccuacguuuuuaaaaauaauuuuuggcacugaagaucugauuaccauauuuuuucaguuuaaaaauuaaauccucgcaaauagaucuuugguauaguugcauucuacccuagguuauuuucuaggaucaagaauagaacaauuucuguucuuuccagcauuacucuuuacuauucauauguucuuguucaguguuuuguuguucucauauucuagguggaaaugaaggguaaucucuauguucuauuuucaguuuucuaggaaaccagaaaaacauggguaguagaaauguauagaaaauguaugaggucucuuaaccauuguguuaaacuugcauuaagcuucuuuuuuagcaauaucgaugucaguguuaccucuucuuuccuuuuuauuuauuuuuuuugagacagagucucauucugucgcccagacugguuggagugcgaugaugcgaucgcggcuaacugcaaccgcugccucccagguacaaguaauucucgugccuugggcucccgaguagcugggauuuuuaguagagaacagguuucaccauauuggccaggcuggucuugaacucgcaaccucaggugauccacccaccucagccuccccaaaguguugggauuacaggcaugagccaccauaccuggccccuuuuguuguuuugaggggcaggcaguaagaagcagggauuucuucaaaugcuaguaagcacaaagagagggagaaguuuuuguaaguaacgaacagggccgggcaugguggcgugagaggccgaggugggcagaucacgaggucaggaguucgagaccagccugaccaacauagugaaacccccgucuccacuagaaauacaaaaauuagccgggcaugguggugcacgccuguaauccagcuagucaggaggcugaggcaggagaaucgcuugaaccugggagguggagguugcagggagcugagaucacgccacugcacuccagccugggcgacagaguaagacucccgucucaaaaaaaaaaaaaaaaaaaaaagaacaguugaucauuaaggccauuaaugugcauggacaguuuguugcccagguuggagugugaugacgacgcaaucucgguaaauauaaaccuacucuguaaccuccaccuccugggcucaagcaguucucgugcuucagccucccgaguagcugggaucacaggcaugcgccacuaagcccagcuaauuuuuguauuuuuaguagagacgggguuucaccauguuggccaggcuggucuugaacuccuggccucaagugaugcgccugccugggccucccaaagugcugggauuacaggugugagccacugcaccuggcccaauaggcacauuuuuuuaauaaguaguuuguugauuagaacgaagagcacuugccguaagugcaugucauuguuuucagcuguuauggcuaagucaguuaaccucaucaacaauuuuuucuucuguaaauugaggacaauuuuugcuuuuaugaaugaagucuuaaccagcaggaagaaauauaaacaaaggaacauauuuuuaauuuaaugaagcaaaauuccauacaucauuuugaaaauaguguuucuuucccugauaggccuguucugcaucauucuuuuagcuuccuucugcccuguuuaucacuuggucccacuuuuauauuuuuccucuucgguccagaauuucuuauuuaguuucuuguauuuugccuacucccucccuucuccaugauucagccuagucuuuccguccucuguggacuugggugugccuuccucugggccaccucgucuuuugcugcuguuagcccucccgccugcgcaccugccacuucacccucgccugugguccacuuacguuccacucagcccggucaguccugcuuuguucuucuccaccgccuuggucucccgugugucuuaucuagcucugguuccuucucgucuccacauuuauuuuguuuucuuccugugcuuguuaguccuugugcacuugguccuugagcucuuuuucuauuaauagguauuacuagauggauuuguugucugccuuuacauagaacacacauccuuacugugcauuuccuggguagccaggaugaaucaauuauuauuaacuucccuucgaacauugagcuuccucuguuuucuguuucuaagaauuagauuaguauucuagaagacuaauacuacuuuaaagacagucaaaacagucauacgcugccauuucagcccuuuauuuaagaguuugugacauuuaucacucccuugaaagauuaaagaacacccaaagcaaguuugggguggagguggggaaggcaggaagagaaagguaagugcuauaaaaggacucauuguuaauuucuagaaauuggacugagaucugaaagcauaagccuuaacauuuuuuagauaaacggucccugaaaagaauaaaaaguaucaguacuuccguuaacuagcuuuaguauugggucauuuguaguuuacauucuccuuuaaguuuuaagaccuucaguaguuaacaaagcagacagagacuggccaggcacaguggcucacaccuguaauaccagcacuuugggaggcugaguuggguggaucacaaggucaggagauugaaaccauccuggccaacauggugaaaccccgucucuacuaaaaauacaaaaaaaaaaaaaaauuagccaggcgugguggcaggcaccuguagucccagcuacucgggaggcuggggcaggagaauuucuugaacccgggaggccgagguugcagugagcugagaucgcgccacugcacuccagccugggugacagcgagacucugucucaaaaagaaaaaaaaaaaaaaaagcagagacuuaaucuuguaaauacucauuuuauuuuugagaggcuuaaugucuccuuaaauauuaaccugugucauuuuguaauuauacuguaauagugucagaaugccauuaacaaccaacccuuuucguuucuugugugggaaagcucauaaauuguguggucuuaccccucuggacccuguaguuguagcauugugaaaauggagcuuuuggcaaaacuuuguauuaugcuguugacucacauugucucauauuuuuccuuuauucuucuauauucuaugaauauggugcuguccugucauuuaauuauuauaauauaugugaacugcuggagguagacugaugugagugcaguuuuucaacuuaaaaacccuuauauaucacauucaugguguuuaagauauaagaacagcccuacaaagagggguugauuguauugaagauucuuucugcugagccugccuuaauugugagggugguuguuuggguaucuuagagcuaaaagaauggcuaagaguccauuaaugguccuguaauauucaccaucccugagcaguuaguaaagaauggccgcaaagccacaauuaggcuacuaacaaggaacuuauguagaugugcuagguccagccuguguucuggaacuauagagaugaauaagguaugguccuuucucucuggaggcucacaguugaauagggaauauuaauacgugaaugauagcaguacaguguggcagaugcuaaaauauauguguguagcagcuauuacaggagaacugauuaauagggagagucuggcugggcucagugacucaccccuguaaucccagcacuuugggaggccgaggcgggcagaucacuugaggucaggaguucgagaccagccuggccaacaugguaaaaccucaucucuacuaaaaaauacaaagaaaauuagcaaggcgugguggcgggcaucuguaaucccagcuacuggggaggcugaagcaggagaaucccuugaacccgggagguggagguugcagugagcugagaucaugccacugcacuccagccugggugacagaguaagacugucucaaaaacaaaacccaaaauacuaaccauauuuauaguuagucaccucacccuuuuuuuaguuaaaagaaguuuauuuagccugaucaguuuaccagaugucuuuuuuagugacuuuugugucuuccauaaauccauucucaaaauuugcaacaguugagcauauuugaccaaaaugugccacagguuucugaagccuguucaagaagaagcaugucaacauuauuggaguaggucuucgcaaugacuacuuuugggaagauuugaguaaaauuuauggauacagaaguuuuggaguauguuagaauauuacuaagucuuuuuauaguuguaaucccaacacuggguuauauauauuuaauaccaaccugaguauauuuccugaauaauaucuguuuuggagacuuggacaaaguuaacuuuuuugcuuuuuuaaaaguugcuguuuaaauuaacuuccugcauuucuaauguagaaaaaauauggcacagugauuugaauuuuguuuaugguuuauuaucuuccuaaauuaucagcucuuuaaaauaugggucucuggccuguauaccaucugauaaauuagguuggguaaauuuuucaccugaaaaaauucauucuuuugacccagguuguuuggcuuggaaaaaaaaaaucacauacucauugcaugauuaaacuuguccaucagauugugauuuugugcguuaugaggauuguagcugggguaauuuuaaaauguugguauuuggauagaacugccagcccaggauuuugauaaagaucaaaauauauacuguaucuaaaguuucuuuuuuaaaaguuauuucacuuauaaucaaaagguuuaaauaaguuuaguguauauuuuaugauuaguauuauuuuguaucgauucagagagaggaaaacugcauucccauagacagggagacuuggugcauuaauauccaaagcuuaguuuaagcuggugaugauuagaaaaguggcuuucauuuguguucucuggaagauucucaguaguccugugggcaugugaacaagagcauguguaaucuucauaauguaugucuuguuagcagaaaugucugaggcauugcugagauguaggaugagcugagguacugguuuugucuuucaugguucccuauuauguuuuuugagaaacugagcuuuuccugacaguguuuaguuuuucuuggcuauuuacuaugcuauuaauaguaacaguuuccauuauggagccucaguagguucuugacauacauuaacccauugcuauuauguaauuuucuaauaaaaugaugugauaaaacauauuuucuguaauauacucauagaauaugugauuauaaguaaauaaauagauguugggguaguccuccagauugguuguauuacauuuuauuuuuuucaaaauucuuuuaauuuuaaaauuucuuauuuauuacauuuaaaaaaaugaggaaaugggccaggugagguagcucacacauguaauuacagugcuuugagaggccaaggcaggaggaucacuugagccuuggaguucgagagcagccuaguuaacauagcaagacuccaucucuuugaaaaaaauuagcugggugugguggcaugugccuguagucccaucuacuugggaaagugaaguggaaggauugcuugagccaaagaguuugagguuauggugagguacgaucacgccacugcacuccagccugugugacaggguaagacccugucucaaaaaauaauaauaauaauaauaauaauaggccgggcucgguggcucaugccuguaaucccagcacuuugggaggccgaggcggggggaucacccgagaucaggaguucgagaccagccugaccaacauggagaaaccccguuucuacuaaaaauacaaaaauuagucgggcaugguggcgcaugccuauaauccuggcuacucgggaggcugaggcaggagaaucgcuugaacccaggaggcagagguuaugguaagccaagauugcaccacugcacuccagccugggcaaugagcgaaacuccaucucaaaaaaaauuaaaaaaauaaaauaggacauugaggcaggauaugauggaauuacccaagaucgugcagaaaguaaaugauuaagccaggauuuuaaucuaagucugauuaaauccugugcuuucaaccacuuuucuguacugccuuuucaaauauuuccccuugaaaaaguaaaauuuggcuguuuuauaaaugcauauucuuuuuucuuuucuuuuuuuuuuugagauggagucucgcuuugucgcccaggcuggagugcaguggcauuaucucugcucaaugcaaguucuccuucccggguucacgccauuguccugccucagccuccugaguagcugggacuaaaggugcccaccacuacgcccggcuaauuuuuuuguacuuuuaguagagacgggguuucaccguguuagccaggauggucucgaucuccugaccucgugaucugccugccucggccucccaaaguucugggauuacaggugugagccaccgcgcccugucauauaaaugcacauucuuuugagcuaaggaguacucuaucaauauccugugguauacaccuuuuccaaaauaacauaucuuuguuccugguuguagaaguaaugagguucaguguuaagagcaaucagugcuuagugguaauagaaaaucagguaauacagaaagguauaaagaagagagcagugaaaaugacuaguaguucuaccacccagagguuaacauuuugauguauagucucgcugacuuuuugguguauagacacauacacauguuuuuaaaauacaaauagauuuauaauaggcauguuguuuuuaauucuaauuucauuuauuauauuuuggccauuauucuaugucauuauacauuuauaucuucauucaaaauuuuuuccuuuauuuauuuauuuuuuuugagacggaguuucgcucuuguugcccaagcuggagugcaguggcgcgaucucggcucaccgcagccuccaccuccuggguuuaagcgauucuccuguuucagccucccgaguagcugggacuacaggcaugcgccaccacgccuggcuaauuuuguauuuuuaguagauaugggguuucuccauguuggucuugaacucccaaccucaggugauccgcccuccucagccccccaaagugcuaggguuacaggugugagccacugcauccggccuuuuccccauuuuuaaaaaugaacuguuuuuaagaaaaguuuuagauuuauagaaaaguugcaaagauuaauagagcuccuguauacuccacaucuaguuucuuuuuuuuuuuccuuaauuuugaaauggaggcuugcucugucgcccaggcuggagugcaauggugcgaucuuggcucaccgcaagcucagccuccccaguagcugagauuacaggcauaccccaccacacccggcuaauuuuuguauuuuuaguagagacgggguuucaccauguugguaagccuggucucgcacuccugaccuggugaucugcccgccuccgccucccaaagugcugggguuacaggcgcgagccaccacacccggcccacuuuuuuuuuuuuuuuuugagacaggcucuuacucuguuauucaggcuggagugcagugguacgaacucagcucacugcagccucgauucucaggcucaagcaguccuuccaccucagccucccaaguagcugguacuauaggcgcacgccaccaugcauggcaaauuuuucuauuuuuuuguaaaggcgggguccugcuauguugcucaggcaguucucaaacuccuggacuuaagugauccacccaccgugaccccucaaagugcugagacuacagguggaagccagugcaccuguugccaguuucuccuauuaacauuuuacauucaugucauacauuugcuaaaauuaaugaaccaauaucaauacauuauuauuauuauuaccaaaauuucauacuuuauucagauuucagucauuggcugugacaguuucuuuuuuuuuuuuuugagacagagucucucucugucgcccaggcuggggugcaguggcgcgaucucggcucacugcaaccucugccuccuggguucacgccauucuccuggcucagccucccgaguagcugagacuacaggugcccaccaccacacccagcuaauuuuuuguauuuuuaguagagacgggguuucacuguguuagccaggagggucucgaucuccugaccuagugauccgcccaccuuggccucccaaaguccugggauuacaggcgugagccaccacacccagccggcugugauguuucuaagacuucuuuuuuuuuuuuuaaaugaccuugacaguuuucaguucaccagucagauauuuuguagaauguugcucaguugagauucgucuguuguuuuucucaugguuaugcugggguuaggaguuucagggagggagaucacagaggcagcaggccauuuucaucacaucauuucagagguauauacagucaacaugacucaucaguguugauguugaccuuagucacucugcuggggucguguuugcccagcuucaccacugcagaguuccuccuucuuaccuguuucugugcuucccucuugggaaggcagcccacgcuucaggagugggaaguuaugccuaccuccuugagggcagaauaucuauguagaugauuuggaguucuguacaggagcuguaucuaucuccuccauuucuuuauucaacauuuauaucuguauauacucaugaauauacccuggguuauaauccaaugcuacuuuauuuauugcucagauuguucuagcuuuugucguugggagcuauuucaguugguuccugugcccccuugccauaucccuaucaucguggguuuauaucuuaauuuuuuaaauaucugcaugguauuccauuguaagaauguacucuacuauaauuuaaccaaucccuuauugauggcaauugagguaucaaaucaguuguaaacaauacugugauaagcagucuucagaagacauuuaugaaaauugucgaucauguauucagaaaggucugcccauuuuacuuucuuuuuuuuuuuuuuuuuuuuuuugagacagagucuugcucuguugcccaggcuggagugcaguggugcgaucucagcucaucgcaaccuccaccucccaggugugagcaauucuccugccucagccucuugaguagcugggauuacaggugcucuccaccaugcccagcuaauuuuuguauuugugguacagacgggguuucaccauguuggucaggcuggucucaaacucccaaccucaagugauccacccaccucggucucccaaagugcugggauuacaggggugagccaccgugcccagccauuuuacauuucaugugauaugugacucuuaauaauacguaagcagauuucagaggcgugagcauucucacgaaaaauagagguguaucugucaccagaguugccucccuuccuuuuucuguauuuccuuuagugagggaugaugguggguguggcaccagcaguccuaaagagcugcuuugagaucacacuugucugagacaccugugccuuuucaauauagagucagcuacuguagacagcuaacaaaagaugaacuaaaacucaauucagaaaaaaacaaaacagcauucucagaguaaaaauauuagaccuggaagcaaccuuagaaaucaucaugcuuuagcaguggauuuuagaaauaggaaacuuuuuauuaggugagaugauuugccugggauuaugcaguagcaaaagcauuuaagaaucuggauuucugccucagucucagaauuucuuguuacauggguauauuuuauuuuuauuuuuauuuauuuauuuauuuauuuauuuauuugagauggaguuuugcucuuguugcuuaagcuggagugcaauggcacagucuuggcucacuguaaccucugccucccggguucaagcgauucuccugccucagccucccaaguagcugggauuacaggcgcucgccaccacaacuggcucauuuuuguguuuuuaguagagacaggguuucaccauguuggcaaggcuggucucgaacuccugaccuugugaucugcccgacucggccuccuaaaaugcugggauuacaggggugagccacagcgcccagccugcauggguauauuuuauaucucaugcaaggauaugcacaauuuuuuauguuggaaauuuuuaagcuuaaagaagacaaaauaguguaauuaaucauguccccaccacccagcuuuauaaauuuguggccaaucguguuaaaacuucuacccacuccccccaccaccauguuauuuugaaguaaaucccacauauuaaaucacuauaaauauuucaguauauucaaaaggaaaaaacuuuuuucaaagcauaaccauaauaccauuuucauaucuuaaaagccuuucuauuuaagaauauuuaguuguaaaaauuuccagaaguuguguuuaucaugaauuaaaauguggcuuuagugaaaauacaguuccuugguauacucucccagcaauuagggagagauucuguccaccagcagaauggccuggguuacagcuuuuaucaaaaucugcugucugagggucuuaguuggaagaaauaaucuccuauuugaguucuucgaggccgaaagauugauaaugacuguauggccgaucucuaacuauauauuguugcuuuuuuaccuuaauuaacucuuaagcuuuguacgugaggaagaaauuccaaggacauaucacaagaagaauuauuuuucagauuucgccacuagccgaagccacggaugggaauguggugguggagcuguuccacucagaucuucugugagggauuucugaaggucaaguaacauucuuacguguaauuuccugcauugggacuuuacaaagcuucuaagaaaaccaacauguugauuuugcauuuguuuuuaagaagaugacuucagaggaaagaauaccccugauaucagagaugaaccuaaaggcagaauggacagugcuuauucuauuuucuucaagcagcacauuaaguggauuacuugacuguugaugacuuaaaaggaugauuaauacucuugauguuuuaaauauugucuuuucuugggguuucacuugaucuuuaaaauuaagugagauacuagcccugucucaaaaacuuuauaaccagaacagcaaauuuccuuuuaaauacccauuuacuugcauugaauuuaugcuauaauagccucuguuuguucacauacuguuaaaauaugcaauuuauuuauuuauuuauuuuauuuauuuauuuaguuuuuugagacagaguuucgcuguuguugcccaggcuggagugcaauggcacaaucucggcucaccgcauccuccaccucccagguucaagcgauucuccugccucaaccuccguaguagcugggacuacaggcaugugccaccaugcccagcuaauuuuguauuuuuaguagagacgggguuucaccauauuggccaggcuggucucgaacuccugaccucgugaucugcccgccucggccucucaaagugcugguauugcaggcaugagccaccacaccuggccucuaagcuacuuuuaaaaccccuuuuugcugggagcaguggugcauacccgcaaucccagcacuuugggaggccaaagugggagaauugcuugaggccaggaguucaagacuaaccugggcaacacagagagacccccccccccgccaucucuacagauuuuuuuuuuauuauuauuagccagguguggugaugcauaucuuagcuacucaggagguugaggcaggaggcucgccugggcccaggaauucuuuguaaugugguagagguuaauuuuuacuuauuuauuuuuuugguguuccuggguggacaugaagaauuuuuaaaauacuuauaaagaugggcauaaagaggcugggcgcgguggcucaugccuguaaucccagcacuuugggaggcugaggcgggcggaucacuugaggucaggaguuugagaccagccuggccaacauggugaaaccccguuucuacuaaaaauacaaaaauuaacuaggugugauggugggugccuguaaucccagcugcuugggaggcugaggcaggagaauugcuugaacccgggagauggagguuguagugagccgagaucaugucacuacacuccagccuaggcaacagagugaggcucugucuuaaaaaaaaaaaaaaaaaaaaaaaaagauuagcauaaagaguugggaaauugggaaacucauuaauugacuaauguccggcaacauuucaacugauugguagagcaccacuggcacuuuuguuuuccaaaauguuugggguccuaauauguuuuauaaaaucauugucuuccaggcuaauuauacaugauaaauuaucagagugaggcuacaaauauucuuuugacaugugaggggcuucuaacuaugacagccauaaauuuaagucacuuuaaguugggcaucaaaagccaacauaaagacauuccagguuauggaugggagacaggcaggggcugguccauagguuuuggccuucccagauguaucuggcuagccuuuacauaccugauaaaggaagugcucuuuguaagaaguuagaaaaagagaaggaaaagagugaaauauaaaaagcaguaguucuugaccccaacugcauauucaaaauaucuagguagcuuuaaaaacaaagcaagugucuaugcugggccaauucaauuaaaaucuccgaaaguggcgcccagguguugguuguaauuuuuuuuuuuuuuuuuaagauggagucucgcucugucgcccaggcuggagugcaguggugcgaucuuggcucacugcaaccucugccucccggguucaagcgauucuccugccucagcuucccgaguagcugggacuacaggcacaugccaccaugcccagcuaauuuuuguauuuuuaguagagacgggguuucaccauguuggccaggauggucucaaucccuugaccucgugaucugucugccucggccucccaaagugcugggauuacaggcgugagccaccgugccuggucaguauuuuuuaaaaaugcugccaaggugauacuucuguuaagccaagacugagaaccacugaacuaacaggaacagcgucugugcucaaauuucagcaccuuacaguuugaguacagugccugcaucuguccucugugcauuagacuacugugcguuccacauagcuuuuauuuauggcucugcugagauuaguauuuuccugaggauggggaaaaucacccuugugaaugguggacacauuuaaacuucaggucacagcuuuaauauguacagcagaauagugcuuaugcaguggaaucaaauacccaaaacagugagaaauucagaaucacugaguagucaaaaaggaaagugggcuucaucuacuuugaagugggaugggugggaaacuuuuugggaaauugagcaucuagaaaaccuguguggaguguggggcugagccaucuugaguacugacagggccuauugugggccacauucuucucuuuuucuagcuuaauucuuuacuuuguaaaacuauuuacuuguaacaagugaaaguauacacggaugaauaaaaaacaagaguuaaugucccacccauguucauagccugaugugaauuccuccccaccuguuucuguacuccaaagcauguauaaugacauaggguuuguuagauuuuuguuuuuuaaauaggcucaaacucugaacaugauucugaagccggauuuuccuccucaauauaucauagauaugccuccaggucaauagauauagauuuaacucuuguuucaaaaaugugaauaaaauuugauagccauuaugaauaaaauaugaauagccauuugguauggcuuuauguaaaauaauauagucaaccauuucccugugaauggacauugaagggacauucaggauguuuccuuucuuuaaaaaaaguugucugggcgugguggcucaugccuguaaucccagcacuuugggaggcugaggugugcggaucaugaggucaggagaucgagaccauccuggcuaacaaggcgaaaccccaucucuacuaaaaauaccaaaaauuagcugggcgugguggcacgcaccuguagucccagcuacuguggaggcugaggcaggagaaucgcuugaaccugggaggcggagguugcagugagcugagauugcaccacugcgcuccagccugggugacagaacaagacucggucucaaaaauaaauaaauaaauaauucuuuaaaaaaguuugccacuacaaacaauguuuuuguacauacaaccuuagggacuugugcuuuuuuccuaaaguauucuuauaauccaugauuugguuuuggucagauuucuuaguuucuggaugucuucucuguuagaauaaaugaguuagugucaguugacuuccaguuaauugacuccuucuggauauuaaguugggcauuaauaggauaaucaacuauuuuaggaauauuuggauacuaaugaauccuggcaaccagaauguuuuccagaggcccuagaaucccuaggauggggcuccucaacagaaggaccauggugggcuucauggagguccaugaaccacaugguauugauggcaaaauuguguacacuuguacauuuuauggcuuucaucagauuuucaaaggggcucuugcugcagauauggcuaaaaauugauaauauauugucaauuagagaauauuacuaagccuaaaaaaccuguaagguacucuaaguucccaucaauagcacauuuuuauuuauuacuuauuuauuuauuuuauuauuguuuuuuuuuuuuuuugagacaggaucucacuacaguugcccaggcuggagugcaguggcacgaacacggcccacugcggccucaacuucccagguucaggugauccucccaccucacccucccaaagugcugggauuacaggcaugagccaccucgcccagccugaauagcacauuuuaaaucacaguauccucuuucuguaaagaccuggaucaaaguaaguuuaucuaauuuccaggucacauaaaauuaggagagaugacuaauacuauagauagcagauucuaguuucagaaugaucugaauagguuguaauaauguucuaaaaucagcaacaugagauacuaaggauaaaugaucugcaggaguugagaaaugcuuggggggugguggacggucucaagugcacgagaugaaaaguagcucagaguuuauugaggcacaggcuuaugugaggcaucucugugauguggcugcuaaaaacagcaagcucagguugcacugaugggugccuagauuacaucgagucuguuguccuguuuuguggguuaguuagagcaccguugaugaauuguguuuaagucucugaaccacaguuuaggugagacauuggcaaacgagggaggcaggacuagugguggauggagaaaggaagucauaucaggaacugcugcuaaaggaguuugguuguuggaucugaaggaugguauaaaaggaaagugguagcagcccuuauagaucagggaauaggaagaccagaggaugguauguagcucuucugugcucaguaacugaaugaaugaguagagauuauaaggcaaaggauuuuuacuuggucuaagacagaaucuugugguggugagagcucuccagcaauaggaugcgcugcccuagagagcaaugaccucccagguuggggaacccuucaagccaagccauggacaagucugagcuccagagguuauaaaacaggacuucagaaguucuuaacuggaguuuuauauuucuucucuuagguaccuuaauucuaaaacaggaaaaaauucuaggauaauauuguauucccuuuaaaaguacuuuuauggaaggagugcuuuugacucaaaggcuacgugauugucaguacagcuauuucaaaggugcugagaauugaaaaauaaccgauuuuuaucugaaacugcagugcguaaguuacucugcuguuccaccugaaguaacuagucuggacuuguaggauaguguuuaagauuucauuuugguuacuuuagagaggagaagaaucacaguuuuccaaauuacaaaaaugauuaaaaaaggaaauuucaucacuuccugcccucgcuauggcuucaggaagcacagucuccacuagacuaguuguccuggcuucugacuugcauagcagcucuguguggcacuggugucaugcugugucaugcccaugguuugcacccaagcuugcauaccgaccuguggaagugcacugccaauauuuguugguugagacuaagcuaucccuuaugacucuuugauaauugaaacaauauaaaaauccuugaagcuguggaaauacauaaauauugucaaacauuuuuauauaaaacuuuguuuaaaaaacccuguaucuuagaccccuguucuaagacacacuagcagucuuagaacuguugggguggggguuacagucacuuaugaccccgggauuucuacuuuuuagagugcggggaagggguggguuagagguuaggaagguagccucguggauucaaaucuggcuucagcacuuaguggcugugugacccugguuuccuaggucuguucucucacuugcagaagaaagauagugauagacuuuugccauugugaguaagcacucagcacagcgccggcaccuggagagaacucagaaauacuauauucuguuaccauaccaccuucucucaccucuugaucucuuuccuauuuuuucugauuuaacagauacugucaucuguaugucuuguauuaucuugaacacagcaugucuaaaacuaauuuuuuauauccccaccccaccuugcucaugcuaaaccuacuccugccauacucuccugucaccccuguuuaaugcacaaguaccauucaucagagauagcauggggagagguuaauaccacaagcuccggagucaaaacugucugggauucaauuccugccccgcuacuuaucuccaugugaccuuggacaagcuaauuuaacgucuguaaaucucagguucuucagcugugaaacagaugugauaucaaucugucuuauagaauugggaaaaaucaaugagaucaauacauguuaagugcuuaguacgguuccugacacuuaggugcacaguacauguuuauuguuuauacuucucacacuagaagugauagugucauccuuaauuccucuuuuuuuccccacugaagucaucagugcuaugauucuaccuccaaagucucucuuuuuccaucacugccuuuacaccaggcuucccuaagcugaauccaucacucacagagcuucaucagccccagaaauuacauguacguuuuuugacauacgugcauguuucuuaggaaaagggcuuuuuuuuuuucuuuuuuuuuuucaaacagaguauuacuccauugcccaggcuggagugcaguggugugaucucagcucacugcaaccucuaccuccugaguucaagcaauuuuccugccucagccucccaaguagcugggauuacaggcgcguaccaccauguccggguaguuuuuguauuuuuaguagagaugggguuucaccauguuggccaggcuggucucuaacuccugaccucaaaugauccaccugccucggccucccaaagugccgggauuacaggcaugagccaccgcgcccagccaggggagggcuuuuuagcuuuuaucguuggcauucaugcaaguccguaacccaaaaaaggcuaauaauuacucuuaucucuugccuguuuccaguagccuauaaacugacaguucuccccuagucucuguuucuaaucuucucuucacacuguuacccaguuaacuauuguuuuaauguuuuucuauugcuauccuaagcugaugcagugguguugacucccuguugcccacaggagugguucuugcccacagguuagaauugcuacaugggaaguuuuuaaaaacugcugaugccuggacccaauuauuauugcuaacaaauaacaggccgucagcauuuuguuuuaaagcuucucaggagauuuuaauguguauccagaguugagagccucagagcuacaggauaguggacccacuccuuagcauggugcuuguaggccccagcaaucuagcaccaauguauuuuugcaaccuaaucuucuaccucuucucccauucauaucccaucacuuguauucagaacacauacuucugcuauucccagaacaugcuacaugguuuccuaccccugagccuuugccuguacugauugcucuuccuagaaugccuuucacuguuuuucugccuggguauuuccaucgcaaaaucucccccaagccccagagagaauuucaucccuuacuuccguuacaggauuuaccuguauuauaauuauuuauauaccugucuuccagggcacacugaacucuugcaagauaagauccuauucauuucuuuucucaagcacuugucaccagguuaggaagcucccugagagccugauggauaaaugaacacaugagaauguacaaccagccgccugcucaggggagucaggaaaucuaugggguuggggaaugcaagucaaugugguauaggagugguuaaaagugcucagcaaaguuuuauccucuuguauugcuuuuucauaccuguauaaaaaggcaagaucaaaauauaugaaguuuaucaucuaggacgaggaaaguuaagaccagcuuuuaaaauacccccaaacauugacugucugaauauaacagcauaaagucaugucauaugugucucccaagacuccagcgguuucugaaugagagguggagaggcagccacugugaugguggcagcuguuaauucugcccaguggauuguuccaacugaguuacugauaugaggaugcccuuauauggacaguucuccagacguuauauguuucuaauuuugaucucaccccuggccuuuguguuuuagcugcugucuaauccuucucuuggcuauuuuuaauacuuuuuuuccuccaugcaucucagaauuguccagcauucuaaagaauggcaaguuaaaugugauuuauucuuccuguuuuuucagugccuaggauuaguuuaagcauaaaagugguuuugagagagauuacuuuaguaaaugaucucagagauacucuguuggauacuguuugagggguguuuuguguuauucguuccuuaucuuaaugauuuuuccugagcacugaccaccacaacacucuuaugagaagaaaugguguauuuaaaguugauacaaagaacagugacuacuaaucugauguugugauuugggaaugcauaguucugaucugcuguguaugaacaacuugaaugcucuuugucuaacuagcugcuuauuacuuuaauaauuuuaaauaagaagggcaagaauuuucuuuuucaaagucacaguguugguuggaccuuauaaauauguugcccuuuuacauuuuuauccaucuuauugaaaaagaguuuuuugggcuggacgugguggcucaggccuguauucccagcacuuugggaggccaagguggccagaucacuugaggucaggaguucgagaccagccuagccaauauggugaaaccccaucuguacuaaaaauacaaauauuagcugggugugauagcgcacgccuguagucccagcuacucgagaggcugaggcaggagaaucgcuugaacccaggaagcagagguuacagugagcugagaucacaccacugcacuccagccugggcaucacagugagacuccaucuccaaaaaaaaaaaagaguuuuucaaguuuuuuuuuuuaagccguaaagaaaucuggaucuauccagagcuguucuuuaugguuuacauaaaagguucuuaguuugggaaacuaaaaaggauaauuuucaguuguuuucaaagagcauuuuuaaaaaacagaucugagucaaagaagugggaaaugaauccuguccuggcaauuggagaggcaagaauauaaugucaaaaagaagaaaccaacucuuaaaaugaaagcauuaaugucuaaaauggauaauuggcuuuuauuucgcagucuacaaucaaccaugacuaucccaguacuguuuguccacuccucuuuugcgaaccaucccccuguauuaugaaggaacuggucucugguauuucucagaauggucucuuggauuauuguaauuauugggcuauuacaguucugagagcugaguuguugauccuucuggguuugguuuuaugguuuuuuuggugggguuuuuuguuuguuuuuugcuuaucacagcuacuuugaaaacgaacacucauuuuuuuaguacuuuuuaaaugaaauacuuaguaccuaaggauacaaucauguacguuuaucaagagaccuguggaaguagucaccugcuggguucuuauagccaagugcaacuagauccucuuauaaauauuuuaucucuuaauuugagcuugacuuugaacugcuuacccuaacagugaccacuucuuuuuuuuuuuugagauggagucuugcucugucaccuaggcuggagugcaguggcgcgaucuuggcucacugcagccuuugccucccagguucaagcgauucuccuuccucagccucccgaguagcugggauuacaggcacccgcuaccacgcccagcuaauuuuuguauuuuuaauagagaugggguuucacuguguuggccaggcugguguugaacuucugaccucgugauccgccugccuuggccucccaaagugcugggaucauaggugugagccacugcgccuggccaaaagugaccacuucuuaguuuaucuguuuggaaacagaucauacccauuuacagcaaaacuauuacaaauuagaaaacauauucuugauuuccacgucucuuggaaaauugguaucaaguauugucuuccaccacacacgugggcaucugcccuucaagugccucuuauagaugcucagagaccugauagugaaaaggcaggagucuugagaauggacuugaaauuauucacagugaagcuggcggcucuccacugucauuuugaggguccuuucaggcauacccugcaaguucccugucuaccugaaauagguagcaaggggaccuaaagccccagagccccagaacagauuuucuaucuaccauggccaggugguuuaacuaggaauucuccuucaucauuacuuuauauagcuuacauauaaaauauauauauuauauguauauuuucuuuuuuuuaaaaaauccauguauaaaauuuuuuuuucaaaaauccaugccaagcucuguuguaagugcuuuaugugcauugagucauuuuugcaacauuccuagaagguagauggauccuuauccucauuuuacagaugggcagagagaacucuguuaaauaacuugccuacugucucaaagcuagcaauugguucaguuugacugaacccaggaauauggcucuguuaaaagacuccuacagcccucuuuuccucagaaagccuuaaauuucaaguuaaaaguaggguaauccuuaccuaaagacccuuaagugcuuuugaaacagacuugaaugauugugaaacaauauagauugaaaucacaaaaauuaguauuuuauacuguguaucaaaagauuugggcaauuagcagcucguugcuugauacuuaauaguuuuccuauuaucugagggaguaaacugagaaguggauguuuaugauuagcaguuuagcacaacucauuauuucacauucuauccaauacagaauugacaauaagccuuuguuugugauggguggaguuuaccuuggugauaccuaugaaaaagugguuucuaaacaaauaaauacuguaagauugcaggaaaauguuacuuauuucaacauagucgaauauuuucaagcacuuuuaauggguuuuuuuguuuuuguuuuuaguauaauccaguaacuauccuuaguacuuuccuuuuaaaaacagaggaaacucaguuuaauauuuguugauucaaguaauaaaacugcauuuaaaaguauuuucaguuuagauauauaucuaguucaagccaaauuagucugggauuaguaagguuuuuguuaaccuaacuuucgaauuacuguggcuuuaaaucuaaucuuugacuuuuuccccaaaaucuuauugcauucagaguuucucauuuuagauuagcuugcauaguaauaaauuauagaagugaagguugcacuuaauaagccugugcuuauuuuuccauuugaggugcauauaucacauaaggugguauuagugcucuuuuguuuugaagcuaguggccauguuguaucugucucuagugguuucaagccuagcaucuuuuuguuuuguuuuguuuuguuuuguugagacaaguucucgcucuguugcccgggcuggaaugcauuggcacaaucauaacucacugcagccucaaacuccuggacccaagauauccuaccaccucagcuucccaaguaccuuggacuacaggcggguaccacugcacccgcuaauuuuuuuauuuuuaauuuuuaauuuuuuuuuuauuuuuagagacgaaaucucacuauguugcccagacugguuucaaauuccuggguucaagcaaugcuauguccuuggccucccaaagugcugggauuauaggcaugacacugugccuggcuaagccuagcaucuuguaucagcaagugcagaauuauugcccccaagagaaaggagaaagcuuccagugugaaaguagaggaaggacagccuguguucuuuuaacugaguggaggcugauguuggggugcauggaacgugucugaccuugugcucuagaucucuguggacuccagacaauggaggaggaagggaaacauuuaaguguguuuagcauuuucuacauaccagguacuguucuuggugauaaagcuguaucucuguaucuacauucauacaugccuaucuauaucuauauaacuguuugcuguguaugcauaaacauauguuuauuuaacaaaacauuuauaccaggcacuauucuacauacuuuacaaaugaaaaacucauuuagucuucauaauaaccccgugaggcauguauaauuauuauucccauuuuaaaagugaugaaggcacagugagaaaguaauugcccaagacaacuacaaagugaugaagcuggcauuugaaccagguagccuugcugcagaugccacuuucauuggauacuuuauagccuagauuuggaaaaauuaaguaauuuagucaucaaagcagcuauuacuugauggagcuugaaucucaaucaagcuguccccuagacaaacauuauagcuuuccuuuuucuccaucuuugcuuguguguugcuucuguauaguguucuuucuacuccugcuacuguugagagcuuaggagaaggcuccauucaaaugccacucccaggccgggugugguggcucacgccuguaaucccagcacuuugggaggccgaggcggacggaucaccugaggucaggaguucaagaccagccuggcuaacauggugaaaccccaucucuacuaaaaauacaaaaauuagccaggcgugguggcaggugccuguaaucccagcuacucgggaggcugaggcaggacaaucacuugaaccugggaaguggaggcugcagugagcugagaucaugccacugcacuccagccugggguuacagagcgagacuccgucucaaaacaaacagagcgagacuccgagacuccgucucaaaacaaacaaacaaacaaaaacaaauaccacucccuccaagaucccuuuuuugaaaauggagauagggucucaauauggugcugaggcuggucugggacuccuggccucaggcgaucuucccaccucagccucccaaagugcugggauuauauuacaggugugagccacugcaccuggcugaagaugccuuucuuucuuucuuuuuuugagacagagucuugcucuguugcccaggguggagugcaguggcacgaucuuggcucacugcagccucuaccuccuggguucaagcagauucuccugccucagucuccugaguagcugggacuacaggcauguaccaccacgccuagcuaauuuuuuuuguauuuuuagucgagaugggguuucaccauauuggccaggcuggucucgaacuccugaccucaggugauccgcccgccucagccucccaaagugcugggauuacaggcaugagccaccgcgccgggccagccuuucuugauuaacacaacuggaagccucuucuuugcuuauguuccuauuggaaugaacuuuuaacuuuuggaaugcuuacuaauuacucccuuauaugauaaguuuauggaccgugggacagugucaugacucaucacauuaugagccucuuaaaggcagaacugucauugacaccacuuucugcuguggucaugggcauccugccacuuauacaaaucuugcaaaugcuugggaguuuccugauggugcuuuaacagauguuuguuaaauagguggcuguucugaauguagagcaguaugaaagccccaagagaauuccaauauaauuuaaaaaaucaacuauguuaaaaugaguauucaaacaacagcagucauaaugcugccuuuacuuucacaauccugauaaaaacugucauaaaauuaugcugaauuagcuauuuaucaagguuuuuuaaagaacugucuugaagaguuugcgucuuuuuuuuuuuuuuagcugaagaggauaccaguuucuucuguguagaguuagagcucucuguuuguauguaugugaacugaguccguuucugaagugugaagacugcaucgcuguggaucacacugguguagcccuccugagcaugcagccuuuuuggaggaauguguguuagucagcuuuugcugcauaacaaaccaccugauacuaguggcucaaaaaaacaaacauuucuuucuguaccucacaguucuguagggcaccggagugguucugacuugagcaagccuggcuggacuuugcagucagcuggcagcuggcuggcugugugguuuacgauggccugacccacccaucaggugcucagcgggcugaccaguggcagggacucagcagugauggugcauccccacuccauguggccuucucauuuguaguaggcaagccagggcgggcauuucgaaguugcaagagagggugagcccccaugcaccagcacuuuccagggcccagcauuauguuugcuguuguccuacuggccaagcccagagucagugcaggaagggacucccuaggguaaggaaggaauagggggacuuuacagcagccaucugcccagacacaugauucgccuguguucuucagucagugacccugaauccugugcuaaccucuggcuggggacaugagaccauaucacggagaaaauuaaacaggcuggcgcagcuacagaguuuuccaaaggaguuuacaaacccugguuuuccugaaauacuuaacgaccauuugaaauuccuuucaacauuuuauuuuuugaagaagcuucaugcuauaaaaacagggagccuuuaauccgcacucaguaaauaucccaaauugcccuucagcaaguaccauacugcugcuagaccugcugugagcauaauggccccggccguuuaugagacucuuugugugccugugcuagauacaucucacuuccuuccaacaccaacccuugaugucagcaacauuauccccauuuuacaggcgaggaagccaagucacagaggugagcucaauugcucgaggucagacagcuaguaggucgugggguacacuuugaacccaggucuuucugaguccacagcuacaauccaaagaauuccuaacgugggccaggcacagugguucacaccuauuaucccaguacuucgggaggccaagguggauggaugccugaggucaggaguuugagaccagccuggccaacauggcgaaaccccgucucuacuaaaaauacaaaaaucagcuggucgugguggcacacaccuauaaucccagcugcucaggaggcugaggcaggagaauccuugaacacaggaggcggacguugcagugagccgagauugcacuacugugacagagacuuugucucaaaauaaauaaauaaaauacagagaauucuuaacgaguugaagaguuuuuucuucaauguucauuuuuugauggcuuuuuuuuuucuuugagauagagucucacucugucauccaggcuggagugguggcgugaucucagcucacugcaacccccgccucccagguucaacugauucucaugccucagccucccaaguagcugggacuacagguaugugugaccgugcccggcuaaguuuuuuguagagacgggguuucgcuacauuagccaggcuggucucaaacuccugaccucaagugauccuccugccucaaccuuaaauaguuggaucaaauaaccagguucaauuugaugauaaauagcucagaauagaaacuucacugcuauuuccagaugucauuuuaaaauauuuuagaauaccugauuucuccaugaccuauccaugcuuuucuaagguuccaaacuaaaaugcagaaucuugaguuauuccagaacauagauuuaaaauuugaucagaaaauaaccuucauuuaagaaaugaggggucaggcaugguggcucacgccuguaaucccagcacuuugggaggccgaguuggguggauugcuugagcccagccuauuuauuuacuauccuauuaugagcuugagaccagccagggcaacauagcaaaacuccaucucuacaaaaaauauaaaaauuagccaggugugguggugcacaccuauagucccagcuacuugggaggcuaaggugggaggaucgcuugagccugggagguggagguugcagugaaccaagauugugucacugcacuccaggcugggcgacagagugagacaucuucucaauuaaaaaaaaaaaaagguuggggggguauugcgucccucuuguguggcacccuccuuccucuccccgcuguagccauagcacauugcacauaaacugcgucuucauacuuacccaaguauuguaucugccugggugagucuguuccugucacuaaaaugugaacucccuggacauagagaccuugucuuucaucucuguaucuguccccaguaccuggcauaguaacuggaacaugccuuuuuuuuuuuuuuuuuuuuuuuuuuuuuuuuuugagacggagucuugcuuuguugcccaggcuggugugaucuuggcaguggcaugaucuuggcucacugcagccucugccucccaaguucaaguggauucuccugccucagucuccugaguagcugggacuacaggcgugcgccaccaugccuggcuaauuuuuuuuguauuuuuaguagagacaggguuucagcauguuggucaggcuggucuugaacuccugaccucgugauccacccaccucggccucccacagugcugggauuacaggcgugagccaccacgccuggccaccaauuuuuauuauaugauuuuauaacuaaaauuucaugucuagcaaugaaauucuucuucucucuuuuuuguuuauuuaucuuccuuuuagucuuucuuucuccucggaucuuuccccuucuaucugucucaguuccuucauuuuccuuagcucuccauuucucccagcaucugcuacuagucuagucuccuggcucuuaaccuuuuugagacacagacuccuuuaauaaagugaugaagaaaguuaucuccccagaagaauacacacagagaacacagaauauuuugcauauuauuucaaagguaaagaaugccaagaagccaggggcaguaguucaugccugugaucccagugcuuugggaggcugagguggaagaaucacuugagcccaggaguucgaggcuggccugggcaacauggugagaccuccucucuacaaaaaaauuuuaaaauuagccaggugugcuggcacgugccuguagucccagcuacucaggaggcugagguggguggauugcuugagcucaggaggugaaggcugcagugagccaugauugugccacugcacuucagccugggugacagaaugagacccuagcucuaaaaaacaaaggaugccaaguaucuaaacuuugagcuccuugaggacaaaaacuaggcguuuuucauccuauaugcccaguauuuaguugauguuucuugaguguauauaagugugcacaugcccagaaacauguaaauauuaguacauguuguagaaaagcuguugucaggaagauauuuguacacucuggcuuuccacuaugauagucaccaggcacauguggguacugagcacuggaaauguggauuguccagauuggaauguacuaauuguaaaauacgcacuggauugcacaggcuuggggcaguacaaacaaaagaaugaagauaucucauuaauaguuuuuaugauuauuacacauuaaaaugaucauaucuuggauauauugaguuaaaauauauuauuaaauuaauuuuaccucuuuauuguuacuuuucuaaaagcagcuacuagaaaauuuuaaauuauacauguaacugcucauagaagguugguaucuggguucauucauuaguggacauucauaaacauaguaauuuucuuuaauuucauggauucguugaacuaaagaucccauaggucaccgccuucccugucccuccucuaccaccaaaaauuaaugagaacaaaugggaagaauuuacucugcuuuucaagguacucugauacagauuuuuaucuacugucauaaguauaccuagaacaaaagcacuguugacucaaguaguuucacuaaugaaaaggaagcagcagaaugacuaauguaaauuggaggagacucuuuuauuuggaaugcuuugguucuuccacuguggaacagguguggcugcuguugaaacagcagagucauacuaggcauaucugacaugugaggaaccggagcauugcucaggggccccugccuuccaaugaauggauguaggauccaucauacaucagauugcuccuuuccaauacaaacucugaugcagaaaugcacuugguguauuugcuuuuucuuacuuucugguuuagggcagaaauaauauuuuggcuuagagacuuuuguccugaacuaugacauaauaggaugagaauaucgugucaaaaauagccuuacaagguccuuuuuggcauuaagacuucuggagugaguuugcaguggauuauugagaauaauucuguucauuagcagcuagccaucuuugaugagugcugacuucucuccuuucagcacagagcaggaaaugccugccucccaugacucuggguuggagugaaggggaaugcauaccagccacccucuugcagagguggggcaggugcuggcacagagccucagguuaggccgaggggaugcaaucucagaucagcagccagcaguguuuguaaacaacaggagggagauugugcuggugauguccaacucacaccaaugaagaucaaccgguuugugcuuugggcagcaggcugcagauggacagugccuccugagggcaucgccauguuuuagggauccauguugcaggauaccugucugcaagagagagucaaggagggcuuuuuaagccccugggguucaggccuggcaucuggguguuaaguagagugaaucuccugaaguccaaacuaacauaugacauuuuaaaaugaggaaaacaaauggcucugaaaaggucuauaggauuauagguaagugguuaauacggaagauguuauaaaggucucaggaggagauggggugauccaggguugguugaagucguugaaauggaauuacccugucuuuuaccugucugugggaaaaaaaaaaaaagaggaaaaugacaucucccaaagaugcuuggagauuugauugauguuuguaaagugcuuugauaucuuucauagaguguucaauaagagcaaaauaugucaucagaacuuagucuaaagcaaacuagucccaaaccgucuugaguagauacuaagcgguuuugugucuuuguuauaaguuguacuuauauuuucgagagaaaguuuuucauguucugauuuucuuuuaagugucagcuguauguuuggggucuuuaccuguuaacuugaguuccaacaugcuuuguagauggucagucaccuacagaggacaauuuuucuagccaaggaguuaaauccaccuuaaaaugcuucuugccaaggacaaugccuuugcaaauauuugagauguuuauucucaguugugauuuauuacugaaucugugucuucauagcgacuccuugggaggugcaggaggaggcagagccagaaagcaagucccugcaaucaguucauuauagagaaagaaaaagcuuuuauuucaggauucugguggauagacuuacugauauguauauucugugucuauuuaauuucacguagugcugcaucuaaucacgcuguuuaaauaaucggacagaauguccuuuugcuuugcuuuugcuugugaagagcacacagcacugccaccuuguugccaaaguuuggucugauuugaaugugcuuaaaaaucaagugaaugccuguugggaaaaagcuuacuccuucucuuugucaguacuugcaaaaacaacuuaaaagaaguuaguauuauuggacugaauucaguaauuagcauaaucaugaugcuauguauuguucaccagggcacgccccuuggccgcauuucccauuaagaggacaccgauguuguccuagugaauaaaucccggcacacaugaugcaaaucagcguguuccugccugcugcuuggcugcaguuaauuuuagccgggguuaguucuaugaguuguaaaaguagaaguuagcaagcugaaaugugacuucucggccuaaugugguaggauaucuauuuuagacuucagauuguguuugugaucaggagagcagucuucugaagaauuguggcucaguuuucuuggaaacuacuuguaaguacuggguggaauuuuaagacuucucuuuguucuuuucuccuuaaaucuuccuaauguuaccgucauaguaauguuuaucucuugggaaaacuggaagcuuucagguugguacguuagagaaagcuaagagagguggcaaaagguuuuucuuuaaaugucuccuacugcaauaaaucugccuuauucaauuugcccaagaaaaaguuuucgauucuuacuuauuuuugcaaaagcaaucuguagauuauuauuuuauguuaaaauauuugauuaauggauaugguuucuguaaauacagaaacauuguauugugucauugagcuuuguuuucuacuaugguaaccuaauucuugagaaaaaaauguugaaaguuaauuccuguuauacucugugcuacaaguuuauuuuguagaaauaauggagugucaaauguaauuuucuugaauguauagauggacaguuuuuuauccuuuuaagggggauuuugugcuuaaaaaauaaacccauauaugccuaaagagaagcacuuuaaaaaauuaauuuaggaagaagguuuuagagaauaauuuaaagcauccucuuuuagacugaguuaguuaucaaaaguaaccaaaggccaugggauucuguaaccuuaacugcaguucaucuaacacauuauuaccaacuuaaauuuguacugaagaaaacaaaagauuuugauauugaauauuuuaaauuaaauuugaaucaucuugcuuauuuagaaguguguuuucaauguggacugaccucaagccaaacaguuugcuuacagcagagaaccaggcaggaauuucuuuaucaauuagcaaguaaauguaucagcuuuaggaauauuguuauuaauaaaacaguucuccuaggcgauaggauaggugcucaccagcuaucuaugccugucaucucuagagcaaggaaggaggcagguccacaguuaguauugugaaagccauuuucccauuuugaaaagauuuaguuaaagacuucuuuguuauuauguauugucugauuuuaaaugcaaaugacauaaagugucaacaaugaaaggaaauacuucaguguuccauuuaguaggaaaagaguguaagaaaggaaaguaguacugaguucuugggcuauuuuuagaaagaaacuuacuucauacuuaguuuuuauugagcugaagagaaauuugcugcccagaugaauuauaaugauaacagaagccucuaaugucaucuucagcaguaaaagggguuuugcuccgguaauccuucauaauauauauuuuuauccaaaaaauucugacuuauugcuauuacuucuuacuucuaauuguuaauaaggcaccaucagaaucucaguggagcauuuuuaaagguacacuguaguuggguauuaguuuucacaccaguauucacuugaccuauuguaguucuuaguccugcaaaagagaaaagcugauucgaauuuauccauuguuuaauuucacagacguuucuguagguuuuucuacuacuaggaagcaugugcuuuaugaugaguugcuaaaaugcgcauaaacacuugaggaguguucguuuuaaugauuuacgugcugugagagaguggcagcggugagugagagcggagaagguuuucauuauauaaguguuagugccggaauuccucguguuugccggugcugcgauucucuucgcugcuucuaccccgugugccuggugaaaugaugcuggcugugacugguuaugaccuugggcgacaaaucaugaugagcucuaugcagagucacacacuggggguccaggugcggagaaacagggcagcuuuguggccgcaggaggaguccaggagccgagcccgccugcccuugcccugcuguucccacgccgcaggugaccgcacgucuccccugcaguccuguuggagccacucuguccagcugcccgugcucucauccuacuccuccacgucuuaaaauaguuacagacccagaggcucugacagaaucgcugccgguugcagauuuauuucacuguuacuuucugccuagagggauagccuucugcucagaagcuuugagggguuucucagggacgcagagaggaaccuuuucucugggaccucuucccucacaugagguuuuaaugggucucuugccugcauggcuaaaugggaacugcgcuauguaacagguugccuuucggcuuggagcccggaugcucagugaucacaucccuagaauguucucucucuaaaggaaaucuugucggaagaggcuguguuaugugaguuccagcuguucaucuaaaguggaaggagcagugagcaggagggaugccuucagcuuccguccgucuuaaaaacaaguguaacauaaugggauauggcccucaggaggaaggcugauuucucgggcauacgggguacugcugucauuauuuagcauguauuaagcaccccacagcacaugcggugcacaaggaaagcauaguuccaacccacaugcuacaacaaggcaggacacagaaacugggcccccugacauucaguaacuacacuggcagaaaaaaaaaugugaaaaugaagaaaagggaaacaagaugagugggguggguugaggauacuucagcauucagcuccucugagcuuuugccaaagacgauuaggacagacagcugugccaccugggcugugccuucccuuucuccuccauagcugggaagugauggggacaagugacaagacugaccccagaagccuugccccccacucucaguccucuguugcaauccuccuacaaagaggagaagcuucacaguuucacuugcaccuaaaacuauuauuauuauguggaggggguaaacuuguuauaaagugcaauaaauaucaaagcaucuuucuccauaaaaugauauuuagauagaaaucuggaguuccagauucucccuuccugaacugguuugcaauucaacaaguuacuuaacccugcacugguuuaggauauugagucaacuguaauauuaguuagggaaaugccuucagcuucucagaggaaaggcauuaugaaggucuacugagcauuauugcagcuuguaaaggaguuagaagcacaugaaucagaagaagggcugauaggaaggcuuggguacuggggaguaauaacaugagcggccugcgugguucugugagucugugagucccuccccccgugcccaaccucagccagucucuaagguucugggucuaguucauggcuccacaacaaagagacuuggcuccacaaagaaccucaaaaaaaaaaaaaaaaccaauugaggguuggaaaaugauaccuaugauaagaggguagggaacuucuauuauuuagccuggaagaggaaacaaaugaccgggagacucuugaauuguucuucaaguauaugugugucucaguggcaaagaauggugacccacugguaucuauuuccaucuagaauaaaagggucagguccagcaaggguugggcuggaacagaggugccgacaguggggacccuguuucuucagcgucagcaccgccuggaaacaugugagaaaugcagauucucaggccccacccaggcccugcugaaucagaaaacaugggguagggccagcagccuguguuuaaaaaaucucccaagugauucuggugcacguugacauuugaggucugcuggaugagaugcaaagauggaggguauuauaaaaugggcaaucuggaugccaaaaaauguaacccuuuuuccugaagucaucuaaacaugggauuauauuuguuugcaguguuuucaauguacucucuaaagucaggagauaaaugaccucucaaagucccuuccagcccugacuuugcucuggauuuccuuuugucacuuagagaagauuaauaauuaaccaggaaaauuuugcaauuacuuuucugagcuaagacaguguuccucucaaaugaggcucaccugagauaaugugagaauaauauuguguuagcauauggaucuacuguauuuuaucaguguuaccagacucuccuccccaugugaccucacagccaccugcaggggaucugggcagagguagcguguagcccauaugggggguggggagcuuauuguuggcucaugagcacuuuacaucacagacuguggccagguugguccgucccugucuucacacagcccauuucagaagagagggggcugcaaggaaaguuggacccuacccacuacacccuaggagcaggaagcaacauagaaggcccuaacgaauccaagcacaguggaauguauuaucugugugucagcucucacuagagauagaggagagggacacauuuuaucacaacauuuuuguaucuacaacaaauagcccaggggcacacauaggauggacuuaauacaaauaaauucuaauuccauuggaauggcuaaggccacaaguaagugcucugccuucuccucuguaaugaguucucuagagucaggaagguggccauucucaccuuucccaaucaaaacaguuacuccuaggaguccccuauucaucucucugcucucucuuccacccaccuuuauuugcacguaauagaaaugcaucugaauuuaguuaugccugugcccuuuuguauauuuuccuuugugcuuucgcuugacagaagugucuccgguugaaaacacaggcugcugagagugucuauuuguuauacuuuguauagcauuuaggacaauaaaaccuuuuugugcucauaaugaagaaagggcucucugaggacauguuuugccagugcuguuaaaaaagugucauacuuccugcaggagcuagguuuuuaaaaauaauaauaaagauaaaaauaaaaacugucacacaaguaacgcacugccaugucugaaaaagacccgcccuaccuuagccaggaaauuguggcccuaauauuucagcacuugaaaaugggaucuggccgggugugguggcucacgccuguauucccagcacuuugggaggccaagguggguggaucacuuggggucaggaguucgagaccagccugaccaacauggugaaacccccucucuaccaaaaauacaaaaauuagccgggcgugguggcgcacgccuguaaucccagcuacuugggaggcugaggcaggagaauugcuugaaccugggagguggagguugcagugagccaagaucacaccacugcacuccagccuaggcaacagaacaagacucugucuggaaaaaaaaaaaaaagggggagggaucuguagaauccuuggcuuuuauagcauaguuaauuacauguuugcagaguacuaaaaauugcuugaggugagaaaagacuggugaggacauuugagccaaacuguaguuugccuggucauaagauauugauguuacuauucagucuuucaaucuuucaaccucauuauguuucaaaaaacugaccucucagacaugaagcugcaugcacuguuauuuucuacaucugugucuguuuucagaacauaugaggcccaaugaacauggugucuguacagagauaagaucgacgugucuccccacuccagagggcacagggagcugaucuuaacccugaaugagccuuucaauauaaguagagucugugaaacccaugaacuuccaauaaauauacagccaguagggaacauuccaagugucuguuuaauuugguucuuaauaauggcagccaaaaagcuauuuucauuucuguacaaagaggaauuacuaaauagucauucuuuucuugguauuucuuccuuggaaaaaucacguuucuaaaaucaaucuguagcuaguucacaaaugugucauuaaaaauaagagacguggccgggcgcaguggcucauggcuuuaaucccagcacuuugggaggccaggguggguggaucacgaggucaggagaucgagaccauucuggcuaacacagugaaaccccgucucuacuaaaaaaaaaaaaauacaaaaaaauuagccaagugugguggcacaugccuguauucccagcuacucgggaggcugaggcaggagaauugcuugaacccgggaggcagagguugcagggagccgagaucgcaccguugcacuccagccugggugacagagcaagaccccaucucaaaaaaacaaaaaagagugguuaagugguuuggaauaaacuuugucucauuauagcuguccagucaaaaaaaauuaaacuugaagaaaaagguaaaaaauuuuacuuauuauuagacuauacaagauuuauggaccuaauaguugaauaaaauauccccagaaacaaccuaauaaguuacugauuaaauaauuuauuguauuuccacagcauagaacacuacgcagccauuugaaaugauggcguuagauguauaucaaguaaaaacuagcagguuacaaaacauuauguauuuaugaccccauuuuuauaaaagcaaggcacaccuauguauguaccugagaaaagaaugcugcauuuauuaugagcaauaacuaucucuaggaggugagcuuauaugugauuuucaccccuucuuuuugguuaccuguauguuaauuuuuuucuucaauaagcauagauuacuuauguaauaauagaaaacuuucucuuuaaaaaguaacuauuuuaauuaauuuuuauuuugacuuuauauuuuauuuaauuuggcaguggccucucaguuggcuuauauaaguagugccuaguccaacugauaaagcuaguacaccaauauguuaauuaugguuauuuugcaguacugggccaguagcauuuuuccuuguuuuacuuucucauuuucuauauuuaucaaauuuguuaugagcacauauuauuauuaguuuugagacagggucucacugucauccaggcuggagugagaggugccaucagggcucacagcaaccuugacucccccagcuugagcgauccucccaacucagccugccaaguagcugggacuacuggcacacaccacgacaccuggcuaauuuuuuaaauguuuuauagagacagggucucgcuauguuacccaggcuggucuugaacuccugaacuaaagcaguccugccuugcucucccaaagugcugggauuacagagauaagccaccaugcccagccaauauuauuuuuacacuggaaaaaucugauucauuuuuaaggcagagacuugggaucauggcuuuuggagagacacccacguaaacugauguguacuggucauugaaaaagguuaauucuguuaauucuggaguauuagagguauccaggaagugucugcuuucacuaccacacuggaucuuaacaaacucuauaaucugaucugauuuuuggccaggaucucagacucaguauuauuuggagagcaauggcagcaagcuggggacuuuagcagauuuuuaagucaauuaaaauaacacuucugguguuaugauuauccauuaaaauuucagaagggcccggaguucagaauguuaaauucaaagcagugaacaguggaaccaugugcaguaggucucagguaauauuuugagugacagugaugagggaugauggaaagaaugaauccccuagccaguguuuccagggcacuuaucuguguaguaucacgguguaucucaccagcguucacuacaugugagagcacuuuaagaaaguacuggcucccucagucauuucugccagacgcugccaggauguccucauggccugaaucagaagguuauuguggguaacuguuuuggugccuguggcacuugauuuaagaaaaucuugaacaaagugggacuucccacuaaagcaggccccccuuuccaccugcuuuauacagugccacaugagaauaaguacuuuugauggucauugagagagucucuccuaagccugggccuggagcaaaauggcauuugucacuagguuuccuuugggcauugaggcugaaauucagacugaauugaaucugcuuucaacaggacuaagaccuuaaacuuaaucgaaaaccaaggcugggcgugguggcucacgccuguaaucccagcacuuugggaggcugagguggguggaucacgaggucaggagauccagaccauccuggcuaacacagcgaaaccccgucucucuacuaaaaauacaaaaaguuagccgggcacguggugacaggcgccuguagucccagcuacuugggaggcugaggcaggagaaugggaggcggagcuugcagugagccgagauggcgccacugcacuccagccugggugacagagcgaaacuccgucucaaaaaaaaaaaaagaaaaccaagugccuugauaaacugaaaggaaucuggaaucaugugcuaccauguuuuggccuagccuuugguuuagaaccuuuguuacucauagaagaauguuuccuggaaugcucggaacugagaaagcugguuuuucaaguuuccucuuuacauuugucauccauauaaggaaugcucuucuuuuuaugcucgccuuccuuucuucaucaucucgugucuuucuacugcaauuauaugagaggaguagucaugacauuccucucugcaguauuacuuccuuaggaagugaagacacaccuugcaugggcagaucuucguuuucuuucuuuuuuuugagacagagucuuguucuguugcccaggcuggagugcaauggcacgaucucagcucacugcaaccucugccuccuggguucaagcaauucucuugccucagccuccugcguagcugggauuacaggcgcccacuaccacacccagcuaauuuuuuguaucuuuagaagagacaggguuucaccauguuggccaggcuggucucgaacuccugaccucgugauccacccaccucggccucccaaagugcugggauuacagacgugagccaccgcacccagcccagugcaucuucauuuccuuuggggagaagaaagagguguggguaaacaccuucacucaauagucacauauucaaugaauagaguacuguucccagugagauuguugggggacaauucccaagacaucagcauguccuggcugccaaguaguucuaacugaguuaagucccaaagcucuccugcacaccaagugaguauagaugugcauaaugccacaucaagauggaauaguagguguuaaaauuugguuacuuggcaaguugaaugccuuaaaagaagaaagaaaaugucuuuuuacuuccuuagaagggauagagcagauaaaaaggguuucugagacuguguuggacaaggcaggaaaacugauggucaucaagagaaauagagugacuuuuuuuuuuuugagauggagucucacucugucacccaggcuggagugcaguggugcgaucucggcucacugcaaccucugccuuccacguucaagcgauucucuugccucagccucccaaauaggugggauuacaggugcccgccaccaugcccagcuaauuuuuuuuuuuuuuuuggagacgaagucucacucuguugcccaagcugcagugcaguggcgugaucuuggcucacugcaaucuacaccucccugguuuaagcgauucuccugccuuagccucuugaguagcugggauuacaggcaugugccaccaugccuggcaaauuuuuuuuaguagagacgggguuucacuguuggccaggcuggucuugaacuccugaccuggugaucgcccgccucagccucccaaauuucugggauugcaggcaugagucaccauacccggccaauuuuuguauugccauguuggccaggcuggucucuaacuccugaccucaggugaucugccugccucggccucccaaagugcugggauuacaggcgugagccaccacaccggccugaaagagggugacuuuuauaagaggaagaagagaguggaucucagcuuaaaaacuugaauugcauuuguuuuccucuuuuuugucuuuuuuuuguuuacuuguuuuuuuguuugcuuguuuguuuuuaucuuuacucugaagacuaaaagcaaaaguaagagagaugaauguaguuaacguagguguuaggaguuauaaaagagcucaucuguuauaaagguuuuuaaaagagugauugccuuagaccugacuugaaauuaaaguggcagcugucacaggaagagggaaucacugacuuucugccucagcugcugugcgguuaagugucccuagggacuuggaaggcagcgugcccggcaacucaccucuuucucucgggccugauuuuugccaucucugcuuuuguuuacauuuguuugguuuccaccucaucuuuaagucauagugucuucaggccugugaggcaugucagcaacaauuaaauaaauccagaguuugggguuuuuuuguuuuuguuuuugaaacggagucuuacucugucucucaggguggagugcaguggcaggaucuuggcucacugcaaccuccgccuccuggguucaaacaauucucccgccucagccuccugagaagcugggauuacaggugcaugccaccauguccggcuaauuuuuguauuuucgguagagacaggguuuaccauuuuggccaggcuggucuugaacuccuggccucaagugauccacccgccucggccucucaaaguguugggauuacaggcgugagccaccacacccagccaaaauccagaguuuuuacuugaaaagacucaaaagccucauccagaagaaaugucuccuggucagauauaaaagccugacaguaucauacuauuaacuauuauaaugauaauuuuuuuaaguuuauauuuuuauuguauucugagaagaaauuauccucagugaccaaugguguaagaaagcuuuuauuuucuaucuccccacuaacuagcaagcagugaacuucuaagaacucaagcagucaaauugaauccagcuuuguaagaccaauacagauauaaaaguauauuuuucuaacaacaaauccugguuauuuuuuuauuugcacaugguaaaauuugcuuuuucugguguacaguuuugugaguuuguacacaugcacagauuuuugugaccaccaacacaaacaggauacagaauaacuccagcuccccgaaggccacucuugagcugccccuuuauucagacccugccuucaacccuuacucccugaacuguggaaggagucuucgagccacacacagccauggucaagggugaaacuccgcaggcuacgggggcuucagcacaaccucuggccacuaaguggcuugugcugucccacaagugaucccuagcgaguuagacuaaaauauaaaaacaaggggaaaaucugaguggggcuggcagcugcgcacuguaggggaauagacuucagagaaucauuaauaguucaaccaaguacccacacaauuaagugacagcugcaggccucugggaagugggaguaucagugagcagaauuguuacaguuuauuauuuaaaagauccaguuuucaaugaaaaauuauaagacauguaaagaaacuagcucgugugaaacacacauggggcgggguggggggggcagacaguggagacugcuuuugagggggcccagauacugaacuuagcagacagucuucagagcagccauuacacguacguucaaagacuaaagaaaaccguguuuagguaauggaaagaagguacacuggcagacucaucaaacagagaauauucaugaagagauagaaauuauaaaauaaaaaaagaaccuggccaagcgcgguggcucaugccuguaaucccagcacuuugggaggccgaagcggguggaucacccgaagucaggaguucgagaccagccuggccaacauggcaaaacccugucucuacuaaaaauacaaaauuagcugggcgugguagcaggcaucuguaaucccagcugcucgggaggcugaggcaggagaaucgcuugaaccuaggaggcggagguugcagugagccaagacugcaccauugcauuccagccugggagacagagcaagacuccauuucaaaaaaaaaaaaaaaaaaaaaacaaaacuccuauaacucaaaaacaaaaagcaaacgaccugauuuuuuaaaugggcacaggacuuuaauagacauuuccccaaagaagacaauacacauggccaacaagcaugugaaaagaugcccaauaucacaaauuauucaggaaaugaaaaaucauaccacaaugagcuaccaccuccacccauuaggauggcuaucauauaaaaauauaaaaccaacagaagauaacagguguugaugaggguaaugagaaauuggaacccuugugcacuauuggugagaauacuaaauggugaggcugcugucaaaaacaguaugacaguuccucagaaacuuaaaauuagaaugaccacauccagcaauuccacuucuggguauauauccaaaaggacugaaaguguggucuuggaaagauauuuguauacccauuuuaauagcaguguuauggccaggugcaguggcucacgccuguaaucucagcacuuugggaggcugaggcgggcggaucacaaggucaggaguuugagaccagccugaccaacaugcugaaaccccgucucuacuaaaaauacaaaaaaaaauuagccaggugugguggugcacaccuguaaucccugcuacucaggagacugaggcaggagaaucggucgaacccgggaggcagagguugcagugagcagagaucgagccgcugcacuccagccugggccacaaagggagacucugucucaaaaaaaaaaaaaaaaaaaaaaagcaguauuauucacagucgcuaaaagucacagcacaaauguccacugauggaugaauggauaagcacaguguggucuacaccuacaaggaaauauuacuuggucucaaaaaggaaggaaauccucauacaugcugcaacguggaugaacccuaagugaaauaagccagucacaaaaggacaaaugcugugucauuccacuccccugagcuccuuaggcugugagauucauagagacuaaggguagaauguugguggccagggguuggagaaaggcgagaauggcaaguuauugucuaauggguacagaguuucaguuuugaaaaugaaaggaguucuguggcuggaugguggcagugguugcacagcacugugaauauaccuaacgccacugaaccguacacuuucaaaugguuaagaugguaaauuuuaugcgauguguauuuuaccauaauuuaaaaacauuuuguaaaagaaacucugcaguugaaaaguauaauaaccaagaugacaaguucgcuagagaggcuucgcaguaaauuagaguugccagaagaaagauccccaaacaauagagauguugcuguaaggaaugaagaaaaaugaacagagccagagaaaugugggccacgauucagugcaucagugggagaaccgacagagaaggggcagaaagcagaaaacaguauuucaacacuuaaaaauaggccgggcacgguggcucacgccuguaaucccagcacuuugggaggccgaggcagguggaucaugaggucaggagaucgagaccauccuggcuaacacggugaaaccccgucucuacuaaaaacacaaaaaauuagccagguguggucgcgggcgccaguagucccagcuacuugggaggcugaggcaggagaauggcgugaacccgggaggcagagcuugcagugagccaagaucgcgccacugcacuccagccugggcgacagaaugaaacucugucucaaaaaaaaaaaaaaaaaaagaaagaaaccauggccaagcacgguggcucacaccuguaaucccagcacuuugggaggccaagguggguggaucacuugaggucaggaguuccagaccagccuggccaacauagugaaaccgugcuucuaaaaaauacaaaaauuagccgggcguuguggcacaugucuguaaucccagcuacccgggaggcugaggcaggagaaucacuugaacccaggagguggagguuguggugggcugagaucacaccauugcauuccagccugggcaacagagcgagacucugucucaaaaaaaauaaaaauaaaaauaaucuguaguaauuuauuuuaacuucccaaauuugaugaagaacacuaauguacacauccagacaacuuagccaaauucaguuaggauaaacacagacauacugcagucaagaaguuuaagagacagagagaaacucuuggaacccacaagagagaagugacugucaaguccaguggaacucaaguaagauggacagcugacuuccaucaggcagugaggcccagaggcagcagauggcauauuaaagugccgaaagaauccuucauccagcaaagcugucuuucaaaagugaagacaaaauaaaaacacugccacauaaauaacagagauuccauccauugcuagcagaacuaccucacuagaggaaggcagacguggcagcucacaccuggaaucccaguacugugggaggccaaggccggaggaucgcuugagcccaggaguucuaggccagccugggcaacauaguaaaacuccaucucuaccaaaaaaacuugccaggcacagugucgcacaccuguaguuccagcuaguugggaggcugaggcaggaggaucaaggcugcagugagccauuaucgugccacugcacuccaaccugugugucaaaaaaaaaauuuaaauaaaaaaauacuaaaggagguucuuuaggcugaaaggaagugacacuagacaguaauuugaguccacacauacacacacacacacacacacacacacacagugagagagcucugcuaaagauaauuaaguaguuaaugauaaaagacaauauaauuacauauucguuuuucuuucuuaacuaauuuaaaauaugaaagagcagcuucuaucugguugcccuccaguuuauaagaaagcucuaugcugaccuugaaacaaucucucuagccccaaguuuucuuuuuuuuuuuuuuuugagacggagucucgcucugucgccaggguggagugcagcagcgcaaucucggcucacugcaaccuccgccucccggguucaagcgauucuccugccucagccucucgaguagcugggauuacaggcaugcgccaccaugcccagccaauuuuuguauuuucaguagagaugggguuuuaccauguugggcaggauggucuugaucucuugaccuugugauccgcccgccucagccucccaaagugcugggauuacaggugugagccaccgcaucuggccuuuuuuuuuuuuuuuuuuuuuuugagacggaguuuuguucuugucacccaggcuggaaugcaauaacacggucucggcucacugcaaccucugccuccuggguucaagcgauucuccugccucagccuucugaguagcugggauuacaggcgcccgccacuacacccggccaauuuuuguauuuuuaguagagaugagguuucaccauguuggccaggcuggucucgaacuccugaccucaggcgauucacccgccucgaccucccaaagugcuugaauuacaggcgugagccaccgcguucggccuagccccaaguuuucuaaaggaaaaaugcaggcacagggagcuugacaagcuccccuuuuuuggaggggggugcuuucugggucuuuuauuuguacgcauuguguccauuaccccgugaguguacccagggaaaucagcugaccucccugaacauuccaugcagugagagaagcagugaggaaauaaaugagugacucugaugccuggucaucucagccccccuuuacaggcacagugggugggagaagggaagggcugugauuguccugaccucugcgaaggaggaaaggugggcuggaggcugggcuguuagcaccucccucccgcaguuucgagggcucacucugggcuuagguuugccagggugcccuuugguccaaaugcaggccuugugcuuagucgugugcccuguucaccucuuggccuggaggccuuuuugugcugcugcugucucagggccagcugcauggccgagaugcucaguggcugcguguagaccagcaagcagaacacccagcuggcuggaugcccucggggucuggaaggccaggcccaggugcucccgcaugauaugggagcagccuuuagcugccuggcugcccucccaagucaggcucucuuggaucaugguggcugccagccauagaccacacccacccacacuucaucagacugcacauuggaucugucaggggacaccauggggcugcaccccauucugcacccauggccucuccugcaaagcuggaagauagcuuugaaagcacagagugcaagaaagaugaucuuuaucgugcauggggaauuaagagccaugagcauucucagagugaggaaauaguuuucaaagaaaucuuauaaaaugucuuuucucuuuuguguuuuuuacugccaucccaugguuuugugaagguauuaauaauaucaagccagugcucaugguuucuuaauuuaguaaaaagauuucacucucagucuccauagaagaugagaggaacugcuaaauuucuaccugacuuaccaaucaaaugaacgcucuugggacuauauugccuuguuuaguguguuuauacugccaauuuagcaaguuauuagugaaguagaaucagguuuucagauuucugaugaagcacuucagagaauugaacagauucucccacauggcaaagaggaagaggcugccuagaucaacuuaauaaucauuuguccucuguuguuuuuucugcuggcuaagaacaauugcuuaagaaucucuggaaugauaacaagaaauauggggcuguaaguugagcauggaaaggaguuaagauaauuucauuugucagcuccucuguuuauauuaauguugcauuaauggaaagaauaugcgguuguaccaggaacaaaaaguuuuauaaguaccauccauauuuuuauugaaccuccaauagaaucaaaacaaaguuagcaaauaaacauguaagagccauaucuauuuucauacaugguuccauuuuaaacugucucugaagggaaaguauuuuccuaauauagcucuuggaacuuagccaaacaguccaacauuucagggcacagaauuggaacaagugauccuagguuugucauuugauagaaguuucauauguuaagcgauuugcucacgaauaucuaccuauuuuugguuaugagugaagaaaauaccuagaauaucugggagggcggggaauccauuuauagugcauacggaaaggaagaaaggagaaaauguugaagagucuuuucuguguuagagagugggaauaaauucauaaagcuuggcuauucucgucccucgcuuccagacaguagugugccucagacucuccagcaaggcggugaucuacuuuaaaagucucuacugcuggggaguccacauuuccagugggagcucacuucggugggcugcaaccuauuccauuauaaauguguuucuccuauccaaauacaguuaauuaguuuguuuguuuuuaagacggaguuuugcucuugucacucaggcuggagugcaauggcacgaucucgccuuacugcaaccucugccuccuggguucaaccaaugccuccgccucagccucccugguaggugggauuauaggcaccugccaccaugcccaccuaauuuuuguauuuuuaguagagacggauuuuaguagagacggaaacaacagagucucaccauguuggccaggguggucucgaacuccugaccucaagugauccacccagcuuggccucccaaagugcugggauuacaggcgugagccacugugcccagcccaguuguuuuucuuuaagagacugaguuuugcucuuguugcccaggcuggagugcaauggcacaaucucagcucacugcaaccucugccuccuggguucaagcgacucuccugccucagcccccugaguagcugggauuacagggaccugccccuacaccuggcuaauuuuuuguauuuuuaguagagacggauuuuuaccauguagagagauuuucaccauguuggccaggcuggucugaaaccccugaccucaggugauccaccugccuugggcucccaaagugcugggauuacaggcauaagccaucgugcccagccaaauacaguuuuguuuuuuuuaaagacaggguccuacucuguuguccaggcuggagugcaguggcaacacuccagucucacuguagccuugaccucccaggcucaggugaucuuccuaccucagccuccuggguagcuggguaauuucuguauuuuuaguagggaugggguuucgccaugaugccuaggcugaucucaaacuccugggcucaagugauccgcccaccuugacgggauugcagggaugaaccaccucgcccagccuaaauagucuuuuuucuuacaugaaagacuguuuccuugugcuguguccaaacugcugggauuggaggcaugaaccaccucgcccagccuaaauaacagucuuuuuucuuacaugaaagacuguuuccuugugcuguguccucaaauuagauaaagagaggcugauauauuuccuaauaauaacuuuuucauggacucauugaauuguaaauguaaaaggaaaauaacaaauaaaaucuuacaauuaccugucauacguucauucagauuccauuugaaugucacuaaggauggcacuuacauauccugaggcagccuuucuacuaaaaaaaaauauuuuccauguaagucaugucguaccuucgaaaucuuuucuucgggccaaaucauccuaacuccucuaacuuuuucucauuuuaauuauuuuuugcuguuuccuuuuccuuuaaaaauauaugcacuuagauuuauuuauuguagauuuaugcaaugccuucccagagaguaagaggcuguguggaaaacaucuaaauaucacagaagcuuuacggcugggaagaaacuucccuguggaaaugagaagaaugcggagggaguguggacagagcaggaaugagaccuggaaggaaaaagggcagggaaggcugaacccucaggguccgaagcaggaaucuuagcuagagaaccaaacgccaaaguaagucuguucaugucccauaaguccacgaaggccguugacugcacugcucaagacagggucagaauuuuccaccccucccuacaggacaauccuguggcucacagcuccaggcuaaacggccucuuccuggcccuguggucucugguugauguagaauaauagaguuggacaggaccagaagaugucaucugaucuugacaauuuugaagggugagagcccggcagcauucuugugaguccauucucuuuauuagccucccuccuucccaugucucucccugcccacccccagcuuaggccaggaacccagagaaccucagcgcccagaguuggaccuccuaucaucagggccuggcaagugucagccaggagcaucacuuccuaguuucucggcauugcuuucauuucagugccuccuacccugguguggugugguguggacucaugggaaggagagagugcauuuagggacucauuguuuaaaucuacuuucagugacgcagccacgucuuuaaaaugaccaaaauuggacucgauuacugcuaaagucccuucagacccuaauguucuaugaucuucuaacucuguaaaccaaaacaggaauaaaagcuuaauuauagguugcuucuuguaagcauuagcuucaaacaguuucaggagaaaagaggccagcagaguccuuggcaccaucaagauacuuucuauucaguucagucuugagggccaaaccucaagagaaggauaaggaagaugagggaagaacugagaaagacucuuugugacugagcaugggcccuuuggaauauaaauugaauauagggcugggcacaguggcucacgucuguaaucccagcacuuugggaggcugaggcgggagaaucaguugaguccaggaguuugagaccagccugggcaacauagugagacuugucucuaccaaaaagaaaacaaaauuagccaagcaugauggcaugugccuguagucugagcuacuggagaggcugagguaggaggauugcuugagcccaggagcuuaaggcugcagugagccaugaucaugccaccgcacuccagccuagacaacagaccgacucugucucaaaacuaaaaauaaaggaauaaauaaauaacuggaauauaguagaagacuccacaccaugcagagaccuuuuuaccaagugcuccaauacuagacaaaaggauauucuugacagugaaaaagauaaauaaaggaauacagaauguguuuuauguuuuacaucguagguaguaagccuggagaaaaauugaggcccuggcugaaaacauaaauagauucaugguaaauucauuuuguuuauuuaagaaaacuaagccuguuuuugugauauguuccuaacuuuuuuuaaaaaaauguaccuuguaguguuuugaagcgucuuccagugauaaaaguggucauugcacauuguagaaaauuuuggauaacgucaaaaaaauaaaaagagaccuagagagaagugcaauuaaccuuugggcuuauuuccugaaagucuuaggcggugcuuucuuaaacauagcggaggucauauggcuaaugucauuguguguucccauguuucaccuaggaucacuguguuccagugucaugaaaaucucucaaguuacaucauuguaguggcuaccuaauauuucaucuuuuagaagaaguugccuuagccacaccccugacugggaacauuuggauguuucuucuuuucuaugaucauaauaaaugacacuacaguccacaucugugcauuauuugcccacauuucaaagucuuugccuauuugcuugagcaguugaggcugaugucauaaagagcacccauacccccugagugcuccucauucacaaucuagagcccuggaguugucgugcaucugaccuggccuggugaguugacaagaaccauuuucuuuucuuuuuuuuuccagacaaggucucacuccgucacccaggcuagagugcaguggcucaaucucaggucacugcaaccucugccucccagguucaagugaugcuccugccucagccucccgaguggcugggauuacagaugcacacugccaugccagcuaauuuuuguauuuuuaguagagacaggguuuugcuauguuggccagucuggucuugaacuccugaccucaagugauggucccaccucaggccucccaaagugcugggauuacaggcaugagccacugcgcccagcuaagaaccauuucaauaagaagauaacuacuuuuuuuuuuuuuaagaacuguguaaaccauuucuaacuguacuuagguagauaccauuacagaaacuuucaucacagauaacauaacaguuacccuugcagaacugauuucagaguugacuuuggggucacagaucagagugacccugugauuguagcuugcccacacucauacuuucucugagugacguccuugcagcucuuggucuaugaagugcccagaacuucacauuuaaaggauguucagucugugguuccccaugggaaugauuuucaccugaaauguuuauauuugcguaaacuuaauacuaacgaauggguuucuaccgugagauccucuagaagccaucuggagggcuugucugcagaaagccagcuuuucuuuuccuugugaauuugaagagagguccguaggcuggcccuggagcaggccuuuccucuguucccuggccccagaagagucaugucccgagccccuccucgauccgucuucucgcugccauuguuuuaaaugugcugugacaucacccgucccugaauccuugcucgacugagugaacuggcuggguuuucugugucucagcggaagauucccuuucucacugaaaagagaacuguguuuuuuuuuuuucuuuuuuucacuguauaaucuauauaccauccuaggggacuugguggagguggggggcaaugcuugcaauauagauaagggaaaauaucaaaagugaacauuaccuuuuaugaccagcauuuuuucugaucacuuuuauugagguagacuguauauaacucaauaaauaaagcucagcaguugugagugaacaguuucgugaguuuugacaacacgugcaguaauacagccaccaccauacucaaggugcacagcagagcucucccuguauagacauggguaguuguuucucauggguaaauacacccuagauugaggcugcugggucguguggcaaguguacacuucacuuuuaagaaauugccaauaguuggcugggcacgguggcucaugccuauaaucccagcacuuugggagccauggcagguggaucacuugaggucaggaguucaagaccagccuggccaacauggugaaacccugucucuacuaaaaauacaaaaauuagccggaggaggaagugcaugccuguaauccuggcuacuggggaggcugagacaggagaauugcuugaaccugggaggcagagguuguagugagcagagaucaaaccauugcacuccagccugggcaacagagugagacuacaucucaaaaaaaaaaaaaaaaagaaaaggaaaagaaaagaaauugccaauuggccagggaugguggcucacaccugugaucccagcacuuugagaggccgaggcggguugaucacgaggucaagagaucgagaccauccuggccaacauagugaaaccgugucucuacuaaaaauacaaaaauuagcugggugugguggugugcaccuguagucccagcuacucgggaggcugaggcaggagaauggcuugaacccaggaggcggagguugcagugagccgagaucacgccacugcacuucagucugguaacagagugaggcuccgucucaaaaaaaaaaagaaauugccaauaguuuuccaaagugucuuuaccacguugagugguuuuuuucuuagcgcccuuuuaguguuucucuucucuaccucuuugcuucccuucuucccuuaaaaagucccuguccaggccaggugcaguggcucaugccuguaauugcagcacuuugggaggccaaggcgggcaguucacaaggucaggaguucaagaccagccuggccaacauggugauaagcccugucucuacuaaaaauacaaaaauuagcuggacaugguggugcgugccuuuaaucccagcuacucgggaggcugaggcaggagaauuguuugaaccugggaggcagagguugcagugagccaagaucgcgccacugcacuccagccugggcuacagagcaagacucggucucaaaaaaaaaaaaaaaaaaaaaaaagucccugucccucacaacaugugucagucuuuaaucaaaaacaaggucagugucugcguguugaggaagaagagcaggucuaagggaggaggcuggggaaacccacaggacugggaagagaguggggcacagggcugccugagaaagauccuuccagaaggauucuggaaccucucauuuguuauucuuccugugacuacagcgaugccaguaauuacaaguugcuugaggcgaaacacuucuacccaauuaaguuuguuccucacaauaauucuguaaagugcaugcgccaucacuaucccauuuuauacaugccgcaauucaaaaagcguguugagguacccagggucagccacuagagaggaacagaacugcgacggggccuuaugcuuuccgaccuuugccccagggcuuuaucugcuaagaaugguaacagucaccacauauugauugcuggcauugagcuuuggccuuugcguuuacauguaaccaguggcgaggcaucugccacaguccccacgguucaggugagucauugaggugacuugcccaggguugcauagccaggagcuggccggacgggaauggaccuagaguccccgacugcaggucuugugcucguugcccuucuccacgcaggagaaaugaauguuccuuuuguaaccacagagaggaaagaagguggcaagccuuuuuccucaggcaggugcuugcuggacuuaggcuggugggcugagggugugagugugaagaagaaaagccgcgcuaaagagcauaggcacaauuguggaaaugaguugucuaaggcuguuuaaguaggagaggggaucuccgggcugacacagugccaaggggaacaucaagaugauuaacaacguccccaagcaaaaccaggccauggcgaagcugcucggggcuugugccagccgcucuucccacccagggcgcuccugugguucaccugugugaauuucaugaguuuugacagcauguacaguaguacagccacugccauauucaaggugcacagcaagggaguccuccauugagacacaguaaaccggccgggcacgguggcucaagccuguaaucccagcacuuugggaggcugaggcgggcggaucacgaggucagcagauugagaccauccuggcuaacacggugaaaccccgucucuacuaaaaauaaaauuuaaaaaaauagccgggcgugguggcgggcgccuauuuagucccagcuacuucggaggcugaggcaggagaauggcgugaacccaggaggcggagcuugcagugagccgagaucgcgccacugcacuccagccugggcgacagagcgagauuucgugucaaaaaaaaaaaaaaaaaaaaaaaaaaaaaagacacaguaaacccggcuacuucacccaaucaaaagcgcaccuguggucagaccccauccuagccccaaaaagcaaaacuaaaaacaaugcaaaagagaagaaaaacccacucgguuauuuuucacuucgguuccauaaaccauguauccucucuccacccccauguuuaauccaccaucugguccuguuggauuuugccgcugcaguucucuuaaaucaucguauucccucccacccaccaccguccacagccuggucccggaugccucaucucaugccuaagccaugcagcgggcuccugacucauccuccauguuucugcuugccuuguauccaauguggucgccacacugcagccagaaggaucuucugggcccuggugugguggcucacgccuguaaucccagcacuuugggaggccaagugggguggaucaccugaggucaggaguucaagaccagccuggccaacguggugaaaccccaucucuacaaaaauacaaaaaaauuagccgggcaugauggcgggugccuguaaucccagcuacucgggaggccgaggcaggagaaucucuugaacccaggaggcagagguugcagugagccaagaucgcgccacugcacuccagccugggugacagagugagacuuugucucaaagacaacagaaaaauuccuaagucugggccgggcaugguaucucacaccagugaucccagcacuuugggaggccgagguaggagaaucacuugaggauaggaguuugagaccagccugggcagcauagggcgaccccgucucuacaaaaaauuuaaaaauuaguaggguauaauggugcaugccuguagucccaacuacugaggaggcugaggcaggaggaucgcuugagccugggcgguuaaggcugcagugagccaugcuugugccacugcauucuagccugggugacagagcaaaaaaaaggaaaagccaagucuggucacgccaauaccccucucugauuaaaacccuucgguggcaccccacuguccacaugguggccagucuuuaaccagacccacccgaccuucauccugguuccccucacccgggccugccuccuggccccuccuucccaccaugagaaccaucuggaaugagugucccccccaccccccacaccaggcccagcgugacucuggccgucugaggucucaggugagccuuugcugccugcuacaccaugucccgccggcugugcucucacgacacuguguggcaccgucuccugccugcauaguucuugucaccaguuuauagacauuuauguguugcuaugauuagugucuguuuccuucacuggacuucccagaugugccaggaccacauccauuuuuguucaucgccguauuucucaaucaauaauugaauauuauucauguuuguccuauuggcaagguagcccgggaaacaagauuuuaucaauaauuuguuuauaucuugagauagaucauacuggcccccaauuuuuaaaguuuugauuuucaugcauugauuuagugugccugucauauuaauaaaauacucuuucaguggaauguugucuuuugcccuuagaguggucuuuucauuugucucacuugggaucugaaucuccaaaauugcaaaggcugaaaaaucuuagaaaugauaacaacuaucaauguauauuuucuguuucauugugugccuauagcauugcacaucgaugaugcucaauauguuuguagauuuguuuauuauauauuauuuucauuuaaaaagcauguaaccacaguauacaguuuggggaggaaaggaaaaaauugucucuaaccuuccuauucaaccucuauuauaauuuuaguauauaccccuggguauuuuuaugcauuauuauuuuuauuuuuuauuuuugagauggagucucgcugugucgcccaggcuggagugcaguggcaugaucuuggcucacugcaaccucugccucccagguucaagcgauucuccugccucagccucccaaguggcugggauuacaagcaucugccaccaggcccagcaaauuuuuguaguuuuaguagagaugggguuucaccauguuggccaggcuagucucgaacuccugaccucaagugauucacccaccucggccucccagaguucugagauuauaggcgugagccacuacacccggccuuuuauaugcauuuucaacauugccauaaucacaguguacauaaaauuguguguccugauuuuucccuuuaaauaaccuuauugaugggucaaauuauuauauuguauauggugugguauuuauucaguucaacucaauaagcauuuauaugcuugauaccauucaaagaaaauauacagugccuuggcucuccaauaauagaauaccauaauuacgaagcuugcagugacauuuuuauuucauggauguaucucauggcaucuccucucccucccagaagcaggaacaguggcaugggggaggggcugcuccuucuggggucagggaaguccucucuuaacggugauauuugagcagggaccugaaugcagggaggagggagcugugcagcugugggggaagauucuuccugcagagggauccucagguacaaaagcccugaggugagagugugccuggucuuucuaagggauugcaaggggacagugacaccagggcauugugagggaggggagaggagcuaaggccagugagcugcgaggaggccugaagggucuuccugacccuggcggggccucuagcuuuuccuccuagugagaugggauaguggcguagugauaggauugccucauucuccaggcuucucuuuuccucucuggggccugucaguuccugccuuggucacccuccagaugagugaccucucgccaggccuguaaacucucccagacacaugcaugauaauauacugugcucauugcuuaugcguaaauguggaggugggucguuggccacacccagugguaucacagacucagauuugguuauugcuguuccaggaaacuggacacauuccacauauuugaaaagccaugcaacuaaauuucucauuucuuaaucuuuugcucauuugaggcacuuguuccucucugaaaauaaugaccaaauauguuuuuccgauugcaugaaaaauguaaccuaguaaggauuacuauuagucuguaauuauuaagcaugcuucaacuccugacaauucuagaaagcagguuuuuuuguguuuuugguugggggugguuauccuaauuauaaucuuccuugaauugcuuuaugguuagguccgucacaugccaaaguuagaucccauuagcaggcuuaaaacauuuauuucugaaagaacaaacuguuacagguugcugaguauaauugauuucuuuuguuuccuuucugcuacaggaggagacaucacagcuuucccagaucgggaggaaaaauauggaauguguuuuaccgcugacugaacacaaccaaaugaacuguccugacaguaguuugcaaaccagcagcuagcaguuuguccagccucuaacauuguccagcacuuuccagagcaaacucacuguuuacaagaacucuuggccuuacgaaguuuauaaccucaagcuuuguuuauuuaaaauauuccugcaaaagaaaaguacccggcacccacuuuccaaaauggccauggaugaguauuuguggauggucauuuuggguuucaucauagcuuucaucuuggccuuuucuguuggugcaaacgauguugccaacuccuuugguacagccgugggcucugguguggugaccuugaggcaggcaugcauuuuagcuucaauauuugaaaccaccggcuccguguuacuaggcgccaaaguaggagaaaccauucgcaaagguaucauugacgugaaccuguacaacgagacgguggagacucucauggcuggggaaguuagugccaugguuggugaguagccucuucucuauaccgaugggacauccgcccacugacccgcuucccugcaguacuuugcccauauccauaaaugugauuuuugcuuuggcuuuucaaaaacugguuggauguuucacauuuacucucuuauuuuugcuuucugcauauuaauuuaugauuuuuaaaguguuuaaauaucaggcaaccauuuauuuucugaacuuuugagcaaacuugguugcuaaaauagauuucagcuaagugaauacuuuucagaaaguacagaaaaagaccuuuguagaacagcgcuuuauuauuuuagaguuguuugaagguugucuaagugaauguguuuucaagguugauguaugaaauuuccaggaagguugauuuagauuuuuuucuuaagguuuuucaucaauuaggaggcaauguuuugaaaacuuggaugucaaaaauaauauuuauuagucuaacuuuuauauucacaguuuaaguucuaaagaaguuaccaaauaaaucuuaagugcguguguuucaagaaauucuggucucuuacauuauuugucauccuuuuguuggcuuuuguuuugauuuucugauucuaccucugggagcuccauuugguauguuuguuuuguuuuccggccaaaaaauaaugugcguguugccuggugauagcaugaccuuuuauugcaguuucaaguugucuacaugaaguguggaggugugugaacugugugaauaagcagaguggcugguuggacagagugauguccccauggccuaagcggacacagaucucggccccgugggucuucccaucacugcccucgcuacgacagaaaagaaccuucccggcaggcguguguuaagugcagcugacaggauucuuuuucugcuugccucuagguagagaugacgacacaacagacagcugauguauacggguaauuugguuagggagaagaggguuagagaggaauucuaccaccuucugcuuucaacaggacauauccucuuguaggaagaguccugcagcaggagguaagaugcugguguacuaagaauacagccacauucccccgaguucuuuauuuugucacuuacauuuuuucuuuucuuuuuuuuuuuuuuuuugagacagagucuugcucuguggcccaggcuggagugcaauagugugaucuccgcucacugccaccuccaccuccuggguucaagcuauucucucaccucacccuccggaguagcugagacuaaaggcgugugccaccgcaccuggcuaauuuuuguauuuuuaguagagacaggguuucaccauguuggccaggcuagucuugaacuccugaccucaagcaauccacccaccaucaccucucaaagugcugggauuacaggcgugagccaccacaccuggccugucacauuucuuaaacaccuggaauuuagagauuauugaccaaguucacaauggcccaaucucauguuguucgaggcgucugauaagaagcagccuguuguacuaaggaauugcauauucaccaagcacuguaggccaguaacacacaccagggagcuccuacuucucagcuugacgcuuuguguuguaaagaugucagguucaacuuugggaggcccccgagaugggcagaccacuugaucccaggaguuugagaccagucugggcaacauagggagacccugucuguacaaaaaaacuaaaaaauuagcugggcaugguggcacaugccuguaguccuagcugcuugggaggcugaagugggaggauugcuugagcccaggagguugaggcugcagugaguugugauugugccacugcacuccagcaugggcgacauagccagacccugucucaaaaaaaaaaaaaaaaaaaucagguucaagaucacuuucauuccaacaacuauagucauuauugaauuuuacuuaccuucauggaacauauguauaucucagcauagucagauauaauggaaauuucucuuagaaaaauaaccguucuuuguaaaauucaccuuuuuaguugugauagauaucuaagauuuaauuccaucaaguggaaauuaagauuuuucuagucaggaaaaucugacuagauguguugaaaguaugggacaaaucaagaaaaacacugacaaaauuaaaucuuuuuuuuuuuuuuugagacggaaucucgcuuuguugcccaggcuggagugcaguggugugaucucggcucacugcaaccucugccuccuggguucaagcgauucuccugccucagccuccuaaguagcugggauuacaggcacccgacaccacacccagcuaauuuuuguauuuuugguagagaugggguuucaccauguuagucaggcuggucucaaacuccugaccucgugauccucccaccuuggccucccaaagugcugggauuacaggcgugagccaccacacccggccacaaaguuaagucuuaacugaaguuuuuccuuuugauggauaaacuuuagaggcaugguucugcuuauuaaagaaauuuguuagggaagccacgcugaagaccuccgugugacagaaggguucaugaacaaggcuucaucugcucacucuuucugcagacgggaucauuucuccguuccccaccccuggcguuuggcucuuuacugaaagaaugaaggauacuuaccucaacuagaauuuggguuuaccaaagcaauuugggguuuugcuugaauaacuugauuuuguuugcuuugguuuuuaaacuuuuuuuuuuuugguaugugguuaaaugaaucucaaagccuauuuuguugggaauuuguaugaguuaccuagauucauaaaaucggguucuuugcccugggagcuauaaauuuaagauggugguguaauuaccauuggccaaaaccacagcugauucuguccagaugccugaauucuccagucuuccucuucuaaauccaacaguccuuuuuucuucucccucuuucccucuguccuuaauucuauucuguuugcuucuuuuguuuucucuguuagucacuucuccccaagccccugggcgucugugcuuccugacagaguuguguuagaguuaaggugauuggguagaaauuauugcugccagugaaacguccugaacaagucaucuugugggacuagcucagcccuaaagcaguagucuguccauuuuguaggaaaccaccaaugguuccaaaaaucugagaauucaaaacucugcaucuuuuuuuguggaaagacccacacuagcacaaacgagccagcuccucgaaacccuuaagaagcacacagcccccuuccagcucccucugcccagccacacucugccaccccacccccgcccggcagccucccuggagccugagccuuugcucugccguuucuuucaucugcacgggaauggcggccucugagaugcccaucuccccacuuucccuaggucguggcuugcacucuuaucccaugcuucaucucuuuccucugucagaugccauuaucuuacauuaaaguaugucuuuuucccucuguucuuccugacacuaacaugaucccauuugucuucagacaccccugaggcuaaggugcuaucaccuacucccaggcccucuugcagguauuuccuggccccaccaggcccucccucagcuguccccugucuccuccccucccugcuauccucucuccuccuucuucccucucucagguggucccauuacucccuaccuuucuuuacaaacucuccuccuccaggauguauuuuguaaagucagccacagaaaauauagcagcuuucaggaaggacaaaucuuauggucugaauucaauuggguggguugauaucacugucucacaucaugagauuauuuuaauuguaagaauauaggcugguagcgguggcucacaccuguaauccgagcacuuugggaggccgaggcaggcggaucaugaggucaggagauugagaccaucuuggcugacgcggugaaaccccgucucuacuaaaaauacaaaaaauuagccgggcgugguagcgggcaccuguagucccagcuacucgggaggcugaggcaggagaauggcgugaacccaggaggcagagcuugcagugagccgagauugcgccugggcaacagagcaagaccccgucuaaaaaaaaaaaaaagaauauaaaccauaucauguauuuucuaagcuaugaauccgugcuaugaaacgugcuccaaacccuggcuuucuuuuuaaaaccacuaguccccgaggagcccagggcucagauguggaggcuuaaggagguguccgcggguaggccuggcgcugccauggagccugauauggguuuggcagcacaaggcuggccccuucuccucccaacgcacgccuuaaggauugacacagggucacagccagccucagcucaaaggucagcacgccuagcacucauggcagcaacuguguguguugcuucauggacuggguccugcacagccauaaaugauccuccugcaacucagaugccuuugaaggaaaugccagggguccccugaaaagugcugcugcugccaggcaaccagguuuccagaauuaacguuugggauuaauaacgugcccagcuuaucagccaggcccuuuguuccccuacaguuccaugggagcuuuucaacaacugcuucugaaagugaucucucccgguugaugcuuuuaauacucacuacaaaaucugaucugcuuaugaaaauauuugaagugaacuguagccuagaaaaacaugaaaccuagaaaagaguuggugaaauugagguaaaaggacacaaagccaacacuaaugagaaccucuuaacaacaaggaaucagacacacaaauaaaaaguccaacauucuggguaggaucugagagcagaugcccaaauuuggguuaaauaucauaguuauuucucauaggagaggcaccaucaacaagcaguaugggcugggugcaguggcucacugcauccagugagccugucaucccagcacuuugggaggccauggugggaaaauggcuugagcccaggaguucaagaccagccagggcaacauagcaagacccccgucucugcaaaaaaauuuuaauaauuagcugaguguggcagcucaugccuguaaucccagggcuuugggaggcugaagcaggaggauugcuuaaggccaggaguuccaaaccagccuggguaacauagcaaaauccugucucugcaaaaaaauuuaaaaauuaaccaggugugguggugcacacuuguaaucucagcugcuugggaggcugagacaggaggaucauuugaguccaggaguuuaaggcugcagugagccaugauuuugcagcuguacuccagccugggcaagagugagacgcugucucuacaaaagaaaaaaagaaaagaaaagaaaaaagcaacaugguauuauacucucuuauauagauaauaugaccuagccaauaucugguccuuuucauuaugugacuguaaggcagaacuacaacaaaaucuuuucccaauauauugccuuucuagucuuucuguguucauucgagacuuuaaucucuugcuugguuuuggccaaaauucaccccagaacaaguucauacacagcacccucacugaaaacugacaagggcagucaguguguagcaccaggagacuugccuuuaaaugcauaaucuggccggacacaaugccucacgcauguaaucccagcacuuugggaggccaaggcggguagaucacuugagguuagggguucgagaccagccuggcuaacauagugagaccccaucuuuacuaaaaauacaaaaauuagccagagggcuugcuugaacccaggaggcagagguugcagugagccaagaucaggccacugcacuccagccugggcaacagagcaggacuagcuucaaaaaauaaauaaauaaccaucaucccuguccccucuguguugaggaaggcagaagcuuuccuuuaacugaaguuaauugagugauuuuuguccaggcuguagcgcuuuguaaagaaacaauucacagaaaauuaaacucugggagauguuguuauggaaaacauuuggauuucuucccuuggugucugcaccucuguacucuguaucugaugguuuuuuguccuucaaucuguagguuccgcuguguggcagcugauugcuuccuuccugaggcuuccaaucucaggaacgcacugcauuguggguucuacuauaggauucucacuggucgcaaucgguaccaaaggugugcaguggauggagcuugucaagauugguaauuggcauuuucuuuuacccauaagaaggaaaguuuacauuuucuagaguaaguuuuauuacaaguuacuuuuuuuuuuuuuuugacccggagugucacucuguugccaggcuggagugcaguggugcaaucucggcucacugcaaccuccaccucccggguucaagccauucuccugccucaaccuccugaguaccugguacuacaggcuccuccuaccacgccugcuaauuuuuguauuuuuaguagagaugagguuucaccauguuggccaggauggucuuaaucucuugaccucaugaucggccugccuuagccucccaaagagccaggauuauaggcgugagccaccgugcccagccacagguuaauuuuauaucuuuuucuucaaauguuaagguuuaaaagaccuagaugggccagacaugguggcucacgccuauaaucccagcacuuugggaggccaaggcaggcagaucaccugaggucaggaguucaagaccagccuggccaacaugguucaaccccaucucuacaaaaauacaaaaauuaacugggcaugauggcagguaccuguaaucccagcuacuagggaggcugaggcaggagaaucacuucaaccuggaaggcagaguuugcagugagccgggaucgagucacugcacuccagccugggcaacaaagcaagacucugucucaaaaaaaagacguagaugguaugaguaauauauuuucccuuaaaauuccuguuuuuuguuuuguuuuguuauguuuuguuguuuuguuuuguagagauggagucucgcucuggcacccaggcuggagugcuagagugcaguggcgcaaucucggcucacugcaaccuccgccucccgaguucaagcaguucuccugccucagccucccgaguagcuaggauuacaggcacaugccaccacgcccagcucauuucuuuuguauuuuaguacagacaggguuucaccauguugcccaggcuggucuugaacucuugagcucagucaauccaccugccucgggcugcaaaagugccaggauuacaggugugagccaccgcaccuggccaaaguuccuguuaauagagauagugaacuauuaugugcuggacaguuguuuaacucuauucuuuugaaauguuaccuugucauccagcuuuggaaaucacccucuguucuucccaggcagguaagaaauguguuagacugaagucagucuauaggucagagaaagauugagcacaagugaggaagaugccuggaauccaggaguucauagucuuggggaagccucaaagugagccccguguuaugucccugccuucaacagaucauccaggucaggcgcaguggcucaggccuguaauuccaucacuuugggaggccaaggcaggaggauugcuuuagcccaggaguucaagaccagccugagcaacauagcaagagcccaucuuuacaacaaaaaaaaaaaaaaaagaaagaaaauuagccuggugugauggugcgcacuuguagucccagcuacucaggaggcugaggugggaggaucacuuguaccucagagguugaggcugcagugagccaugauuaugccacugcacuccagccccugggugacagagcaagacccugucucaaaaaaaaaaaaaaaaaaaaaaaaaaaaaaagaucauccagccugcccuuugggaagaaacacucugucaacuguccucucuaccuuguaagccugccuggcagggaccaagacguaagccugcacccauuaucaggugucuaacaaguuagugccuggcucugcuuuuaggaagagguaaauccauucaccuccacaaauaccaucccacccaucgugaacgauacucuuucacuccauuuccauauucuggguuacucaauuuuuuacaagaaucaugaugaccuuaggaguccugggucaaaugggaucccugagcugccaggcaggggcacaaaccacaaggaaacccaccuuccaucccaggcuucuagaacagugguucucaacucuggcuguacuuuagaaugacccggggaagcgauugaaaaauaccaaugcccaaaccccauucccaaccuuuuaaaucagaauucuggggguccagccagggccaaacgaguuuuugaaaaugccccagaugguuccacugugcacccagaggcgggaacuacuuggcuagaggcuaaaaguuucagaguuccagcagcuagauggcaggaaugaaaguacccggcuggccuuggcaaaggaaauggaaguuggcccagcuuuuaaauaacccuuacuguuggaacagcaacagagucuccauauguguugauaagaagggcaggcagaaagacuccgugggaggcaggacucaggaugcugucuucugaggcccgagcuuggggcagggguuucuugacccugcauuggcaguguggucaguggugugugacuguguguugaugucugaguguggccauaaaugugugaaggucagcucugccaagucacagggcuuguuagguucugaauuaaagguaaauaauucuggaaauacuuaugaauguauguaauacauuuuguuuaucauuguguucuaugaauaggaccauaauuaugaaugaauuuuaacauucauuagauuuuuuuuuuaauuauucaguugcuucuugguuuauaucuccacuguugucugguuucaugucuggccugcuguuuguacucaucagaauuuucaucuuaaaaaagguaaguggggcugcuacuuuuaauuaaaucuuaagaacuauuuuuggcucuacucaguagaaauuaauaaugagagggguuagaggaauaauuguauucauacauugucaaggcacagcacccugcaguuagcgucagauguuauuauaaauagccagaaagagccaagguaaauuacccagagagucccccagaaacaagcacugcaaauaguguuucuuggcucuguacuuuaguucauuaaucaacacucccaggaguugugcugagaccucaaaaaggaaagguaauuauuuccugaauguuaagcagaauagaaugagauaguguuaagauuuugaaacugucauuaaaaaacagcuggagaauuuccucacccaaaugugaagguguguucccuuuuuuuuuuuuaauggagagagcaagguugaaacacugacgcaauuugaggaaaggauaaaaagaaggaaauacaccuauuggguacaucuugucuaaaaaaaaauuagugcuuacugagaucaguguucuagacacaaaacguggcuaucuucuuuuguuuggcagucacaggguugcugcaguguuugauaacuauugagugcaugcuuccucugcaggcagggacguacccuccagguuguaccuugcuuggaagcuggcgcagcccuuuucuugcagccuugcuuggccaucuguugaaggguccauucucucggagagcaccaacuugcccucaccguuucucacccuuccuucuccugggaccaggaacacucauauucacauauuggaaggcacaccccucucuagccugccagccuucaccccuccccuccugucucuggaauccaugcucaccuggcaagcccuacuccgcccuuaggugucacuuccuaggaagcugcuccucuccuccccucccccagauucgccugguccccucucuuuugagcuccggccacaguccaccuugccaucacggcacuuagcaugucauauggugcugcauuucuugcuuaguugccuguucacuauuugacuguaagaucugugagagcagaaaccaugacugcccuggccacuucuguauucuagggcccagcacugugcuuagcacuuacaagacacuugguaaauauuuaggcagagggaaugacagaugcuuggaugaguggcagauagagggauggauagauggaaaggagggagggagagagagaaagaaaguggagggaagaaaggagacaggucaaacaagaagucugucaaugaguuucaagacuaaguuauuuuaggccaggcgcgguggaucacuugaggucaggaguucaagaccagccuggcaaacauagcgaaaccccaucucuacuaaaaauacaaaaaguuagcccggcaugguggugcaugccuguagucacagcuacuugggaggcggaagcaugagaaucgcuugaacuuggaggcagagguugcagugagccaagauugcaccacugcacuccagccugggcaacagagugggacucugucuaaaaaaaaaaaaaaaagauauuugaaaaaacauacgguaauuuaauugaaaacacagacucggggcuguccaccugcagaaguuauugguugggaaucucucuuuagcaaugucccuaagaaaacaaugccauggaaacggcauaggucauagucauugagccucccagcauuuuguuuucaguucauccuggguucuuuucacgugauacaucacagaugaucauagcuggcugugucacucaugccaggcuccagcccauuaaucuugguguuugccacauggcugccuccccugccuggucuggugugacacucccacacuugagucucauucugcccugcucuugcugcaucacgccucacugcauucaacucgagccucuugacaagugcucuuggcuccuugagacauuccagaacagcuccuugaugggcuguacuguucugcaaacauacuugacuuccaggcguguuugcauuuggcaguagcagucuuugagaugcuuauccauacuucugcugcugucaucgauuuuuagaccuaauuuuccuuuuaucauggcagguagcauguucauguaaauguggccuucgugguuauuagaaguuagccccuuuuugaauuauuugagccacaucugugugccaguguuacauugaugggaguuucuggcccguauuuuuacuucaaaauucucuguagaucugcuaaaaacucuaaaugccucauauucucuuagauguuauuuaacugaaaacaugcgcaguaccauucguguugaacuuacuagauuuagggaguguuguagcagaagccuaaaguaguuaauaaaugucgaauggcaaauaaauuauucaacaaggaacugcaguucuuuuuaacuucuaauagucgaagguuaaauacuauaccuugggaaaagauucggaaauucauagcacaugguaacauagcuaagaugcauuguguaauagaguguuguaaaaucucaugguaaugcagugaugcugaagucaucugacucucuuagaggaugcuuggagguuggaaucucaaauuauuuguugaauguagccaguuagggccaaaccuggacuuggcuguagugagcacuauggguuuugaggaaggagaugcugagcucugggcuuugguccuccggaaccggcuugacccaacagaucuuuucuguuuccaagucugacaucagcucaugugauuccagggcuuuaaugugucugcuggccacaacagugggcucuuugacauugcauuugugugggagagauggccccagccaaugccauuucugcagaaguggagcagaucacaggcagugacaacgcccauccuuuuggccacacugggguuugggaagaguuucuuguaacaguauuuuguaucauuuugucuguguuggcuccaaaugcugcugggauccugaccuuccacucugucuccuugucuuccuacaggaagacccuguucccaauggccuccgggcacucccaguauucuaugcugcuaccauagcaaucaaugucuuuuccaucauguacacaggagcaccagguaaggaucccuuggaagcauacuccaggggcaaagugcauuguauucuaacaguaucaguuuauuuggugcugguauuguuggcugacaguaaaaagcauuacucauggucauuauggaauaggugcuggaguuguuggcugauaguaaaaugcguuacucauggucauuauagaauaguaaaaagagugguaaaugcauuuacuugucuuaauuaaauacccaagagauauguagaguacaaaggcaacagacuuucaaguuagaaaaaaaaauuaaauccccacucugccauuuacgcagcuguguugccacuauagcuuagccucucugagccucagaaccugaucuaaucccacaggccuacaggguugugcaggggucaggagaggguguggagcaccuggggccaugccuggcacccagugagcgggacaguccacacaucagcaaugcccagcggagcucuaaagccguucacagcacagaguacagaccccuggaaauaucagaccaguuuauccagagacuagaagccaugcuuuguuuuuuuagauaccgaagccaaugaugauuuucuuugcugaauuacuccuuuccuugucauucucauggauuuuguuguuauuuuuuauguuuuuuuuuuuuuuuuuuuuuuuugagauagagucucacucucucacccaggauggagugcaaucgcgcuaucuuggaaaacugcaaccuccgccucccagguucaagcgauucuccugccucagccuccuuaguagcugggauuacaggagcacaccacagguuuucacuauguuggccaggcuggucucgaacuccugaccuugugauccgccugccucgaccucccaaagugcugggauuacaggcgugagccacugcgccuggccgcuuuuguucuuuuguauaaagguucagagguuuuuuguggggggggggguuaaaaauuauuuuuuauuuuauuuuauuuuugagacagaggcucgcucuguugcccaggcuggagugcaguggcgcuaucuuggcucacugcaagcuccgccuccuggguucaugccauucuccugccucagccucccgaguagcugggacuacaggcgcccuccuccucgcccagcuaauuuuuuguauuuuuaguagagacagggguuucaccauauuagccaggauggucucagucuccugaccucaugauccgccccaccuuggccucccaaagugcugggauuacaggcaugagccaccaugcccggccuuuuuuuuuuuuuuuuucuuuauugcccaggcuggaaugcaguggugcaaucauagcccacugcagccuugaccucaugggcccaagcaauccucccaccucagcccccugaguagccggaaccacaggugugugccaccacacccagcuaauuuuuuauuuuuuguagagauggggucucuauauugcccaggcugguaucaaacuccuggccucaaguaauccuccugccucagcuucccaaagugcugggauuacaggugugagcccuacugcaccuggccuaauucuuuucuuuuagaccuugaauaggaaaaugaauaagcuuauguaugguauucuuguuugcacccauuucagcacugaugagcuaguagcauucuguuaaacauuucuguacauguuugcuagagaauauuccucuucuguuugugagaugcgccuccuacagccagacugugggaucugugacaucaacagauguguuaguuugugcugguuuucaucuucuuaaugucuguuauggaugaagauuugguuauuggccauguugacagaaaaggcucccucucuguguuuuaaagaugaaauuucugcuaaaugacauguccuaucauaaucgaaaagcgcccucuuccaaaauaguggaaauccuuauuacuuucucaaacuaggaguucucaauguaauguuccucagauuuuauuaagaauaucuaauuauauuuuauauguuucaguacugggaauaaaguauuccuaaaugauucuaacauuauauaaccuuuuacugugguaucuguguaguguucagaacauugaucuuaaaggcuuaaauacucagccgggcgcaguggcucaugccuguaaucccaacacuuugggaggccgagguggguggaucacaaggucaagagaucaagaccauccuggccaaccuggugaaaccccgucucuacuaaaaauacaaaaauuagcugggcgugauggugcgcgccuguagucccagcuacucaggaggcugaggcaggauaauugcuugaaccugaacccaggagguggagguugcagugagccaagcuugcgccacugcccuccagccugggugacacagcgagacuuugucucaaaaaaaaaaaaaaaguuuaaauacucacuguggggcuuccagacuuugggugauuugcggaugaaggaaaggggagugccagagcugcuuuagguucuaggaaagcaggaagcaaaguuagauugaugaggagagugggaggaaggugaaaucccagucacagguaacagcagccugcugccccuuuagguuauauaauucauggaccaggaaguguguuugucacagcuuuuugaaguaugugccccaggauaaauuuuuuuuaagugaggcugggcgcgguggcucacaccuauaauccccgcuguuugggaggcugaggaaggcagaucacuugaaccaggucaagaguucuaaaccaguguggccaacauggugaaaccccaucucuacuaaaaauacaaaaaucagcuggucaugguggcgggcaccuguaaucccagcuacccgggaggcugaggcaggagaaucacuugaaccugggagguggagauugcagugagccgagaucccgccacugcacuccagccucgucgacagagcaagacuccaucucaaaaauaaaacaaaacaaaaaaauuuguuuuaagugagugacagagaaaaaucaguuccaaaccauggaguuaagcgcaccaccuagcaugugaaucccucaaacaucucauaaugccagguaauuggaaggccuggagcacuggguuggaagugaacucuguaacgggagauaucuuaguccuuguuuuuuuuuuuuuuuuuuuuuuuugagacagagucucguacugucucccgggcuggagugcaauggcaugaucucagcucacugcaaccucugccucccagguucaagcaauucucuugccucagcuucccaaguagcugggauuacuggcgccugccaccacgccuggcuaauuuuuuguauuuuuaguagagacgggguuuugcuauguuggccagucuggucucaaacuccugaccucgugauccgccugccuuggccucucaaagugggauuacaggcaugagccacugcaccuugcccuuuguucuuauuuuauaugggcuuuuagaguucaaguuagcugaacagaaagcaaagccuccugcaaucaccagacgccucccagguugcugacuuaagagacugagccagugaaagcugaggacgccuucuguggugccaaguccugaacaugggaauuggcaucaauauggaugggguuuuuucguuucugcauuuuauuuuuucuacccucuauucuucuugcuuccugguucuucuuccaacugucagaagacaauuacgauuuuuaauaaaagucugacuuuuucuauacauggccuuuuuuuuccaucucuucuuucccccaucuuuuggcugcaguuggcacauucgcuaaaaauaucaucuuacugggagaguaaauuauccuagggaaaauuaaacugugugaugaaugagacucuaagaauaauauaaauacuaauauaaauacuucauaggguuguugugagaaauaaauaauguaacuguauugaacugagcuuuauguggauuaauccuucuaguccucccaacuacucuugguaauuggcaauacaaauaaccucauuuuacaggugggaaacugaggcagggcaaugcugaauacccaagguccuguaacuaauaggaugcagaaccagaauuugaaccaugccuccaguccugagcccuggggucuuaguugugacauuauacagaugugggagguaguuuaaaacacuacauauaauaccugguauguaauauagcaguuaaugauaauaaaaauugcaucaaccuuaacaaauuuuuuuuuuuuugagacggagugucauucugucaccuaggcuccagcaaucucggcucacugcaagcuccaccuccuggguucaugccauucuccugccucagccuccugaguaguugggacuacaggggcccaccaccacacccggcuaauuuuuuguauuuuuaguagagaugggguuucaccguguuagccaggauggucucuaucuccugaccucaugaucugcccgccucagccucccaaagugcugggauuacaggcgugagccaccgcgcccagccucaaccuuaacaaauuauuucucuucucuuaacucucuuuaaaaugucuucugguauauuugggaaccuggagugcaugcgcacgcucucucucucucucucucucucucucucucucucuauauauauauauauauuuuuuuuuuuuuuuuuuuagacggagucuugcucugucuccuaggcuagagugcaguagugugaucucagcucacugcaagcuccaucuccuggguuuagggauucuccugccucagccucccaagcggcugggacuacaagacgcacgccaccacaccuggcuaauuuuuaauuuuuaguagagacaggguuucaccauguuagccaagcuagucucaaaccccugaccugaggugauccgcccaccucggccucccaaagugcugggauuauaggugugagccaccgcgcccagcuauuuuuguacauauuuaauauacuaguuagugugaagaagcagccaccuccuaauuaggaauauaaaaaaucugggcuggucauggugguuaacaccugucaucccagcacuuaagaaggcugaggaggagcaucacuugaagccagguguucaagaccagccuuggcaacauagcaagaccccaucucuaccaaaauaacaauaauaauaauaauaauuguaaaaucuguauaagggaguaaaggcugucgugaacuaugaucguggcccugcacucaaccagaugacaaagcgaggcccugucucaaaaaaaaaaaaaaaucuguguaaggaucuugaaguucauuauucccucgaagcacaaccaguauuuauucccaguccugaaguuagcguuagguucuguaguuggguggcuguucugucaggaaugugacaucaccuccccucccaaagucuuauuccugauuauaaaguaaggccaggaguagcaucuccguucgagggacacuauagucccugagauaaugaaggugggguaccuggcacagugcccggcacauaaucaaugcuucauacagucauuggucccucccucuccucggagauuggcuguaggaccuccguagauaccaaaauucggccgggcgcgguggcucacgccuguaaucucagcacuucgggaggccgagacgggcggaucaugaggucaggagaucgagaccauccuugcuaacauggugaaacccuguuucuacugaaaauaaaaaaauuugcccagcgugguggcaggcaccuguagucccagcuacucgggaggcugaggcaggagaauggcaugaaccuaguagggggagcuuacagugaccugagauugcaccacugcacuccagccugggagacagagcgagacucugucucaaaaacaaacaaaaaaaaugauaccaaaauccauggauauucaagucccuuaaguuggccgccaguaucugcugaaccauggacggagaaggccaaccgugccuguuagaggcuguuuuguuaccaucagucauaauuaaccuaacccagucuuuuggccuuaacuugccagaaacuccugagucauccuguccuucuguuuuuccacacaucuuuguauggaaaaauucuuacuugaaguuucucaaggggcuugccuagaggagaaggucauggcucugaaggucccaccauuuuguuccuccgaugagucaaaaaaggacuuugcuaauauuuugauuccaggggaauguuucuagaauguccagugagugagucaaaaucuuauuuuuauguaagccuugaagguauuuuguccuucaauguagacuuucauuacauacuguuuccucauaugggguaucucugcgaguccagcugugucauuaauagccgugguguccuaguucguguuuuugguguuuuguuuugauuuccucugcuucucuacucuuaauuauugugaaguugauuauuucuuaggcuuaguuugauuuguguuacuuuacauuugacaugacuuuucucaaaagucauucuuacacuucaaagacuaaguucgcacuuuuaaaaaauugucuuugcauuuuuguucuuaaaaaaaugacuugcaaggacuaaaaaauaacuuuaggaaauaaaaugcuuacuuggguuggauacaagccuaagcuucauuuuuaaugaaaaagucuucaguuguguggggccugguuuuuguucaguguuuaaacagugaaugcuaaaguucauggcaugccccuuugaacagucgaagcaggucacccaguuaagccucugguaggcaccuucuaaggcaauguguggucccuggccagcaauagcaugcaggaacuugucaagaugcagauuccgaggcccagcccuggacccacagaaugcagcccagugaccugugguuuaauaggggagccucagugauuuggaagcauguuacaguuugagaaccacugcucuaggcacgucucuuaccagaaacguggcuuccucauuaccguucuaauguaauggguacucccaaaaguucuaacccuaacccaaccuuugcucacucguuuccaccagcaaaggaauucccaacuuaaccaggccugguuccugacuuucccagagcaugucuguaccugagacaugccugccccugccucugcggccuccugcggccuccucccccuccuccuccucuucaucucuuccuccccuccuccaucuuuuccuccuucugcucuuccaucucugucuccuccucuuuaucucuuccuccucguccucccccucuucaucucuuccuccucauccuccucuucuucaucucuuccucuucccgcuccuccaucucuuccugcuccuccucuuuaucucuucuuccuccuccucuuuaucucuuccuccuccucuucaucucuuccuacuccuccucuucaucccuuccuccuucuccaucucuuccuccuccuccucuucaucucuuccuccucuucuucuucaucucuuccuccuccuccuccaucucuuccuccuucuccucuuuaucucuuccuccucuuccuccauuucuuccuccuccuaucucuuucuucuccuccaucucuuccuccaccuccuccaucucuuccuguuccaucucuuccuccucuaucucuuccuccuccacuucauuucuuccuccuccucuuccaucucuuccuccuccuccuccaucucuuccuccuccuccuaucucuuccuccuccuccuccaucucuuccuccuccucuucaucucuuccucuuccuccuccaucuuuuccuccuccucuuucaucucuuccuccuccucuucaucucuuccucccccuccucuucaucucuuccucccccucucuuccuccucuuccucuucaucucuuccuccuccuccucuucaucucuuccuccuccuccucuucaucucuuccuccuccuccucuucaucucuuccuccuccuccucuucaucucuuccuccuccuccuccaucucuuccucuuccucuucaucucuuccucuuccuccuccaucuuuuccuccucuuucaucucuuccuucuccuccucaucucuuccuucuccuccuccaucucuuccuccuccucuucaucucuuccucuuccuccuccaucuuuuccuccuccuccuccaucuuuuccuccuccucuuucaucucuuccuccuccuccucuucaucucuuccucccccuccucuucaucucuuccucccccucuaucucuuccuccucuuccucuucaucucuuccuccuccuccucuucaucucuuccuccuccuccuccaucucuuccucuuccucuucaucucuuccucuuccuccuccaucuuuuccuccucuuucaucucuuccuucuccuccuccucaucucuuccuucuccuacuccaucucuuccuccuccucuuuaucucuuccucuuccuccuccaucuuuuccuccuccucuuacaucucuuccuacuccuucuccucuaucucuuccuccuccuccucuucaucucuuccucuuccaucucuuccuccuccuccaucucuuccuccuucuccaucucuuccuccuccuccuuaucucuuccuccuccuccaucucuucucuucccuguccuccuccucuucuuccuguuucuccuccuccuuugcccccuuucuccuccucaucccccuccucugguuucuccucuuccuucucaucuuccuccuccuucucuucuuccaccucuuccuccucccccuguuccuccuccaguugcagcugcuucugauccaguuucuaggaaaccaggacaucagaaaccucucaggcugccaguuggcuuugugagaaggagcccugcacucagaaggccucuuucuuccaugcugugauugugaagugcaggcuguggagaagccagaaauugccguuacagugauuccuagucuuggauuggggaagcccuggggugagaagagucuccaguuaucaccaagagcuggauucaaaacagggucauuuaaauucaccucauuuucaaaauuauuacaaauguacccugguuugaaaaaguugguaccagccaggcucauggcucacaccuguaaucccagcacuuaugggaggcagaggcaggcagaucaccugaggucaggaguuagagaccagccuagccaacauggagaaacucugucucuacuaaaaauacaaaaauuagcugggugugguggugaguuccuguaaucccagcuacuuaggaggcugaggcaggagaauugcuuggaccugggaggcggaggcugcagugaguggagauugagccacugcauuccagccugggcgacagagcgagacuccaucucaaacaaaaaaagaggccgggcgcaguggcucaugccuguaaucccagcaguuuugggaggcugaggcagguggaucaccugaggucaggaguucgagaccagguuggccaauauggugaaaccccaucucuacuaaaaauacaaaaauuagcugggcauaguggcaugugccuauaaucccagcuacuugggagguugaggcaggagaaucgcuugaaccugggagguagagguugcaaugagccaagauggcaccacuuuacuccagccugggcaauacaguaagacucagucucaaaaaaaaaaagaacgaacgaaaaaaaaauacuugguaccaugugcaaaaaauauauauauauauuuuuuacuuauagagcaaauuaggaaaucacauuuuuuauuuuauuuucucaacuaaguuguuucagaauuccuauuacauagguagcuccucuaaugcuuugaauauauugaucuagagcaaaagacaaagcucaauuuauaaggcaagauauuagagcaguucuacaaaggagguaaucucugugugugugcaugugugugcacacauaagugugaauguuuacuaugagaagauauccgcagcauauuguuaugugacaaacaaaagcauagaauaguauauagugggauucugcuucuguuuaauaaaaggaaaaaagaaaaauaaauguucgacauggugucugugccuaccuagaaaaugccuggaaacauacacaccaaauaguucuuacugucucccugggaaguaaguugaagaggggaggaugaugaggaagguucauauuuguacaucauacaauuuuguagguacugcugauauuuuuacgauaagcauggauuauuuauauaaugaagacaaagaaucugcauugagucaauaagaaggaagauuguagggagaugaugggucaugauauaaggaaacugauauagacuaaagccuuauuggucccauauaaguuuuauuuguuuauagauccuuagucaugaguguuagaugugaaaaacaagaaguacaacaaggcaauaacaauggagacugagcucguauaaaaaguucuauguauuucucccuaaauggcuugaauauucgucuaaucuuuugggaauuuggaauagaauuguaaagaugcuugagguuagagcuaaaucacuauucaucguaucuuagcugcuccgcaaaugaaaggcgcuugacauuugcgccuuuuaguggcuaaaaccgagaacggagacccagagcuccuugcgcggguuccuggcagcuacuuuuggcugagugaacacgagccacugaggcugugccccaguauguccauccgcagggggaaaugacggccaugucuuacugccugacguagccauaauuguuuggaaacaauucgagauccguaccagaaagacaauuuaauagaaaguauuuuugucaaaaauguuguuguguagaagccagucuugaguuuuuaggagaaaaaccguuugccuugggugugcauugauucaggcgcuguccugugcugaaucuuuguauugaauuguuuuuuauccacgaaacuggauuuuauauacuuaguacaauuuggagcuguguaacacagguaacugucaguuuacuuuuuucacaugcaggccuuaaaaguaaauccuugugcucaucugauucucugcuaaaucaccaaacugcuggaauacuucaguaagauccuguccccauucugcucccccucucaccuacugugaacagcuuccccuguuuucccagauuccuucucucuucuuccuccuccgugacguguuacccugucuccccaccacuuccccugggugaugcguuucucuccugcuuccccugccaguuucucaugacugggaggugauuucagaguuuucuggcuguaucccaggccacaucagugguagaggcaggugugacggcaaaggugcaaagggcaggugauauuaucuuaagucgaagcacagggugagaagucuugcccccgaccucagguucacccuuuugguggugguccugacaccaucugggaccccaugugacccugcugggagccuggcgugguccuagaaggagcccaucaaguagcccuucuugacuucucuuucgggcccugcucagcaugaaugguaaaaauagggccugauagcaaaagcguucacucauuuuuaaaauauguaucccagauuguuucucucucccuguggucucuaggguuugccucucuuagaucaguuuggcgcaguagcgcuaagccgaaaguagcacaauuaguaauuguaucaucagcaaaaccacagaagaagcagggaaaccucuucaggaaccaugcuuugaagccaugcgugggaucgguguuggcgucaguuguuaguuugacguugguaaagagcggguaccauucgaguuggcaagaaccagcuuuggugcaauccuuugcugcguguaugaaccccuacaugaagguggacagcagacgcugggaagccuuggccccagacacagcccagugcaaccaaccaaggggucgcacaagcggcucucagcuuugggugcaggggcagagccugaguuggauggggccugcuggugucaguacagccgcguggcagagcugagucagccuucugauguagucagggggaugggagcugagcaguuaagugccuguccucccccagugaccuuagcuaucacugugcuaggugauucuggauuuuuguuuuuaauacuuauauacauuaauucugacuauauauaguauuaacuaccuauucuauucauacuaucucuuacaauuauaaaaaagaaauuuuuuuucuucugagauagaaucucgcucugucgcccaggcuggagugcaguggcgugaucuuggcucacugcagcuccaccuuccggguucaugccauucuccugccucagccuccggaguagcugggacuacaggugcccaccaccacgccuggcuaauuuuuuuguauuuuuaguagagacgggguuucaccguguuagccaggauggucuccaucuccugaccuugugaucugcccgccuuggccucccaaagugcugggauuacaggcaugagccaccgcacccagcccaaauguauguuaauuuuuuuuauaguauguuaauuuuuuuuuuuuuuuugaggcaggaucucacucuguugcccaggcuggaguucaauggcgcuaucauagcucacugcagccucaaauuccugggcucaagaaaucuucccaccucagccucccaaguaguugggacuacaggcgugcaccacuacucccagcuaaucuuuuuguuuuuauuuuguagagacagggucucacuauguugcucaggauggucuugaacuccuggcuucaagugauccucucaccucagcuucccaaagugcugggauuacaggcaugaggcacccugccaagccuaauaguaccucagcugaguaacuuugugcugcuuucuauguauaaaaugguuaacaauaaaacaaagacugcaaauuuauuuaagagcaaaguguuaaauaguuaaccccuuugaauuaaauuuuuuaacaauuuacaaaagugacauucuuauaguauauauauuuuuauuucuuuuucuuuuuuauauuuuguuuuuuacuuuuuuuaguaaauucucccagauccuuaucuuauuguauauauuuuuuaaguuaccacuauaaagguauguguaauaaaaagugaaauucccacuccagucucccaucucuccauaaagaaauuggaaaccacuguaucuucccagaacuuuuucuguaaauucacagauaugacgggaauguggaaagguggauguuuuauuuuucaaacauaaauugcaucaugccauguguauaucauacaacuagccugcauuacucauuggaucuugggccucuuuccuuaucaguacauauagaccugcauaauucauaagacugucuacaguaauuacuucacauuuucauaaugaugcauauauuaguuguucuacaaauuauuacuauuacaaauaaugcuguggugaguauucuugcauaacuaccugugaguuuauguaugagcauaaguguucaaguugugcacauaugaaugugugugaaugugccuguugucaccauugacagcagauggacaaaauucagggugaugagggcuggagacaugacagugcuaugaaaagaugacguucucaaaccaugugcacuuccacccuuggauuggcuaauguuauuauugcuuagugugcauuaugggauuugagugaaaaguuuuucugcacuguaauuccguaaguugaugcuucaaagaagaguuagaauugaaggucaguguccuuuuaaaaaacucuuauuccuugggccagguggcucaugccuguaaucccagcucuuugggaggccaaagcaggaacaucccaugaggcuaggaguuugacaccagccugggcaacaucgcaagaccuugucucuuaaaaaaauaaaaguaaaaauaaaaauaaauaaacaacaacaaaaauccuuuuauuucucaauugauuucaaagaaguucuguguaugugguuagggcacauguccguuuaaaguagggcuacuggcugcugaggaacuaggagaggccucaguugcggagccaggcaguguccagauggcagcuuccugccgcaggugggcugggcugaggugggcaucaggauggaagacagcugacuccuuucuuuuuuuuucuuuauuucuuuuucuuuuuugagauggaguuuuacucuuguugcccagacuagagugcaauggcgcgaucucagcucacugcaaccuccgccucccaggcucaagugauucuccugccucagccuccugaguagcugugauuacaggcgccugucaccgcgccuggcuaaguuuuuguauuuuuaguagagauaggguuucaacauguuggccaggcuggucucaaacuccugaccucaggugauccucccaccucggccucccaaagugcugggauuauaggcgggagccaucaugcccgaccucagcugacucccuucucagccacauuuguugugcagccauuuagauauugaaauaauauguaaauggauuucaucccaacuuaaauaugcuguuugugcccaguuguuaaaauuuuauuuauuuauuuuuauuuuauuuauuguuuuuuuugagauggagucucgcucuguugcccaggcuagagugcaguggugcaaucucggcucacugcaacaucccccucccagguucgaacgaaucucccgccucagccucccgaguagcugggauuacaggcaugcgccaccacgcccagcuaauuuuugaauuuuugguagagaugggguuuuacuauauuggccaggcugaucucgaacuccugaccucaggugauccucccaccuuggccucccaaagugcugggauuacaggugugagccgccaugccuggcccccaguugguaaaacuuuaauaauuagcuuacuaacuaguuuaagcacauauucgccagauauaagaugucuugaacauacagcuuucuacuccaaaaaguauagcauguuuuuuuaguugagaguuuuauucacuacaaaauccaggugauucguucucgauuuggggagugggaaguccaccgcccugaggccugaccuugcagaaguuuccaguaaugacacugcuucucauuuuccuucccagugcucggccuuguucuccccaugugggccauagcccucauuuccuuuggugucgcccuccuguucgcuuuuuuuguguggcucuucguguguccguggaugcggaggaaaauaacagguaugggccuuuuaauucuucugauuuacagaaaugcucccgauucccaaaaccucacauguaacaugccaugauccuuacuaauggaggaaauggaagugugggugacuccagaacauaccccauccucugucucuccguuccugagugcuuucuggcucauacguuuucuugauaaguuguaacccaggugggcagcaaggucccaguugccaugaguaacuggaaguuaaccgugcagugcaguucugccagccuguggaaaaacauuagccuucauagaaaugcaaauuaacuccacaaggagauuuuguuucccacucacaagaauggcuaagaguacaaaguuccugcaauuccauaugugggugaagaagugaaauaauuggaacucucccagguuuaugcugaaauuuaaaauggugcaaccacuuuggaaguuagguuugcaguuucuuuauaaaguucaccuuacacuuaccaugugagccaguaauuucacuccuagcuauuuauccaaagaaaugaaaacguguucauaaaaagacuuguauacaaaucuuuuugucauaauagcccaaaguggaaacaacccauguguuggucagcaggcaaauggguaaccaaauugaguaaauucaugcgauggacgaccacgcagcaauagagagaaugaacugcuggggaccugacggcugaaggcauccuacagccgugauacugagcagaagcccaugauccggaagagcaccuauucugcaugcuggcauuuuucauaacauuuucuuaaauuuuuauuuaaaaguuuuauggaucuuuccauuaaauuuaagaauauggaaaauucaucuauagcaacagaaagcacugaucgccugggauggguggggguuggagaaggcagcucaggaacuuaucagggacaugaaaugucuuuguuuucaucagggaagggguuuagagugugcccacuugcggcaggucauaaccuggaugcuuaaaauguaugcauuuuuggcugggcaugguggcuuacaccuguaaucccagcacuuugggaggccgaggcauguggaucaccugaggucaggaguucguuggucaggagaccagccuaaccaacaagguaaauaaaacccugucucuacuaaaaauacaaaaauuagcugggcccugguggcaggugccuguagucccagcuacucgggaggcugagacaggagaauugcuugaacccgggggggcagagguugcagugagccaagaucgugccacugcacuccagccugggugacggagcgagacuccgucucaaaaaaaaaaguauacauuuuauuauauauauauauauauauauauauauauauauauauauauauauccuauaauaauaauuguauuauuauaguacuguaauaauuauacugugguauaauacaauuauacuauacaauaacuguauaguauaauauacaauauaguacucuacuguauaguacuauaauaauuguauuauuauaguuauaguaauuauaacauauauaauaaaacgaagcaauaaaaauaaaacacauguuauuaaaaggaaaacaguuuuuaaaaagaagaagaauauggcuuaggaagucagccaaggcuguuuuccuauucccaauuccccauauuugaauuucaagccuugaagccacaugcuuuuuacagaacucucaaaaaacagauauuuacauuuggucucagcauguaccauagggucacauuuugguauggauauaucugcauuuggaaauucacuuuuugaaaaagaccaaaauacaugagacaaagcaugcuccugaauuggaagacaguauaguagagaugccaguucuuagauucaucucuagacuuuagacaauuuaaauagaaaucccagcaggauauuuuguagauuuagacaagccacuuuuaaaguucauguagaaagucaaagaaacuagaugagcuggaacaauuuuggaaaagaaaaaaguuggaggauucauauuaaccugacuucacgacuuguuaugaagccacaaggcaguguggaagagagagacacauagauuaauggaacaagaauagagucuagaaauagacccacacuaauguggcaaauggauuuuaaacaaagguacagaaacaguucaauggagaaaggacagucuuucaacaaaugguuuuggaacacuugacauccauaugccaaaauaagaacauuaaccuaaaccuuauuuuaaaaauuaacuuaaaaugcaucauagaucuaaauauaaaauuuaaaaaacaauaagacuuuuagaaaaaaaauauaagggaaaacuuuugugaccuuggguugagaaaggguuuuuagauaugacaccaaaaacauguucuauaaaagaacaaguugggccaggcaugguggcucacgccuguaaucccagaacuuuaggaggcugaggcaggcagaucaccugaggucgggaguucgagaucagccuggccaacauggagaaacccuguuucuauuaaaaauacaaaauuagccaagugugguggcucaugccuguaaucccagcuacuugggaggcugaggcaggagaauugcuugaaccugggaggcagagguugcauugagccgagauugugccauugcacuccccuugggcaacaagagcaaaacuccaucucaaaaaaaaaaaggacaacuugauaaauuguacuucaucaaaauuucaaacuauugcucugugagaagcaccgggaacagaaugggaaaaaauguuugcacaucccauaacuacaaaggacuuguauucaaaaaauaaaaacacauuuuagaaaacaaauaacucaauuaaaaaaugagcaaaauaggccaggcgcaguggcacacgacuauaaucccagcaguuugggaggcugagguggguggaucacaaggucaggagauugagaccaucuuggccaacauggugaaaccccaucucuacuaaaaauacaaaaauuagcugggcgugguggcacaugcuuguaaucccagcuacucaggaggcugaggcaggagaaucgcuugaaccauggagucagagguugcagugauccgagaucgcgccacagcacuccagucugguaacagaguaagacucugucucaaaacaaacaaacaaacaaacaaaaagaacaaaauagcccaggcacggugacucaugccuguaaucccagcacuuugggaggccgaggugggcggaucaugaggucaggauuucgagacaagcuuggccaacauggugaaaccccaucucuacuaaauauacaaaauuagucagguaugguggugggugccucuaaucccagcuacucaggaggcugaggcaggggaaucacuugaacccgggaggcggaaguuacagugagcggagaucacgcuagugcacuccagcgcacucuagccugggcaaaaagagugaaacucuaucucaaaaaaaaaaaaaaaaaaagagcaaaauauuugaauagacacuucaccaaagaagauagauggggccagacacgguggcucacgccuguaaucccaacacuuugggaggcugaggcgagcaguucacgaggucaagaaaucgagaccauccuggccaacauggugaaaccccgucucagcuaaaaauacaaaaauuagcugggcgugguggcacgcaccuguagucccagcuacucgggaggcugaggcaggagaaucgcuugaacgcgugaggcggagguuacagugagcugagauagagccacugcacuccagccugagugacagagugagauuccaucucaaaaauaaauaaauaaauaaauaaugaaaaauacugacaguacuaaauuuugucaguauuuagaagaaugaagaggaacuggaaccucguacguugcugaugggaaugucaaaugguacagggaaacuguuuggcagcuucuuauauggcuagcacuugccauaaauauacucuuaaccacuccuagauauuucccuggaaaaaugaaaacuuaaauucacacagaaaucugcacaugaauguuuauagcaccuuuauaugcaaucuccaaaaacccacauuauccacagaauaaauaaacuguggugccuuuguacauuugaauacuacucagcaauuaaaaggaacaaauuauugauccauguaacaacguggauggauuucaaaggcauuaugcugaguagaaaaagccagucucaaaaaucgcauauuuuauuauuuuauuuaugugacuuucugaaaaaggcaauuuuucagaaauugaaauuucugauucugagguuaguuuaagaaaacagaaggccagucuggguggcuauagauuuacagaacauuagugcuggagggaacugugguauucggaucugacccuuuuuugguuguuguuuuuggauaugauaacucgggcccuaaauuuccaucuuuuccucaauugcugaauuuucuggcuagaguuuuccagguaauuaauugaacuuuugacuuucuuuucuuuucuuucuuuuuuuuuuuuugagacagagucucacucugucacccaggcuggagcgcaguggcgcagucuuggcucacugcuaauucugccuccuggguuuaagagauucuccugccucagccucccaaguaguuggaauuacaggcgccugccaccacacccggcuaauuuuuauauuuuuaguagagacgggguuucaccauauuauccaggcuggucucaaacuccugaccuggugauccaccugcuucggccucccaaagugcugggauuacaggugugagccaccacaccuggccucaacuucauuuucucuaucuagcuauaacuuuuuuuuuuguuuccaaaaucagugcuaaagcauaaagauauagauucacuuuuuaauauucauguuucaauaauaagaacucucuuccagaauguucaguaugacuuuguuuucuuuaggcaaauuacaaaaagaaggugcuuuaucacgaguaucugacgaaagccucaguaagguucaggaagcagaguccccaguauuuaaagagcuaccaggugccaaggcuaaugaugacagcaccaucccgcucacgggagcagcaggggagacacuggggaccucggaaggcacuucugcgggcagccacccucgggcugcauacgguaagaugugccuggagagcuuggguucuguggcagcacagagaaguucccuggggaggaccagcugggccugggugugggcaaucugguuuuaaugcacaaaaggaucccccaguuuuauaauuugagaaaacccagaagcuagggaggccucaggaaaccauuucguagucagcagagcaggcucacucuuguccugugauuucuuccaagagcuguuuauagucuaaccggaggcacuggggccacgcacuguaugucugugcugcacccacucagcuacauaugcagaucuccaugccccaggaguuaucgaauugcugaacguugguuaacccagcuuacuauggaagaugcaaagagaaagcuaaauuuguaaccaaggagguggucccaccauugaaucacagaaaccuuagaaaauguccagacugaccaggugcaguggcucaugccuauaaucccagcacuuugggaggccgagguggauggaucaccugaggucaggaauucaagaccagccugaccaacauggugaaaccccaucucuacuaaaaauacaaaaauuagcuggguaugguggugggugccuguaaucccugcuacucgggaggcugaggcaggagaaucacuugaaccugggaggcagagauugcagugagccgagauugcgccauugcacuccagccugggcaacagagugagauuccaucucaaaaaagaaaagaaaagaaaagaaaaaauccagaccauucuguguccuuuagacucucaauguuugugggcagugccaggggagcacagcuucaccaaagccugcccuggugacugccaccucugcaagguggguucuggcaccugccuaccacaggugcagucucagauguggcccagagaaagcaaauucauuuugccugacucaucucagauacugccuuugacauucaugacugaccuuuuaagaugcaccuaaaaaauuagccuggaugauggugcacaccuguagucccagaugcuugggaggcucaggcgggagaaugacuugagcccaggaguuggagugagcuaugauugcaccacugcacuccagccugggugacagagcugagacccugucucuaaaaacaaaaucaaaacagaggcaccuggaauaucuaccucacacgaaguggguuuugucucauguaugaaguuucucuaagaugaguuucuuaaaaagauucuccuuguguugguuucuagaaacagaaaaaaugugccaagugccauaguaauuucuggaagacacuuuuuaggagaacuuaagauguuuugaaaauaccacauuauuaguuuuacccuuuuguuguauguuuccauguuuuuuuuuuuuuuuuuuuuuuuuuugguuuuuuuuuuuagugguaaccauauuacauguccuuuauggccaacuuagaaaagaaaguauauguuaauaagucauccccagccuucuggagauaagugccaugaaauaguagggaguguuuccuucgcuuauauucgaaaggcuggggcugggcacguuggcucacgcuuguaauccgagcacuuuaggaggccaaggugggcggaucaugagguuaggagcuugagaccauccuggccaacauggugaaaccccaucucuacuaaaaauacaaaaaaguuagcugggcauggugucgcgcuuguagucccagcuacucaggaggcugagggagaaucgcuugaacccgggaggcgaagguugcagugagccgagauugcgccauuguacuccacccugaggacagagcaaggcuccgucucaaaaagaaaagaaaaaaaaaaaaaagacuggaaaaugagaccuucucuaacccuuuucaggaagagcacuguccaugacccauggcucugugaaaucgcccaucuccaacggcaccuucggcuucgacggccacaccaggagcgacggucauguguaccacaccgugcacaaagacucggggcucuacaaagaucugcugcacaaaauccacaucgacaggggccccgaggagaagccagcccaggaaagcaacuaccggcugcugcgccgaaacaacaguuacaccugcuacaccgcagccauuugugggcugccagugcacgccaccuuucgagcugcggacucaucggccccagaggacagugagaagcuggugggcgacaccguguccuacuccaagaagaggcugcgcuacgacagcuacucgagcuacuguaacgcgguggcagaggcggagaucgaggcggaggagggcggcguggagaugaagcuggcgucggagcuggccgacccugaccagccgcgagaggacccugcagaggaggagaaggaggagaaggacgcacccgagguucaccuccuguuccauuuccugcagguccucaccgccuguuucggguccuuugcucacggcggcaaugacgugaggugggugcuuucauucauucauucaacaaggguccuugaggcuccgccaggggccagcgcugugcgggugccgggauccagcagugaacggcaccgauggaagucccugccagggauaggggugcgcaggcgguggacagacccauaagucagcauugcgugcgggacagcgagcaguguuaacaggaaaguaagguagauagacacagggcaggagccgccaggauggcagugcgaccugggcuuccagggaagggcuggccggugacggaggugcaggggcggccacguggcgucagcaggacggcaggugcagucuugaggcgggcacacaccuguguucuccaggacaagcuaggaggucgccggucugcaggucguggaugcagagcacguggccgauggacacaggaaggaaggccucgccucgagaggggagccguggagcugugagcaggggccacacagggcacauuugacaggggccacacagggcacguuugacaggggcacuggcuuuggacgacggccuggaugcggaugugagagaagaaggaaagaggcagcugccaagaucggagccguggccuuggcaaaggcaagaguggagcugcugucuguuagggaugacggaggcccuggaugcagccagggcgcgaugcugcuauucagguugagcaggcagcggccguguacgcccgaguucaggacaggccgggcugggugcagagcagguaacguggguggaggagcacuggggcagugaggcaggcaggcaggaggcagagugcacagaccgaggaaacagccagaagguaugcugaaccaggacgcuaggagaacuuccuaggaggugauuuaauuuuuuuuuuuaagacggagucucgcucuguuccccaggcuggagugcaguggcgcaaucucagcucacugcaaccuccuucucccaaguucaagugauucucuugucucagccuucccaagccgcugggauuacaggcuccccaaccuggcccggcuaauuuuucuauuucuaguagagacgggguuucccauguuggccaggcuggucucaaacuccugaccucaggugauccgcccaccucagccucccaaagugcuggaauuacaggugugagccaccacacccggccauccuucagugacaucuucaaccccagugagaaggcuccgucccacucgugggcccuaguucuccccacugcacgaugcagccgcuggagcugccgcccgagccugcaggucacuccacaugguaaugucgcaggcauccugcaaaugaguguguagggaugggcagauaugacccuccaaccuugaccccacccaccccaccugccccaccccacgcccaggccugguguguaggaagcagggcggccuccuggggccugagagccccaaguuugggucucugcugucgucuuacagcuguguaaccccuagacaaggcaugugcuuuuccgaagucuccguuucccaaucuguaaaaugggggaaaacgaguccuaaccucccaggcuuccccuguguaauaugcucaggauggugcuccccacucgcucgguuucuguccguuucugcucuugccaucacggucauggugaguccacugaccuuucaggggacugugccguugucgucuucugucgcagucagugacuccccaugggcuacgcacacugccuccccacgugcagcugcaacucugcuguucguaaaagaagucucgcugcagaugaaccugggcaucuuauguucugcucagcaucauaugggcauuucugugguauuuuauuugguauuuucuuggagacagcaugcucuguccuauguuaguaacuuuuugucugcccccacaccgucccacuuccuccuccucaucaagcauucuuuccagaaggccugguacuggcagagcgcuaggaacuggguccucguccauuagaaguuuaaacgccaguuagggagaugagaaaaacauauccguggaaaaguaacaacacauucucuaacauucacacacucagaugcacacacacacgcacacacacucacaugcgcacucacacgcacacucacacauggacucacgcacauucacacacacaccauguuucauuucaaaggaagcaucuaggcaguggcugcucggggugacuguagaauugcgaagaguugcuugcagcguggggacuauucuggggcuuuggagcagggagagcgucuggugaaagcaccauucuagaagucaucugagugagaagaggcguccaugcauucagcacgagguugagccccgaggccucagcacugagcugccauggccuaucccacccugucucuaacaucccucugagccaggggcgggugucucucagagaugggaucugaugcucagggccacacagcaaaaccaaagccaaauuggaauccaguuucagugacucagugauacccagucuacacagcuggcugggggaggagacaagagcuugcagugagcugggaccaugccacugcacuccagccugggcgacagagugagacugucucaaaaaaaaaaauaauccauuuaauaggccgggugugguggcucacgccuauaaucucaacacuucgggaggccgaggcagguggaucaccugaggucgggcguucaagaccagccuggacaacauggugaaaccccaccucuacuaaaaauacaaaaauuagcugggccuguuucugggcacuuguggucccagcuacucaggaagcugaggcacaagaaucacuugaacccagaaggcggagguugcagugagccgaaauuacaccacugcacuccagccuggugagauugugccacugcacuccagccugggcaacagagggagacucucucaaaaauaauaauaauaaauuacacaccuauuaggauggcuaccacuuaaaaaaaaaaguaacaaguguugucaaggauguagagaaauuguaacccugugcaccauuaguggggguguaaaaugguguaaccacuauggaaaacaggauggaggcuccucaaaaaauuaaacagaccuccccuaugacccagcauuccugcuuccggguauacauacagaagaauugaaagcagagucucaaagagauauuuguaccacauguucaaagcacugccguuugcaauaggcaagaggggagaacaacccagauguccacugccaggugaauggaaacaaauuauguccaugcauacacuggaauauuauuuagccuuuaaaaagaaggaaguccugucacuugcuguaacauggaugaaccuggaggacauuaggcuaagugaaauaaaccaucacagaaagauaaauacuacucaugccuguaaucccagcacuuugggaggcugaggcgggcggaucaugaggucaggagaucaagaccauccugacuaacacagugaaaccccaucuguacuaaaaauacaaaaaauuagccaggcgugguggcacgugccuguaaucccagcuacucaggaggcugaggcaggagaauugcuugaacccagguggaggauauugcagugagccgagaucaugucacugcacuccagccugggcaaccaagcaagacuccaucucaaaaaaaaagauaaauacucuaugauuccacuucuaugagcugucuacagcagucaaauuccuagaacuagaaaguaggauggugguugccauuagcugcggggaggggcagugggaauuuguuuaaagagugcagaguuucacauuugcaagaugaacaaguucuggagaucuguuucacaacaauguaaauauacuuaacacugcugaacuauaaauaagaaugauuacgaugguaaauuuuauguuaugcuuuuuaccaaaauuaaaaaaaaaucauuuggaccaugaauagauuauauaggugaaccucaaauacaccaaguugagcuaugcucaagacaaaagucaccauguacaggaacaccugggagacacuguggguuccauuccagaccacuacaauaaaacaaguuucacaauacccaugaaguuuuuggugucccaguacauagaaaaguuauguuucuguaauaguauaccauagucuauuaaaugcgucuuaaaaacaauguacauaccuuaauuugaaaauacuuuauugcuaaaaaauaaugcuagcaauccugugaacauucagcaauucauuauuuugcugauggagggucugggccuugauguugaugucugcugacucaucagggugguggugauuaaagguugggguggcuguggccauuucuuaaauuaagacaacaaugaaauuugccgcaucaauuaacuuccuuucacaaaagauuucuuugcagcauguaaugcaguuugauaacauuuuacccaccguagaauuucuuucaaaauuggagucaauccccucacacccagccucugcucugauaacugaguuuguggaauauucuaaauccuuuguugucaucucaacaauguucacaacaucuucaccaggaguagauuucaucucaagaaacuuucuuugcucauccauaagaagcaccuccucaucuuuucaaguucuuucaugagauugcaguaguucagucacaucgccagacuccacuucuaguucucuugcuguuuccaccacaucugcaguggcuuccuucauuuaaguuuugaaucccucaaagucaucugugagaguuggaaucagcuucuuccaaacuccuguuaauguugguauuugcacuuccucccaugaaucacgaauguucuaauggcaucuggaaugggggauccuuuccagaagguuucaauggacucccuagacccaucagaggaaucacuaucuauggcagcucuagcccuacaaaguguauuucuuaaguaauaagacuugaaagucaaacugcucuuugauccaugggcugcagaacagaugcuguguuugcagacaggaaaacaacauucaucuccuugcauaucuccgucagagcucucuggugaccaagugcauugucaaugagcaguaauauuuugaaauauuaauauuuuuuucugagcaguaggucucaacaguaggcuuaaaauauucaguaaaccaugcuguaaacagaugugcuuuguuguuccauuucuagagcacaggcagaguagauuuagcaucauuccuaagagcaauaggaguuuuggaaugguaagugaacauuggcuucaacuaaaguuaccagcugcauuagccucugagaagagagucagccuguccuuugaagcuuugaagccaggcauugccuucucucuggcuauggaaguccuagcuggcaucuucuaccaauagaagacuguucuucuacauugaaaaucuauuguuaguguagccaccuucaucagugaucuuagauggaucuucuggagaacucgcugcagcuucuccaucagcacuugcuacuucaccuugcacuuuuaugcuaugaggauggcuucuuuccuuaaaccuccagaaccaaccucugcuagcuuccagcuuuucuuuagcuuccugacuucucucagccuucacagaauugaagagaacuagggccuugcucuggauuaggcuuugacuuaagggaauguuguggcugguuugaucuucuauccagaccacucaaacugucuccauaucagcacuaaggcuguuuugcuuucuuauuauucauguguucauugaaguagcacuuuaaauuuccuucaagaagcuuucccuuugcauucagagcuuggcuaacuguuuggcccaagaggccuaguuuuuggccugucuccgauuuugacaugccuuccucacuaagcuuaaucauuuccaguuuuuuauuuaaacugagagacaugcaacucuuccuuucaguugaacacuuagagggcacuguacgguaauuuauuggcuuaauuucaauauagcaauaucucaggaaauaggcuggaggagagggagagagacaaggcaguggccggucaguggagcagggagaacacacacagcauuuaucagugaagcucaccgucucauaugggaacaguucauggcaccccaaaacaauuauaauaguaacauaaaagaucacugaucacagaucaccauaacagauaugauaauaaugaaaaauucgggaauacugugagaauuaccaaaaugugacacagagacaugacgugagcacauacugcuggaaagucgcuccagcggacuugcuuggugugggggugccacaaaccucaaauucauaaaaaacauccuaucugaaggccagguacaguggcucaugccuguaaucccaacacuuugggaagccaaggugggcagaucacaaggucagggguucgagaccagccuggccaacauggugaaaccccaucucuacuaaaaauacaaaaauuagcugggugugguggcccgcggcuguagucucaauuacucaggaggcugaggcaggagaaucgcuugaaccggagagguggagguugcagugagccgagaucacaccacugcacucaagccugggcaacagagcaagacucugucucaaaaaaaaagaaagaaaaacaucauaucuguggagugugauaaagugaagcacaauaaaacaaagucaccuguaucauguacauugccgcuugcauauauaguuaaucuuuucucuuuuuauuuuucccaguaaugccaucgguccccugguagccuuguggcugauuuacaaacaaggcgggguaacgcaagaagcagcuacacccgucuggcugcuguuuuauggaggaguuggaaucugcacaggccucugggucugggggagaagagugauccagaccauggggaaggaccucacucccaucacgccguccagguaagccugggcugguggacgagcagggcaggucuugucauccgaggccuggguagagcuucccggcugugucugaacggccugcucagcacuggcaguuggcagcgggucacagggaggaggagacagugggcaagaauggccccaccuagcaugccaccuauccuugcccucccuuacugugcccggcccccagccacagcgucccugagaugaggagugggaagggcagacaagcagggguaguggagcagagcaggcagggaagagaggagaagcucacccucagccagcacgggggccaaaggcaggugggcagggagggcacagacuuaaacaggccccugggcuggccuuuccugaaaguucucuggccaccccagcucucagcaaccacccugcugggguuacuuuccucuugcucugccagacagggaggcgcccccugccauugugggugagcucuggaggcuuuaaauguggucucucaaccgcauagccuucagcugcaucagggguuaaaggaacuuccagaacuuucagaauaugaccaaaauuuggagccaccugugguaggaaaucucugucuuuuuaaaacaugugggaaguuuccuuuuccuacaggcucugggaguuucaggaagugauccaaaggcagcugggguggggaggaccggaacccagguuucaucacgcagcucugccccgcaucugcagagaaagcuaaaauagcuccagugagccuccuauauacacacagacuuaaaauuucuaguuuuaaguucucacuugaaauucauuucaauaaaagauaguuuagaagauugauuugaagaaaaauucguaauccgagaaaaauacacucuuuuguaauuagugcacauuuuuaaaaugagagcauaguuuuuccuuugcguuuuagaaaugacugauuuacuaucuuauugcacagcaggaaugucuggcccaguuacugcaguguguggucuuugaaaacguaucagaaggccaggcugcugagggcccaugcacaggaaaaugcagccuuggugggaauugcuguuguugagcagcggccucuuguucuguuaaaauugaucuugcccagucagcagucggcagucaccccagagaauguucuggugagccucuagcacccacggggugucagggaggcugauacagagggcaccugugacgugucucaugcuccccccacagcggcuucacgaucgagcuggccucagccuucacaguggugaucgccuccaacaucgggcuuccagucagcaccacgcacuguaagguaggccccugcuagccgggagcccuuccccaggccgcugggacagguccagggccaccggagcgcaugcaagggaagcuguagggcucuguagaugguugugcaaaaugcagcuccagguucuccaggucuccgggaccuuguauuccuccaucuguucccuccaccguccuccucucggcaggacgacacuaucucucguucagaccuggcuuuuccaaggcagaaugccagggcuggccugccugggacuggccugcuauccucccacuguuuccacaguggaguuugauuggcauccugugugcgcugggcauaccugugggcucacuugggagccugccacuugguccagccaaugaggggacuggggguugacaguguuagaaauuaacacaaaucaucucuggaauuguaggacacaguuguuucugguuuuguuccuuauaugauguucaaagugacuauauugccauaaauuccccacgagggguaauugcugauacugaccacugcggagugcucugaaaccugcagcuggacaagagagggcuccuggucaugguguggaaaguuggagcugcagggaggagcccugaagaccagugaagaggaaauggguuccgggaguuucagggagugauccacagguggccaggguggggaggaccagaacccagguggggaggaccagagccccggucucaucacccaacucugcccaguaucugcagauacuucuaaaauagcucaggugagccucuguauacagacaaacucaccagucucaacaaagcgaaagucacuuugagauuuuuccuagguucauucauuuguauuauucaagaaaaacuaauugguguuugcugcuugggagcagagcucucagcaccaggaggaauauaugagcccucaaaacagacacagccacccacguuucuauuuacucacaauuuuaagauuccagccaguauguuuaaaagacaacgccaagcaaaggcaaguggcuucaugcuucaaacacccaggucagguggcccucacaagaguaucuggaguggcccagcagcguguuucaaagcuggggcuccacgcaugaagaaucagccucaguggaaagaguuuguuuuuuccuuuuuugcuaccauauacagaaauacuucaauuuccacaaaguuucuguauacaaauccccccacuuacugaucaucaggagagugcuggguaccgugcucaacaccacacgcauggcacaccguucccucuccacagcaagccugugggggcggaacugucacucccaguccacaggugaggagacuggguucccucagaguugagccgcuucccacaugcacacagccacaugugauagauccaggauucagaucuucaccucaggccacacaccuucucguucagguccccaucagcaccauuguggugcccgaccauggccaaggugccuggggcaagcacuccacugguggucuccccaagaagcuuccccagcuucauagaugaggaaacugaggcagaggaaaguuaaguaacgugcccgagauuacacagccagggagcagcccagcugaggcucccacauggacggcauggccagcguccuccuccccggcuccgccuggcaagcauggggaaggaaggcaggaagaggugcaggugugcccgccacccauucauugugaguuuccuaauguggguuauuuaaaacuuaccagagaagcacauauucacugaaauauuucaaacaauacaagacuauaaggaaugaaaagugacaucuucucuggacuccacaucacuuccauucacugugguguguggagcguggaggagacgcgugucacuaaauacauucuuuuccaaggacacgggcuuaugacuuuucuauaggcaucaguugucuuuuggaaugcuuuuaaacagauguaaugccaucuuuuuaaugauuaaccuacacuaaagcaagacugcugaaggcagacucuucuacaccaguugaaauagcuuuuuuuuguuuuguuuuguuuuguuuuguuuuguuuuugagauggagucucacucucauccaggcuggagugcgguggcauggucccagcucaccgcagccucugccuccugaguucaagcaguucuccugccucagccuccggguagcugagauuacaggcaugcaccaccacacccagcuaauuuuuguauuuuuaguagagacauggcuucaccauguuggcaaggcuggucucgaacuccugaccucaggugaucugccugccucagccucccaaagugcugggauuacaggcgugagccaccgugccuggccugaaagagcuuuugaaaaaacagcacagguuugguucuuccagguuggugcuacuuagcuaacuguaugagcagucuaauccguuuguauguauacuguauacaguguuggaauggacaguacugauuuugcuaauaacacuaaacucuagaauacaguuuauaggaauagaugaaaaguauaaaaugcuuauuuaaaaagccaaacucuugaauuaucuauaugcaugauuuccccaauacuguauugauauauauacuauaaugaugugugacuaagagauuuacauccaguuuguacaggaccuuagugaauagauguauauguuaucauuauccuaaaauaccuguacaaaguacaugauaagguuuuuuuuuugagauggagucucgcucugucacccaggcuggagugcaguggcgccaucuccacucacugcaagcuccgccuccuggguucaugccauucuccugccucagcuuccugaguagcugggacuacaggugcccaccaccagcuacuuuuuuauauuuuuaguagagacgggguuucaccguguuagccaggauggucucgaucuccugaccucgugauccgcccgccucagccucccaaagugcugggauuacagacaugagccaccgugcccagccaguuuuguuuccuuugagcuggugaugaguaguauuaggauagcuucuuggcacuuaaagcaggucucccugaaugggacugcagcagggugccaucuauaaaauugacaagacaggucacaacuuggauuugaguaaguuuguccgauaucauugaucguggacuucuggacaaagccuagagcuauucccugugagcacuaaggacagagucucagcucucaggaacuugccguguaguuggagagcagauggcucucaucagaguccaaauaauagaagugcugagaagagcucacaguugucauuaccccauaacacuuauucucucauaucacauauuuccccugcacacaacaguccccaaauggcaaacgugggaugaacuaugagagcugugggauggcgugaagaauggggcccucuguaagugagacugugaaucuggaaacauugaaaggguauugauguccacauagagucauaguugaauugcaucaguuuucaggauaauuauccuguguuugauuuuuaaguuucaugcuuagagccaucuaauagaaaguagggagaaguuggggacuuggcaggaaauaagauggaaacuauuguuuaaaaugagguuuuuaauguaucuagguagauguuauugauuuaugcuuccuucuaaguguacauggcuaagugcauagauuuguuuuguuuuguuuuguuugagacagagucuugcuuuguggcccaggcuggagugcaguggcuugaucuuggcucacugcgaccuccgccuccuggguucaagcaguuuuccugccucagccuccugaguagcugagauuacaggcaugcaccaccaugguuggcuaauuuuuguauuuuuaguagaaaugggguuucuccauguuagccaggcuggucuugaacuccugaccucaaguggucugccugccucggccucccaaagugcuggaauuacaggcaugagccagugcgcccggccuaagugcauaguuucaauuuugucguagccuauuucaaaacauuuaugaaaccauacuauauuaugugauauaugaacugaagguauaacuugggaaaaaacaauuaggaaaguccuguuaucacauuuuauuccagaaggcauauauaaggcagucuguuugaugaguuacacccucuguauguauucugguuuuauauauuuuguauuucauaucagaggacucaguuuaucagauauuuuccuggaauaauaccuuugaguagggucaaaagccuuaauuggccagguacgguggcucaugccuauaauccuagcuacucgggaggcugaggccggagaaucgcuugaacccgggaggcggagguuguggugaguggagauugcaccauugcacuucagccugggcaacaagagcaaaacuauccccccccgcaccccccaaaaaaagccuuaauugaagacacagaaaccgguuuugaaaauaaaagaauccucagauguuauguuucagcaauucguucaucauucuucccuucugugacccuuaaucacguuuggucuuuagcccuagcagauaacacacagugccacuacugagcacaguugcucaugugugugcucuuuaauaggaauuuggaagucauauucugcagaauguuuuaauuccauacuggguggauugagauuauuccuguuuguggaucacccacauugucaguccucacugaugacauagaugaugauucaaccaccauuucaauuuggaacagcauacagggaacacuacugauuucaaauguaggauuauaauuucuaauuuaauuucuaauucuuguucucuggucccccuucuucucaacaauuuuuugcuauaaguaccugaugauggccuuaaacuggaaacacacucgauuuauuaaaagggaaguuagaacacagcaaaaaaauaacauuuuacauucacggaagacaugaucaguagcaaagacauaguacucuggaucuuuuaugaaucaaauaacauguaacuaaauacauaaaauuguuaagaacucagaaauuacugucuuagcguaugauaaaugaaguauagaaaaaguaugugggaauaugaagaauuugaacguuuauuuagaacagcauaauuaauaaauauguacaaguuuuuacgcuacugaucauaugccuuccugucaagcaucgugaaacauuuauaaaaauccuaaaaucagaagaccaugauaaaaaucucuauaaaauuuuaaaaacagaccugacaugguggcucacaccuguaaucccagcacuuugggaggcagagguaggaggaucgcuugagcccagaaguuugaaaccagccuggggcaacauagugagacccugucucuauuuuauaaaaguuaaaauuuaaauuaaaaaaaaaaaaaguuuaaagauaaguugugcuaaccaugaucucuaauuacaauaaaauuaaacuagaaauuaauuauauauugaaauaagaauguaucccaauggagacuuuuuaaugcuuuuuuaagguaacaauugaauuaaggaguuuagaaaaauacaaggauagcuuucuuggaaaauaauaaaaaccaaaugugugugucuguggguggauacaaacagcaaaaccuguggcaaccaaguuaugcuaagaugaaaauucauaucuuuaaaugguuuaauugaucaaagggaaaauaaaauaaccaaguauuaaaauuaggauuuuguaaaaaguccaggacaguaagaauugaggaaacagguuguaagaaauauagaagcaaaauuaauuuaaaacaaaauaagaaggggagaggaaaguggcuacuaacaaaaugucagaucacaucaaggaaaagagggaggggaaggaggaagacauuguaacaacagagaagagaacuguuuccauuauuaaauaagccacacagcuauaugcuaagaauuugaaaacccaugugaauuauuuucugcaacaauauacgugacaaagaaauauuggccuaagaaguagaaaaaaguggaaaaucugacccagaacaauaggaugaaauuaagggaguucuccaaaaauaauuguucccaccuaaaaaagcaaaaaggggcuagggguggggcgggugaggauacugcugacuagaggaauucauuagaaucuuuuccauuuaaacaaaaaaaaacccagcucucacacgaucucaacuuucccacaauguaggaagaaaaacaaaacuaaaaaaccucucccauuugugcuauggcguacacugaauaacccuaauaccaaaccuaauuuaaaauaucacaaacaaugaaaucuguuuaccgaugaauauugauuguaaaaacuuuaagcaagaugcugaaaaaugacaucaacaauauuuggcugggcaugguggcucgugccuguaaucccagcacuuugggaggcugaggugggcagaucaucugaggucaggaguucgagaccagccuggccaacauggcaaaaccccgucucuacuaaaaauauaaaaauuaggcaagugugguggugggugccuguaaucccagcuacuagggaggcugaggcaggagaaucgcuugaacccaggagguggagguugcagugagcugagauugugccacugcacuccagccugggcgacagagcaagacucuaucucaaaacaaaacaauacuauacaagaaccuuucagcaggaccaaauugaucaagauuaccagaaagugggcucccuucgugacagggcaggacugcaucacccaccaccagcaggcugugcagggcaagguccucgcaggggcucaaguuggguauauaggcagcuucaguauaauaugccuuagcaauccacuuaaaaaaaaaaagaucucuguugagauauaagccaaaaagacauuugaugauauucaguauuucuuuuuuuuugagacggaguuucacucguuacccaggcuggagugccauaauggcaugaucucagcucaccacaaccuccaccucccggguucaagcaauucuccugccucagccucccgaguagcugggauuacaggugugcagcaccacacccagcuaauuuuguauuuuuaguagagacgggguuucuccauguuggucaggcuggucucgaacuccugaccucaggugaucugcccgccucggccucccaaagugcugggauuacaggcaugagccaccgcacccggccgauauucaguauuucuaaaacacuacuagaguucguaagagugaccaaguccaagguaaaaauagaaaaauccagcacuuguucaucagcaauagccaauuagaaaauguaacgggagggaaaaaaacugccaccauaauugcagcaaaaauaaaaguuaucucagaauaauccuaauaagcacugugagugucaucaggcacaugguguguucuuauagucccagcuacucaggaggcugaagguacgaggacagccugaacccaggaguucaagaccagucuaggcaacauaguaagaccccaucucuaaacaacuaaauaaauaauuuuuuaaaaaagaaaugugagugauauauauggaagaggcacaaaacugcucagagguauaaaaagauaaucugaauaugagacguaaugugcuauuggaugggaaaaccagauguuguaaugaagucacuucucccuaaauacaaccugaacaggauuuuacuuggaauuuuacaaaacgagacuaaagaauacauuuuggugaaauaaauuaucagcaauauaaaaugaucuaacaagaaaacugaaaggaggaacuagccuuaccugacguauaaugucauauaaggaaacaaaagucaagaguagguccugggaggaggggcuagaacuggguguuaguguuuuauggggcaguuuccccgugggaugaugaaaaaguucuggagacagauuguggugaugguuugcaaaacaaugugauuguacuuaaugccucuaaaugguaugcugaaaaauuacuaaaacuguaaguuuuauguuauguauaucuuaccacaauaauuuuuaaaaguagauaccuggauaagaacagaguagauagcaauggauggaaccuguucuauaugagcauguauuuugaaaaagggaaaauuuaaccaguaaguguuugaaagguugaauagcugacugucagucuagaaaaacaaaauuagaccacucucaaaauacaugaacauaaaucugauggcuuaaauaauauuuuaaaaauauucuuaaauuuagaguaaaauggaauuuuauuuuagaaaaauaaaauggaauuaaauauuuaucaaauauucaagccaaggauaaaucacagaagaaaauuauagcauauuuuauugcaugaaguuagaaacuugaaagugaaacaaagcaaaauacuaccuuaagaaaauguguauucgauaucacagaguuaauauuauucagugaagacuacacauaaauaaauaaggaacacauuagauuuuaguauguaaauggacaaaauacaugaagagacaauuuuuuuuuuuuuuugagacggaguuuuacucugucacccaggcuggagugcaguggugccaucucggcucacugcaaccuccaccuccccaguucaagcgauucuccugccucagccacccaaguagcugggacuacaggugugcaccaccacgccuagcuaauuuuuuguauuuuuaguagagaugggguuucacccuguuagccagcauggucuugaucuccugaccuuguauccgcccgccuuggccucccaaagugcugggauuacaagcaugagccacugcaccuggccgacaauuuguauaugugaaagcuagagagagugaaauucaguaaauauauuuuuuaaaguucagccuuaauuguaauuaaagauacgcaaauuaaaacagcaacagugcaucuuuuugucgguuaauuagccaaaaaaagagcaacuuacaugauaucaugugcugauauucacagauuauggaugacacuacauuaacagcuauuuauaaaacuauuugucauuauguauuaagguccuaaaacacguugggagaggaaagagcucuuccuugaaguagaacuccaugugagaaauugcaauggacuuugguaaaucaccauuuuauuuuauuuauuuuuuauuuuauuuuuuuuugagacugagucucauucuguuguccaggcuggagugcaguaucgcgaucuuggcucacugcaaccuccaccucccagguucaagugaguagcugggauuccagguaugcaccaccacaccuggcuaauuuuuuuuauuuuuaguagagacaggguuucaccauguuggucaggcuggucucgaacuccugaccucaggugauccacccgccucggccuccugaagugcugagauuacaggcgugagccaccaugcccggccugguaaaucaccauuuuauagccaucgucauaaacauuggauugugaaaucuuuagcagaaggggaaagugagguuugauaagaugcaggauauuuuaaucauauuaaaaagucucuucacagauuguggcaaaugucaaaaaauagugaauuggguaaagagaaaacaggaguucuugcagcuuuucucuaaguuuugaauuauuucaagauacauuuuaaauguucccuguuaacuacagucgauuucagggaauuuuuuuuuuuuuuuuuuuuuuugagacagagucucucucugucgcccagguuggagugcaguggcaugaucuccgcucacugcaagcucaaugcaagcuccgccucccagguucacgccauucucccgccucagccucccaaguagcugggacuacaggcgccugccaccacgccuggcuaauuuuugguauucuuaguagagacgggguuucaccguguuagccaggauggucuccaucuccugaccucgugauccgcccaccucagccucccaaagugcugggauuacaggcggaagccaccgcgcacggccgggaauauuauuuuuaaagccaaaauccaaccugggcacaguggcucacgccuguaaucccagcacuuugggaggcugaggcgggccgaucacuugaggccaggaguuugagaccagccugaccaacauggcgaaaccccaucucuacuaaaaaauaugaaaauuagcuggaugugguggugcuugccuguaaucccaccuacucaggaggcugagacaggagaaucgcuugaaccugggagacauagcuugcagugagcugagauugcaccacuguacuccagcacuuugggaggccaaggagggagggucacuugaggugaggaguuccacaucagcguggccaacauggugaaaccccgucucuacuaaaaauaugaaaauuagccaagggugauggcaugcgccuguaaucucagcugcucaggaggcugaggcaggagaauugcuugaaccugggagauggagguugcaguaagcugagaucacaccacugcacuccagccugggugaagagugagacugucucaaaacaacuauauaaaacaacuauauaaagagcuauaugcugaagagaagaauccccaaacaauucuaccuaaaaucuaagcuauuuuaaaagcuuuaacaaauguaggggacuggguaauguuguacuagagcuuguuucugagauuagcccauguacauugguagaguguagccuuuguggcucaccuguuuuuacuuugcaaugucugcucccacaggugggcucggugguggccgugggcuggauccgcucccgcaaggcuguggacuggcgccucuuucggaacaucuucguggccugguucgugaccgucccuguggcugggcuguucagcgcugcugucauggcucuucucauguaugggauccuuccauaugugugauuugucuucuuccagcugcaaacagcuaaagggauggucugguguuggcgugugggagacaugugugcucgugccgcacauacacauccuggccgugcacggcucucucaugaccagcucucugccucccuuccaggaggcuccaucccacacuguucacccaggcugcggagacucaccuucccgagcuaacuuaacuacuguacauaauaauauguauuaaacugguaucguggugauauaauguggugcaguuacuuauauauuaaauaucuauuguauccauagaauaggcagcauuauuucaaacauauucaaguugggaguggagaucauugccuagaagucaauauucaauaaaucuuguacauaacuauuucgauggcaaauguuaagccuucuaaaaggaaaguguagauuggaaaaugauuuuuuuuccaaaugauguuuuugccuucuaauauacuguaagguaaugagcuucagaacaggcaaccugacccugcagaggucgcgugcugugggaugacagcgggacgggagcucacaagugcuuucacugaagauuuguucauauacuguguauugauuguuguguaauauaucaucauugcuuuuguaaauacguaaaacuguaauuuuuuaauggugugcuucccuuauacuuuuuugaucagagaauuuuggaaaguaccaaagaagcaggggaaucauuggccaguguuacguuuucacauugucugucucccacccucacugaucacgccugccccagagcaguguguggcggugacaccgucacccagcaugcgccacgccguggcucccaccagcagugccaccgccaccacaccccagaucccacccaccuugcaguggccuuuccuugucaucagaguagagaaugcacagguguuggugagggcguguggcugagcacuacaugucaaguccagagucaguuucuaucccaauucucccugcagccugaagaacggauccuugucuccaaugucagcacaaaggaggcuuuuucugugcuuugacauucuagcacuucagggaugagagggagggagaauccuggaugcuggauggaguauuucucugaggcccacacaaagcuggacacccccaggcucuacuccaucccauuggagucucuucuuuuuuugauagcgggagggaggaaguacgacuaauguuggagccugaaacuauggaaaugcugcuaaaauuuuuauauugacaaacauuuucuugguacuucauugucauuuuucauuaaucaaccauauuaaauuuauaauaaaaaaugccccucagaa

SEQ ID NO: 191848 - RNA, 46814 nt, Homo sapiens
cacuguuuaauaaaaauuuauugacuuacaagugauuauuuaucaaaagaccauuaauagcagguacugaaaugauguguuacuggguggugcugggagacuaauaggaaaucaaugcagcuggccggccagaaugcauaugagaagcccaccccccggcagccagcgcaaucacccccgcaacacacgccaggugccaccccuggcgcaaugaaaaguucccccuuuuuauuuaucguuuacaaaugaaaugaucaauacuuuuaaucuagagcaaaauuuauuaacuuucccaucggagagagacauauugacugggggagagaguggggugugcgugcuguagaagauggauggcugcguggccauauccuaaccuguccgcgaggcagugcaccugcagcugcccuuccagccuacggaccgggccaccugggacaagugcaccuggagaagccgagucuggccacccgggaugcacagcaggcaggugggaccuaugacauggggggauccuucaugcaucaggggacacuagcaagcaauagcccagaaaaucaaguuccuggccaauuccaggaaggaaauggcaggauucagagacccagauuuccacaggacaacaggguuagugcccacuguuugcugugccgugaaggucacacgauggcacccaaaaaugccugucacuggucugggaagggcauuucagggaucuggagcacucccccugaccccucacacaucaagccucuucucugaaaggcagcaccagggacggauucugacacggugaagcaucaagucccaaggcugguucugcugucaagggaaucccacuagcuuuauuaaaaaguucccucuuggcugggcgcaguggcucacgccuguaaucccagaacuuugggaggccaaggagaguggaucaccugaggucaggaguuggagaccagccugaccaacauggugaaacccagucucuacuaaauacaaaaaauuagcugggugugguggugcaugccuguaaucucagcuacuuggaggcugaggcagaagaaucacuugaacccgggagguagagguugcaguggagcugagauugugccauugcacuccagcaugggcaacaagagugaaacuccguguuuaaaaaaaaaaaaaaaguucccuaacugguggguggaaagucucauguuugaguaaaaaaggcugucugagaaccacaaugaagauacugcccagccugagagcaguauggccccagccccauggcugccuaaagcccuugaggucacccucaaguggguuaguuccacuagcccugauguuuuagagaagcaauggauucaaagcugacuucccguauuuccaaacccagaagacuucagagaucaaagccaaaguuugaacuaugggcuuaaaaacagagaauucagagguggacgaggucucugaggucaucuagccaagucccuaguuaugacucaggagacggaugcagagaagugaaggugcagcaggcuuggagggggguuagcagcugaccagcacuuuccacucauuacaccacugggugucauucccagcucagccccacccuugcugggguaacaggagggaacacauuauuuuguacuuugcauguuucuaagugucuugaguuuuugccccauaagaccaacucgguuaccccaaaccagauacucugacuaugggucacuuggggcuugcaggaccccuaauuuaaaaggauggagcagucgccuggaugaugguaaaaggcauacacggaaaggggagguuacguuucugcaggcgugaaucagugcucuccucacugcccggcccgcacaggacuucccuccacagcacugacuccacgugacuucacaccaggugcggccacaccugccggcaggggccgcagacagcugugcugaaugugagacaaaagcaaaaccuguguguguguguauauauaaauaccuaugcaaaucacgaaaguaacaaaccauaaaguuucagaugaacuuuuuaaaagagaaccugaucuuuuaagaccaauuacugaucccuccaguugguuuacaaacacuguaaacaucaccuauaaaagcugaaaaucacuuuuuauucuuaagcauuuuguaaaacaguuccuaagagacuuauuagucauaacacugacuuuauuuuuucagucuucauuugagagcaaaaagauuucccccgggcuggcaacagggcaggugaggaaaugggaggcucucccagggaggucacagguaggugcagagaaaaggagauugcagggccaacccagcagguaccacaugcaaaguggaucugucugcagccccaggagcacagcuucacucccacccacucccugaacugcaggccagagggcgaccuuggggacgugacacucagcaccacaggcacaaaauccugagaggcaucaugacugugccacgagggagcaugggucccaagugagggcugguggggcaugaauggggagcugaggagcaugaaacuggugaaaccccagaacccacaggggcugcuuggccuuggcucugccuccacugugacuguacagcaggcaccaguggccgacucuuuuccuguggugccugcucuggcugugcagaagcugccaugcagcacaugcccugcccacccugccccucugcagcccuccccugucccuccccugcagaagccaccaugcagcacaggcccugccccgccccggccccucugcagcccuccccgggcccuugcuccucccccacccuggaguuuacucauugcuuccccuaggccucacaucagcgacccgcacacaccccgucucuggagaaauccacgucugugcuggaaauucuaaauuaaccaaagaucugcaagcaucugagacgagcuguucaccuucugagcugcaggguuccucgcuccagcagucaguuggcuucuccgcagccccagggccaugcucccagaagagaacgggaauccucacgagaagccugcuacucagggccacagccaggggagaaaguaaagggagaagucccccaguucauucaccagccaguuuuauuuacucacaagaacaaauccaaagcccagugcagcagcucugagcucaggccugccgugccccguuuugugggccuguacuugaaacacugaacgugauguguccuucacucacccgcagcacuuuaauccccacaacagcccugugagguaggaaucaccaccauuccccccgacucauauuacagauggggaaaccgagacacacauucaacaaagcgcgcaucacauggggaguucaggguuagccuggaguacgaacacacguucuccccauggcccagucagcggcccaccuggccucuuccccucccuuuaguaaccccaucagcagcagcauaaaaaucuaacccuucauuuugcugaaagccccugcagaugacaguuuccuuccuaucaugucugcagagcuccaaggcugggggcgauguugaggccgaagccagccacagugccucagcugugccuuuccuggagagcggguggccgcccccagcacaucccuggcacacgggcuugcauaacagacucuuguaccgccaucucuagcacaagaccauggccacaucuccccaaccacucagcccgcacagcgugcaaagguggggaguucacuuuaauggcauuccuccaacgacuuauuguaaaagaaacaaggcaucucguccugggucgcaacacccagcagcauccguuuagaccaccaaggguaggcugcgccgggugcacagggaucccgcugcggcucggcgaaagccggaguccugggauccagagcagcccggggagcccuggagucuggaaaggacacagcagugggggcggcggcggcaacuccagcucugagcccguuggcaccccgcacgguggccccagccagcuggaggcaggcucaggagcggcuccuguccuugugguuccccacgaucaucuugcuguacagcuucugcugcuccuccuugaacguguccuucaccuucucccucuucaggcccccaucccuggagagacaaaggcuggauguaguaacagccaagagggcucccagccacgcucacaccaugggagaugcaccaugcugcccaaacaccaagaaaaaccugccagaaacaggguaccccguggcacucucaccaagacaaccucaggggauuuggggcuccgggaucccaauauccacccuuucuaucucaaaaggucuacccuugcccuugggugagaauuuacuacucacauucaagguacuugauaacugcuuaaaccuaccaaggaguuuacaauucuuucuacucuaacauucaucuucaccucacaaaggaaaaggaggaauucuggcauuauggaagguagacaugcuuuaagaaauaucgacucauaacguaucuguaaaaucuaucuguaaaaugucauuuguuuaauucagacccagggauacucugaacucaugcagagagcuaacacaagggguaacgcguguucugacuucuuccaugcucaaaaaaagagugccgucaggaauggagguuuaccuccggggcugccucucagaguuccagccucacugcccccgugccucccugcagcagccccaaaccaacccaccagacuugggauuguuucauuacagucccauugccucuugccugcuggcccccuccgugccuacacucuagaauuaucaccaccuucaacaacuuauaaaaauccaagcccgcuuucagucucuccgcuacacccuuuaaaauccauagcaaaggcauagauuuuaaaagcagccacucugucuuuguuaaacuucagagaugggaacauggggcagaaguuaaaccuucaagcucuaaaagucugugagauguggguucaaaaucuagcuccagugcuaauguuaugacuuuggaaaaaagugauuugagucucaguuucucaucugcaaaaugggaacacuguuuacagcgcugcggcuacugugagggcgaaagagacgaucacacagggccccagcagcucagugacuggcacacagugagugcacaauccacacuagcauuuuuuaaaaggccaucaucugagagccaaucuauucccugagacucuacaguuggguuuacaaugugaauuucuacccuuucuuuucucauagauaaugcccaucuaagucaaaugcucuccccaguugacccuuggcucuuaaaccuaaaugccccacagaguggaaaacuuucucugaaccagcauugaccccugucagucuccuacuguuugggauaaaacuaccucauacucuaguauaagggcuggucaaaugcagcccacgggccacauccagcugauaccuguuuuuguaaauaaaguuuuauuggaacacagccaugcucauugguuuauagacugucuguuuucacacuacaauggcagagaucaucaguagcugcaacagacaccauauggccugcaaauccuaaaauauuuacugacuacagaaaaaguaugucaauccugcucuauuagguaacaagcugaauacaccaaacacaaccuuuaccuuucuaagaaugguucaauuuugccagauacacugggaccugggaaaguccuccuuccuucuugaaguuuucagaucaguagcaggucaugcccacccagagaugggcacuguccagguguccuggaagacugguucaaaccccagaaagguacacagaaucaacugccucaguccaggcaucccugauccagguuccccaaggucaaggaagcacagggcacuucuggguuggaauucggggagagucaaacugcucucucuagagcugacaaguuuaauucuccacaccacggggaaugacauguaagugaagucaaugacacagcaucugcugcagaaacucagcugaaaaggccuggcucuaaacuuaccacagcagguccacaaguccucccugccuggcaauggcagauuucacccuauucgcaaacuggacagcaucuucaucugccuguaagaaagaacaaaugagaccacucagccccggcuugacguuacacagagcaggcgcagaccugccuggggcaggcacucaccucucuagucaugggaggcagguaccacacgcugcagacaauggcccagcuggucaucauucgcagcagguacgucaccaucccguauuugcugcuguuccagaaggcaucgccaaauugagggucauacugaaaacaauggaaagcuggagguaagacaugaguaguucucacaacguuugcgaguccacagugacugcugugagugacuccacugggccgugcugguacuggggugcugcucccugaccuugcaugaguacuguggaagccccucuccauguggccgguucugacugugagcaacacugaucucccccgaggaacccggccucugcuacagaucaguaaggaaggcuccccugacagccugccucaagcaaaugucuucccuccuugauuaguuucaggucuuacucauagguauauaaaguuuucaaacaucuccaaaaccagggagaaaaggaucaugcacucccauguacccauucccugauucaaccaccgccaacguuucccacuugcuccaccuguccccucucagcauccugucauucaucuaguguaccucccccaaauaaagauauuuucuuacacaaacaccaacuuuuaaauaugauuucuggugcccagaccagggaggaaacuauuagaaagcuucuacauuuacacuuccaacaaagucagucgucuguucaggaggcggcucugugcucacgcugacagccuugggaggucucaaccacacaggccugcaucuaccaugaagcagguaucagauccuuucauuauuucauuggcauuuugcagaaaauguagcugcagcugugacccacauucucaccaaacaaguagcuggaggggcaggugagcaggguagguaagcucuagaggaaguugcgcaaggagcaacaggaggaccugggugcuugagaaugccuggacaaagugccuggugcugccagcgaaugucugaagggauccuguacacaaggcaguaggcugaccuugugcaaacacccaggaccagaguggaaaaauaaaggagccagaauuucaagaguuaugccacacggccaugcugccaacaacaucaaaaaugcccuuucccugggaaagccugagaaggagcccagggcaggguccugcaugugggaugggcuaggguugaacucuaugaucuuauaggccuuuccagccuaaguuuuaugauccacaguauaaauacuggacaauuuugacaagacuguggcccuaacuacaaaaaugaagauaacuuaggcuuaauuauagaagcuaagaaaauuagauuuaacuacagaagacuuaauguguuauuauaauaccaacagaaacaagggaaaauaauaaguuuuuaaaacuaagcaauguguaugaucagaaaguauuuuuuuaauuuuaauuuuauauauaauaauauacauuuugagacaagagucucacacugucgcccaggcuggagugcuguggcgcuaucucggcucacugcaagcuccaccucccagguucacgccauucuccugccccagccucccgaguagcuggggcuguaggcaccugccacuacgcccggcuaauuuuuuuguauuuuuaguagagacgggguuucaccauauuggccaggcuugccucgaacuccuggccucaagugauccaccggccucagccucccaaagugcugggauuacaggcgugaaccacugcaucuggucaugucguuguauuuuauaaagccugauauggacagaaauucugaugucaccagagugugagaacccuuuguuucgggcugauucucuauuccacacugggcaguguguguggacagagaaaaaaggcagaagcucaacacagcgacacacuccucacaucaggucauggcuggauuccgguggaaauauaagaagagccuugaaaucgcuaagguuauccaaguuugauuaccaauaaagaguucacaaaaaccaguaaucuguagaccagauguucuuagccauacaugggcucuacucuguggacuaaauggaaauguaucuaaaauuuauaagcauuuuacuuuggagaggagcggaaacuccucaggguucguguucugacagcagcuaagagccacugcuucagaacuguggccgccacaguguggucccaacuggcaccaucaaugccacccagaacauguuagaauggaaaaucagaaggcccagcgggguggcucaggccuauaaucccagcacuuugagaggccaaggcaggcggaucacuugaguccaggaguucuagaucagucugagcaacgcggggaaacuccgucucuacaaaaauuaaaaaauuagccaggugugguggugugcaccuguaaucccagcuacuugggaggcugagacacaagaaucaccuaaaugugggaggucaagguugcaugagucaugauugugccacugcacuccagccugggugacagacugagacccugccucaaaagaaaaagaauaggaaguucagaaacccuggguguggggcccagcaaucugcauuuaaacaaucccugcaggcaaugcugaugcagccuaaguucaagagcugcuguucuggaggcagcaguaagggcuuccauccagcaucacggucacacugcaaagcaccuguccucguuuugccagaaugcaggaugcagaugccaguccccacucccacacccaaggcagacucugcuaacagacuauguuccucuuuccugcuguuuccagacacagcauccucaggcucuggugaguccuagccugucaaucagaguccccugcaggcaauauucaucugccaucccuggccugguccucugccuaaaugauaaacagugaguggcuggugagcaucggccucaccaggagcaacaccucuccaguggcacuggcaaggugaaaagaaagucagaaccaacucuacagaaugcucugcagacaacccaguccccuacaaaagaaauucuaagugugagccugacucauaucugcucaccauuuuaucgagcucucaggcugcagccuaaauacuuuaaccacacugaggauggccuguguuuuguaggugucaugaugugaggccugguggaugugaagaggguaagagcggggaggaacaaugugcagaugacuagcuaaucacauccuauagcucugggugucugaaggguuagaggagcaguuccuaaagggucgacguagacuagauaaacucccaggguccaucucauuguuaggagcuguuguaggucuaaaagaugacacaacuaaaagcagugaagcuguuucucccacugggcuggaguaaugaccccccccccaauccucauggcucccccaaaaugcaaaaauccagcuuaaaaccacaccacugugcccugcaaucagccagcuuuccauguggaggggccuacauuccagcuagguuuaugaagcaagguaauaagugaagggcuugccauuucccgaaugguggcggcagcagcaugcaggcgggaaucuggcugucccccauuccacacuccccaggcccuucuaaggggugcugagcacucaccauccuccuccggcagcacuugacccacgucaacccagccccacgccacucugcugagggcaucgaccacagacuggugaccccagcuccuuccucuaccuccuccugcugcaccccacucacagcagcuccaguaaugacaguguguaccaucggaggucuuauaccuugauagcaacaggguaaacuguggcuccaauuucaaaacuucccuuuuugaacaucaucaccgauguauuauugaugcagguuccuaaaaugcaggagacaauaaaaugcuauuucuguuggcccuuuaccccagauauuaggcguuucuuaaagacuaaguauaauagucaaaauucuucuaaugguuccuccaguaagauacaucugucaucucccuaacuuaaaaacaaacacuuaacagagacaggcaagauggugccuccgauucucuuucuacaggaccacuuucccugauucauacacacagccuagauaaagcagagacgcgcaguggccuuaggaggacaccaugagcucugugaggagcugaaacauuacagaagaaauuccugcauuuggggaguucacacuauggcauucuuaguucaaauucugaacuuaccugaguuuuuaguccuacuuccaaccuaaaggggaccuaacauuauucagugaaaacagauaaccccaacaagggcugagggccuugguucccaggaaacaucagcaucacacuccugcacuccccacagaagcccuucguggcaaccaaccccuucuuaccuucugggaagaugaggauaggcagcuugcuuuuaucuugcacauguucagucagucuuucaaagaagaaaauaaaauaaagggucagacaaccuuauacacaucgucaaaauauguuuauaaauaaccuauuuauuugugacacuaguuucgauuauaaaaaguuaacaagcauaacuguauccuuuuaaacccauaaucuaaugcucaucaagaaaaaauguauauggauagagaaaaaucagguuaccauuuaauucacagaacuguucaauucugugcgaacaucggagcaccaaugaugccacucaaccugggggccaccugaaagagacaccugccacaaggccugggcauggcccccucaauaaaccugugucacuagacuauguaacaguugugaggcugggcccagcccugcuggcucgaugcucugucccugagauguagcaaagggaguuaggggagaguucaucugucucuauggaagauaaucucaacugucuuuucuuauguguuauuuuuugagacagggucucccuguguugcccaggcuggaaugcgguggugcaaucauagcucacugaagucucacccucccuggcucaagcgauccucccacgucagccucccaaguagcugggacuacagaagcguaccaccacgcucagcuaauuuuuaaauuuuuuguagagaugggggucuuccuauguugcccaggcuggucucgaacucccgggcucucaaagcacugggauuacaggccugagccaccauguguggcuuggucucaacugucuugaugucucugucugcugcaaaucucuuugcauuacuuacagcagauucaccuucuuaaaguuugaaaacagggcaguacuuuguuccacugccuuagguuucuuuuuauuugugauaaaugaauucauuuugagguuucaaauagcaguaaaaauucguauuuuguuuauuaugauggguacaaugaauuaaaaaaagguuaagaaacauuauuaacuugguaaauaauacuaggguuucuauacuuuuuuuuuuaagacagagucucauucuaucgcccaggcuggaaugcaauggcgcgaucucagcucacugcaaccucugucacccugguucaaacuauucuccugccucagucucccuaguagcugggauuacagaugcccgucaauaauuuuugcauuuuuaguauuuuguauuuucaccauguuggucaggcuagucucaaacuccugaccucaagugauccgcccaccucggccucccaaacugcugggauuacaggcaugagccaccacacccggccacuuuuaaaauuucauguuuuaggaaaaaauuauuaugaaagcaguauaggcuuaugauagaaggcacguaacugcacuguggagggauaacuacccugaaaccuuuucagcauucuaacuggccaagcagaacagcaguguucuguccauuaccucuuagccaccagguggcgauccuucacuuccgagcgcucaaaccagacgugugggcaggccuucaccauggcucucugaaucacacccaugagucccccgugcacuugacccaccuaagcgcaggcacaggacucauuaguagugaagccaucuucacacgaaucuccccacucuaggaagaaccacaucucacaaaauaagcaguccaacuucucacuucuaacgcuugccggcugaagguugcucacugccaagaaaccacuaccaagacuccccaaaucuuaaacuucuccuuuuaaucaguaauacuagaaauagguaauuaaaaacauaacugaaaccccuaagacaaaauacuaaaauacuaaaguagcgcaauucccuguguaaaacugccccucccugggcagauucucagaugcccuggacacaguccuugccagcaacucccucugccccugcuggucugccugacugcccuuggcauccucuccagccacacucaccaaucacucugcccaggguaucuccuaucacagucccacagagcccccacagugacaguaaggugggggccuggcccacgcauaaauguguuuaugugaaggguccaggagccuccuagcccugaccacucuaaagcaggaagucuugccucaagaacgcaccggaaagagcucuuaccauggcauaauagccaucgcuggccaagaugaucacaucgaucggugagguaugauuggccacacagaugccaccauuucuuggucuguuuucccuggguuuaaaauguaugcaaagcaaccaaaauuagugugaaacaguucauguaacacaccucucaccucacaugcuucaucugcucuaacuaaaagcucagaagugucuucccauuuggcuaaguauaggugggugguguuuccugcagcgccaucucccuuccuaucaauacaaagcgcucucaccugucaugguaggugaugauggcugucagcgcucgcacgcagauccgguaacacauuaagugaacauguuuacucaugaacuccuuaaaccugcaauaacaggacaaggauucuggguuuuauuuuacauacaggaagacagaaagaguuacugacuucaacagcucagcaguccuuuauaacagcaaagugcuuguauagacaucagcaccuacaggaaaguccugugaugcaugagcaccuuuauguucacacaugaggagagaaagaggggacagggagacucacuuacauccacccaaaucaguggguggagaauucacagccuagaauccggcauccgcagaccacaggcgggcugaacuccguucccccagucaacauccagaggcagguccaaggccagaggccaaccuccucacccgcccaggcagaagaaagguuucuaaaccccagaacuucccaaagggagcaaaauauucuucacacaaacagacaaaaccucccuacauuucaaaccauuuuaaaaacuguauugucucaucacuuuauccacacagucaaaugcucaaaacuaaacaacaagcuguaaaaucuguuaacaucugagucucggacucuacaugucuguggcuccucccuuuugucuucaaaaugggaagaaugugagggcugaaggacaaaaagaacagucauagaucaaaauuuaaaaaaaguaaagacuuuacugcugaugccguuguugccauuggguuguuauuauuauuugagauggagucucgcucuguugccuaggcuggagugcaguggugugauguuggcucacugcaaccucugcccccuggauucaaggauucuccugccucagcuucccaaguagcugggauuacaggcacccgccaccgugccuggcuaacuuuuguauuuuuaguagagacagguuucgccaugcuggccaggcuggucucaaacuccugaccucaggugauccacccaccucagccucccaaagugcugggauuacaggcaugagccaccgugccuggccaccacuggguuauuuaauccaucuaagauuccauggcuuugguuguguccaaagaaguguccuugccuucgauaucugagcaccauucccagaacuaacuguccuucaggcauggacugccacacucuacucaccucccauuuggcaaguaucccaccacaguugugcccaccaccagaaggcuaaucccugugaaagccagugcuauccuguaagaagaagaaaaguuagagcacagccagcaaaucauucuaccaaguacagaacugaaggugugaaaaucaaagggggcaucacaaaaaccacccccaagaccugcucaccugggaccuggaccagaguucaccuagaaauguaagcaggccuaucagaaccagagauccuuuugauuccagcugacagugagccaugggucuggcucucagcugccugcaucuccugaggccucaggcagcuggaaggcuggaaaacccuaagcuggccauucugccacagggcugcucccugcugcccuccccuucccuuuggcuggaaaccccgguggaagcacagcuucccucugaagcaacaggagguggagcuugaagguauuagcaucuggcaaggcacacucagagcagcacauggugcagagaagcugaaagaucaauacugccccuguaccugagaggcaagcuucaggaaagaaugagccauguccaggaaggaguggcagaaagcacacaauguucccugucccuguguuugcugucaucuagagaagcaagcugucuuuaagaaauccaacuauuucugucugauaugcagagaauccaagggccucuaaaggagaaucaccaguguaucccuccaaagagucacguggccuggcuaacgacagucauucccuccuccuuucuaaaacgggaauacacagcagagcaggcaggugggcugugcaccacgugggguggcagcagcgagccccacucccgcaggcccugccucaccugagcggcagcagaaagcaguaccgaaucagcacuccuaacccccacaggaccgugagccgaaggcugauguacuggaaguuauaauugguucugcucagcagguuccaggacuccaguucuucugcugagaaucucuuugucaccucaucauccauaauggucuccauuccuuuccggcaaaaguagaaaaugucagagagcucgaacucuggaguguuguccagagccuuacuacuaccacuucgacgaaucucuuugaucucuucuucuagugaagugggauccuuugcaaugauuccugcaaaagaaugugucccugucaagcagcacgcugggggagagcacgugagacauacucagagcacacauccugcacuaaugcagggaagagcguguguggcaccagaagcacuggggaacacuguucaaauggaccucucaggacaaggaucacacccccaucuuaccguugguguagggcuuguaaagcuggugguucuucuccuuggcuccucgcuccauucucaagguagcccacugggaggggaaggaagcaagauacaagagcaagaaugagaccuguuuucaaucagugaacaccuccaucucuauucugugaaagccucagucccagucaccuaagaccguagccaagaagcacauagucuagaaggaaacucaaaccaccucuccccagagcagccccuuccuugacaacugggaccaagaguuaagucaccuauagcaaaacacugggaacuucaagaagcuggggcgaguuccucaggccuaguuccucacugccuacgucucucugucuccgggcuguagggagcucacuugcugacagcacagaccucacgauuccuccugcacugccgcacggcagcuacucaaaacagcgaagccagguauccuguaaacuacugccugccaccaaauuacuccaagaaagcagcaauuuucauuuuaaaggagacaaagagcuuaaguaauacauauguuuggacuguccaguaacaggaguaacauuuuaaugggagaaucccacaacuuaacacugaaaggccugggaguggcuuaauaguguuaaaggaaaaaaagaacacuauuaggagaccgaaaaaaaaaaacccagauucaauucccaaguuuacauucacuagcugcguucauuaagcaacccauuccaagucucugaaucuuggucucuuuaucugcaaaacaggauugauacuaccucaaacuccuacuucacgggaucgcuuaggauaaaaugaaaucauguaugggacaaaacuggggaaaugcaaagcacucuguccugauuauuaccgaaauaacacagauucuggaaaagaccuaggaaaaagacgcuuuuccuagaaucccucuucauuaaaacugguuucgcugguauaagacagccaggggcugguucucucccacuaucaaaugagaggugaaaacaugggugcacuuauccccccuuggauaugguaucacuagagagaaagcuaugucauguccacagugagucagagaaacagaacaggcauucaaaagccucaaccuucggcuuccacgguuaugcacagugggcacgagcccaucaucccauggcaugggaagaugcacguggcccagggcacauggugcggguucugcuggcaaagcccaaagggucagcaagacugcaccacgugguccagcaaagccgaaugcugcacgcgaguuuaaucagugaucugaccucaucuggaaaucucaaaccacacagucuagagaggaagguggcucacaaagucaccacgcaaagaaaguucaaaggcaagaaaacucacaugacccauuuucucuguuucagauauuuggccauugaugucuuuuggcucuaagcacagacgagcuuuccuuuaaaaauguuaauauaauaccuaaaauggaggaagguaaaucucaucugguuuccuggaacuagagaagaggugaaaaggggcaagagaguucacaacaauccuggcaugcagaaacacaggucacucaaccagaauuuaggguucuacauuuuggccaggcucuguuuuggcacugcaagaauaaucagaagagaaaaacuuggggccagacgcaguggggcucaugccuguaaucccagcacuuugggaggccaaggcagaaagaucguuugagcccaggaguuugagaccagccugggcaacauggcaaaaucccguaucuaaaaaauacaaaaaaauuagcuaggcauagugaugugugccuguagucccagcuacuccagaggcugagaugggagccaggggacguugaggcugcagugagcggagauugcaccacugcacuacagccugggagauacagcaagacccugucucaaaaaaaaaaaaaaaagagagagaaacuugauucuguacugacaauucugauacuccaugagacugcaauaggcagagaauauaugacauaaggccucucagaugacaauuucagucugaggauuguuucaaugugcaaaauucaagacgccugcaggcucugugaucaugggaaagggaucugcuaauugagauucuacaucuccuaguucuguggcaguucaguaauaaacaucccuuuggccuccugcuuuuuaauuucaggaacaugacaaaacacgucuguguuuaggaaaaaauugccccaagucacaagggcaggggaaaagaggagagggcugaacagccuguuaagaaauggcugaucagguggcugggugcaguggcucacaccuguaaucccagcacuaugggcaggaggaucauuuaagcccaggaguuugagaaauggcugaucaaugaacuggacucuuucugccugaaagaaaccaaaauauuucauccugaaauauacuucuuugacauauuucaagaggacuguucagaaggacuggaaaugcaagaauaacggagaaacugucuuuuguaggaggaauuugcaucuguagaggagacaacgugaaguaaacaacagaugcaaauagacuuucucugaagcaacucccuccuugucccaaucuagaaagaacugagagucagacgccuuuaaaggucugaaagaaacacuuagcaucuacacuuuugaagggcugcuaucugugagguuucaucuacacaagacuacccgugcuagccaagccaccucuucucucccucuuguuaccuacugccaccugauuuaccgccauagccuguuuuuuggccaugcucggagcccccacuguuucuguaaccucaaaugcuacaaaagcaucaaccaucuagcuauuucuuugagaucuuuguaaaacuccugugcacauuaauaaauuuguacgucuuuucuuuuauuaaucugcuuuugagaguugauuuuucagugaaucuucagagggcaaaggggaugcuuucccuuggccccuacaaacccuacuggaccaaaucaaaaugccucugggaaaacacugcuucucugcacuauacucacacagcacacuccugauaccagaugugugaggaaugcccccccaaacccaaaccaagcaaaucuucagcaggcaccagcuggguguccucuaauucaauucaauucaauucugaggcuauugaccuggaguugguaucagaucccacaaguuaagagucagucccacaugacugccccuacuucagauccaaguugaaagucucacaugacucguacuucugacugaccagcuauaaaucgggguucccacaacccuucuucagguucaaugugcuggaaugacucccaagauucagggcaaugguuuacuuaacauguauagcuuuaugauaaagcacacacagcucaggaagcaccagauggaagagaugcauagggcaagauacggcaagcccuugccauccucccaagaggaugcucucacccagcugccucgugguucaugcccuguccucugcccucccuuauucccuauugaauugcuucccucuugcuucccuccgauccacaugcugccagaguccagccacgucacuuucuuguucaaaaaucuucaaugggcugggcgcaguggaucaugccuguaaucccagaacuuuaggaggcugaggaggguggaucacuugaggucaggaguuugagaccagccuggccaacauggcaaaaccccaucucuacuaacacuacaaaaauagucaggugugguggcacaggccuguaaccccaacuacucggggcugaggcaggagaaucacuugaacccaggaggcgaagguugcagugagccaagauugcgccacugcacuccagccugggcaacagagggagacucugucucaaaaaacaaacaaacaaacaaacaaacaaacaaacaaacaaacaaaacacaaccuucaaugauuucucaaugccugaaguucaguauuguaacccaccucauucccuccaugcgccguguuuuugcucuacugaacuaugugccaucucuaaacaauauuaccuuuucaccuuuaucaacugugcuucuagaaugcucuauccuucucccuuuuaggauccaguucaaaugucaaaucuaagaaauguuaccuacucaauuccugcaaucagaauucaccucugccuguguauuucaacugguauuucaacuaauucauucugaguuaguuauagaugcauaugucuuuccuacuagacuacacaaaccucaagaggcggcagccagaacuuaccccuaugugcauuucagcacagucugagagagugccuucuacuuaguaggcagucacuaauuuaauucaucaacucccaauauuuuucuccaucaaggucuccuuauggaaaaguagagccaaaaugacaaaaccuggagcuauuuccuuucgucuucccccuuaauuccugucugcuucagucuguccuuuaaccuacucaaggcuauguuaaaaucacacuccucaucggggguaggaugaccucuuucacuacaaccaugugaaaggaguauuaauacucccacucucuaaaugaagaaacacuggaaaguucaaugccuuuuucagagccaguaaugaaagcccugggauucaagguaacagcugccugacccaacacaaaugcccaucgcacacaaugccaccaccacuagucucuucagcuucuccacaacugccacugguuucugacucuccaccaacaaguuccaccuuggaguuuaacacagaucacaucauagcugucucaucuucucuaacgugaccugaucaacuccuuucacaucauuuguucucaucuuucuccuuuacauccaggcuuucuucucuccccucuuccaggucauuuucaacucagcugagggucaacuccugggaauucuacuccuaguaauaccaucaccacuguggaggggguucaugugaagcacaaacauuaagcaaacacuaaaacccuuccagucacaugcugcucucugcacacaaagaucuucugugacucagcaugaacaggaccugcacugaguuagggcuuccaggaaagggaacagaaaagauauugauccacccauauccucuccauguuccuccucccuuggcagguacacaaauacuuucuccugguuccuuuauauagggagaacuagucaugggaaaggagcuguaagccagggcuagcuuaggucugccaaaagcacagguguauguacugcaugaacuauuagguauccaguuuuaaugaucuuuaugaagauuauuuaguaaaaugugaaaauggcugauaaaaugccaaaagaaaauguagacacacaacaacaaguaaacacuauuaauacagccauaaaauauaaauguuuauugccaaagacugaaaggaagaaggcaaaaaaaaaaaaaaaaauuaaaagguguuacaaguugugggccaugaaugaauguuuaaaauuuucuaaugucugucuggcuaucuuauugcuauauuacaagccaccccaaaacuacgugaauacaccauucauucauucauucauucauucauucugugcagcugaggacuggaauccucagaagacucaucccuccagugugggguggcuggugcuggccuucagggccucacugagcugggagcugggcugccuacaccugguuggcuuccuuacaacaugguagcugggguccaggggcaagcggccugagagacgggccagauagaagcccuacugcauuuucuaaccuaaucucacauaucacagcauccugcccccccacauccucugugucaggaacagucacugagguccauacuugggacaucagaauacccuggggagcuuuuaaaaaaacgccuacccagaucaguuaaagcagguucuggggcccaaaauuacuuuuuuuuuuuuuuuuuuuuugagacggagucuugcuuugucacccaggcuggagugcaguggcgggaucuccguacacugcaaccuccaccuccuggguucaagcgauucuucugcuucagccucccgaguagcugggauuacagaugugcgucacuacgcccggcuaauuuuguauuuuuaguagagauggaguuucacaauguugaccaggcuggucucgaacucccgaccucaggugauccaccugccucggccucccaaagugccgggauuacaggcaugagccacugcgcccagccccagaaguauuuuuuaaaaugccuccccaggcgauuuaaaugcacugacaggagggagaacggcaaaaugaagacgaucucugaacuuucuuccggcucuaaacuuauacccauuauuccaauuuaggaaguggugaagaggcuuaaaaagguaaaauaaaggucucuccuugcuagagaauaaaugcuuauguccccucaaaauucauguugaaaccuaagccccaaggugauggcauuuggagguggagccucugggaggugauaaggucaugaaggugaagcagucaugaauagcacuaguaauaucccuaaaaaagggacuucagagggcucccucaucccucugccgcaggagggcacagagagaagacagaugucuaugaaccaggaagcggccucaccagacacugaaucugcuggugccuggacaugguuuucccagccuccagaaauguaaaaacuaaacguguuuuuuaagccacccaacccaugguaguucguuauagcagccuaaauagacuaagacacuccucaauuuuaagaaagguacacauaaacacccacaaguguuagguguauuuuagacagauacacagauacugacuucccaagaccugaagcccacugggccaaguucagcuguaccuaugugaccacugagaaggcagcauucaguuccuaccuuccauucagaucgacucagagcaguaacagagggugaaaaaagaccagcacucuuccggagcaccccaggccccugcaggaauacgccaguccuuucuggcccacgugacucaguuuacagccaggcuguaaugguccacaaacaggacaggccccacagggcaucuacaacccuuucgguggcuggcacacaccucuaaggaaggaaggagugcaaaucuaguuucugauauucuaaauguugaggucacaaauauacauaugcuacuuccauuaccgcuucuaaaucacugugccccaggccaggugugguggcucacgccuguaaucccagcaccacuuuggaagacugagucggauggaucaguugaggccaggaguucaagaccagccugagcaacauggcgaaacccugucuuuacuaaaaauacaaaaauuagccgggugugauggcacgcgccugucaucccagcuacuuggguggcugaggcaggagaauugcuugaacccaggacgaggaggcugcagugggccaagaucaugccacugcacuccagccugggcaaaagagcaagacucugucucauaaauaaauacauuugggccacuguggcccaaaccaguaauuuucaagauguggcuucaaauagucucuguugguucaagacugcagguccuauaaauuggcccaaaguacacauaugaugaauuuuccauuguaucauaaucuacauuaaaagucauagggauguacauuuuaaauaauagucacaauacaaaggauuuggcuauaaacuuuaaaguauuaauuuuggggacauuuucaaaauggagcaaggaauauacauggauucuaggccuucugcccuacccaaagucauccaagugaaauuuuaacuacuacaagagaacucuaggcucauaacucuuacuucuaccuuuuaauaauuacaacuuccauagguccaugaauuaaccacuugcuuacaaauguaaaugaaagcuagacacuagacaccagacaccacucacuguguccuaaguuuaucagcuuuucuacuaauucuauccugauagauguuuuucauggugguaaaagggcccagguguaaguuauaccauccgcagggauccugugugcugcucgagauuuucuuggacuaaaauauaugaaaauuacauuuccuaauuaaaauaaauacauuaaaaaacagccaguccaaagacugacuagaucacuacuccucaaauuuuaauaugcaucugauucaccugugcagagucuaacucaauaggucuggggugggucugcaauggucauuucuaaccagcugcuuggcgaugcucaugcagcugcucuccagaucgcucucugaguagcaaggacccagauacagauaaccccaaguccauccuuaagcaaugcucuaagauuauauucuuaaaaaaacagguacucaaacaaaugcacguacacgcagguccacagcagcacuauucaaaauagccagagaagguagaaacagcccauccuuguccaucaauggaugaaaggaugaccaaauuaugguagagacauacaguaaaauauaauucagccccucacccacaaacaagcagaagagaaguagugacacgugcuacgaugcugaugaaccuugaaaauguuaugcugagugaaagaagccagacacaaaagggcauauuugguaugauuccauucacaugaaauaugcagaauagguaaauucagaggcagaaugcagacugugguugccagggcuggcggagggaggaauggggagugaaugcuuaaugagugugggguuuccuuuggacugaugaaaauguugugaauuggacagaaaacaaugugaauauaguaaacgcuacugaacuguucacucuaaaauuauuaacuuuauguugucaauuuccccuugguuuucuuaaauguaaaaaaaaaaaacaccauaugcuuauagacauacuaaguaccaaaaaagaaaaaacccaagauucaaugacaaacauaaaaaauauuucacacuauaauguaacauuucacauagcucacuuaaucugagucuuuuucuucauugauaaaaugcagauaaauaaaaugcagguugauaaaaugccccaucuaccacagaauuauaaggaaccaaagaaaaacgauaaaaguuacucucaaaaccagaagauacaauaugggccagguacgguggcucaggccuguaaucccagcacugugggaggcugagguggacagaucacuugaggggucaggaguucgagaccagccuggacaacauggugaaacccuaucucuacuaaaaauacgaaaaaauagccgggugugguggcaugggccuguagucccagcuacucaggaggcugaagcaggugaauugcuugaacccgggaggcagggguugcagugagccgugauugcgccacugcauuccagccugggcgacagagugagacucuugucucgaaaaaaaaaaaaaaaaaagaaaagaaaaagauaaaauaugaacaaugcuguauuauuuuuacuacuauaagugcacuucucaaauuauacaugaaucccuaaagauuuggugacuacuaaaaacagacauuacaaugaaaucaccaaaucugugcagagguauuuaagucuugugggagagaucaacuuccaaaaaacaucacuucucaccuauuuccuuacaaugugaccaguuugguauaauucaacagucagguaaguucugacauauguucagaaauguauccuuugccucuaccuuuaauaaaacaauucaaaugcccuuuucuguccauucuuuuagucugaaaugcaaggaccuacuuagaauaaaugccuggaagagaagaggcucucccaugcuucucagugagggaauaugccugcagcagcuucgagcuauggcaucaguuaugcaagaagagacagagauuggcagugcuuuucuuuaauucuaagccccauucucuuugaaauaaacaggcaacauguggagucaugguauaggucccucggcucggcauaaaucaaacacacaaguaccuuucaaaaguagacguuuaguuauucuucuuacucaaaaagccacuucccauucucccaacuuucucccuaucuaauaaagagauaauaggccuguaagaauaacuuuuugcuaaaugcacuucuacccuccucugugaagcaaccuuuuguaacagcauaacuuaccgcaaagauuuuuaacagacuuuucauguagaguuugcggauaccaaaggagacuccaaaaauggcuggcacuaugaugaaaacgagaaggagggugaagaggacagucagggagaugcccagaagguugacaaucaggcuaucaaaaggcagcaacaggaacaugguggaagauccaggccaggccagcaccugccucccuaagaacaaauugcagccuucagaugguccuuccugacagcaccagccagggaaaggaagcaaguucccgaagaacagcaaaccccauuccaaaguccacacccuucaaccgccugaauagaaggccugggaacagaaugacagaaaaacacggccacaggaggcaacugcaaacgccaggucucuccagaauggauggacucuaaagaugauugaagcuagaugggucuucaguaaaagcauccgaguccagauggaguuucugugcaagugagcagugaggacgggggcucugcucugcuguccugaugcugcuuccagagguuuuacaugguuuuccugcccaagagcauucaacagauaaaucuguccugcagaucugucacuaccagaaguacgaagaagaauuaaacuuggugccagaaaaauccugauaacuccuguggagggguaaucacuggcacuucacacagaaggcuuuugacuugaauauguggaaauuaaauaacuguuuuacuuaaaauuccuucauaagccgagaaccauguucaugguagagaguucauaucuggccccauccuccucuggcaaggcuccuggugcucacagcuuccaggauccuccuaccuggagagcuacagucuuugccagaaggaaagagaugcuggcacacaaugucucauacugcgagugcugaguguaacuccagaugcaucuggcauugguauccucuggacacucuucucccgaaggcacccuuucuuagcagugaccuggguucuuggcaaacagcugcuuacaugcugccaaagcugggggagggaaacagaaacauugucagucacacaaaucaagaggaaaaaugucaauaugcugggggccaggcggacuguuuuaggguaagccuaaaacugucaguguggucaaugacugcuucucaagucaucaaggucaaagagaccaggcagacccaacagguggcagacaugaaugugggagggaaacauagagguuucacaguuuucaacccaaaugauaugaucgguggucaaacuuucugaauauaaaauacauguauauaagacacauuuaaaagauaaaaagcgugugcuauggaaaguacaucuccuuccugucccccagauacucagagugguuccgcacagaugcagccaaagguuguaaccaccuuuguauucuucccaagacauucuaugcuuaaacaaggaaaucacaaugguucuccgucaccaauggcccccaggccaggcaacaaggacguauuauucuucaccuugcuuuuuguuuuuguuuuuaguuuaacacaucuuagaagaaugucccaucaauacacauagagcuccuucacucugcaggugcaaaguuuucaacuuaagaaugugccacaacuuaguucaccagucuccuaaggcuaaacacugauauuuuuacuuuuuuuuuuguauaauguuguaacgaauaaccagguacaugcaugacuuaguacacaaaaugugcuuagcaaauauauuuucgggguaaauuccuagaaauggaauugcagaggaaaagaaaauacacauuuuuaaauuugcaagaccuugccauauuuuccacauagagauuaaacuccuccagccucuccccacacuggccacucauugugaaauuccacuauuucaaauaucucacaaaaguauuccaauuuuacaucgcacauuccaaaucccugaacuugggaguauccuaucaagucucucuggcaaauauuuuggcuucacacuaaucaccuucaggcuauuccaaacacuuagaaguacaagaaauugaacaaaugaacaaguacugacuucgccuuaaaaucugcgcaauguuuuaagggaggagaccacccuucauauugucuuaugcccaauuucugccuccaaagaaagaagaaauaaaaucuaaaaggcagaaauggaauccacaggcagauagcccagcaucgugccaugggccuaguaguuaaaaaucaaccccugaccuaacuuuuuguguuaucuauagauuucagacacuguauggaaaagcaucgugaaaaccccuguccuguucuguuccauucugauuaccggugcaugcagcucccagucacguacucccugcuugcucaaucgaucaugacccucucaugcggacccccuuggaguuguaagcccuuaaaagggacaggaauugcuuacucggggagcucgguuuuugaagacgugaguccacugaugcucccagcugaauaaagcccuuuccuucuacaacuuggugucugagguguucuuguccgcggcuaguccuguugcauuucuugguucccugacuggaaacaaggugauuagaggaaggccaaggcagccccuuaggugacuuaggccugcccuguggagcaucccugcgggggacucagaccagccugagcaauguggauccaaagagcgcuccuggguaggcaauugccccaugggacaugucgccagagcagcauguggcaggcucccagaggaucaacgcaguggcugaacaccgggaaggaacuggcacuugggaguccagacaucugaaacuugguaagacuggucuuuggaacuugcccacuccauuugaguggaagcguggccugaucacccacagcauggcuguacggguacuuuggcuuuuguuuuugacuuaacuuggauugcuugauacuuugguuuugaccuggcuuggaucucuugauacucugauuuugguuuugauucugguuugguguaaacuguaaaagugugugugugcccuuuuuacccguucuuuguuuugugguguguguguggggugagcgugguguuuugucucaaggaagcaugggucaggcacaaaauaagcccaccccacuaggaacuacguugaaaauuuucaagaaaggacugaagggagauuacggcauuacuaugauaccaggaaaacuuagaacuuuguguucuaaguuuggccagaaauagacuggccaacauuagagguggccguuggccaucagaaaagaagccuggacaggucccuuguuucaaagguacggcacaagguaaccugaaagccagggcgccuagaccaguuccuguucauagacacuugguuacagcugguuuuagaucacacccccccaccccugccccgccacagugguugagagaacagcagcauaaguggcuggcagaggcaaggaaagaccagcagagagagacagagaaaagagacagagaggaaaagaggaaaagagagacaggaagagggggagagacaaagacggagucaaggagggagagaggcagagagagaggaagaggcagaggcaaaaggaaaagucaaagagagagaaaguuaaagagagaaagaaagagauauacaaguaguuaagaaaaaaaguguacccuauuccuuuaaaagccaggguaaauuuaaaaccuauaauugauaauugaaggucuucuccgugacccuacaacacuccaauaccaccuuguuguaaguguaaacaagggcuuagcccgaaagcacugaggccacuaacaaccuguagccuuccuaucaaccauccuuaaccuaguaaucugcagauggcccaaaagcauucaaucuguaguggcaacugcuuugcuaacagaagaaaguagaaaaauaacuuuuagaggaaaccucauugugagcauaccucaccaguucagaaauauccuaaguaaaaaaaaaaaaaaaaaaaaaaaaaaaaggaagauuuaacauuaaccacugaaaauucccuuaacccagcagguuuccuaacaggagaucuaaaucuuaauuaccauacaaagguccaaccagaccuaggaggaacucccuucaggacaggacaauagaugguuccucccagguaauuaaaaaaaaaaaaaaaaaaacuauaccaauucuaaguuaauuuggacuaaacaaggucuuauuaauagcaaaggauaauuaaaaucccaaacuuacaagguuuucaacaaaacugaagucugcuaaaaguuaaaaguguaacauauauuauaguaacuucuaaucuugucgccuuagacagucuaguccacagacauaaaggaaguucacuuuggaaaagaaugguuaucaucuucagaaaaaaaggggggacagaauuuauguaaaaaaaaagcuauaugguaaauucuugcccugaaauaaaauaacuggucguuuaaaaaaaaaguuugggccgggcacgguggcuuacgccugaaaucucagcacuuugggaggccgaggcgggcagaucacaaggucaggagauggagaccauccuggcuaacacggugaaaccccgucucuacuaaaaauacaaaaaauuagccaggugugguggcgggcgccuguagucccagcuacuugggaggcugaggcaggagaauggcgugaacccgggaggcggagcuugcagugagccgagaucggaccacugcacuccagccugagcgacagagcgagacuccaucucaaaaaaaaaaaaaaaaaguuuguaauaagucagaaaguugagacauaucgaagaauugucugcgaaaguugugagaaaaagaaguuauuaaaaaaaggaauuuaugcaagaaauguuguauaauauaggccuccugaauguaaaacuauuuaaaaaaacaguuuaugugcaagguauauuaggaaaguaaaauauaccuuugguaaauggauuauaagcaggcauaggaauguaaauuuuuaccuacauuaaaagguuaaaaaaauuguuuuaaagguuuacgcaaguuuuaaaacguuaauuguaaagaaaauucuguguguaaacauauuggcuaaaguuaaagagguaucauccaguuuuucuguaaacugaacauuaaaauaaaaacacaauggguuuuucuuaaagcacuaaccugcucuuuaacaaaaaauuauaaaagguuaaaaagagccuauaaauaucuuaccuuauggucagacauuaaaaauugaauaaauaugucuacaaaguuuuauuaaaaccaaguuuaacauuaauaacacacuaauauaaaaaugaaauauagcuuaucugguauaaaaaucauccaggaagcauugucaaauauaaaaugguguuuggcuuucuuuguucuaaaaacuaauaaaaauaggugcuaaaggaaauuucucaguagaaaggcaccaaggacuauaaaguccacugcugauguccccacauuuaaaacaaaaggugaauuucucaaaaaucauauacuugguuuaucuuccacuaaacuaaaagucuuuuagcacauguaccacccccagaauuuccgguaaaccagcaccagccugaggaucacguucucaucaaagggugaaaagaagggaaacuagagccagccugggaaggacccuaccuugugcuguuaaccacagagacugcuguucguacagcaaaaaagggauggacucaucacacccgagucaagaaagcagcaccuccuccagagucgugggccauagucccagucacaccugaggcugagugguccacacacggccgaagcaugaggaaacucaccgugggacuuauuuuccuuaaauuuuggacuuguacaguagggacuucaacugaacuuccucaaacuaaggacuauucccaguguauacauccagucaaaaaguuaaaacugucuuuuuguucuauaguuauuauaaaugugcuggaacucuaaaaaggacuuguuuguauaaugccacacaguacaagguauguagcccaggaagugaccagccugauguguguuauaaccccucugagccucccauguccacaguuuuugaaauaagauuaaggacugaagacugguggggacucguaagugauacaaguaaaguauuagccagaacagaagaaaaaggggugcccaaacgcauaaucuugaaauuugaugucugugcugucauuaacagcaauaaguuaggaagaggauguggcucuuuugauggggaaaaaggcuauaugaccaaaaguaaguauauuuguuaugaauuaggacuguguggaaaugaauguggauacuagucuugugucauuugggccacguggauaaaaaaugaaaaggauccaguccaccuucagaaaggaaaaaguggcccuuccuguacuaagggacaauguaacuccuuagagcuaguaauaaccaauccccuugauccucacaggaaaaaaggggagcgugugaccuuaggaaucgauggggcuggacuggauccucaaguaaauaucuuaguucaagaagaaguuuacaaacacucuccugagccaguguuucaaacuuucuaugaugaacuaaaugcgcuaguaccagaaauuccaggaaaaacaugaaauguuuuugcaauuagccgagcauuuagcccagucucucaaugucacuucauguuauguauguugaggaacuguaaugggagaucaauggccaugagaagcccgagaauuaguaccuacagacccaguuccugaugaauuccuggcucaaaagaaucacccugauaauuucuggguccuaaaagccucaauuuuuggacaauauugcauagcuagagaaggcaaagaauucacucaccccguaggacaacuuaguugucugggacagaaacuguauauugguaccacaaaaacagucacuugguggaguucaaaucacacagaaaggaauccauuuaguaaauucccaaaguugcaaaccacauggacccaccuggagucccaccgggacuggacagcccccacuggauuauacuggauaugugggcauagagcuuaagccaaauuacccaaccagugggcagguaguuguguuauuggcacuauuaaaccaucuuucuuccuacugcccauaaaaacagguaaacuccugggcuucccugucuaugcuuccugcaaaaaaagaagcauagcuauaggaaauuggaaagaugauaaauggcccccuaagagaaucauaccauauuaugggccugcuaauugggcacaagauggcucguagggauacuggacugccauuuacaugcucaaccgaaucaaacguuuacaagcugucuuagaaauaaucacuaauaaaacuggcagagccuugacuauucuggccuggcaagaaacucagaugagaaaugcuaucuaucaaaauagauuggcucuugacuacuugcuagcagcugaaggaagggucugucuggaauuuaaacuuaguaauugcugucuacacauagaugaucaagggccaguaguugaagacacagagauaugacaaaacuggcacaugugccaaugcaaguguggcauggauuugauccuggggccauguuuggaaaaugguucccagugcuaggaggauuuaaaacucuuauaauaggaguuacaauaguaauaggaaccugcuuacuacucccuuguuugcuaccuguacuucuucaaaugauaaaaagcuucaucauuaccuuaguucaccaaaaugcuucagcauaaguguacuauaugaaucacuaucgaucugucuugcaagaagacauggguagugaagaagaaagugagaacucccacuaaugagugagguucucaaagggaggaaaugaacaacuacugacuucgccuuaaaaucugcgcaauguuuuaagggaggagaccacccuucauacugucuuaugcccaauuucugccucuaaagaaagaaguauaaaaucuaaaaggcagaaauggaauccacaggcagcccagcaccacacccugggccugguaguuaaaaaccaaccucugaucuaaccucuuguguuaucuauagauuucagacauuauauggaaaagcaucgugaaaaucccuguccuguucuauuccauucugauuaccggugcaugcagcccccagucacguacccccugcuugcccaaucgaucacaacccucucacguggaaccccuuagaguuguaagcccuuaaaagggacaggaauuacucacucagggagcuugguuuuuggagaugugaguccgccaacgcccccagcugaauaaaacccuuuccuucuacaacuuggugucugagggguucuugacuauggcucguccugcuauaguuucauagaacucaaggcccuucccuuguuaccucguuuguuuauccccaguccaucaaucuguaugauuugcauuuuacacaucaggaagcugagagagguagcugcagacccaguuccucuguacggcuccaugacauucacacauuucugaagacaaaaugcucuagucuacaaggacaugcuauucaguggugcugggucaugaacccuaguuccuaguucugauggccacuucuuacauuuccuuccacuuucacacugucacugcgauugcuaacauugacugagugcuuacaacaugcccagcacugcgcuaaggagcauuucacauauaccacccucaaguaauccucacgauggcuguacgguggagucauugucauccugaucuacaggugaggacacugagguugggaagauuaagggacucaaguuacccagggcugcagagaguuggaagcaggacaagagcauucgucuccaggccccugcucuguaaccccuacuucuuccugucucccaaacuacaugcuuuaaaaugaaguagcacuggccgggcacaguggcucaugccuguaaucccacuuugggaggcugaggcagguggaucaccugaggucaggaguuugagaccagccgggccaacauggugaaaccccaucucuacuaaaaauacaaaaauuagccaagcaucauggcgcaugccuguaaucucaacuacucaggaggcugaggcaggagaauugcuugaaccugggaagacuccagcaugggugacagaaugggacucuuuaaaaaaaaaaaaaagaaguagcaagccagccugcucuacagaacuugugauuagagaaaaccaucaagaucuggacuccauuaucagaauuuggugguggucucagaauccaagauacagacacgcucuuguguuuugauaaacgcucguacaugccaguuuucuaaccguguucuagagguaguucaggaaccugaguuaccgaaguucucaggccuguccagggcaacaucuccuuuccuccaccauugcugucucuccacucccuguggacagcacugccaugggaaagaggcagcaagggccucuguccuacuggccaggguuacccugaguuccacagacccaaggugauugacaccagggucacuuugacccccaugccagaguguagaucacuccucuaaggaucauagcuaagaauucccaagguuauucuggguucauguccccaaaccaguaaacaccugcagcaauaaaccaauuucuucaccuaguucagggguuggccagucacagcccacaucuggcuacagucuuuuucacaaagacucaugaguuuuuacauucuuagacucuuuuaaacagaugcaaaaaacaaagaagauuugaaaaacccuaaaauacucacuaucugccccuuacagauacagacccuaaaauacucacuaucugccccuuauaggaagagucugcacucaugaccuugcuagucuuuccuccgcucagaggcccccugcuggcucucccagucccaucccaucccaccccaucccaucccgccacaccccaccccgaguuccuuuugcugaaugccagccuccaggacagagaacaccaaacuggccuaacaaguuauuuggccaacacuaaacaacacucacacaaauucuuagaaguagaggaaagagcaagccaacugaguuuaucaaaucgguaguguuuggaaacugaaaaaucauuaaagccagagguaacugguggcuuaagguccccuuaauacagacuuugaugucuagaaauaucaaaacuguucacaucagaacucaaucaaaccacaauuucuagauaaccguucuuuuacgagaggcuaucacuuugccucaaguaaauauaagcaugaccccuuaagaaugugagcuggggaagccauucauucagaggaauauucacuuauucccucaacguccacagauggguuccaaccaaacucacccagaaucaucagggccaacguucccccacaggccaaacauuccagagaaucagcuaguucugagucuuuuaggaaggaagcugccuccauuccaggaaggcaacagagcccaucacuaagcuaaccuaacucuucaacccauggaauggcaaaucugggccuuuaggcucccuaauggccucaguucuuggagugacuaguucauucauucaacaaauacucacugggcacacagugugugccagacaguacaucagguguuagcuguuguucagcggugaaaagauaugcccauccggaaacaagcacacaaaaaguuguaauuucaaacuaugaugacuguugacaaggaaaauacacucuuggaaaagaaaacaaaacagaaggaaaggaaaaggaaaagaaaagaagagaaaagagagaagagagaaaaggaaagggaaaaggaaaaggaaaagaaaaaagaacagaacagaacagaacuuaauuuaaaucaaggcaucuauaccaauucucucccaaucacaagguauuggacugggacuauuaucacuccuaaaugcagaaucaaauacuuuucagucggcucucugugacacaucccaacucagggaccauaacugcuagaauaugugcagacagaggcccugugccaacucaaaagguaaaagaaaggccacuuuauuaauacaugcuuagaucacaaaagaaugcacguauuuuuagagcacaccaagcacaaugccugucacauguuagaucucaaugaaugguauauauuaucauuucauuagaaucagaagaaacucagucuucaguccuagguaccaaacuucaaaaaggcuuagaaaggaaagcauuauaacguaugacacaaaauccacaggccaaaaaacacaacuugccuagcaagcaggaaguguucaauaaaaagguuagucguaaaauggagaaauucgaauugaaacuacagugagauggcaaagaaauucugauaaaccacugcacuggugagaauggaaaaacauccucaaauacugcugguuggaguguaaaaaggguucaaccucuacaaagaacaauuuagcgacugucaucaaaauuuuaaauguauguaaccuuagauccagcaauuccacuucuagaaauguauccuaaggauaaaucggaccagugguucccaaccaagggugauuuuuuuacccccuuggggagcaucuggcaauaucuacagggauuuuuggcugucacgacuugggaugggagugcuacuacuggcaucuagugcagugcgcagggcagagaugaugcugcacaucuuacaaugcacaggacagcucccacacaaugaggaacuguccagccccaaaugucaguagugcagaaguguauaaacccuguauuuuaaagcaugagcaaagugauaauaugugcugggauacugacugcggcauugucuguaauaucaaaacaaacaucaacgucucccaauagaggauauaauggaauacuauucaucuaagccccugucacuaggaaggagaaggggaauuugaauguauuucccaagaaguaaugacauuauacuaaugagguuuucaacuaccacuuuugccuaaagguguuuauaugccucugaaauggcuggagcaugcuuucucauucagaaaguucacauggccugacagggaggcaaacauggccacagccagugucugcagagcauacugggggcaaaugagacucuccagaaaacaggaacauaaaugcuuaaggcuucaaaauggcacucuguguaaaugcauuaguaaaaacugagacucucacaguaauucugaaucaggacaguugguauccaugcacagauggcaggggcaugagccacgugggcccucagagacccagccagaaccauccccuggccacuaaaggcugcacugguucuccacccaggaugcuuauuugcaucucugggccucagcccagaugaaauaaauuagaaucucugcagguacaaucuggauuuguucuuaacacacucgagcgauucugauguggagccaguugagacuacuggguuaaggguucuuaccaguuaacugagaaaggacaacugaaacugagaagacaaccaucucugagcacaaauuauccauacguaaaaggcaucuaguucucuaaaaaaaggagggggaucacauucauaagagagguggugaggcucuagaacgacaucccagggcaugaaagcugguggaagcccuucaguacuggagagcacucaggucagaccgggcuggcugucaccuagaaaaagcggauuugcuugggacacaugaagcaagggaacuggugcuaugguuggcagguauggggugcaaauucuagcucaauacuaagaauccaacccucacacuuugguggugggaauguaagacagugcagcucggagaaugguuaaacaaaguuaccauguaccucgcaauucuacuccuaaguacauacccaagagaaagacaaacugucuacaccaaaaaaauugcacaugaaugcuuacaauggcauuauucagaacagccaaaagacggaaacaaccaaaauguccaucaacugaugacuggauaaacaaaaugugguguauccauacaauggaaccuuuggccauaaaaaugaagaaaugauacacgcuauaacauggaugaaucuucaaaacaucauacuaagugaaugaaacccauugaaaagaccacauauugauuccacuuauacaaaauaggcaaaucuacacagacagaaaguagauuguugguuacuuuagagcuggcgagaguggggagauacaagagugauagcuaaaacguuucuuucugaggugacaaaaauguucuaaaacugacucuguugaugacuauacacaucugugaacauacuuucauuaggugaauuguaucucaauaaagcuauuuuuaaaagaaucuaagauuaaguuguucaaaaagaauaggcugcauagggagaccuucaccuacaacugcauucugcagaguggcagauacauuauggugauuagacuggaugucuuuuaaaaauccuuccugaaacaaguuuuuuguccuuacgucuuuauuuaaaauugcagaaugucagggaagcaguaaagcaugauggccaaacauacagggaaucagacaagcuacauucaaaaccagccuccccuaccuucuggcugucugaccucaaaaaagucacauuccaugcuucaguuuucucaucuguaaauugggaauaauacauauccugugguauuguugucaagacugaacaugaugccuaucaagcuaucaguguagugcuuggcacaaaauccucuauaaauagaagcuucuacuacuaaucaucaccauaaagcuggaggcaauaauaauaaaaugaugacaaaccacaacuuuaguaguuaaucuuucagaauucuagcccaaugucuucauuuuauggcucaaauaaccgagccucggaaggguuugaugauggggacaaguuacggaauggcugguaacagaggcaggacuaacacgcccaucugauguccagucgagugcacuucuugcuucccaggcugacuccucacuugcuuuaggguggauuacaauucagaaaaaagcauccauuucuccuaguuuacugucagaacauacauaggcccaccaaaugccccaacuguaauguaaacaaacacgcacacacaggcaugaggaaaugugugcuacgcugaauuuaacgucgaguguaucgggacugguagaguguaagaaauuugcuugaauaggaagcuguugcuuaguggggaaacugcauguuuccaaacagggcagcucucagagcgacucaguugacaugaaccugaagugcuaaaaacccagaacacacauagcuggcaucaauccuggauaaaauaaauuacccaagacaaagccaggauccaacuggccaaaggaugauucaacucacagagaagacagaacauggucagguucggggccuuggucuuaucuaagaucauuaugcccuccagaacuuucuugaguuagaacuggauaaguaacacggcacugguaccaaguucaccccaaagcaacggaaccaucucuugaagcuggcaaaacaaaaaacagaaaacaaaaccaaaaaaaagaggcuauuuugaugaugacaauuugauuugcuggagcuuuaagacccaagacaauucauuauucgaccugaacacugcucugauggcucaauuucaauaccaguucuugaaaucugaguacugcauauguaauuagaagcaacuuccuggccuuuuucuuguucaaaaaaucuuuuuauccaauuuacuucacucagcauaauuauacugagaaccauccauguugcugcaugugucaacaguuuauuccucuugauugcugagcuguauuccaguauauggauauacccguuucuucauccauuccccuacugauggacacuaagguuguuccaguuugaggcuauuacaaauaaaacugcuaucuacaagucuuuguauggacauauacuucauuucucuuggguaaauaccuaggaguggaaugacaaauuccaaaauggguuguaccauuuuguauucccacuagcagcguagggaagucucacuuguuccacaucuucaccaauacagucuuuuaaauuuacacacaucacuggccaggcgcaguggcucacaccuguaauuucagcauucugggaggccgaggugggcggaucacuugaggacaggaguucaacaacagccuggacaacaaggagagaccccauuucuacuaaaaauacacaaauuagcugggcgugguggugcauuccuguaaucccagcuauuugggaggcuuaggugggaggaucaccugaguccagucggcugaggcugcagugagccaugacagugccacugcacuccagccugagcaacagagcaagacccugucuuaaaaaaugaaaccuuuucaucacaagcgcacaaauucgugacagcagacuuuuuuguucaucucucugcaaauucaaaauacuucuaauugugcaaagaaaaucacuaaaacaugaaagaaaaaaccaaugaccacaaccacaaacucuaaccucagaccugaacauuacuaagcaaaauaaaacauuccuucaucuuuauguuccacugacagugauucucugcaguccaacagagcagccacuaaccacgugugaccuuggagcacuuaaaauguguugugaauguaaaaugcacacuggaguucaaugacuuagcaugaaaaaaaugcauguaaaauaucccauuaauaauuuuuauauugauuauguuucaaaguaauauucuggauaaacuagguuaaauaaaauauauuguuaaaauuauuuucaccuguuucuacuuuauacaauuuuuuuaaaaaaauuuaaauugacuuucaaaucaaagucaauauauaggagcuaaaaaugaucucauagacaguagaauauaauagauaccagcagcugggaaggguggacguugagagcuugguuaauggauagaaaaaaaaaacuuaaauggaacgaaugaguuccaguauucaauagcaaaguaggaugacuauaguuaccaauuucuuguacauauauauauauuauuuuuuuuuugagacagucucauuuuguggcccaggcuggagugcaguggugcgaucucugcucacugcauccuuugccuccagguucaagcaauucucgugccucagccucccucauaccugggauuacaggcacaggccaccacagccggcuaguuuuuuuuguauuuuuaguggagaagggguuucaucauguuggccaggcugauuucaaacuccugaccucaagugaucuacccacuuuggccucccaaagugcuaggguuacaggcaugagccaccacgucaggccaauuucuuguauauuuuaauuugaaauguuaaguagauuugaaauguucccaacacaaagaaaugauguauguuucaggugcuggauauccuaaauacucugauuuuaucauuacacauucuauccaugugggcaaauauuacuguacacuauaaauacguaaaauuacuguuugucaauuucuuaaaaauugauacauaauuuuacauauguauggagcacaaugugauguuuugagauacacccacacacacacacacacacacucucucucucucccuccccuuguggaaugauuaaaucaaccuuaucuauuucuuugugcuuuuuaaaaaagcauuauuauaaaauuuaaaauuguguauauagcauauauaauauuucuaugggacagcacugaucaaaaauuuuuaaaggagacucaaaauaauguaucuucaacuggcaaagaaagaaagaaagauguguguguguguguguguguguguguguguguauacuuucccacccuauuucuccaaggugaagaaaaugguacagcagaaagggcuuagaucuggaaccaggacugccuuuagguucuaggugcaacucuuacugucuagucuaugugucccugaauacaucauucagcuucggccacgugcagugucucacgccuguaaucccagcacuuugggaggcugagguggguggaucaccugaggucaggaguucgagaccagccuggccaacauggugaaaucccaucucuacuaaaaauacaaaaauuaacugggcgugguggcgcaugccuguaaucccagcuacuugggagauagggaaaucauuugagcucaggagguggaggguugcagagagccgagaucucgccaccgcacucaggccugggcgacagaggaagacucagucuccaaaaaaaaaaaaaaaaaaaaaaaaaaaaaaaaucauugaacuucccuugauuuaagcuuccugaucauuuuuuuuuuuuaauucaaacaagucggccgggugcgauggcucacgccuguaaucccagcacuuugggaggccgaggcggggggaucacgaggucaggagaucgagaccauccuggcuaacacggugaaacccugucucuacuaaaaaauacaaaaaaaaaauuagccgggcgugguggcaggcgccuguaaucccagcuacugaggaggcuaaggcaggagaauggugugaacccgggaggcggagcuugcagugagccgagauugcgccacugcacuccagccugggcgacagagcaagacucugucucaaaaaaaaaaaaaaaaaaaaagucaacaaaggccuggcaugguggcucaugucuguaauuccgacccuuugggaggcugaggcgggaggaccguuugagccagggaggcugagggugcagugagccuugaucaugccacugcacuccagccugagccacagaucaagaccaucucuauaaaauaaauaaauaaaagucaagugcaaauguauuacgcuccuguuuuacaaagcauuuuucuauuauugcagaucuucgguuuacaaauuaacuggaggugggauccaaacauacuaagauuguacaaggcaaaaugaagagagcccuagaugagacucuguguuuguguggcauguguacgugucugcauguguuuuaaaggugaaaaaguacauuaaaggacucaggggaaacucuaagcacuuggaagacuccuucuaacucuaaaauucuauucucuuaaaaagccuuaaucauaguguacgcuauuacaugguuuagugauacauggaacggaugauauuccgucaaguucucuccaugagcacaaugacacaguaggaaguaaaagacacgucauaaugagguucuacuuuacccaaacaaacaauucugcaguacaguucauguuuaaccagggccaaaucaucuccagauagcuuagagaguuuuguuuuguuuuuaauaaaagcuaacuuguggugacaagcacacacaagaaaaguggguuuuucuuuagcagaaaccacuuagcaaguuaggcuagccucugaagagccuagccacaacacuccucacaccaaacacaaaauagacacacaacaguugccuccuccucccuccucuaucuuuagggguaaugauuuaccaugacacucaaaugcuguuauugcagugguacuuccauaaacuggacaugcauaacaacuauuguauuuaggucacaaacucacaaaagaaaaguccauccugaaaguaaguugacaacuaugucaucauauaaauaaccuaaacuuccaugaaaacucaaagaccccuaacaugaggacuugcuuguucccagcauuccuuggagaggcagaauauccccauuuuaaggguaggaaaauugaggaauaaguacugaauuuaccagucuuuguugagauaaggaaauguaauagcauaaauuuugcuaggaaaugcauauuaugguuuuguaagaaagucuaacccaugguccaagaagcccagauucuuaccuauuaauggcaugaaaggcuuucugagaugaugcuauuguucucucagaaaaagaagaguaacacucuuaagucauucugguuucccuuaguaacucuuucuuaaauagccgugaauguuaucuacaccguuuauagcuuguucuucuucucaaacugguauaccacuucuaaggucagaauuuuaucauguucccuaaaaacuauuaucagaacuucucgucugccccaaauugauuuuuaagaaauaauuuaaggcauuucuuaaaauucugaaauuugguggaaaagcucauguucgccuauccaaauccuucaugaauguaagcgucuucauccacagccuuccuacaccauuucucuuuccugaaggcaaguaguaugggucaguggaaccgcagccucgaggcagaggcgagauuucagccucuuaagaccugcagcucuggacaagucacugaacuucucuggaccuccaagggcucagaaaaaaaugaaaacauugaacaggacguuccgaauguucucauccagaucugaaacacuuuuuuucuuuucuuuuuuuuuuugacacgagucucgcucugucgcccaggcuggagugcagcggcgcaaucuuggcucacugcaaccucugccuccuggguucaagcgauucuccggccucagccucccgaguagcugggaauacaaguacuugccaccacguccggcuaauuuuuguauuuuuaguauaugcaggguuucaccauguuggccaggcuggucuugaacuccugacuuuaggugauccgcccgccucggccucccaaagugcugggauuaccggcgugagucaccacgcccggccauacuuuuucuuuuaaccuguucuaucauguuaagauaccuuuugcugugcucuuucuucaacucuacuguguuucuuagcugaagaccucaugaguaggcuguguuccaaaacaaaaagcaccuuaugacuugguauggugguuuucauuauggaacugaagcuacuuuugacagacucaucuugcaucaaguucucccugagacauacgggaggggaaaugggugggguguguauggcacaggaauagccacaguuaaguggcugaggaggccagaacaaguacaugcugguucccuauuccaucuauuucccugugucugaaauucuccaaaauacaaaguuaaaaaagaaaagaaaagcacaucucuuucaaagagagaaguauauuugauuggcauuauuacaggauuuugucuggagacuuugguaugguauaacugcucuucacaccauuucccuuggauugagauagaaucuacaagacaugaaacuaaggagagcuccucaaaguucagccaaaauuaaggaaaaugaaccaaaaacaaaauuccucaaaugaccucaagguuauccaugagaagauccaugguaauacuuggcagaggauggaacuuauuuccaucgugcuacaccguaugucuccuauaagcuauuuucugcaacuucugaacagcuaaacuucagcccucugugacauggaaagcgaggaaauaaacaagccccacugggagaaggaugccucagagggugcugaaauaaaaaaggaaaggcaagggauuucaggaguuaagaaauccuaaagaaaaaugggagcaugcauuuggagaaggagaggguaaagacaugcaucuuacggcagccagagaacacaggaaggggaaugacaggggaaggcgcuuccuggugcuccaacgcccagcagcccucgccacccacauccccggacucccggggcgggagggcugcgcacaccugggacuugggggaggcgaggggcuccgaggagccgggcucggagagcaggcgagcggagaggcgggcggccgggguucggggcgggcgcggaccguuccaucccggacggggggcacccgcuccacccgccggggauccccggggcgcggcgauggugccuccugacgccggcgcagcgucgccggggcgucccagaccgcaggccccgcgcggccgcccaagcccggcucccacgucccgcucucggcuccccggaggucggagacuuugagguaaggggccagcucccuccuacucaccgaccgcgaggcuaggcagcuccaaaucccgcggcgaccgcucccucccgcccuugccgccgccgcgggcccaagcugcgucaggacgugc

SEQ ID NO: 191849 - RNA, 15841 nt, Homo sapiens
gugccugggcggaaacuuugcgagaguagcgcgggagcugagaaguugcaggguugaguuggucccggcaaguccuugagcaguuuguuccucugucuucccgcuuccuggugccccgacugcguccccacgaacgccccguccuuaccgccggcugcuguggagugccucgcugucucccagguccccgagugagcgucgaaugggaccucuguggcuagggcaggccuguguggguggcacugagagggaggaggggagggggauguucgcaguuuccuugcgaccccagggacuuucuuuguccccgccauccaccuccuuaggccuuugggaucgccgacuggucuaaugucgccggcccuuguggcucugggaaauuagcauugauuaaucuuccuaacaauuuuuguuuuuauagagacaggaucucccuauguugcccaggcuggucucgaacuccugggcucaagguaucuuccugccucggcuucccaaagugcugggauuacaggcgugagcccggccagcuccuaauaauguuaagugcuugcuaggagucaagcgcugugcugagcgcaggggcuucccacgucauugcguccccagugcuuagugccaggcacugagcagaggcgcgauucguauuugaacuaaaacgaaccccgucccugaggaacaagaccucuacugggaagucaaagaaaugaauagugauuguauggugugaugggugcucagcucuugguggacagaaguaagggggaggcuuguuugagaaacggauaccugaccuaagccuuggaggaagaggcagacacuggaaaacuagagucccugcguucucucaccacuugcuaaagggccucuacaaccccaggaaaccucaauaaaccuuuccuuucuccagauagaugucuguucuugcagauaauuagaaaacgcauugcagaguauugguucuuucccucucauuagguuccugguuucagagaagaugaccgaagaaguggauuuccugggacaggacucugauggggguagugaggaagugguccuaacuccugcagagcucauugaaagauuggagcagguaagcaucccagaucgaaucccuuugcuccagucagccuuuuuauuuaguucaacugugaauaucagggaucacaagaugaggaaacggaauuuggggcuuacuuuagaacagggacuggaucuuaccaucuacauggaaacgggaagcaagaaggacauccucuguuagagaccucaucauaucaaacacagcauccccaaguggggucaguaagggacagcuuugggcacauucagugaacaguucacagagcaaggauccacgugauauuuucagggacuguagaggucccugaacuucuuuaccuuagucccuugaacaucugcuguuucccuggagaaugccuguuuagcaagaaaaugcugaaaugccuguaagggaaaacuggucauauuuuuccuuuuucucacauguuuuuucuugagucgucugcucuccauauguccacugcuuaucuaaaauccuuucugaaauauuucuccuuuaaguuguaauagcuaugacuuacugcauauuucccaugugccaguaacuguguucuuuacacuuauaucucaugaugcucugguaacaggaguucagacuaucuggauuuaaaucugucugugacacuccucuguuaugugaucuugagcaaguuagggaguuugucucaagccguugcuugccuauaaaauugagacaauagggccgggcacgguggcucaagccuguaaugccagcacuuugggaggcugaggugggcggaucaccugagguccaggaguucgagaccagccuuaccaacaugguaaaaucccgucucuacuaaaaaacaaaaauuagccggaugugguggcgcaugccuguaaucccagcuacucgggaggcuaaggccggaggaucaccugaaccugggaggcagagguuguggugagccaagauccuacccaccauugcacuccagccugggcaacaagagugaaacuccgucucaaaaaaauaauaaaauaaaauugagaugauaauagugucuauguccuggaguuuuugauuaaaugugguaauuguguaaagcacucagcaugcuaucugacacaugauaagcacucacuagaugugagcuguucauaguaaguauccuuauccucuugcucuaacugccccuuuccagagcucucucauguuugcuacuuuaguauucuucauucuucccugccauacaugauaucacgaaugacaaaacggaacuaaaaugauuuuuaaauuauaccuuacaugauaauccuuacuauuuagcagugauucuuaaucuguuuuuauaucacagaccuuuuugagaaacugguagaaacuguggucuuucaucccacaauaacgcacacaugcacccaugcagaauuuugcauaugacuuccaggggaucagagauccccugaaauccacccacagaccuaguuuguggaacagcauuaagaauuccugguucguuaggaaaggguucauuaaacaaaaaucaaaaggcacauagcauaaaggaaaaaagggauacauuccuggagugcaguggugugaucuugguucacuugcagccuccaccucccagguucaagcgauucuccugcaucagccuccugaguagcugggccuacaggugugcaccaccacgccuggcuacuuuuuguauuuuuaguagagaugggguuucaccauauuggguuucgcuguguuggccaggcuggucuugaacuccugaccuugugaucugccugccuuagccucccaaagugcugggauuacaggcaugagccucugugcccagccuguuuguacuucuggauuagagugaaaagacaggccaccaggcugggagaagauauuugcaaaauacuaauauguagcugacacaagaugauuauccacaguacauaaacagcucuuucauacugcccaguacagacugauaccucagagaagaagaaaacaggaugaccaauaagcauaugaaaaagauguucaaccuuuuuaguaaucaggaaaaugaaaaucaugagauaucaucucauaucuaucagauuggaagaacugaaaaacgugagcaauauaaaguauggcaagaauguagagcagcugagcgcaguggcucaugccuguaguucuagcaacucaggaagcccaagugggagguucauuugaacccaggaguuugagaccauccugaggaucauagcgagaucuuaucccaaaaagagaaaauuaagaauauagggcaggccgggugcgguggcucacaccuguaaucccagcacuuugggagaccgagaggggcggaucaccugaagucaggaguucaagaccauccuggccaacauggcgaaaccccgucucuaccaaaaauacaaaaauuagccaggcuuguuggcaugccuguaaucccagcuacucaggagguugaggcaggagaaucucuugaacccaggagguggagauugcagagagccgagaucaugccacugcacuccagccugggcaacagagcaagacuccaucucaaaaaaaaaaaaaaaaaaaugaagagcaauuugcacacuuauauacugccgugggauauaaauagguauaaucgcuuuggaaaauaauuuguuauugucuaguaaagaugaaggugcacauaccugcggcccaguaguuccacccccagguacauaccuagugaaaacuuccgcauguacucuaggagacauccacaguauguucacacauugcuugcaauaguuaaaaauuaaaauaaccuagacaaccguaaacaaauagcauugagaaaauauaccauacacagugggaauaaaacagcagugaaaaugaguaaaauaacuccugaaacagcaugaauaacaggaacuuaauguagaacaauaacaaccauaaaauaugagcugccaaagaaacacuuuauguaaaguucaaacuugcaaaauuauuguucaaggcagagccgccacccuugggugauguggcacacugcuaugccacagaugccucuguguggaccccugcaccuuccaggacagcuggagccccaggcugguuacuuuuucaagugagcaucaucgggguccuugaaaggcagcuagaggauggggcggcggggguucugacagcacagcugcagcuugcugguggguaagcugcaguaacaucucaugccugaugcucuagugcagugcccugagugcagccaaggaagugacccgccaccugcacggcugccacagccagauccugucucuuaugcuguguggcacagccaaagggacagccugacagggcugcugaugagaacagcuccaggagcauauauaggauacccuuuaaugccuguaaaaagugauuuaaaaguuguuaccuguagugcagauuugcucauuuuagugauuguuuuaguuugcuagggccacagagcgaagucccaaagacuggguggcuuaaauagaaauuuauuuucuuaauucuagaggcugaggucaaagugccagcauaguugucuucuuccgaguccucugucuuggguuuguaggugaccauauucucccuguguccuugcauggucuucccucucgugugugucuguguuaaaauuaccccuuaucagggcaccagucuuacuggauuaggggccauccuaaugaccucauuuuaacuuaaucacuucuuuaaagaccuccaucuccaaauacagucacggucugagguccuggaaguuagguagauuuuugaggggcggacacacuucagcccguagcaauaaugaacagauuggcauuuagaauuuugaucaggggccaggcacagugguucaagccuguaaucccaacacuucuggaggcuaaugcagggggaugucaugaggccaggauuucgaagaccacuguaggcaacaugguaaaaccccaucuuuauuaaaaaaaauuuaaaaauuagccaggcuuugugguauguaccuuuagucccagcuacucuggaggcugaggcaggaggaucacuuaagccuuggaggucaagaaugcagugagccauuaucaugccacugugugaccagaaaccagauguagccauuucaagcauaaaaccugaguuaaaaaaaaaaaaaagauuggauuuagauacaaguuucucaguaaaaauuuuggaaagauuuauaugaaaguuuuauacuaauauaaacuuccaccuaauguuuuauacuuuauugucauaauuucauaauguaaaugaagugguccccaauacuaccccaguguaccagacaagcacuaucauuuucuuugaauauccugucaugaacagguugagagguguucuacagagauaugaacaaauguagugagaccauaaagaaaauucaacaugaaauucaagcuaaugauuaccucugaggagggagggacacacagggucuuuuuuuuuuuugagauggagucuugcucuguugcccuggcuggagggcaguggugcaaucuuggcucacugcaaccucugccucccagguucaagcaguucugccucagccucccaaguagcugggacuacaggcgugccacgcccggcuaauuuuuuguauuuuuaguggagacggaguuucaccauguuagccaggaugguuugaucuccugaccucgugauccgccugccucggccucccaaagugcugggauuacaggcgugagccacugcacccggcuuguucuuguaguuuuaaaaauuauucaguauuuggcugggcucgguggcucacgccucuaaccccagcacuuugagaggccaaggcagguggaucacuugaggucaggaguucaagaccagccugacgaauacggugaaacccugucucuaauaaaaauacaaaaauuagcugggcauaguggcacaugccuguaauuccagcuacucggaaggcugaggcaggagaaucacuugaacccgagaggcagaggcugcagugagcugggaucaugccucugcuuuccagccugggcaacagagugagacugugccucaaaaauaaauaaaaauuauucaauauuuaauaaaaaucaaucaaaaagaaaugcugcuccuaauaagcccuccagaaaauaugauguuuucccaugcauuaugcagguuuuuuuuguuuguuuguuucagucugcaggacuguuacagaugcucaggcucugcacaaaugccuaugacuguagccauacccagcauuugguaaugugucuugacggugaucauggggagaagcagacacucaaggacgucagaaaaaaauaaguugagccuggucagcauauaauucugagcuaugcuaaaacuacauuuccuguaauugaaagauaaguguagcuuuccucagucacuuagggauauuucaguucucuaagccuuggaagucucuaaaaugaaccaaacagcugggccugagucauaaauuagagcuuuaaccucuggcuccaaaacuccauaauagaugagcgccuguuucuauuaugauccuguauacuuuggggccauuaguaaauuacucaaucuguauuuuuucaaucagaugaggauaacuauauccauuuucucugagauaugaugaugaugaaugaaaaauauuugugaagugcucugagcuucaggaaugaagagcuguguggauugguggguuauugcuuucucucuaaauagacaugggguggcgcugccugggggaacagugugcccgggcugccuggcaaaggcacuauuugaacaccagguggugucacucucagcaccaagcgucacacuaacugaaguaagcaaggguuuguaugagugucaguugaauagaagguugugaacacagccucccaacuaaaacaagacacgagaaagcaaucgcuaaacguaguuugucuucaaaacaccuucaauguuuccaguuggugggcagacaguuuucuugccugcgccaucccugguuuucguuggacuugggcugacucacuggguuguuuagcucuguggugggugaugcuugcuuuuucuggcauuugucuuuuaggccuggaugaaugaaaaguuugccccugagcugcuggagagcaagccugagauuguagaaugugucauggaacagcuggagcacaugguaagagucgcuugucuuggguugacaaaggaggagaaagguaaaagcauuuggucagcacacugagagcuuguggucugguagcaaaucuguuuuguuuggcuccacucacaguccaguucuuuaaaacaacauugaauuaguuaucuauguuuaucaaucuugagagugccuguaaauaucuggauauuggcuucccaugaaaagucuaaaauccugcauuucugcaugagaacaguugaccagagcagucccaugagagcuguccauccauguacucccugcuccccacagccccugacuacccacccuucucuuguagccuccccaccuggccccugcaaacauuugaguuuguggucccuggccuagaugaucugagcauaaaucauugucaacuucagagaagcuguaaaauguggauauuucaguuucucagcugguguuuuaauacugcuuuuuagacccaauggaaguuucgucugugugcuguacuaucucccuuacaaucagauuggaguucuuuuggaagccucuggcugaacagauucuauucaaauggucauuuucuaaaaguaaaugacuauuguuuguacuuuauacaaugauaaaaugaaaacucacaugauauuuuuguuuuccuuggacugaaacauagucuggguccucaacguugccggugaugaugguugaacaucauguuuuuuauaaaccuuaauuucucauuuaauaggaagaaaaucucaggagagccaaaagggaggaccugaaggucagcauccaccaaauggagauggagaggauccgcuacguccucagcagcuacuugcggugucgccucaugaagguuugacguggagauaccuggagggauugagacagcacagucuguaaugcagacugaauguccuggggaaaacuugggcuggggcccaggaggguccaggaccugaagaugcugcuaagagcccaauauccauguagcuaaacuguaaggagagcgagagauugcuccacagaagcacagaggaacguguguggcccacugcggggacaccgcacacauuuuuagucuguucaccugccgagugagugguucccccuugcguuacagcauggcagugcuaaagggagaguuguuggcauuggucaauagugaaugcugacuagaggagaacuuguuuccaaaauuauuuugucugucagauggccaacgucagugucaaaugaaccaggaugacuuacauucaccuacagcuuuguggcuaucuaacuuacaaaaaugaaguugcaggccaggcgugguggcucacaccuguaaucccagcacuuugggaggcuaggcggguggaucaccugaggucaggaguuugagaccagccugaccaacaaggugaaaccccauuucuacuaaaaauaaaaaaauuagccaggcguggcggcaggcgccuguagucccagcuacucaggaggcugagacaggagaauugcuugaacccaggagguggagguuucagugagccaagauuguaccacugcacuccagccugggcaacagagcgagacuccgccucaaaaaaaaaaaaaaaagaaauugcaaaacauuccuaguuuauaacucugagaaauucuuacuuccuugacauuucauuugguucuaugugucucuuuaguuauuacaaauaagauaaauuaucucuucuacaugagaaugcuucagcuaucugaagacugcccacagucuccucgaagucuucucucaggcauacauuuuagccauucaaaccauuuacucuccuggucucuucucuaaaaggguucuuguuugucucuauccuucuuaaguuacacuaucuuaaacuaaacacaguaucccaguuguaguuugaccaaguuugugaaaaacagaaugaucauuucucuuauucugguuauuaagcugguaguaaugccaaccacaucacauuagcauauuuaucacauuagcauauugacagguacgcugccugagcucauucuucacucacguggacacuaaccccuuuuaagaugauaauuaccccauccagucacuguccucuacuuguauggcuuagguuuuggcuccuuaaguguagggcuugauacuuaucucucuuaagcuuuaucuuauuaaauugggccauuucccuugucucuggaugcugaucuugucaccuaauguauuagcugucucuuaauacuuuaugucaucaacccccuuuuuuuauuuguuugguuguguuuuuuuguuuuuuuugacagagucucacucuguugcucaggcuggagugcaguggcgcgaucucagcucacugcaaccuucgccccccagguugacgugauucuguugccucagccuuccaaguagcugggauuacaugccccugccaccaggcccagcugauuuuuagaagagacaggguuucaccauguuggccaggcugaucucgaacuccugaccucaggugauccacacccaccuuggccucccaaagugcggggauuacaggcaugagcuacugugccuggcccacauaagguuuuugauggcaugcuuaccaaagcuggugaugaccaguuacaggcucacgccuauaaucccagcacuuugggaggccaaggcagguggaucaccugaggucaggaguuugagaccagccuggacaacauggugaaauccuaucucuacuaaaaauacaaaaaucaucugggugugguggugggugccuguaaucccagcuacuugggaggcugaggccggagaaucacuugaacccgagaguuggagguugcagugagcugagaucacaccacugcauuccagccuggacaacacaaugagacuccaucucaaaaaaaaaaaaaaaaaaaaaaaaccuuaugugauuauuaauuggacuguggcaagggucuuucacaaaagacuucccuacaguuugacaucuacccauugagucagcauucuuuuuucagccacuuaggagucucccaauccaagccguccccuagccccagguccauagcuugccugcaagggugucucagagacguuguccugugucuuauggugugucucuccacccacccuaucccaccuccaggccacauguccuuccucgggaggguuguguaaacccucuuuauguuaaccacauccuucucuuugacuuuugccaauguuuucaugaagauuuugcuuuauccucacagauagagaaguuuuucccucauguccuugagaaggaaaaaacacguccugagggggagccuuccagccucucgccggaagaguuggccuuugccagagagugagugagugagccguuggcguggggcaccuggcugguucagcaugaggccuguccuagaggccugugcgcugcugccugcuaaccuuggacguccaucagcuguguacaccacagcgauuugaauccaugucuuucagguucauggcgaacacagaguccuaucugaaaaaugucgccuugaagcacaugcccccuaacuuacagaagguggaccucuuucgggcagguaaacaggacguucucccugcagguggcccacccauccucaggugucccaggguaggauccucucuucacuguuuuuacccaaauacaaaaaaguaaguauguagauaaacagaaagaagagcaaggauucuagcuaaaaaccaaaaaaaucacggaaagcagauccaaugguaggcauuugagcauugcuuccuuguucccuggggugggcugagccccaugacugcacuggugcuuguagacucgggcauggagccgcguucgccuucaguagccaucugcugagccucugugaggugcuggcagccccgaguaccagcacugcagagccuacaccaacauugccccugcuuagaggggcuggccaucucuucgucacaggucccagaaugcacagggcucgccuagcuggaggggagggcugaaacaggaggcuagggagaccuccagugagucccuguggccucagaagagggagcagguuggaggguguggagagaggagggaggggagccggggaaggggagcuuggccggagccccuccucgggcuucuucgcaccagccccugagggcugccgagcaaggaaagggagguauaggcagagcccuuaccgucggaucaacccaccgggggcccuggcuuacaggauaaagcccauguuccucaguguuucacagugcgccagauccaagcaagaccuccucaggcaaaauugccauaccaaaucaaacgagcuccaguacacccgagcccuggaaauucaucucugcccagccugugcuggggcuggggaccacacagccaccccugcggugguggaacagggucuuagucccuuugggcugcucacaguuauggagacugggaaguccaggauccaggcccccacagacucagugucugccaagagccuguuccucauagauggcgccuuccauauguccucacagagaagggaaggggcaagcagacucucaggcuacuuuuauaagaucacuaauccuagucucuguguguccuaguccccucccucccccccaccuuuugauuuuuguuuuuuguuugcuuuuuauuuuuugagacaaggucuugcucaguugccccagcuggaguagauugacgcugucauagcucacugcagccuugaacuccugggcucaagcgauccucccaccucagcuucccaaguagcuggaacuacaggcaugugccaccaugcuuggcuauuauuuuuaaaauuuuuuuguggagacagaaucuugccauguugcguaggcuggugucaaacuccuggccucaauugauccuccagccucagccucucaaaaugcugagaucacaggcauaagccacugugccuggccuauucucuucuuauaagacaccagucagauuggauuagggcccacacuacuuggccucgcuuucacuuaauugccucuuuaaaagcccuguuuccgaauacaaucccacgcugaaauacuggggguuagggcuucagcguaugaauugugcagggacacaguguagcccauaacaccaggagcaagucagacccauaccagacuuguggaacccugaauuggucauuuugcugaggcugccugaggaaaacaaaaggcccaaugcguguccgguuuccucccuggucagccacucugucugcaucuuugaagaguaggaaugggcugggcuccuaucuaaacccugagugugccauaccauucuucccagcaacuuuuacuuuguugacuuuguuggccgaggauuuccuaaucacauuguuguuuuccuggcaguucccaaaccagaucuagauucuuacguguuucugagagugagagaacgacaagaaaacauacugguagaaccagacacagaugagcagaggugaguggcgugcaucuuucacagugggcacauuccucccgauggagggccagccgagcucugcaggcaaauguguuucccucuuuuucagggacuacgugauugaccuggagaagggcucacagcacuugauccgauacaaaaccauugcaccucugguugcaucuggagcuguccagcuaauuuaaaacuaggcauaaacagccaggcauggugacucaagccuguaaucccagcacuuugggaggccgaggcgggcggaucaugaggucaggaguucgagaccaaccgaccaacauggugaaaccccaucuuuacuaaaaauacaaaauaauuagccggguguugguggugugcaccuguaaucccagcuacucaggaggccggggcaggagaaucgcuugaaccugggagcaggagguugcagugagccgaggucgugccauugcacuccagccugggugacagugagacuuugucucaaaaaaaaaaacaaaaaacaaaaaaaaaacaaacuaggcauaaacucaugaggucaggagaucaagaccauccuggcuacuaaaccccaucucuacuaaacccaucucuacuaaaaauacaaaaaauuagccaggcaugguggcgggcccaucuacucaggaggcugaggcaggagaauggugugaacccgggagguggagcuugcagugagccaagaucgugccauugcacucuagccugggcgacagagcgagacuccauuuccaaaaaaaacacacuaggcguaaacaagaaugaagaccuggaaccguagagaaaauacuagaaaccccucguaucacguugugccugaggacaauaauaaaguaguuuacuaggcaucagacauuccucagcagugcugugggucacgggcgugaagcggagcucgaggcaggauugcuuguguugcugcauguccugucugcuguuuuagcccgugucaguagauggggccauuguacuguuuguucugcacacuuggcggagcagcagaggcucucagcacgccuuuucccuuuguaguauuuucugagcuaaggaaagucaggcagaaguaguucauaagaaggcaucacugccugugaucggggcugcauuuagcccugaccugauaaugguaggagaguucauuuagccuuucugcugcgaagauuguaaauagauuaaagaaaacagcuguggccuucucccgucauacaucauuagacuguguaaacuaacauuuuagaaccucuaauauuggacuuaaaaccaauuucugucgugcuuaauugaaaaucacaacuaaaccaauaaaccauuauuaaauuuccauucugcagcagaaggcaccucuggacggcucccggcuuguaguuuaaugaaguaugugcucccugcuguuaacccgcagcccuccccaacucuccagcagcuuugccaagucagccuccgggccaucuggcuguccuuggccaaggcacuguuaacggagugacguuaaccaucuuguauugugaccuguggccgcuuuucugguuuaaguccuucacuuuuucaagaggaauggaugaaauuaaugugcaugcagagucucacagugaugccggaaggaaggauguauaggcagugaaugaaugaucuuuccuugaaaugcuauaaaaagcaaccugcauuccagucuuuucuuccugguugaaguuggcagauuuccauuugcaggguaugggcugcgagaguaaucaggguaacauugcugucauuuccaagagaaaucaguaggggaaagcaagggaggucuuuuuuuuuuuucuuuuuugagacggaguuucccucuuguuacccaggcuggaguggcaguggugugaacacggcucacugcagccuccaccuccuggguucaagagauucuccugccccagccucccgaguagcugguauuauaggugcacaccaccacacccaacuaauuuuuuguauuuuuaguagagaugggguuucaugauguuggccaagcuggucucgagcuccugaccccaggugauccacccaccucggccucccaaagugcuggaauuauaggcgugagccacugcgcacggccuggggagguuuuauuucuugacaaagguauuugauacucgugcagucccuggagggucucacuggagagacaacauuuaggcugagaucugauuaacaggaggcagcugcagugcagaggucaaaagggaggguguuccaggcagagaaaacagccugugcaaaggcccugaggcagaaacaaacucuacuugaggucagccugguuagaaagcccaacucaaaauagaaaguauuacaugauaaggucugaggcaggcuggacccagaucuuacaggaccuuguuaauaaggaucccauuuggucccccacaguccugagaagcgggcagggcugugggaaacagcagauauuuagugguaagccugagaucagaacccaagucugcacuuccuagucacguucucccuguagugcuaagcccagagaccugagcuguuaaccuagaacagugugcuuccuaagccuuaaugugcauacccaucgccuggagcucgccuuaagauguagguucugccugaagcccaaguucauuuaguaugucaugguuaauucagaguaaaaucaagaguuaguacuugauuuaugcuuguuauauaaagaaagagacaacuucacuguaugaucauuuugucacuuuucaaaagcauuuaauucccauucaauugaaaauguuucaagaacaaaccuguuuggucauuuuauugauauugcacauuuguauaugaauaaauuuuugcaaauuaaaaaaaaaaaagauguagguucugaaacagggugagguccaggauccugccuuucuaaggagcucccauguugugcaguugcugcuggcccggggaccacauugaaugacggcucuacguccucaugccuccagcugcugcccuguacauguccaacugcacggagcacuuuacauccucuaaaaccacaguaaauugcuccauuuccuaaauuaccucuucaagagaagacugguuuugaugucauuuuuaaauaaaggagaaguugaauuucaaaaccaaguggaacaggaa

SEQ ID NO: 191850 - RNA, 108275 nt, Homo sapiens
cggcaggguuggaaaaugauggaagaggcggagguggaggcgaccgagugcugagaggaaccugcggaaucggccgagauggggucuggcgcgcgcuuucccucggggacccuucguguccggugguugcuguugcuuggccuggugggcccaguccucggugcggcgcggccagguggguguccgcgccccgggucgguugggacggcugcuuccuagggacggggcgcucggagugaaccuguggugccugggaguggaggggcccggccuggggaucggacccggggucggggggcgcggccgcuccaggugugugcggaccggggucgcacccgaggcgcgggguuuggcgccccaagcccuucuuggcccggguccucugcccggcaccgcuuccuccguguccuguucgauggagccguucccagcguccccccaucccucgccgccucgcgcgaccccgggucccccagacgccccgaaacccgcucuggggcgggcgcugaccucggcgggccggagcccugcaggcugggcgcgcccgcgggcguucaguccuccaaacgccugcagggagggagcuggcucucgcucguggaguuaaugucgcuuggaaagagacugagagaugaaacuuuugcugcagguuauaauuugaaauuuugacguucaugguauccuugggucaacacagcuaaauuuaaugguggaauaaaggugggugggaggacgcucauuucucuugggucauuuuuguaguaagaauauuuuguaaacgaugugcuaccuuucuauagccaaaccauucuuaaaaaaucuguguuuuuauuggguucguacuguguuaaauccggacagauaaucccugcucuuuugaacucacaggauuauuguaggaauuaaaucauuugugugaaaucguuuuugaauugugaaacugcccuugacuauguaagauacuuguauuggagaugcccaaacauaguggaagcagauugucagcacgcuggcgucuuucuggaaacaaguuguuuauuuuggauuuuguaugauauaauuguuugcauggcuguauuuucucuaucagcgacagaggaugauggagaaugggaguuuuuacuaaaucauugauugaaaguuauucaaaggugaugauagaagauuucaacgcaggacuguugaccuucaggaaacuaauuacuuguuuuucuuaucuuuggcugcuuuauuugaaauuaaguaaauuugccccaguguggaaauguugaaacucugacaauguuuugaaugggaaguugccaaauuucuucugguuaaaacuacuuuuccggugguauucuagaugguuaacacucaccgauguuuaaggugaagacgauuauacauccggaguuuuauuaaucugugauuuuuuuuuguguuuguaaauguaaauaagacuguauuuuuaaauguuaauauaaauugucagucauuaccgaccugcauuaggugaguggaauauccugauggucuuuaacugugguuuuggccagcuccucacuucggcauguguaugccccuucaaaguuuagccaccguuuauggaacuccuauaaacaccacacaguugauuguagaggggcagaaggugaccaaauaugcuaagcgcaucugagagauguuggggaagauuuuuagagaaaauaauauuugaacugggcuacaucggugauuuuucaaguagaauaguagauacauucuaagcagaggaaaguuuuugcaagaguaugguggggcggggggcguaugaaagaacaugacuuuuuaggaaaugauaaaaaugucaauaugucuucaugcagacuauaaaagggagggauggaagaucaaacuaagguagguuguuaccaguugggaagagucuucuaugcugaacuaagggguuuggacuucaccccguaggaaguucuuugggcaguggagguuuuaaguaggggugcgaccuaaucucauuuucuguuaagaaaacgggcaacacgguggaggauagaaucuaggagggagagacuagaggcugggacaccgguuaagaggcuuuuguaauagugugcagugagucaacucuuguuucucucggggaacguucauacaaaaucagcugaccacauuuuugcaguauaagguguuuaaaacgugcacugaaacauuuuccaggaucgaaagaggaauuugagguaccaggcacacgucaguuacauuaggaguuaauuagguuuuauaggauuuuuacuaccuuuuauaacauugucucaaugaggaaaugcaguauaauuuccaaacagcuaacuuucaguaaacuuuuuuuuuuuuuuuaaacugacaaagguaacugugucauuguaaaaaauaagcggaaucagguaugaaaccucuucugauuuucuaagguaguaauuaugaggaacagauuuagaauuuuuuuuuaaacaaagacuggcauucuaaagaaaaugacuuugaaagcuuacucauggugagucacuguaaaaucauuuguguaguaagaacuuagguccauacuaaucucguuuucagaugccagcaaaauauuugaauuugauauguuuguguuugugccgauaggagaauguagccuuuuacauuuaagaaugauuugguuuucaaccuuuuaaguaaaaaagaaagcauauauaauuaaaauauguacaaaccuaguuccugguuuccaagacaguuuucaaaaagcacuugaagcuuuaacuuaccaaauuuauauuugcucuuuguaaaaaaucuggguuuauaauagaauuuauuauggaaucccccaaaagaugcaagcucuaaguaacuggaagcuuuuucuugggaauauccgcaagcucaaacauaugacauagccucauauuucuuuuuccuuuuugguauguaacauauacuggaggcuuggagucaugccauccuuuugagucagcgcuauggaacugccucauaaaugaaugcaguccuuuuguaucucaguagcuaaucccucacagucuuuuuuuuuuugagauggagucuugcugugucgcccaggcuggagugcaguggcacgaucucggcccacugcaaccuucaccucccgaguucaagcaauucuccugccucagccuuaugccuggcuaguuuuuuguauuuuuaguagagauggaguuucacgguauuagccaggauggucucgaccuccugaccucgugauccgcccaccucagccucccaaagcgcugagacuacaggcaugagccaccgcgccccagccucucucacagucuuugaaugggucuaauguggacccaacuaaaguuggguagcacaauguuguuuguauauugagagauuauuguaguuuauuuuccauuucauguuguuauuuuaaucagauuauuuucccuaagugaucauaugugggacacugcuugagucacaucuuuuuuuuuucuuucugagagacagggucuugcucuguugcccaggcuggagugcaguggaacagucauagaucacuguaaccucgaauuccugggcugaagcaauccuccugccuaagccuccugaguagcugggacugcaggggugugucaccaugcuuggcuaauuaaaaacuuuuuuuguguguggagaggcaaucuugcucuguugcccaggcuggucucgaacuccugggcucaaguguuccuccugcaucagccucccaaagugcugggauuacaggugugaaccaccacaccuggccuuaaaucacaucuuuuaagagugagcuagggaaccuuagaaauuaacuugguccguuuuaaaauaugcaguucuguuuguauuuauuuauguuuaugguaauguaaguauuguguuacuaaaccuuacuggaagaaaagaaaaugauaucacccccagacauguuauaauguagggcagaacucaaagggaaugggacguucccuuugaugaauuguucuuuuaaugagauuuuucaugauuuaagucauuuuaggaugauuuuaacgucuuccuucuaguaguguagaaucuucauaugaguagaccccaggagagccugauucuaaucagucuuauugaaaggcugagaauccuguugugaagauaucuugggccuaaccucccaucccagccacuuaagagaagugauuaagcagucuguggauagcaauacaaugaaauacgauuuugcuaucaaaaugacaaauguguaggcuauguagauuuguagaaaaguugauacaaaagauguuaaucauaaaaaguaagguucacuuuaagucauaugugauaauuacaacuaucagaacuauguuuguuuagcuguaaccaucagaagagguuauuuauucaacacauauuuuauugaauacguacuguaccagugcaggaaguacaugaugaauaagauaccguccuugaucucaaagaacuuaaauucuuugcuggaggaacuuaaauugucuagggcauuaaaucuuagaaaugggugguguuuuucccaaagggacacuuaaacaaacaacagaagccauuucuuuuuaaauguaaagauggguaaauauuuaagaaaaguguaacacuaaaaaaaguaagaguguagaccuagcaguagaaauuauaauuaaguauguuugaagguaguuuuuuuuuuuuuugagauggagucucacacuguugcccagacuggagugcaauggcucgaucucagcucacugcaaccucugccucccagguucaagcgauccuucugccucagccuccugaguagcugggauuacaggcgcgugcgccaccacaccuggcuaaauuuuguauuuuuaguagagacaggguuucaccauguuggcaaggcuggucuugaacuccugaccuugugauccacccgccucggccucccaaagugcugggauuacaggcaugagccaccacgcccagcccaaagguaguuauuaauauacgguauguauuuaucuggaauugaccuggcgaauacuagaaugauuaaaaaaaaaaaaaaaaaaaaggcaaaaacugcaauuacuuuugcaccaaccuauuauauggcucgaaauaauagugcuuuguagaucuaauugaaacaauuucucuacaagaaauacuuuggaaacagaauuaucuuauuuauccugaauguggaggccagguuuauuuuuauuuucuacaguggaaguacuuaaaaguggcuguuuguuuauguaguaggcaggagaagcccaugguuuggaguucacauuuguuugcuuugcaauuagguagaauucuuuuuuuuuuuuuuuuuuuuuuuugagacagagucucacucuguugcccagacuggggugcaguggcacaaucuggggucacugcaaccuccaccucccagguucaagugauucuucugccucagccucccgaguagcugggacuacaggcacgcaccaccacgcccggcuaauuuuuguauuuuuuuuuaguaaagacgggguuucaccauauuggccaggcuggucuggaauuccugaccucgugauccgccugccucggccucccaaauugcugggacuauaggcuugagccacugugcccggccacaauuagguagaacucuuuuaacucacuucccuguacuacaauuacuauuaugaaaagugugcucagacuuccucuaaaacacacuacaguguauagaaagaucuacggaguuagagaaagaaagaagugcaacuaacaccuuuuccuuucuuuaagauuagacauguuaaguuucauguuucagugguucacguuuucucuucaggccguuuucucuuuuucuuuuuuuuuagacggagucucccucggagguugcccaggcuggagugcaguggugcaaucucagcucacugcaaccucccccuccugggcuaaagugguucucagcucacugcaaccuccccauccuggcucaaguggucucgugccucagccucccgaguagcugggacaacaggagagcgccaccaggccuggcuaauuuugcauguuuuguagaggcaggguuucaccauguuggccaggcuggucucagacucuugauaaaauaaaugauuaauuguggcauuuugguuuucaaaaugagaauuguguuuaaaaugcaaaagagggaaagaaaguuauauguaaucuuccuauauuuagcuuuuauuuuacuucauuggcagucuggguaaaaaauucauagaagacagaagacuugguuucuagucuuggccugaaacuuuuagcugucacaacugggggaugcuguuggcaucuaguggguggaggccagggaugcugcaaaacauuccacaguacacaggacagcgcccuuacagguugaagguuuauacaaauaauauuaaagcucuuuuuuuauauuaauguggaaaaauguuauuuugguucccaugagaaacugcuacuauuuggaauuuaaaaaaaaaaaaaacaacuaaagggaauuuggggaaaaucuaugcaggauaugaacaggaaaaaagaaaaaaaccugaccuagagauaagaaaggaauuuugggaaaaaaacaugggaaggaggauuuucauacaauuaguauguauuauuuugaugacauucccccaguaugugcauuuguuaugauguuuuggaacuuuuuauggcauggcuuuaauucagaaagugguugcuuggauuuuagaagcaagaugucaauaucagaauaacagcccuuacacacagaaauuauuucagggugcuauaauuuugaaagucuuuuaaaaauaagugauuaguuacggcauuuugcuuuucaaaugagaauuguguuuaaaauggaaaagaaggaaaaaaaguuacguauaaucuuccuauauuuagcuuuuauuuuacuucauuggcagucucgguaaaagauucauagaagacagaagacuugguuucuaguuuuggccugaaacuauaaguaaaguaaacuaacuuugccuauaaaguaacugaaccuguuucaaaaugaaagcucuuuaaauaccugccugcccauaagaacuacagaugcuuuauuuuuggaggcauuucuuuuucucuguuauguuugguucugaguuguaacgaaaaaacuucaguuugguucuauauuguuuagcuucuaguguaacaguugucugugucuaucagcauauguauucuuuauuuuuuuuuuuuggcagggucucccucuguugcucaggcuggagugcaguugcauaaucauggcucacugcagccuugaucucccaggcucaggugauccuuccacuuuagccuccugaguagcugggaccacaggcaugugccaccaugccccacuaauuuuuaaauuuuuuugaagagacagggucuugcucuguugcucaggcuggucuugagcucuugggcucaagugauccuccugccuuggccucccaaagugcuaggauuacaggguugagcuaccaugccuggccagcauauguaaucuugucuguaaugauuuacuuaaagagaauuuuuuuuuaaaaagugaaagcauguuuauuaagaaaguaaaggaauaaaagaauggcuacuccacgagcagaacaguggcacgggcugcucagcugaguauacugauaguugcuucuugguuauaugccaaacaagggguggauuauucaugaguuuucugggaaaggggcaaggauuuuuagaccauauaagguaacuucugggcauugccauggcauuuguaaacugucauggugcuggugggagugucuuuuagcaugcuaauguauuauaauuagcauauaaugagcagugaggacgaccagaggucacuuuccucgcagucuugguuuugguggguuuuagcuggcuucuuuaccgcaaacuguuuuaucagcaaagucucugugacuuguaucuuguacugaccuccuaucucauucugugacuaagaaugccuaaccuucugggaaugcagcccaguaggucucagccuuauuuuauccagccucuauucaaguuggagucagucuggucugagugcugcugacauauuuucccucauccuuuuacaugggaaccuuaauccuaaagauuguagagggacaaagaucuaucuucugugacuucuucaggcugaauaggggcaaucauguuccugccuaacuauaggguaucuuguauccgggguagagaggagcucagucacacaacgucauuaugcugagggccauucacaacucugaguucuguugaguucacaacacaaaaggugauaucuagaagauuaguaagauuaauaauuaauaaguguucaauuuaagaaaacauucaguaagcuuauccugcauuccuacacaaagauuacaauagcaauauauuucaugacaguauagcaaauaaguaaaauuauuccaaguaaacuaaauagaaagcuguuccaugaacugggcaauuguuggaacccagcugauauagggucacuaacugauuccaauauaugcccagaauuagaauacugauccagauguuaacauuagccaucccucuuguuuauucugagcugcaguuagagaucacugauugguucacugaaauaagcagagucaguccaaauugcagggaaaaacucagaaacaacugaugagacuagaauuuaaugucagguguacuauaguucuugaaacguaauuuuucccuuuccuguccuccauuuucauuaaaaacaaaucaugauaggacugauaggauaugauggguagcaaaauaagcuuuagucuuauuaugcuuggccugauuguuugaaauaauugcaguaagaauaauuauuugccacauaggcacuuuuuaauuggcuuugauggaacuuuguuccauaaggaaucucaccugagauguuuuuuaaagcagagcucagccauggguuugcacaguuaaauacagguaugaguuggguaaauuccucuccucuugaggucccaagauaacuugacacaccugggacuguagauagugacagucuuuauuuacaacagaucaggaaccucguacagggacuguguagacaagguauguggccaguuuucucaaggggcuuuuaucgguucuauaaaucaaguuugauuccuuaaaggaaagcacaacauuccagucaaaacuugguaaaauaaccaguuucuccaguuguguccugugcaaaagaaaacagauucuuacagaaauauaagggauugauggguaaagaguuuaaaagcuguuuauacaugcaguacauuggauaugauauaauuuaugguuucuuguuugcagcuguuuguaucuuuuuaaucccaaaccagacaaaauuauaaacauuuuauauacaauguuaucuuggaaaaaguuagauguaaauaauucaucuuaaucuauauuugagaaaucugagggguauuaggaaacucaugagugaaugaacauauagauuggaucaaaggaggagaguaugagaguagggagaccagguaaaaagguaucauagucaucuagaggugagguuaguaaggguuaagccauugguaauaaugcuggaagaaaaagagguuguguuggacuuaucgagagacuauguauuggacucccacauggugugucuuccuaagagauuuguguuggcaauuuugauuauacucaauuucaauucaagugaugacuuuagaacccaagcccugcuuaagacaucaugauuccaugcggauagacugaacagaauuggaaaugggaguuagucugcaugacuuucagagcucuuaacuguuaagaaauuuugcuuaaaauuuguguuuuugugauggauuaauggcuauaauuugaaagcguggcuacauuguugaguauguauuugucagaguuaacccaucagauauuaaaaguaccuuuucccucuuacaguccuuguccauuuaauaagugucuuagucuguguugcuauaaaggaguaccugagacuggguaauuuauaaagaaaagagguuuauuugauucacugcaggcuguacaggaagcauggcacaggcaucugcuucuggugagggcuuuaggcugcuuccauucauggcagaaggggaagcggagcuggcggguacagaggucauaaggcaagaggaagcaagagagaugggggagagaggcucuuuuuaacaaccagcucuugagggaacuaauagaacaagaacucuuucuccuacccuggccccucagggauggcauuacucuguucaugagggauccacuucaaugaccccaacaccuguuacuacaccccaccucccaacacuggcacacuggggguuaaauuucagcgugagauuuggagaagucaaacauacaaacuguagcaguaaguauuuaguaguaucaucugagaggauguuauucaugcugggugagggggaggaaugggagaugagugaagggugcuagacucuaggaugccuuucccccauuuccccaccaaaccaguucuuuucuuucuucuuguguuuauaccuuaagauuucuuuugagaaaaaaggguuaggguuuauagcuaaaaauguuugaaaugauugcuauguauauuuauaauguuuggauaaagacugauauucuuuuuuaagaaaauacauuuuccucccucauacuuaccuaaugcauugcuauuuucauguauuaauacaacuuuauaugaguacuuuuauuauaugcauauuguaauaugggaaugucaggugauuuuucugugauuugaacauuuugauuuuucauuauauuguguucccacguaguuuuucaguuucacuuauuauauuuguuuuugccuuuucuguaggcuuucaacagaccucacaucuuucuucuuaugaaauuauaacuccuuggagauuaacuagagaaagaagagaagccccuaggcccuauucaaaacaaguaaguuauaauuguugagaaauaauaugugguuaauuuuuuucuuuucuguuuuagcacaaagguguuauuuguagcagugaucaguucagugaguuauuacuuggcuguuacuuagaauagcaccauaugguacugauguccccuggauguuaugcuaguaaaagcaacauauugagccuuaauauccuuuuuuuuuuuuuaaaauggagucuugcucugucgcccaggcuggagugugcaguggugugaucucggcucacugcaaccuccaccuucuggguucaagugauucuccugccucagccuucugaguagcugggacuacaggcaugugccaccaugucuggcuaauuuuuugguauuuuucaguagagacaggguuucaccauguuggccaggcugaucuugaaguccugaccucaggucauucgccugccucggccuugcaaagugcugggauuacaggugugagccaccacgcccagccaguaucuuuucuuuuuuaaagacaauaugaucaacucgaaacauaacagaauagaauaguuaaacaaaauuguaucacuaggguaggcugcugauuauauacauuuuaacugacaggcaauggucacagugauuuuauuauaauaagaauuauaauucuuacuauaauuauauaaccucacucaguuugugauagcuagaacacuuuauacuauaucuucacugacgguggagagugauaauguguuaaaugcguauauuuuauauuagggaauauuuacuaaaauacaaguuuuauuuucauauuggaagaaaccuacugugcuguaaaugggguaaccagugcacaaaaauuauuuuuucuacuauucuuuuguaaaguuuguucagaaguaaucuuauuuggacuuuaauuuuauaaguccuucaacuuuauagaaguauaauuaaauuuuauuauaauuuaacaaugacagguaauaaugcauagaauuuagcuuaugaauuguauuaauaucugaauugcugauacacucagaaauguaaggcagcgugccuguuuuuuagggagugggcauuguaaaaagaacacuggaguugaggaucaggaacuuuuaguuuugguccucccugugaguaccaccaccuacuaguuggguuggucacucaacuccauuuacaucucuccaacugaggaguaaaugacucuaagaucuccucuguagaugaauuuauacauuuuacuuguuuuugguuugaacugggcagacuaccauuugauuauguuuugucuuaggauagaguuaaucaguuaaucccuguuugggugcgaucuuggcucacugcagccuccgccuccuggguucaagugauucucgugccucugccuccugaguagcugggacuacaggcaugugccacuauacccagcuaauuucguaucuuuaguugagaugggguuuugccauguuggccaggcuggucucgaacucuuggcuucaagugauccaccugcuucagccucccagagugcugggauuacaggcaugagccaccuguuuuccuccuuuucuacagucaaugguagacuuucagccuagggaccauguuuucuccuuuuuugugucucugauaguaucuucauuuaguacuucccucauuaauacuugggaucgucauagauaauugucauuuuuaugcuuugguuaauauuuggagaagugauauagucagugcauauugaacuggauuuugcucauucaacagugaauguaauuaacucguuaaaaaguauuuauugaguuacuauuguaugcuaggcaccauuuagguauuggggauacggcagugaacaaaacagacaaaaauuuaugcccuugcaugaaugcagucuuguauucuauggagcuugcauucuagugauggggggggggggcagggagagagagagagagagagagacaaaaacaaaaacaacaacaacaaaaacaaacccccccccccaaaccaaaaauguauauuacuucagauggugauaagugcuauggagaaaauuaaagcaagaagggggauagggaggcuggaaauggugaguugcuggggagaggauugcauuuuucaguaggauggccagggaaagccuuacgagaagguagcccuuuaguaaagacuagaaggaggggggugaacaauccaggcagauacuugggggaggaguaaacuaucacaaaacaaucuucaguuucucagauuucuuuuuaguagacauagcagugauguuauuacaucacgugauuaucuaagagcagaaugaguagaaaggcacaugacaaagcuguggcaauagaaagagcuuggugguuuugcuggcccacuggagacugagguagaugaugaaggguucuuggauucccaugcaggauguggagguggaugacaggauccauagguuggucuagcgcuuagaagucagaggcagaugugccguggugaagggguugaugcuguuucuugacaaaagguuaacugagucuggaaacggaagggaauauuaaguagacacuucugauaauguuaguugucgagucccuccaugacuuucuuuuuuauuaaagaguuaaggcgaagucacaucucuuaguuccagagaucacguuaagcacuuguggcuaaugacauggugaauugcuggggaaguuguuucagaguugccugagguagagaagaugaucccaugaauuggaggauguguauauauguuacuuuaauuccuugacucuaagaugccaucaauugugagacacaccauauuguuuuauguaccacuaauaaagacacggaaguggcccagcagggugguuuaugccuguaaucccagcauuuugggaagcuggguggaucaccucaggucaggaguucaagaccagccuuaccaauguggugaaaccccgucucuacuaaaaaugcaaaaauuagccggguguguugguggacgccuguaaucccaguuacuugggaggcugagacaggagaauuuccugaacccgggaggcagagguugcagugagccgagauugugccacugcauuccagacuaggugacagagugagacuccaucucaaaaaaaaaaaaaaaaagacagaggugcugcuaguuagucuagacugcuuugccuuuguaugaugcauccucauuucaaggacguuaaugugagggaaaaaagcauguuuuagaauugauaaaaugagguaagcccuguaauuuguaucauaaaaggaguugaauuucuuuuuaacuuuauauaaguagaacuagguauaauuucuugaaaccaagaguuucauuucauuuagacaaaagcaggaacuaucuuuguacuguagguaauacaucgauggacuugagaagauaaucccugcaguuauagcugaauuagaaaugaauuuaagaagaguuagauagacaugggguuauuuuccaugaucaguuaugaaaggaaggaagggaugaucagaguauauuuuuuauuauuuaagaauagacacaaaguucuucuauuaaauaguucagccaauaccaaauuauuuuaauucaggauggaauuuccugcaucuuauaaaugagauguuguugaaaaguaauuuuuaagaugauguuuuauucuuuuccccuucugugcauuuagguaucuuauguuauucaggcugaaggaaaagagcauauuauucacuuggaaaggaacaaguaagacauuuaauuuauuuuggcuuuucaguaauguuuuuccaauaguauauugguuuucuuucuaguuugauaugguuuaguggauccugaacccugggauuaagcagauuuagcucuucauauuggugcugcacaguggcagcuggcugggcaggcagugacuucuaaacaggaaagaaggcagagacuggaaccaaguaccuccaguuuauucuuuucaaaugcaucacuaagggagcaaaggcuacacauaugugggggaguuggggagaaggggagccugcagugacugaauaggguccaauuacuggaaagacuaagguuccacaggcuacuucuaugccuacucacauagacuuuaauaaagguaaaggauauaaugcaucaggacaaagaaagugcaggcagucaucaaggcaugacccccagaguccuuucucaguugcacagaugugcuuugccuccagauuaugaaccgcugagauaugugugaggcaucauauuuucuggggagcccaggcacaaguuuacugaagguaucuuuccuacuuugcugaucauguagcuaaagucaggcuguguaccuaacuaaaucggacaaaaaccuuccauuuauucaucucuagucaauauagacaggcugucaaccauuguggaagacaguauggcgauuccucaaggaucuagaacuagaaauaccauuugacccagccaucccauuacuggguauauacccaauagauuauaaaucaugcugcuauaaagacacaugcacacauauguuuauugcggcacuauucacaauagcaaagacuuggaaccaacccaaauguccaacaaugacagacuggauuaagaaaauguggcacauagacaccauggaauacuaugcagccauaaaaaaggaugaguucauguccuuuguagggacauggaugaagcuggaaaccaucauucucagcaaacuauugcaaggacaaaaaaccaaacaccacauguucucacucauaggugggaauugaacaaugagaacacuuggacacaggaaggggaacaucacacaccagggccugucgugggguagggggaguggggagggauagcauuaggagauauaccuaauguaaaugaugaguuaaugggugcagcacaccaacuuggcacauguauacauauguaacaaaccugcacguuguacacauguacccuagaacuuaaaggauaauaauaauaaaaaaauauauagacaggcuggucccgggugccuccaggggaguuuugaacuugaaagggcauauuuaugaaucacuaguuagcacauuacaucucugacuuguccauaaggccuggaaauaagcauacagcugcuccaguccugcugcaagagaacgugauccucauaaacaugcuugaugccacugaaccuccuuaacauggagugaagauuuggaaaucaggaauaauuguuucuuucaacaauugagacagaaauuugccuccauacuuaggagguuaauucuuauuuauauagaacuuuaagaaaagaguguaaaaaaccauuuauuuuucuaauguaaauaugauauacugucaauaacccaguuuuuacuuuuccugugagccauaucugaaaaauuuagggacauuauuuauguugucuuaaauuuuuuggaacuagcauuuuaagaccauuacaaaauguguagcuuaauauuaaauauuauuuaugaauaaguaauguacacuauuucagaguuguccguuuaugagcuuuuuuuuuuucuccuuuuuuuuuuuuuaagagacaaggucuuacucuguuauccaggguggagugcagaggcaugaucauagcucacugcagccuugaacuccugggcuuaagcaauccucccaccuuagcuuccugaguagcugggacuauaugugugugccacuaugcccagcuaauuuuuuauuuuuuguagugacagggucucaccguguugcuuaggcuggucucaaacuccuggccucaagugauccuccuaccucagccuuccaaaauguugggguuacaagugugagccacugcacccagcuguuaugagcuuuuaauuuuacaauagcacauuuaaaaauaauuuaucuggugaaaguucuuauuuacuccugcuugucuccucuaggaauaaugccuuaugaaucguguccuuaguuguagauagauaacauauauauaaacgguguuuuauuucucuuccagagaccuuuugccugaagauuuugugguuuauacuuacaacaaggaagggacuuuaaucacugaccaucccaauauacagguaauguauuuuucucuugaucccauagcaaauuuuaaaacaauuauaauuuaaaaaugaguucuguauaggcacucaggacuguuacauugcacagccccacaggguaccuuuaacauuauaacauauggguuaucuugggaaaagugggugcauuucuauagacuaagcuguaccuuacagcucuccagguacucaguaguuaagguuuuuuuuuuaaagacuaggaaaauaaaucuucuauuuaaugguaauccuuacugaugagaaaauuugauauguuuugaaaauaggaguuucugauuuuuuuguugaaaguuaauaucucuaaaagugcacuuauuaaaacauuuaauuugucagugauauuuaguaaagaaaaacacucauuugauguuauguguucuaauguucuaaauuuuuucugaaaauaauuguuuccuaaaagaggugugguccucucugcaucagagaacagaguacuccuggggacagagcuggccagaauacccaaaauaauuggcagaugucaaauuuggcuuucuguguuuauuacuagagcauaaacauuucuaguuuuguuugaguguuuuacaguccuuuuuggcaguuagguauuauaccuuuuuuucuuuugcaaugguuuucaugagaaaucuuuauucccauuacauguguauguuuuauuuuucuucugaacuuuguaauacuuugcuauguugaauuguuucuguugguagcgcacuuuugcagcauucuucaaauaggaggcaaaaaaaucuuuagauuaauuauuaguacuuacaaaaaccaaggaaaugcugacuuaggccuaucuucugguccacuaucugauuucuuuaucuuaguguguuguugguccauuguuuaauagaaaauuaguagaggaguuugaauuuaccuuacagcauaaaccagauagaaaauaacgcauucauccagucaugcauccaaugauuaccaaggcagaaggccaaacaccacauaauuugugucacuugacaaaagcaguaauguuaaaaggcauuuuuuuccucauagagguuucuuggcauacuuucuucagacauacacuguuugggcuugaguuuugacucauuauuugcugaugaagcuacuuuaaucuguuugugccuugguaucuucgcuuuaaaauguaauaauaguuaccacuuuauggauauacugggaaacuuaacugaguuaauacuuacaagaugcuuagaacagucugacaauuuuuaacucaacgaauguuauuauuuguugcuauuauugacagcguauguucuuaaaacugccaaaaauugauuuaauuauauagaaacuuauguaacuauuaucuuauauaauacuuaaguaucauaaguaugauagaguuaugcuuuucuggguguuugaaaaaugucaacuaagacagauggugucucacuuauuucuugguuauuuaauauuguucaguuagaugaaagugugauuguagauuugaaauacaaaauaaaacuuggauacugugauuuuuuuaacauggccagacugucauguauuauaaugacauauacuuuuguccauaaaaugaaauuaaguuucacugaaaaauuuacauacuuuccccuggggauucuauugcuucagauuaaaguuuauaaaguaucauuagugucuuccacagggucauuuuacacaaacacaguuuuagugagaugucaacuggcuuuuguugguuguuggauugacugugauuuaaaauguuaaagaugauauaaugcaucuuguucugcuucuaggcugaaaggucacugaggcagagcuguuuguaccuuguauccccuggaauuuugccuaaacauuuguguacucauagggugguaggagauaguccgcagauggucuaaagaaugccaugugauacugugagaugccaauaauauaaauaaaacuuuguuauuauuaaacuugacuggccuaaaguaauuuuguuagcucugcaauuucugugaugauuuucagcaauguagcaauauuugaagauaauacaguauuuuucauuuagaaucauugucauuaucggggcuauguggagggaguucauaauucauccauugcucuuagcgacuguuuuggacucagguaagcaauuuccuuuaucuucuuuuuuuuuguuuccccuaugucuuacccucuuuccuguuucugucuccaaauuaaaucauuuugggcacuuagcaaaauuggaauuuacuuugauguuacugaacauuuuuacagcuguguuucagauauccuuggcauguuuauuuaagaaaguauuauaguugaugaguuuuaauauguaaagaggaaauuuuuuuugagaccacuaaaucauuuuugcuauuuaaaaugaaauauacuuuaaauuucuguagcacuuuauauuuauaaaauuuucacuuguauuauuuaagacuuguauuuaagucuuauuaugacugugaauaagagcucauuaucucuguauuuaggugagcaaacugaaguucagauaaauuauauuacaauucaaauuaaguuauuauaguauuaacauuacauuccuugaggucauggcaacauggcacugugcugguugguugacugcaugauugcuugaacuaaaacauauuaguucuauauaagaugaauaugauuauauucacuuaggcacuaacacuuauuugguaguuacugugugccaggcaauauguuccguguguuuucugcuuauuaaguaauuuuguuuucagaacaauccugugcagagugcaaaccaaggcagagguuaaauaccucgcugagaguccugcagcuaguagaagacauuuggaauucagacucuuguccucugguccggaugccacauucuuagccacuauuuuguagugccuuccauuucccguagaucacucagggagguuaagugacuuacaggcagugacgcugcuaaguagcuauuugagcuuucaauuuagguccgucccagcccuaucugucugauucuaaagccucuauuuucuucucuauguaaugcuaugccuacuuacacauuuaagaauuaggacuugaacuuagguuuucugauuccuuguguauuuucuuuuucuuaaaauuuguauacguguaaugcaacauucagaggauugcugcauuuagagaaugcgaguuaugggauugaaccccugcagaacagcucucauuuugagcacaucauuuaucgaauggaugaugucuacaaagagccucugaaauguggaguuuccaacaaggauauagagaaagaaacugcaaaggaugaagaggaagagccucccagcaugacucagcuacuucgaguaaggaaauaacauaauucuucauggcucagacuaccauuuuagaaaaaucauguauuuauucaugaaaucaauacuaugaguaguguuuuuuuuucuuuucuuaauuuugccaaauauaugccagacauugugauagguacuaggggaugaaaagaugagcgauauauaguuccugcuaccaaguugaguacaguuuagauccuguggguuuuggaaacuaggacuuaaaucugcaacaauguucacuguggccuugaccucuugagcucaagcaauccuccugccucagcaucccaguagcuacugcuacaggucugugccacccaccgugccuggcuaauuuaaaacaacuuuuuguagagaugaggucucauuacauuacccaggcuggucuugaaccccugguaucaagcaauccuccugccucagcuucccaaagugcugggauuauaggcauaagccacugcacccagugcaauagaguuuuuauuuagguaccucuuagacaacucaaauggugauucuugaacccuagauuggaaaaagagagagauacggcuuuaggaacuuaaugacuucagauguguuucaaggacacucugcuaaugacuuuaagugaugauaaacuaugucugagucccucuuuggagacugcuauagcacuucaugauuuacucuugacaugggugucucuuagacugaaaugguucuaggacuagaucaacuucagcugcagggauuguaccuuucuacauaugagauucuguugcugccuugaaagaggcauauuuuuaauuaaguuauacuaguuuauggcauuauuuuuauugccucugcugcuauccacucuuuugacuugggcuauucuuuuuaacuuuaaacauuggaaaacauuaaaauuuuugcuuauucuacuucgcaugaauuucuguaaaaugacaaaacuagucauuuuuuaaaauggcaaccuuauucuaacuucugcucugggauauuaguggauauguuuucuuuaucucucagcauaguaaugggcuuuuucauuaaaauauguguguguuugcauguguguguguguguaguuuugauuuuagaaaauugguaauucugcuuuguaaacuuaaacccauuuuaucuguaacuaacauuuuucucauauuagugcagauagcagauaacacuucaaaaacauuuuuuuccccucagacauaguuuaucaucacuuaaagucauuagcagaacuggacaaaguuuucaucacuaagaagcagauaacacuucaaaaaacauauuuuucacuuucuugauauaggauauguuaaguaaaauaauuuuaugauguucuuagcagacaugaaauaagugaugagagauuaggaugugaucauagccuuauaacuuccuuuugccuuuaugauguuuguguuuuugacagagaagaagagcugucuugccacagacccgguauguggagcuguucauugucguagacaaggaaaggguaagauuggugacaauuuuucuucuuuuccaugaaaaggauaugagaagugagcauuuaaugaaggaaaucuaaacuacacauuguuuguauugauuuuacuuaaauaaugauuuuaaaacuaaaaugguuuuuuucccuuaaacuuuauaccaccagaauaccaacagaagcuaaauguagcaaaugugacugccuuuaacuuuaucuuuuauuaaugauuuuuuuuucuuuuucuugcugaugacuugcuuaugcugaauuuuuugagugaaucuguacugccuaucaggcucuugagaacuuuucagauuacuuuaaugggcuguggcucuaaaagguuuggcuuuguuggcuaauaaaauugcuuugcuuucuagaauuugagauaaccuauauugcacuuugagagauggaaaaccuccagguccuggcaugcuuuagaagggaauaguauuaauuuccguguauaggaucacaugagggcauuuuccuuauuuauacuuaagaaacugaacuaagugcuuugcuuuaacuaagagaaguaaugugucccuauuuuggcauuuacaggauuaucaguuuuagagauaauggcuguauaauuuauuuucauguugcuuuuuuuauugauauauaauacuucacauguuuaggggguacaggugaguauuuguuacaacagcuguguaauuuaaaaaagagaguauuuuuaguguuuuguuugacuuuuacuuccaacuuuguugucagugugaaaaaguuauuuguggaaacuuacuaugauuggcaguuccuuucuuguaagcuguagagacaguuuugagguuuuuuuugguuuuaaaaaaauuccuuguuguauguagguuggaaaauaacaagccaccccaaauaacuaauuuggagaaaauauuaagagauagacuuggauuuguacauuauagguucauugcccucaaguggcagaaggaaaagcacauggaauaugaacaagugugaacucugccccaaacagugggcaaaaagcuucuguagaagaauguuuuggacaagucacaaaagucaagauucaaaauguuuuccuuggcugggcgcaguggcucacgccuguaaucccagcacuuugggaggccgaggcgggcggaucacgagaucaggagauugauaccauccuggcuaacacggugaaaucccaucucuccuaaaaauacaaaaaauuagccgggcgugguggcgggcgccugugaucccagaacccgggaggcggagcuugcagugagcugagauggcgccacugcacugcagccugggugacagagggagacuucaucucaaaaaaacaaaacaaaacaaaacacacacaaaauguucuucuucauugcugucuccagauguauuuguuauauacagauagaaaaugguuaaaaaaaagguucaauuucaaucaagcccuaucaaauauauuaaauuaauuuuuuuucuuguuuaggaggaucaugauuagaucccuaacugauaaaaucugauauauucugauacuaaugcuuuuagcauagagcaaaaucauaaauccuuuuaaaauuuuucuucugcuaaauugguuauauaaauuaauguuaaaaauagacauuucaguuuagccaggugucaaagaaaaauuagucauauuuauuuggcuuaagaugguuaaacuuuuauauauuuucaucuacauaugauuuuuuaacuagugauuauugguuaaucucucauuuuuaauucagcccagcauuuagaaaugguuuauuggugcugaucuguaaccaaucuggcuguuucugucucaguucuauuuucuguaugucacuucguuuuucuguccauaaaucuucuuccacuauguggcugcacagagucucucugaaccuguucugguuuggaagccacacaauucuugaaucagucauucuuugcucaacuaaauucuguuaaauuaaaaaaaaaaaaaguuuauugauuacaucauuagcuuaagaggugaaagggucaggaaguucuuuagauugucuuuuauucuuuuaucuaugcauuuugauugcuuaaaacucuaccuuugugaaaugcuugaaaauauuuuugcauuaaaauaaaaggaacauuaagaagauaauucguuuuaaaguucuacuaauuuggauaaaaugaagucuucagugcucuuucauuauuauucacuuuacccuuuuaccuguuuuucuuuuauuccugucacuacaauguaaccuuuaaauuucuuaauuugaaauguugauaaaugucuaaaugccucaauuuuuuguucagaggaaauauuuggauucuucauaguaacagacacauuuuuauuuuauuuuuauuuuuuuugagauggaguuuugcucuuucucccagacuggagugaaauggcgggaucuuggcucacugcaacuuccacccccacggguucaagcgauucuccugccucagucuccugaguagcugggauuauaggcaccugccaccacgccuggcuaauuuuuguauuuuuaguagagagaagguuucgccauguuggcuaggcuggucucgaacuccugaccucaggugaucuacccgccugggccucucaaaaugcuagaauuacaggcaugagguacugcacccggccuuacauuucuauucuuaaaguacuuuggugauaaugauucuccuucuuugcuuuuccaguaugacaugaugggaagaaaucagacugcugugagagaagagaugauucuccuggcaaacuacuuggauaguguaaguuguauuuucuaucaaccaggaugauucuguccuauucuuucagucccagaacagaacuuaaaaaugucucauuuugaguucugauuuucauagggccucaaugacuuagucuuucagaggucugcuuucugguuuguuuuguaacucuuuuuaauguuuaaaggaaaguaccaguguagaaagacugagaagagcaagagauuucauauuagcaucuacuuuaucuucagaguugcuaggcuuaggugcuuuggcauuuauggaaagaucuuugaauuuuugucgaaugcaucuuauuuugaauaaggcugccuucuacccugaaaacaugauaugacaauauuugugugugugugugugugugugugugugugugugagagagagagagagagagagagaaagagaguguuugguuugagauuuuggaguucauccggugggagauauuaaagaauuagauauauguucuuauaauuuuaucuacaaagcugauaugaacauuaaacgugaugaugacgaugaugaugauagcauucacuugaguacuuacagugugcuagacacugagcuaagugcuuuacauuuauuaacccauuuacuccuuacaguaccccuaugaaauuaugaguuccacaguccuuuaucugaaaccucugauguaccugugauuaaaauuuuagauaaguuuagaaaaacagugugauuaacucuguauuauauaacaccuucgacaggaucuugggguagcaccucauaaucagacucauugauauuucugcagugaaauauaggaauauuuacauuaaauagguuaaauguggacuaugaaugggcuugcauuauaucagggcaaauuuuggagccaguuuuaccaaaaacuuaauuuccagaguuugucagauuuuagaauagaagauaauaaggauuucgaaucucuguuacuauuauuuuaugguugaggaaacugagacuauugagagguuaaaguuuuauuguauuuuuuuuuuuaugagaugagucucgcucuguugcccaggcuggaguccaguggcgcaaucucggcucacugcagacucugccucccagguucaagcgauucuccugccucagccucccaaguagcuggguuuacaggugugcaccaccacgcccagcuaauuuuuguauuuuaguagagacgggauuucaccauauuggccagguuggucuccaacuccugaucuccggugauccaacugccucggccucccaaaguguuaagauuacaggcgugagccacugcgccccgcccaaagucucauuguauuaaaggaaagauaguuuuuuuuaggcaggggaguuuuaauuuaaguagccguguuacuucaugugguuaaaagauuuuucucacguucuuuacuauauuuuauauacuuuuauuucuuucuucccagauguauauuauguuaaauauucgaauugugcuaguuggacuggagauuuggaccaauggaaaccugaucaacauaguugggggugcuggugaugugcuggggaacuucgugcaguggcgggaaaaguuucuuaucacacgucggagacaugacagugcacagcuaguucuguaaguauuuuuuuuuuaaguacuauuaaugaaauaaucaaaauaauaauuuuugcuuauuuucuuguauuagaauuauauucucuugagguuuugggguauucauuuaaaugaggaaaacuuagcuugauguggcauuaucaugagaccucuucuguuuuggauuccugugaccuuucucccauauccuccuuuuuucuugaguuuacauccucauuuggguauagugugcuuuguacuaguuuuuugugaacggauauauagaaagaaaacauuuugaccuccugugugucugaaaauaugguuucccaguuucggaacagaauugaaaaauuaucucaauuugaguucugauuacucuaggccuaaguaacucaguauuuccuaggcaugcuuugaguuucuuuugcguuuguuuuuuuuuuuuuuuuuuuuuuuggagacagagucucacucuguugcccagaccagagugcaguggcacgaucuuggcucacugcagccucugccucccaggucgaagcaauucuccugccucagccucccgacuagcugggauuacaggugccugcccccacaccuggcuaauuuuuguaguguagcagagauggggucucaccauguuggccaggcuggucucgaacuccugaccucaggugauccaccuguuuuggccucccacagugcugggauuauaggcgugacacuggguauaaaauuguauccgugaaauccuuuuucuucacgacuuugaaggcguugcucuuuugucuuuuuugucccagcauuacuauugggaagucugaaacauucugauuccugaccuuuuguauguggccuguuuuuccccgucacuggaaacuuguaggaucuucucuugguucccaggcuucugaauuuuccugaugauguguuuuggugugggucuuaauuuuuaguaaaaucguacgcucacacauccucguaccagugagaaugccaucuaguucacaaaauaccauaaggagcaggugucaagcauacucacuaugccuugcccaaccacacccaccaaacuaucuuaacccccucucuuuguguggucuccaucuguccuguuagagacauuucccagaugcuugaugauuuuuaguuguuuguuuacaguugagaauggggucccgaaaaccuuuuuggaagccuugaguccaugagugcauuuuggggccuaugaguuccuuauagggugguuuggcuggaauguccuugucaaucuccuuaugucaguaccucuggucaucuucuccuggcuggucagauggcccagagaaggauuuauccauucauuuaaaauauauuuauuggguguauaccccagacacugggacauagcagugaacaaaacuggcaaaaauuccugcucucauggaguccauguucugguggaggagauuggcuauacaugugauaaauaaguacauguaguauguuaaccaaugauaagugguaaggagaaaaauaaaacgggaggguagauauaaaagcauuggagguugugauuaaaauuuuagauaaaaguuuagaaaaacaguguuauucacuguugaauuuugaggugacauggucuagccagggagaugccuucugaguaaagaccugaaggaggugagggaaugagucuggguuauauuaauauuagggaagagagguccaggcggagggaacaggugcugagguacagguguguggggugugacuggggaggcacacagggcccauccugaauucuuuuuuuuuuauuuuggagacagagucucauucuaucacccaggcuggagugcagcggugcagucuuggcucacuguggccuccgccucccagguucaaaugauucuucugccucagccucccgaguugcuaggauuacagaugugcgccaccauggcuggcuaauuuucguauuuguuuuuuuaguagagaugggguuucaugauguuggccaggcuugucucaaacuccugaccucaggugaucugcccaccucggccucccaaaguacugggauuacaggcaugagccaccacgucuggcccauccuuacuccucauguucacccugcucacugcccugcagcugcccguguaaacauauucauuucauucguuaucugucucuccucacuaaaauguguauuuuaauauauaguuaaauauaauaaguguauaaauaaaccuaauguauuuuaggagagguuucaccuagaagguaaaaagaaacaaacuugucucgguauccagaaagugucuucauuugucugaaaaaauuaauaagaaggagauaaggcauaaguauauucugauuuuagaauuuuuuuuuuuugccauuuuccugccauguuuuguagguucucccaauccaguugagauuauucauaaaauaaaagcaauguguuccuuuuuuccccaagaacauuuuuuaacuuuuacauuuucauuuagaaagaaagguuuugguggaacugcaggaauggcauuugugggaacaguguguucaaggagccacgcaggcgggauuaaugugguacguuguucuugauguuuaacuuuggauguuugcacugggacaauaucaagcauuuauugacuguauacuuccuccccugguccuuaaaacaauauuuuggguguuaugaggaacacaguagaagucgcagauggguucuuuccccagagacugggucaaguuuuuaaauaugugcuauguguuuauuagcucuuuucuuuuuuauucauuuuauuuuacuuuaaguucugggacacaugugcagaauguccagguuuguuacauagguauacaugugccauggugguuugcugcaccuaucaacccgucaucuagguuuuaagccccgcauauguuagguauuuguccuaaugcucucccuccccuugcuccccaccucccgacaggccccggugugugauguuccccucccuguguccauguguucucauuguucaacucccacuuaugaguguagcucuuuacuuuuuaugggugaggaaacauguacuccauuuuagagaauuaaauuagaaccauuaacuuguuuuccuauaaacuaccauaaguaaucuguuggugcuaaagugguugaccucuugcuugaaggauccauguccaucacgugugugauucauguuacuuucuuacuagacugaaauguauaaagacuguuguuggaugcuugauuuaucacguaggcugucaacaguguagugaauaaauuuccuuuugugaaaaaauaaucugagcagcaaaacauuuucuuugcguucagaaaccuaauuacuaccuuccuguucugaacaguuuggacaaaucacuguggagacauuugcuuccauuguugcucaugaauugggucauaaucuuggaaugaaucacgaugaugggagagauuguuccuguggagcaaagagcugcaucaugaauucaggagcaucgugaguaccuggguucuucuucuccuuuauuugguauuguagauccauguuucuuacacugugagggauauucaugucuacauugggaaaacaggaaauguuauuuccgguuugcugaaauuaauugcaugacauaccaaugagaagucuuuuuuuuuuuuuuuccagccuuuuagauuuaggggguacauguggaguuuguuaccugauguauugcugaagucuauuuuuuaauuaaaugauuccagagagcuuuaagaaggcaauacuuauguaggcacaaguauguaacuacacucuucuguaaaccaguuauagacugaaaguauaagaacauggcaaaguuuauuaucugaauuagaaauuaagagggaguuucugcuagguucaguguggauuggauuacacugaaggacugcauaagaaguuucuucacaaaccucuuuuugagaaagugcugcauugucacuguagguagaagagauccugauauauuucuauuaacaaacccuguuuuauagagauaaaggugggaggcaagacagagaagaggagagagaaugguuaacauuuguuaagcucuuuuuauguacaggcacuauuguagccauuuaaaacguauccacucacuuacuacucaucagugaaaugaggugcacauacuuuaucuccauuugcagaugaggaaacugaggucacacauccaaauugcugacugggauucaaagucaggaagucaaagccugugaucugagaacccuuuccugucccagagcuaaaaaauaauuauaauagaagaucccauggugguugggcaucagaaauauagauuucuaaugcagauucguuguaaugccaacgagguuccuuccuaauuuagaaggcaggaguccuaagcagagagcugaauguaacuguaguucguacguguguagauguugagccugagugaaaauuagauaugagaggugauaucuuuaacaaauacaggacggaccugguggcucaugccuauaaucucagcaauuagggaggauugcuugagaccaggaguucaagaccaaccugggcaacacggugagacccugucucuaaaaaaaaauaaauaaauaaauaaaaaauaaaauauuaacuggguguguuggugcgugccuguagucccagcuacucaggagguugaggcaggaggaucacuugagcccaggaguucaaggcugcagugagcuaugauugugccacugcacuccagccugggcaacagagcaagacccuguuucaaaacaaacacagaugaagauuucacauggggaauauccguggccccaaguguucaugccacuucccaccucccucaggcuccugaagcacugacagaguaauaaaaacuucugucaaccagccuuucagcugaaguucugaguggacaagacaauuucaaucacaugcuaguauaaagggaagcacucaagcagaauuuacaguuuuugaacaaauacuaggcucaaaaauagauauggaagaguuaaaauaguacuuacaaaaagccaugcuucauaaaaaaaaaauuagguauguaaggaacgucauauguuuguaaaagauuuccuguaggagagggaaguaaauuuaggauuugcuuuggccagcagugaaguugagaaagacgugaguucagggaaacaagaaauguguaaugagcaaugagauaagucauagauuaaaauaaaaaagaagcauucagagguaaggagggaauguuaugaaacagugccauaguggaauuuaauaugguauaggaagcaaugaagaguggacccauacuuuauucaccaacuugucaaacauuuauugagcacugaccaccugccagacuuuguucucagcacuuggaauaccucagugaguuagaucgacucacccuucaaggaguuuacaucuggggggaagacaaucuauaaacauaagaaaaucaauaauauagaguguuagaaggcgauaagugcuaugggaaauaaaauagagcagaauguggaggauugggaggacggaggguggugaaacaacagaacaggcuucaguaugacaaaacuggauguuaauaacagaaaccugagugaguugguauuuaaaaccacuccccuaaagucaacccugugucaagcagacuuacaguauacuuaaaauauuuugaggagaaugguauuuuugaauauuauauuuaaaacagugcauauugacguuuaaauaugaagauaacaugauuucaaauuuaagguauccaucauuuucccaagggaagagccaaaaaaguguuguuguuguuuuuuuuuuuuuuugguugacuugaauguguauaaacuugcuagggauacaguagauagaaagggagugaacuguucauuacuggaucuuggagagucucuguagccacaggggagacugaccccauaggaguugagguagagggacacugauaacaugaggauacugauaacaugagguagagggacacugauaacacugauaacaugagguagagggacacugauaacacugauaauagagaggguuccaggugaauuauucagccuuauucucccagugacuucuuaucucuugaauagaaguggccaaagugaguaccuaugucuuguccagcuuagugggaaagcuuuugauuuuucacuguggaguaugauguugucugugggcuuuucauauauggccuuuauuauauugaagugauuucccucuuccuaguuuguugagaucuuuuguugugaaagaauguugaauuuuaucaaaugccuuuuuggcaccuguugagaugauuaugugacuuugauccuugauucuguuaacgugguguuaauacauuuuuguguguugaaccguccuugugucccagguacaaaucucauuuggucggagggccugauguuucugguguguuguugaguucuguuugcuaguauuuguuuugaggauuuuuacauuuauguugcuagggauauugacuuacaauuuucuuuucugguugucccuugucugacuuugauauuagggugaugcugggcucauaaaaugaguuuggaaguguuccuuccucuucaauauuuugagaagacuuuuuuuucuuuuaagcaguuuuagguucacagaauaaucaagaggaaaguagaaagacuccucccauauacuuucuguccccacacuugcauagucucuccauuucaauaucccucaacagagugguaugguuguuaaaacugacaaaccuauauugacacaucaugauuucucaaaguccauacuuuaugguucagucuugguguugugcauucuauggguaugaacaaguguaugaugacaaguaucccucauuaugguaucaugcagaguauuuccauugccuuaaaaaauccucugugcuccaccuagucaucucuccccaccccuccaacccuuggcaaccacuaaucuuuuuacugucuccauaguuucguguuuuccagaauaucauauauuuagaaucaugcaguauguugccuuuucauauuggcuucuuucacuuagcaauaugcauuuaaggcuccucaugucuuuucaugucuugauagcucauuuauuuguagugcugaauaauaacccauuguuuggauguaccacaguuuaaccauuuaccuacugaaggacauauugguugcuucuaagcuuuggcaauuaugaaaaaagcugccauaaguguccgugugcaggguuuugugugaucauguuuucagcuccuuugggugaauaccaagggaugcgauugcuggaucauauguuaagagaguauguuuaguuuuguaagaaacugccaaauugucuuccaaaguagcuauaccauuuuguauucccaccaacagugaaugagaauugcuguugcucuacaucuuugucagaauuugguguugucaguguucuggauuuuggccauuccuauaggcauguagugguaucucauuguuucaauuuacauuucccugaugacauaggauguagaugaucuuuuuccuucuuuaugucuucuuuguggcaucugugaaggucuuuggcccauuguuuaaucagauuguuucuuuucuuauuuuuuaguuuuaagaguugcuugcauacuuuggauaagagucuuuuaucaaauaugucuuuugcaaauauuuucuacuagucugcagcuuaucuucucauucuuuuaauauugucuuucacagagcauacauuuaauauuuuaauucuuucauggacgaugccuuuuguguuguaucuaaaaaauaauugccauauccaagaugaucuagguuuucucccauguuaucucccaggaguuuuagaguuuugaauuuuacacuuagaccuuugauccacauggaguuaauuguggaggauguaagaucugugucuagauuuauuuauuuauuuuuugcauaugaauaucuaauuguagcagcaccauuuguugaaaagauuaucuuuuauuguauugccuuugcuccuuugucagagaucaguuagcuguauuuauguaggacucuuuuugggcucucuaucuuguucucuuuaucuaucugucaccuuuugcuaauaacacagucuugaagcuugugcaugcgucacauaguucucgugccaugguuuucagcuccaucaggccauuuaagguccuuucuacccuguuuauucuaguuagccauuugucuaaucuuuuuucaaaguuuuuagcuuccuugcgauggguucgaauauccuccuuuagcuuggagaaguuuguuauuaccaaccuucuaaagccuauuucugucagccugucaaagucauucucuguccagcuuuguuccguugcuggcgaggagcugugauccuuuggaggagaaggggcgcucugauuuuuagaauuuucagcuuuucugcucugguuucuccccaucuuugugguuuuaucuaccuuuggucuuugaugcugaugaccuacagaugggguuuugguguggauguccuuuuuguugauguugaugcuauuccuuucuguuuguugguuuuccuucugacagucaggucccucagcugcagaucuguuggaguuugcuggagguccacuccagacccuuuuugccuggguauuaccaguggaggcugcagaacagcaaauauugcagaacagcaaauauugcugccugauccuuccucuggaagccucaucccagaggggcacccgccugugugaggugucauuggccccuacugggaagugucucccaguuaggcuacaugggugucagggacccacuugaggaggcagucugucuguucucagagcucaaacacugugcuaggagaaccacugcucucuucagagcugucagacagggacguuuaaaucugcagaagauucucuugccuuuuguuuagcuaugcccugccccaagaggugggaucuacagaggcagcaggccuugcagagcuguggugggcuccgcccaguugagcuucccuggcugcuuuguuuaccuacucaagccucagcaauggcagacgccccucccccugccaggcugcugccucacaggucaaucugccugcugcccuagcagugagcaaagcucugugggcguaggacccgccgagccaggcgugggauguaaucuccuggugugcuguuugcuaagaccauuggaaaagcacaguauuugggugggguugucccaauuuuccagguacagucugucacggcuucccuuggcuaggagagggaaauccccugaccucuugugcuuccugggugaggcgaugccccgcccugcuuuggcucacccucuguggacuacacccacuguccaaccagucccaaugagaugaaccagguaccucaguuggaaaugcagaaaucaccaucuucugcgucuguuacacugggagcugcagaccggagcuguuccuauucggccaucuuggaauggccacacggucuugauuacugcagcuuuagaguaagucuugaagucagguagcaccaguccuccaacuuuguucuucuucuuuacuauuauauuggcuauucugggucuuuugccaccccauguaaacuuuaaaaucaguuuuaucuauauccacaaacuaauuugcugggauuuugauuaggaucgcauugaauguauagaucaaguuggggaacugacaucuuaauauugagucugccuguaugugagcaugaaauaucucuccauuuauuuaguucuuugauucuuucaucagauaguguuauaguuuccccauagagaucuuauacauauuuuguuagauuuauaccuaacucucauuuuuggggguccuaauguacaugauauuauguuuuuaauuucaaauucuacuuguucauugcuggcauauaggaaaguaauugacuuuuguauauuaacccuguauccuauaaccuuacuguaauugcuuuuuaguuccaggagucuuuuucaauucuuuuugauuuucuacauagaugaucauauuaucucuguacaaagacaguuuuucuuucuuuccagucaguauaccuuuuacuuuguuuucuuuucucacugcaguagcuaggacuaccaaucugauauugcuuuaccuuccucacauuuuuuuuuuagcauugacaguguguuuuuuuuuauuuuuaauaguuaugcuucuaaaacauauuuaaauuuuauuuuuaauccaaauugaaaauauaugucuuauaauuauaucacuuaauauauuuauauuuacuguaauuacugauccauuuaaucaaaucuaaaugccauugauuauaagauacaccacuuuuuccauaccacugagaaagaaauauggugucaaugaaauuaauacgucaauuguaaucugaaaugaaucucaguuucaaaguuauuuaaauauggaaagaauguguuuuagaaucaauuaaauacagcauuuggguuuaaaucuaccaucuuauaucuccuuuauuugucuucuuuuaugguuuuuuucuuaaaaguuuucggucuuaaauauuuaaguugauggauguuccaauuacccugauuuggucuuuacacauuguaugaauggaucaagugaucacauguauccugagaauauauacaucuauuguguaucaguuaaaaaugggacgacaacaacaacaacaaaaucuucuguguuauuucuuuuggguugguagaguguuuuuauauuuauuuucacuuuguagaaauggguucuuguuauguugcccaggcugguuuugaacuccuaggccuaagcaauccucccaccuuagccuccugaugugcugggauuacaggugugagccacugugcacugccagauagaguguuuuuaguagauacuguuuuucuucuagacauauuucuagaauggaaauuaugcagucuuuuauuuuuuuuaaaguuacccuagaaauuauuacacauguucuuauuuaucaugucuacuauuaaaucuuauccuuccccacacaguucaaaggcuauaucgugccuuaacuccauucaucacuuucuugacucauauagcugugugccaggaagauauuagugauuguuuaucauuauucauuuagauuuugaccacugcccuugcucuuugguccucuugcaucucugaccuuccauuugguauccauuuuucagucugaucaaagaaccaguuuugacuuuccuuuaauguguuuuuaguaguaguguaucucuuaguuuuuguuuuuguuuuucuccugagggugucuuuguuucuguuuuuugaggauauuuuuguugaauauagaaucguagaucaucaguuauuuuucaucauauugggauuuuuccauugucuuuugcuuuccauguuguuguugagaugucaaggugucagaccauuauuccauugaaaugaaucugucuauuuaccuauggcuguuuucacaauuuugucuuuaaacuuuuuuuuuugacguuucauuaucauguuccuguuguagaaagaaaaaaauauacaacaugcauacauacguauguuauguauauauaacacauuuacacauauaugucuucauauccugcuuagaaauuuuuuaguguuuuaaaguuuguggcuugauauuuuucaucagucggaaaauucucagucaugucuuuacauauugccuguguacacagggugucugcacauuugcugucucucuuacgccucugugauucuagugaacuguguguuagaccucacuaugucuccuuugucucuuaguuuuuuaaauauguuuccuaucuuuuuguguuuuuuucuucuguguaauuucuucugauaucuuucagcucacugauucugucuucauauguauuuugucuguuguuaaacuuauccauugaauuauuaauuuugcuuauuucauuugucaaauuuaugucugguucuuuuucaaaucugauauauuaguuuuguagauuuuaguuuccugcccaaauuuucaugcuugucacuuuugucucugaucauaguaagcauaaaugucuuauggcuaucauuugauaauccuagaacuaguauuaggagucuuuauuggacuuuaucugcucguuuuuuucuuucuuguaguguauuguggcuucaugugguauuuuauauuguguagcuguuauauuuaaaauuuuuuuuaagaauaauuucuagaccgggugcgguggcucacgccuguaauccuagcacuuugggaggcugaggcagguggaucacgaggucaggagaucgagaccauccuggcuaauacgugaaaccccgucucugcuaaaaauacaaaacauuagccgggcaugguggcgggcgccuguagucccagcuacugaggaggcugaggcaggcgaauggcaugaacccgggaggcagagcuugcagugagcugagaucgugccacugcauuccagccugggugacagagcgagacucugucucaaaacaaaacaaaacaaaacaaaacaaaaaaaagaauaauuucugaacuaggaugagguuauccuagguaauacauauuuuuuucucuuauuuuuccucagauuccuuuuuacuaccaagcugauauuaaacuuucuuuuuuugagggcauauuuccuacccucuacuucauaggcuguuuaauaaauguuaauuuucuaucauuuuguuuggcuuuuuuuuuuagaugcuagugauguacauguuucauuuuuucccccucagauaacucagucauugggagccaguuccauuuaauaaaauggauaaucuacccucguaauaagauuuuuuuguuauuguuuaugauauuuugggggcacagugguauucuuaugcauugcuguuagauucuggaaagugugaguugcucuuccugggaggugccuuucuagaaaaauggcuuucuuaacucugccccucaaugucagcaagcuuccaucagcaagcuuccauaaucagguguuuuuuucuuaaucuaauucaguaccagcacuuagaaucuucucuuaagacuuccuaauccuaggcugugggaaucagcauaguaauggugaaaauuguguucugggaauuuucagaggacucaaauaaauauguuuugaaugauaguugaaauuuuuuuuuuugucauuuccauguaaaacauuuucauuauugucgaucuccuuuugaagccauuuugggaaaaucaccuagaugugagaaaagagaggaggagaggcuauaaaucauuaauauuguagagucuagaggugauagagaguagaaauacuugaguugcucuucaagccccguaucaggagaaagaucauucuuuuuguugccauaggugccagccagugauggcuaguggaaggguauuuucacuguagccucuaaagcauuuuaaagucucacugaaggccaacacaggggauguuguuacuaucucccaucuguuaaaaagcaccacaagugucuaugauuuuguuaugcuuuuuaguucuauagucaauucaugugggugaauuuuuuuuuuuuuuugguagauugcugaaggaucaagcauuugaaacauuguuuauaagaaaauauccuucaacuaccagauaaugagcuuauuuaaaaaauaacuuguuuagaggugguagacuuuauguagguugaaauuagggacuaaaauauaggacuauacauaugccugcgcaaguucuuuuuuuuuuuuuuuuuuuuuuuugagacggagucucgcucugucacccaggcuggagugcaguggcgcagucucggcucacugcaagcucugccucccggguucacgccauucuccugccucagccucucugaguagcugggacuacaggcgcccgccacugcgcccggcuaauuuuuuuuuuuuauuuuuaguagagacgggguuucaccguggucucgaucuccugaccucgugauccacccgccucggccucccaaagugcugggauuacaagcguaagccaccacgcccggccugccugcgcaaguucuauggccauugucuaauuaaauauauguaauuuauaaauauauauuuauguaguauauauauuuaaauauauauuuaaguguguguguguguguguuuuuuuuuuuuuuuuggagacagggucucuggagagcaguggcuugaucauagcucacugcagccuuaaacuccucccaccccagccuccugaguagcugggacuacaggugugcaccaccaugcccagcuuauuuuuuguagagacagggucucauuauguugcccagguggccuugaauuccugggcucaagugauccucuugccuuagcuucccaaagcauugggauuacauuauuaaauauauuccuacagaaaacauuauugcauguauaccauguagcaggcgcugugcuuaccacauaaagaucaacaguacaaaauaaaaaacaauuacaagccucuguuuaaacugcagucuucuuuguuuaucaaauaauuauuuuauacugcuuugacauuuuuacuugaugucuaauaggcucaaacuccugugaucccuccuaaaguuguccuaaaaugugaucuacccauagucuuccccaugugaauuaaugguaacuccuuccuucuaguaucccaggacaacaaccugggagucauucuugauuucucuuuuuucucacucuucaucuuaauggcuguuccuuuaaaacaaaagcaauccaaccacuucuuacagcucccacuguuucauuuugguccaucaucaucuguuugguggauuucucuaagagccuucuuuguagucuuccucuuaauagaacaaguauggugauccuauuaaaacauuagucaaaucacauuacuccugcacuuuucauggucuuccccuuccaacuuccccauuccacuuagaguagaaagccacauuccuacaauggccuauuccugucuuugcugacuguaucucucaugacucauuuccucacugacucagucugccaggaaagcuucuaccccagaguuuuugcauuugcuauuccuucuuucuauaguguuuuccucccagauacacaguuuugauugaacugucacauauuugaggugccuguccugacugcccuuuuaaaaucacaagcaucccuuccucugcagagcucaucacacccacaccccgucgccuuuuuuccccauagcacuuauuaccuuauaauaugcuaucuaauuuauuauauaaguaaaucacugaaucauaaucauaaccuuuacaugggcagggauuuuugucugcuauguucacaguuucaucccuugcaccaagaagaaugccuuguacauaauagauauucaguaaauauuuguugagugagugguugauugauauugcacaaaaggacuccuccccacaauauucuuaguagcaagaaaaagaauaaggaagacaagucuuucuguuauugacaaaagccuugugcuaaauguuuucuuuccgugagucagaauuuugucuuugccuauucuuuugucucaaaccauugauaguuuauguucuuucuuuuuucuuucucugccagucuuuuaaaauccuuccacguccuacaucuagauacuuuuuuuguuuuuuuuggucaaacagcaguuaacaguaccaaaauguucuaggcagacugcauuccaauccaagaggcaggagucaguacuaucaacuuuucuagagaccaguuagcaaagaagaguuuaacaugacuacucagggcaaaaaauauguuucuuagaguuccuuggauauacaaaagaccaagcuauagauagggcugcuucuucauuaacuagaaugcaacauagcuuucacuccugcugcuacuucugguaccauugcucaaacugaugaaaagagauucaggguaccaaauucccuugaaaaaauacaaauauauguaagauauaaauuuuauuguauuuaagauguacaacauguuuugauguaaauauagguggugaaaugguuagucaagcagauuaacacauccaucauuccacauuguugcccauuuuuuguguguguggcaaagagcaccuauaaucucuuuuagcaaaaaucuugaauguaauacaauauuauuaucuauaguccucaugcuguaccugagaucucuagacuuguuugucuuacauaucugcuacuuuguaucagaccuacaugucccauuuccuccaccuccaccauaaucaguguuuuauuuucugucucuggauuuuccacuucuuuuuuuagauuccaaaauaagugagaucaugcaacauuuuucuuuuucugucuggcuugcuucacgcagcauaacauccuccagguuccuccauguugugguaaaugucaggaucuccuuuuauaaggaugaauaauuaccagucuuauaugugccacaguuuuguccauucaacuguugacacuuuguuuguuuccauaucuuggcuaaugcugcacugaaaaugggauaauacagacgucuuuaugaggugguguuuucauuuucuuuggguguauacccaaaagugagauugcugggucauaugauaguucuguuuuuaauuucuuuagggaacuccuauuguuuuccacaguggcugcaccaaucuacauucccaccaacagugcucaagauuccuuuuuuucuauacucucacuagcacuugucaucucuuuuauuuauuuauuuauuuauuugagacagagucucucucuguugcccaagcuggagugcaguggugcaaucucggcucacuacaaccucugccucccagguucaagcgauucuccuaccucagccucccaaguagcugagauuacagacgugcaccaccacaccuggcuaauuuuuguauuuuaguagagacgggguuuuaccauguuggccaggcuggucuggaacuccugaccucaagcgauccgcccgccucagccucccaaagugcugggauuacagcggugagccaccauaccuggccguuaucucuuuuugaugguagucauccuaacaagggugaggugguauuucauugugguuuugauuugcacuuccuugaugauuaaugauauugagcaucuuuucaugcaccuguuggccauuuuuaugucaucuuuggagaaaugucuauuuaagucuuuuguucauuuuaaaaaucgaguuauuuguuuuucuacuauggaguugugugaguuuuaaaaaauauauuuuggauauaagauacaugguuauaagauacaccuuauaagauaugugguuugcagauauuuucucccaaucugcagacuuuucauuuuguugguuguuaucuuugcugugcagagcuuuuuaguuugauagcuauaguaaucaaaacagcaugguagugguauaaaaacagacacguagaccgauggaacggaauagagagcccagaaacaaauccaaacauguguagucaauuaauuuuugacaagggcaccaggaggauacaauggggaaaggauaguucucuucaauaaaugguucugggguaacuggauuucuacaugcaaaagaaugaaauuggacccuuaucauacaccauacacaaaaaucaacucaaaauggauaaaauaccuaaaugucagacuugaaacuguaaaacuuucuaagaagaaaacguugaggaaaagcuccuugacauuggccuuaacaaugauuuuuggauaucacaccaaaaacucagucuacaaaagcaaaaauaaaauagaauuuuaaugugacauggauuccucaaagauauaggugauguauagguguaauuuccacuaguuuucaaagguaaaaauagccagugggacuaccugaaaguauuuuauaguuauugaguaaaguaguagcuaaaaaaaaaaucccagguagaacauaucaaaauugcauuuauauaaaucucacauagcucaaguuggacauuucuuaaaggccaacuaacuuucaaaguacuaaccacgguucccaggaauuaucauaaaauuuauuauauguaaagcucaaguugaaaacuugucauauaggaguagcugaaauucuacacugugcagucugccuuuugauggcuagugugcaucugaacuggaguugcccauuugcauuauuuuugcagagcuccuaauaagugguaaugggcaugggugaacauaaaaauguuauccuucagaguagaaaaaagauuggagacaacguacagcuaccuuccaauauuugaagaaccuuuacuguguuagauaaauaaaacuuuauucucauaggacuaaauaauuuuuaaagucucuucugaugcugagaauuaucauuuuguauuucaauguaagugauauguuuuaaagauauuuuauuggaaguacaauauauuguaagaaaagugaauuauuauauaguagcugaaguaauguucaauauuuaucacaaguagauaugaauucucauuucuguccacuuuuauuagcuucuuuucugucauuuaaaauauucacauuuuguggguuaaagucaugacuuaacauuuucaaagugaguaaucacugugacauagaucuuuuucuuaauguuuauuauagggguuccagaaacuuuagcaguugcagugcagaggacuuugagaaguuaacuuuaaauaaaggaggaaacugccuucuuaauauuccaaagccugaugaagccuauagugcucccuccugugguaauaaguugguggacgcuggggaagagugugacugugguacuccaaaggucaguuuaauuuuugacuuuugccuuguaaaauugccaugauauuugcaagaaauaaaauggcuugcuuugggcaacucugacauaggagcuaaaguaaaauuuaguggcacagugaggauuguuauuuuguuuguauggcuguguuccagggauuggucaucuccuucuucucagaguaugacuaacggugccaucuguuuugaagucagggaaugugccauguuuauucucuacuuuuuuaaugcuauuuucuaugauuuaugguuauuagcuuauuugcuuuaaagaaugaauuucaccuggcucuuuauuuguaagcuuucaccauucuggcacugccauugcaggaauauuuauuuagcuggacucauuuuaaaaaugaauuggagcuggccuguccuccagcguccuucaguauucaaaguucuugcuacucaaaguagcacucuaaaaaaaaaaaaauucaaguaguaaguaaaagcaaccuuacacacguuuauuucccccauaaaucuuuuacuuccuuuuuuuauguuugauguuuuucuuuuuagacuauucuguucauuuauauacaguauacaguagguacauuuauaaauauugggcuuguuuuaggauuuauuuuuacuuuaaugugguaagaauacuuagcaugaaauugauccuucuaagagauuuuuaaauguccaguacaguauuguuaacucuggguacuguguuguacagcacaucucuagaacuuuuucacuguguguaacugaaacuuuguaucuguugaucggcagcuccccauuuuccauuccacaagccccugaccaccacuauucuguucacugcuuuuaugaacuugacuauuuuagauaccuaauauaaguggaaucaaaugguauuauguccuuuguggcugccuuauuucucuuagcaugguauuguauacucaaguuucaucuacguuauugcaaugacaagauuuccuucuuuuuugggaaauaguauuccauuguauguguguauauguauguauguauguacauuuucuuuauccauucaacuguugacagacauuuaggugguuucuacaucuuggcuacugugaauaaugcugcagugaacauaggaaugcuaauaucucuucaagaucuugauuuuauuuuagauaaguacccagaagugggauugcuagaucacaugguaguuauauuuuuaauuuuuaaaagaaccuucguacuauuuuccauaguggcugcaccauuuugcauucuucccaacagugcacaaggguuccaguuucuccacauucuugccgacacuuguugucuuuuguuuuuuuccgugauagcaauccuaacagguaugaaauuauauuucauugugauuuugauuugcauuuccaugaugaugagugacauugagcaucuuuucauauaccuguuggcuauuugugugucuucauggagcaaugucuauuaagucucaggccuguuuuaauuauuuuuuuguuucuuuuaacauuuuuauauauuuaggggauguaaaugcagauuucuugcauguauauauugcauauugguaaagugagggcuuuucauguaccugucauucaaauagugaacauuguacccaaaagguaauuuuucagcccucacaccccucccaugcucccacuuuuuggggucuccagugucuguuauuccacucuguacauccaugaauacugauugcuuagcucccacuuauaagugagaacaugcaguauuugacuuucugcuucugaguuacuucaauuaggaaaauuaacccauuuuaaaucagguuauuaguuuuucauuuuuugcuauugagcuguagcucuuccuguauauuuugaaaguuuaccccuuaugguuugcagauauuucccccuauuccauaacuuggcuuuucacucuguugauugcuuccuaugcuguguagaagguuuuuaguuugauauagccccacuugucuauuuuuggcuucuguugccuguaauuuuggcaucauauccaugaaaucauugccaagaccaaugucaugaagcuuuuccucuauguuuucuucuaagaguuuuacuguuucaggccuuauguuuaagucuuuaauccauuuuaaguugauuuuuguguauggcguaagauaagguuccaauuucauucuuuugcauguugauauccaguuuuccacgggggaagggacuaccuuuucaccauucuuuuucuuagcauccuuguugaagaucaggugaucucauauguguggguuuuuauuucugcauucuuuauucuguuccauuggucuauaugucugaauuuuauuuuauuuuagauucaggggguacauauguauguuuguuacauggguauauuguauccugguggggauugggcuucugguguacccauuacccaaacaaugaacauuguaccuuauaaauaauuugucagcccucacucuccuccuacccucuccagcccucacucuccuccuacccucuccucuuuuggaguuacccaguguccaucaccuccaucuuuauguccaugugcgcgcauuguuuagcccaugcuuauaagugagaauaugcaguguuugauuuuguguuucugaguuaguucacuuaggauaauggccuccagcuccauccauguugcugcagaggacaugauuucauucuuuuuuauggcuacauauaguauuccgugggguguguguauguguguguguguauacauacauauauauguauauauaugugugugcacacauacauauguauguauauaugugugugcacacauaccuauguauguguauaugugugugcacacauaccuauguauguguauaugugugugcacacauaccuauguauguguaugugugugugcauacauacauauguauguguaugugugugugcauacauacauaugugugugugcauacauacauaugugugugugcauacauacauaugugugugugcauacauacauauauguguauauauguguauacauacauauauguguauauauguguauacauacauauauguguauauauguguauacauacauauauguguauauauguguauacauacauauauguguauauauguguauacauacauauguauauguguguguacaccuauacauguguguguacaccuauacauguguguguacaccuauacauguguguacauacauauagguguguguacauacaccuauagguguguguacacacaccuauaugugcgcguguguacacacaccuauaugugcgcguguguacacacaccuauaugugcguguguguacacacaccuauaugugcguguguauacauauguguguguacauacauauauaugugcauauguguguauauauguguguguguauauguguguguguguauauauauauauauauaaaagauuuuucucauccagucgacuguugauggacacuuacauuaguuucaugacuuugguauugugaauagugcugcaaugagcauaugagugcagauaccuuuuuuacauaacgauuuauuuuccucuggguagauacccaguaguggaauugcugggucaaaugguaguucuaguuuuaguucuuugaaaaaucuuuauacuguuuuccauagagguugaacuaauuuacauucucaccaacaauguauaagcauucccuuuuuucugcaucugcaccaagaucagccuuuuuuuuuuugacuuuuuaaugauagccauucugacuauuguaagaugauaucucauugugguuuuaauaugcauucucugauuuucaaugauguugagcauuuuuuccuguguuuggcagcugcuuguauuucuucuucugaggaauggauuuuauugaaucugcagaucacuuuggguaauauggacaauuuaccaauuuuaauuauuccaauccaugaacauaggaugucuuuccauuuauuuguaucaucuuuuauuucuuuuagcaauguuuuguaaguuuuuagugugugaucuuuuuccucacuuguuaagcuuauucacaaauguuuuguuuucaaugcuauuguaaauagcuuuguuuccuuaauuuccuuuuuguaguucauuguuaguaugugaaaaugaccuuauuuuugugugucaguuuuguuuccugcaacuuuacugaauuuauuuauuaguuauaacaaguuuuuugauggacucuuugggauuuucuauauguaugaucaugucaucuuaaaagagggacaguuuugcuucauuuccgauuuagaugccuuuuaguuuuucuugcuaauuguucuggcuaggacuuccaauacuaaguugaauagaaguggcgagauugggcauccuugcuucauuucugaucucagaggaaaagcuuuuuguuuuucacaacuagguaugauuuuagcuaugggaauuucauauauggccuaauuauguugaaguuauuuuccuuuauuucuaguuuguugagagcuuuuugcaugaaaggguguagaauuuuaucaagugcuuuuucuguaucuauugagaugaucaugcuauuuuuauccuucauuuuguuaaugugguauaucucauuauuuaauuaauuaaauuuuuuuuuuuuugagacagggucuuacuguugcccaggcuggacugcagugcugugaacacagcucacugcagcuuugaccuaaugggcccaagugauccucgugccucagccucuugaguagucgggacuacaggcauaugccaccaugccucacacauuuuuguauguuuuguagagaagggguuuugcuacauugccuagacuggucucgaacuccuggacucaagcagucugccugcguaagacgcccagagugcugggauuacaggugugcaccacugcaccugaucucauuaauugauuuuuguauauugagccuuaauugauuuuuguauauugagccaucccaauuuauacccaaggauaaauucuacuaggucauguuguauuuuacuuuuaaugugcugcugaauuugguuugcuaguauuuuguugaggauuuugcaucuguauuuguuuggcacauuggccuguaguuuucuauauuuggcauauuggccuuggugauacagucugcaucaggauaaugcuggccucauaaaaugaguggaauuuucuccuccuccucuauuuuuugggugaauuuuuagaaugauuggcauuaguucuuuaaauguuugguagauuucaccaguaaagccauugguccugugcuuuucuuugcuaggagguuuuugauuacugauucauauccuuacuacuuauaggucuguucagacuuauuucuuuaugauucagucuuggugggauguguguuucuaggaauuuauccguuucuuuuaggugauccaguuuguugauguguaaauguuuauaguagucuuuuauaauucuuuuuauuuauggcaucaguugaaaugucuccuuucucauuucugauuuugagucuucucuuucuuuuucuuaguguagcuaagauugguuaauauugcuuaucuuuugaaaaauacuaacucuugguuuugcugauuuuucaauucuuuuucuagucucaauuuuguuuauuucugaucugaaguucauuauuucccuuaugauaauuuuggguuuaaauuuucuguugcuuuucagauuucuuggguuguaaaguuagguuguuuauuugaguuuuuuuuuuuaauauagguuaucacagcaagcuuuccuuguauuuuuuuuuuuugacagagucucacuguguuguccaggcuggaguguaguggggcaaucuuggcucauugcaaccuccaccuccugguuucuagugauucuugugccucagccuccucaguagcuaggauuacaggcgcgcaccaccaugccuagcuaauuuuuguauuuuuaguagagaugggguuucgccauguuggccaggcuggucucgaucuccugaucucaggugaucuacccgccuuggucugggauuacaggcgugagccaccacaucuguccuccuuuuaguauuauuuuuguuuuauuucauaaguuuuuacauauuguguuuuuuguuuguccaaaaguauuuuuuaaucuuguguuugauuuccuuuuugacccaaugguuguuccacaguguguuguuuaauuuccacauauuggugaauuuuccauuuuccuuucugcuuuuauuguugucuuuuucuauucuaauugcuaguuucauccauuuuggucagaaaauauauuugguaugauuucagucuucuuaaauuucugaagaccuguuuugugaccuaaaaugugagccuggagagaguuccaugugugccugagaauaguauguauucugccacuguuggguagaauguucuguauaugucuauuaguuugauuuggucuguaguguuguucaaguccuguguuuccguauugaucuucuaucuagauguuuuauccauaauuaaaaugcagucuugaaguuucuuacuauuauuguguugcugucucuuucuuucuucaguuuugucagugcuugcauuacauauuuaggugcucuaaugcugggugcauauauauuuauuauuguuauaucuuccuagugaauuguuacuuuuaucauuauaaaauguuuuucuuuguguuuugugacaauucugacauagagucucuuuucuuugauacaaauauagguaccccugcucucugugguuaccauuugcauggaauaucuuuauccauucuucacuuucagccuauauauguccuuagaacuauagugagucucuuguagauagcauauaguuuuuuuuuuuuuuuuuuuauccauucaguaugcuauguguuuuuguuggggaguuuaacauauuuacauuuaaaguaauucuugauagggaaggauuuacugugauuguuuuaaauguuuuuuguuugucuuguagcucuuuugccugcccuuucuugcuguuuuccuuuguaauuuuuugauuuuguguguguguugauaauucuuuuaucccuauuccuuuuucuuuuguguaacuuccuucuauagguauuuguuuaugguuaccuuagagcgugcauaaaauaucuuguaguaauaacaguauuuuuaagcugauaacaacuuaaccucaauuacauacaaaaacucuucacuuuaaguucucccauuacacaguuuauguuguuguuacaguuuacaaucuauuaauauuguguaucuuccaacauauuuuuuauaguuuuuuuuuuuuuuuuugagauggaguuuuguucuuguuguccaggcuggagugcaguggugcgauggcucacuguauccuccgccuccuggguucaagugauucuccugccucagccucccaaguagcugggacuacaggugccugccaccacgcuuggcuaauuuuuguauuuuuaguggagaugggguuuuaccauguuguccaggcuggucucgaacuccugaccucaagugaucugccugccucggccucccaaagugcugggauuacaggcgugagccacugcgcccggccuauaguuacauuuuauacuuuuucuucuaaauuuacacuagaagugaaagugauuuacccaguaccauuaacagcaacacaguauuuugcauuugucuauauauuuauucuuacuaauuaauuuuauacuuucuuaugcuccuguguugcugucuagcagucuuucauuucaaggugcagaacuccauuucacauuucuuagaagaaaggucuaaucaugaugaacuucccugcuuuuguuuuucuagaaaagucuuaaugucuucuucauuuuuaaaggauaguuuugccagauauaggauucuuucuuggcaguuuuuuucuuucauuacuuuaauaugucaccucauuaaccuucuggccugcaagauuucugcugaaaaauccacuaauggccugauggggguucccuuguaugugaugaauugcuuucuuucuuacugcuuucaaaauucucuuugucuuuugauaauuugauuguaauguuucuugguguugauuucuuuagauucuucuuacuuaagguucuuugggcuuccugcaucuggacguccauuuccuuccccagauuugggaaaauuucaaccacuaccucuuugaaauaagcuuuuugguacuuuuucuuagucugcuccuugugggauugccacaguguguauauuagucucuugauggugucucauaagucccuuaagcuuucuucacuuauauuucuuuuuuuuuuuuugcuccucugacuugauaagguaacccgacuuugaguuuguugaaucuuuauucuguuugcucugaucugcuguugaacuccucuguugcauuuuuccauuaaguugguguauucuucagccccgaaauuagugagaagaccuucacuaguuaaccuggccagagcuuuuuugggccucucaaacuuucauguuuguuauacugccuuuucuauuguuguuagcgcucagugucuacaauaugcuggagccuaucaguguucugagaggggagaaagaagugaauuuguugggcaaucccuagaaaaguuggaacaugugacaugugguccaacaguuucucuuuccagggaaaagcuuggaaguguuuuuuuuuuuuuuuuuuuuuuuuuaaucacuauguuaaacuggguagaggaacuguggcgagugucugagugauaguuugaacaaccaccuucauucuuuguagccuucaggggucuagcacauaccagcuccaucugugcucugagagaggagagggaaaagccaauuucuuggguagcuccuagaaaaauuguagcguuggaugugugguccuccuuugggagaagcuaggagcuguggcaagugcccacaugcuaguuuaaccuacuaccuuuguucucugaaaaccccagggaucuaauauauuccagguccuauauguugucagaggcagaugagauagaagguagucccucaggaagcacucuaaaaaacuguaauauuggauguguggcccaacucuuucucuccucagggagaugcugagagcuguuuccuccugaucuuauaugacgcgucaugaguugggauugcggcgagaaaggaucuccaguuuuccuacugguuucaguguggcugguuuuacaauugccugggauguaguagccucucaacuaguuucuggauuucucacaaagggaauugauuaguguguuacuguugaauugcugacuuuuuauaggagauuuguuagccuccaauaaaaguuaaaauguacaugcuuuuagaucuaguaauucuaccuuuauguaacuaucuuagagaaauauuuguguauauacacauggggaguguacagggauguuuauugcagcacugccuguuggaggaaggagaauccagagcuuucuauucucccauuuuggugaugccacucuggcuuuuauuuuugugcauaaauaaaaucagacuuaauauuguuuaaaauugacuuaaaaucucuugugugcagauuuuuuucuauuacgauauccuggacauuuuucuguaucauuuuauuauguagacauagcccuuuaauuugcugaauaguauuccaauacaaggauuuacuaugauuuauuuaaccauacucucauuaauuacuguaauuaguguuuucuauuguaaacagugcugccguauacauccuuguacacaccucauguguauauauacaaacauacacaccucauguguauauauacagauauacacacgucguguauauauacaaauauuuuucuaugauaguuauuguacauaaagguagaauuauuguaucuaaaagcauguacauuuuaacuuauaucagaagcuaaugaauuuccuauaaauagugugggucaguuugcauuucugacaacaguauauuaugccauuguguacccauagucuuaccagcacaggauaauauguuuucuuaauuuuggcaagcugauggguaaaaaauaagaagauacuguuuuaguuuacaguuuuucaugugauuguagauuauaggcaucauuuucuucuaugaauuauuauuuuauguauuccuuaucaguucuguugguucauuaaaucuucuuuuaaauugauuuuuagaccucuuucuauaagauggacauaacuccuuuguuauauauguucuaauauucuuuauuuauagcuuauuuaacuuuucauagguuacauuuuauguugaaauuuaaaauuuaaaugaaggcaaacuuacuaauuuuuuuccuguaaugguuucagaaauuuguaucuugaccugguuuuuaguauuccuauauauagaucaucaucauagccccucuacaaauuauuuuaguuuuuuuuaaauuuaaaauuuuuauguuaacucuuuuaauugaggagggggcauguggaguaagcuuggaaauuaaacuuauccacuaaugaucaguuguuguggaaccauuuaaaaugguucuuuuacgauaaccuaaguuccuauauacauuaucuauuuccugauucccuauucuuucaugaagccaacuguccugcaguguuuuugaacuggccagcauucaccuucaaaucuuuaugugaacuuauguuuuuaauacuguuggguaaaugucccggaguagaaugacuugguuagaugguagagguauuuaacuuuucaagaaacucucaaacuguuuucuaaagugauuguuccauuuuucauuuccauccuuaguguaugggaguucuaauuguuucauauccugaccaauacuucguguggucaguguuuuuaauuuuagccauucuauugagugugagguggugccucauugagguuuuaauuugcauuuccuuaguaacuaaugaugcauugagcauguuuucaugugcuuuuuugccaucaggcuaucuuauggugauaugacuguucaacucuuuucccucauuuaaaaauuuugauuacuuauuguugaguuuugagaauacuuuguguauucuguauacaaguucucuaucagauugucaauauuuuuuccaaguuguagcuugccuuuaauuaacuuagcaguauauuuugaagagcagaacuuuuucauguugaugaaguuuauuuuauaaacuuguaauuuuaucgguuguucuuuugguguccuaucuaaggacuucuugccugcuccacaguugcaaagguuuucuccuagaaguuuuauaguuuuagguuuuacauuuaguuccaugaugcauuuugacuuuuuuuggguauauuucaagauguacauuaaaguucauuuauuuuaaaauguuuauuaugaaauaauuauaaucugaaaagaaguugcaaaauaauauagaguccuguguacuuuucacccaguuuuccuuaguggugacaucuuauaaagcuguaccacagaauacaaaacagaacauugacauugcuauuuuaacagagaagaugucucugugggugggaguuuggggguaagaaggagccaugguggcccagaguauagugagagaagccaagcaagguaaaaaagaguguucagcuagggugaagagccauccaacagagaaguuagacccugagcaugaagauaaaugccuuuauggacacugaccucucugugaucaucaaacauacuguuaugaacugaauguuugugcuuccccaaaacucauguguuggagccagccaccagcauggcuacauuuggagauggggccuuuaaggaaguaauuaagguuaaacgaggucauaaggauggggcccugauccacuaggaucaguguccuuguaagaagagacaccaaacaucucacuugccgucucucugcacacaugcacugaggaagggcuaugucagcacacagcaagaaggcagcccucugcaagccaggaagagaauccucacuagaaacugaacuaguaggaaccuugaucuuggauuucuagccucaagaacugugagaaaauaaauuucugcaguuuaaaccugugguauuuuguuauggcauucugagcagacuaaguaaggcacauacuauaugauuucuguccuuugaaauauguugagacuuauacuugcagcugaagagacauuguuaaauccagaaacaguaagcaacuguuucuggaggguaacugcuacaaucauguuagaaugaaguagauuuuagguguaagaugagaauuuuauuaaugaguauucaugucaauuacuaauuucuuuauugacagucauuuuauguucacaggaaugugaauuggacccuugcugcgaaggaaguaccuguaagcuuaaaucauuugcugagugugcauauggugacuguuguaaagacugucggguaaggaauuccucccuuuuggaaacaggaaaaaaaaaaaaaaaaaaaagaaaaccuguguauaucaaaauuuguuuuuugagauuucugagucagcacuauuuuuauuuuauggucaugggaaaaauuuuaugccacuuguguauaauuuuaaagcacacucuuuuacguuaaguggucuguugauauuguuuucuaaguagaaacauuuuuuuucugauuuuuagaguaacauaugccuguuagaaauaauuaaauaacaugaaaccauagaaaguagagaaugaaagauccucuauuauuuuauacucuucagguaaccacuguugauaauuuguuaauauaaucacguuuuuucuauacaaaugugaguguauguguguauguguguuuuuaaguggguaagcacagauacauauauuuuuacuaccugcuuuuuucaauaugacaccauggacuuuuuucccauucauguaguucuauaauacaugguuauuuaaguaauauuacuuguauaguuguaccauaauuucuuuagucaacuaaugauggacauuuugauuacuuccaguuacugcuuauaagagaaaucacuggugcagaauauucauacuaaguuuuugauauacauuuuauauaucuuucacacauaugccaaucuauacuucuaccaacaguauuaucaaauacuuguuuccuuaugccaauauuggguacuagcaggcacuauacuccuaguuaauucaauagguguaaaggguucuuguauuuuuauuuaguuugcauuucuuuugguuacaaaugaggucauguuucuuuacuuuccauaguuaggacuuacaugaauuaccuguuguuagccauuguucauuuuucuguuggguuauuuaaucuuuugcuauuguuagaaugcuuuauagauguaaaugcugugguuucacauuugauuaauuuguggacauuauccugauauuucuguuuaauuugaauucuauuucacuaguuccuuccaggagguacuuuaugccgaggaaaaaccagugagugugauguuccagaguacugcaaugguucuucucaguucugucagccagauguuuuuauucagaauggauauccuugccagaauaacaaagccuauugcuacaacggcaugugccaguauuaugaugcucaaugucaagucaucuuuggcucaaguaagauaucaucauuuauaauugauugcuucgauauuauuuauuuuugauuuagauauuuuaaaaaagguaaugaaacauuauugauaaaguugaggcucucuuguuucucaucguauuuccuuucuucuuuggaggcagucaugaucaugaauuuaauaugcacagauucaguugauguuuucuuauuuuuacugucuauaucuuuuuauauuuuguguaucacgcacacacacagauacauauauaguaucuaguuuuaauaauguugaauugugcacaaggaucugcuauuugcauuguucacucagaauuuucuugaaauucaucuauauugauauauuuauauuauaguacauuaaaguauuccauuagaugaauggaucaugauuuaguuauucucuuacugauagauauuugggauuuuuaaaaaauuuauguauuuuuucuuuuaaaaguucuuauuuuuaucaagggcauacauauaaagagccaaauuauuguguaaugcauaguaugaacaaauaaggacuguucccacccacuauucccaucacuugaggcaguuuuaccuuuuuuggcuaagauuuuuguuaacuugugcuagguuuuuagauaaucucuuggcaaugcgacguuuugauuuuuuuguucuaggcauuaguuauuaauuucucacuauagaagaugaguuaguuuucuuuccuucucuuccuucaacccuuaacaacucccaucauaccuaugcugauuuuccauucuucauccucccaauaguuagggcagugaugacuguguauuguauaauggccacauuaaugcucuucacaacuaaacuguauaguaaguuauaauuacuugccugauuucucuagaguuacuaauucugucuuucuguuucucucucucucuuuugguuugguuaauuuccuauguacuuuccauuaauugaccuguauauuguuaaccauuggccugauugugccuugaguugauuaguggcaucaaguauucuauuuauuucaauuuguucaaauaagucugaacagaaggccucuguuccucuucagucuugacugguuucccucuguauaguuaguuaggguucucuagagaaauggaaccauuguguugugcguuuauguauacagucauauaccgcauaacaacauuuuggucagugagagauugcauauacaacaguggucucauaaaauuauaaugcuguauuuuuacuguaacuuuucuauguuuagauauguuuagauaccuuuucuauguuuagauacguuuagaugccauuguguuaccauugccuacaguauuuaguacagugacaugguguacagauuuguagcuuaggagcaauaggcuguaccacauagccuagauguguaguaggcuauaccaccuagguuuguuuaagugcacucugugauguuugcacaaugacaaaaucaccuaacaacucauuucucagaucauaucccuguuguuaagugacacauuacuguagauauuacuguauauauaaucuggaggaauuauuacgugaaucuaauauuuauauauaauauauaauuuacauauaauauauuaaauauauaauaucuuauauauguauuacaugaaaaucaaauauauucuccuggaggaaucugauauauuagauucauguaauaaauccugcguaauagcaugagcccauauaugaauuggcuugugugauuguggaagcugcuaagugucagaucugcagggagagucagcaaucuggagacccuguagagcugaugguauaguuccaguuagaagucuggcaggcucaugaccauggaagagcuaguguuucaguucaauuccaaaggcaggaaaaaagcugaugucucauuccaaaggccuucaggaagacuuuucucuuacuugagggaggacuggccuuuucguucaaguuuaaaauugauuggauggggcccaccuccaauagggagggcagucugcuuuacucauccuacugauuucaauguuaaucucauccaaaaucacccuuacagagacauccguaauuauguuugauuaaauaucuggggauucuguggcucagucaaauuaacucuacuaaaaaggguaaaauuaacccucaucaaaaauccacuccuugucagcuugaaacccauagacaccuuaaaccauaccaaaucuccaaauguggaccuuguuaagggcauaauuccaccuagcaugauauaauaacacuauccugcaugcaacuaaaaccucacuaaccucuuuuccagaaaaggagguaaagugauguuuauucuucuucuugauaucccauaacuuaaauacugggauauaaaauuaacaauacuuaaaugcuauaauaucaagucaauaugucuuaugcugcaugauaaagguauaaggaaugagaacauauuugcucaguacgugugugugaaugcacacacacauacacacaugcagcuauucuuaaugaaacagucuucguuucugcaacuggucaugugguuguagcugguauuuauaacuaacuuccacccauucuguauucccuuugccuucagcaagcacguuagcuguuugugguucuuuaccuguuagggugacccaaacugucguucuugaagggucugggccauuuguaguccuuccuagauuggguuguuaaaguuuuccauugaacuuaaacuuaaucaugaagcaugguaauacuaagagaugcccuaagggaucuccggcauucuagacauacucuuccuugccuccauuuuggaguaguaggccaguuucccuuuggugguucggaucaguaauucuaccuggcauagaaacugccuucuuugccuguugacuuggagguaugaggagccaauguggcugggccucuggcuuaauuucuaguucaguagaaucauuauuguggcuccugguggcagcauuccuccuuuuggaacuaaggccucuaguccaguagagcauaaggucgugggaacaggaaacaaaauuuugcuagugggucacuauggauaauggugagugguguuucucccauuuccaccccuugauaccuggacacgugaauccugguuaugggaaaaucagcauuggauguuggcugcugauugagagcauauacagccuuuuggagaaccuugccccagcacuguaagguauugcuaccuaguggcacuguaacugagucuccaaaaggcauuuccaccaugcugucagccagcugcuucaggaugguggggaaggaacaugguaaggccagugaauuccaugugcaugggcccauugccucauuucauuugcuaucaagugaauucuuugguuugaagcagugcuguguagaauauuaugauggugggggaggaauucuguauguccacagaagguaguuuugguaguucacaggaguguugcuacagagauggcaaaucuauaucaagaguacgugugucugucccaguaagaacaaagcacugcuucuuucaucauggaaagggaaaaauguaaucaaccugccaccaggcagcugacugacuaaccuagggaauggugucauacuggggacucaggauuggacuuugcuacuggagaauuugggcacuuagcagcaacaaugccaggucaguuguugagaggaaguccaugaugcugagcccacgcaucgccuccaacccugccacugugaguacgugguuccugagcccauggaugagaauaguuggcuggggaaagaaugagucauccuaucuacuugauuauuaaaauucuccucuacugaggccacccuuuggugaacauucacaugggacacaaauaucuuugcccuacaacccagucaugggccauagcccauaaauugguguauaaucacgucuggcuguuucuucucccaaggaaagugaacaaccaggugcacuucagggaugucccagaaaggggcugcagugcuacagucauccacuuuugguucuucauaucauaucauguguagaaccaucugcaaaccaggucuccgucuucuuuucuacugucaccugauggguaggaaguuccccgugaggucauaguugcuggcuaggagagaaaauguaguguagcaggaguggggagcaggggcauguggggcacuucuuuauguaacuugugccuuccaggccuugguuuggcucaauuacauacguagcacuuccauuucaugauggggugcugcugcauaugcccagcuuuauagcuuggugagucagaugacauccaguuuaucaugggcaacucagguugaaugguaacuugguggguggcccaugguuaaauguucaauuucuacuuuaaggcccaguagcaggccaauaguuuuuucucaaaaggagaguaguuauucgcagaggaucacaaggcuuugcuccaaaauccuaaaugccugcacugcaccugaccuauagggaacugucggaggcgcuaaacagcauuucugucuguaacugcugcuucaagcacuguuugaucugcuugaucaagugggcuaagcagcagagcaucuugccugacagccuggaccuauugcagaguuucucuuuguucugggcccagcucaaaacuagcagcucuuugggucaguggguaaaugggccagaguuaugcaaccaaaugaggaauauuuugccuucagaaauccaaauggaccucuaaacauugugccauucuguugguugugggaguggccagaugcaacuucuucuuccccuuagaaaggauaucuugacaugucccacaccacuggacauguagaaauuucacugagguagaaggcaccugaauuuuugucagauuuauuuucuacuuuuugucgugcaaauaucuugccagugacaagaauaguugcuguuucuugcucacuaggucuaaugagcauaauguuuucaaugacuagugugauauuuuguggaaggaaaagguaaucaagauccccaaaacuaaauuaugacauggggcuccagaguugauauucuuccuaaguaggacagugaagguguauugcuggccuugccagcugaaagcagcugcuucugguaggcuguguggauggguauagguaaagguuuuuucagaucacagcugcauaccauguauuaggggauguguuaauuugcucaaacaaugaaauacauuugguauagcagcuucaguuggagucaccacuuagcuaagcuuauaauaauccacuaucauucuccaagaucugucugucuucugcacagggcaaauaggugaauugaauggagaugugaugagagucccugccccugcaucuuucaaguccuugauguugacacgaaucucugcaaucccuccagagaugugguauugcuuuuggcuuacuauuuuccuagguagaggcaguucuaguggguuccaccuggccuuucuuaccauaauaaccaucacuccacaggucagggaaccaguguggcaauucugccagcuguugagugugucuguuucaauuaugcauucuggaauugugggaaaaaacccacaagguggguucagggacccacuaggccugcugugagauggaccugagguaaaacuucaucuaucaccugaccuucauaagccccuacucugacuucuugaccacagugacauuuuggguuugcucaauuauuucagauauaggguucuguguuccugaaaggucgaauuuuuuucucagugcacagugucuuagucugaucaauucugucucagucuauuuugugcuauuauaacaaaaugccacagaccggguaauuaauagugaacagaaauuuauuggcuucuggaggcugggaaguccaagauaaaggugcugccaucugaugagggucguuuugcugagccaucacaugacggaagguggaugggcaagagacgaaguggggccaaacgcacccuuuuauaacaauauuaaucuuaucccagagggcagagccaucauggacuaaucaccucuuaaaggucccaccucuuaaugcugucacaaugguaauuaaauuucaacaugaauuuuagaggggacagacauuuaaaccauaucuggcugcucuaacaagauauacuguagacuguguggcuuaaauggcagacacuuauuucucagaguucuggaggcugggagucuaagaucaaagugccagucaauuugguucuuggugagggaucucucuuuucuucuuauaagaucgccaaucccaucauaagggucccauccucaugaucccaccuaacucugauuaccucccaaauggcccaucuccaaauaccaucacuuugggguuagggcuucaacagaugaauuaugggauacacaaacauugaagggguacacaaacguucaguauauaaccauugcccugguaaaagccauaggucccuuggaaaugucugggauaaugauuaauaguauaaauuuuuggcauuguaugggaggguucuuccuuaaagaaacuuacccugccuuuaguugagaguuucuguuucuguaaacuggcucaacucaaggaauugauuaagaggcugugacuuucuguuuuuaugauucaaauuagacuuuuguuuacuuggccuagaguuuucuuauuugguacaggucaaguaagacuaugggaagcugccuaucuugcuucuacuuagacagaaacagugugaucaacuagccaaugccguaaguuuuuacaugggucagguuauucugauugcugcuuugacucugcucuccauuaugguaaccuuggcucuccauuaugccaaccuuggcucuccauuaugcccaccuugccuuuggugguugaauguugacacuuuccuaucaccuagaaucugauacuuucauugcauuuaaguuucccaacucaguggccauagcuccuacuauaaggucugcccuuuagauaagagugaucacagagcuuuucaaggaugcuaggccuccccuuacaaauuuauuucuuacagucuuggugaaagguguguuuucuggauucuuccaggguggguaaauacaucuuaagugacaaaucgacucaaacauuuuagucucccucagacuuugaaucccuuucucugcauuaaacugagauaggcccugcauuccugacuugcucacugugagcugccuuuugauucacauuucagccaaccaaccgaacaaacuguuagagaccuuucuaacucccugaauggcaacauucaaugcagacugucugcuucgugaguccucaccaaugaauucaucccaauccaacuuuauguuccucccaccauuaucucacgcccuuaauauccauucccacacauguucccuggauuucugucuguguaaauuagaaaacucaaguagucuuggaguguggugaaccuccucauggguuguauuuaguauuucaccuuuaggggcauuuucuaugacuugagucuaguuauagguuuagaaccaaugagauauuuuggagguggauccugagggaaauuggcauuaucuugcauggcagcugccuccagggaggcuauuacaguuuccucaggcaaugcaggguuaguccccucagauguuggagacgcuguuuccacuggcaaagacgacucaucagaauuuagaggcucagccaggcgccuguaaucccagcacuuugggaggugaggcaggcagaucacuugaggucaggaguuugagaccagccuggccaacauggcgaaacccugucuccauuaaaaacacaaaaauuagccaggcauaguggugcacuccuguagucccagcuacuugggaggcugaggcaggagaaucgcuugaacuugggagguggagguugcaguuagcugagauugugccacugcacuccagccugggcaacagagcaagacucugucucaaaacaaacaaacaagaaaagaaagaguuuagagcucaguguacccagcuuuaucaaagucuccccacauguccucauuucaacuuucaagauccaguuccuuauugaucaauaaccucaauuuaacaguagauacccuacaaggcuaggaguucaauuugcuuucagccagucacaggauaagauucuagguuugauuuucaacaaucucagcucugcaacuaccggcgauauggcuguccuuuagggcacacacagaaaauuucaggucacuuauauggugcuugaacuaggaaucccugcgcuuaucaucuucuuucccuacuuuguccaguaaaauaaggagcaaccaggcaaucucauacuguuaguaugagaaaaauguuugaaggcaucauauacauaguuacccagauccuugcuucuuguaaaugucugauuaggagucucuaguguugauauguuuuuggacugcaauuaccauaucaugccgugaacuaucagugcuacguuaacuuuuggaaauagagucauaagugucuuuaaaaaucuaaucagauuagauagcccauucuagaaaccuuggaaucaauucagaaaacucauucucaaaguucuguuccucuggaaccacuguugguccaaaaucugaauuaguuagacugcagagaaacaauaucaauuggauauauacauauuauauauauguuuauucauuuauuauaagcaauuggcucaugcgauuaugguaagcaacugaaaaucccagauuuguaggaugauuuggcaagauggagacacaggagagaugaugguuuaguuccaguccagauuugaaggccugagaaccaggauugccaauaguguaaucaguauuuauccugagaucuuucaccauaaucugaaggcgaaucauuggcucucucccuuuugaaucuccuguuugcauuucccauauuaccuucuuucuuuguuuauuuccuccuuucauggagcuuuccuuucgguaguuuccuuagauaaggugaauuagagguaaauuuuuugagauccugcaagugugaaaaugguuuuauuuggacuaaauacuugauugauggggauggaaaucauuuucugucacaguuuugaaggcauugcuuuauugucuuccaguuuacagaguugcuguuggaaagucugaagccauucugauuuuuauaccuagcuuuucccucacccccucugaaaaagcuuggagaaugaccucuucaaggugauaugccuugauguggguuuguuuuuauucaccgugcuauguaauugguggguacauucaaucugggaacucauuuuuuuuaguucuggaaauuucuucccuuucauuuuuuuggugugauuucuuuuccuggaucacauauuauuuggauauuggauuuacuagauuuccuuggauuuuggauuuccuggauuuucuuaucuuuccugucuuuuuaucuguguuuuuuuuuguuuuuuuuuuuugaccuacuuucugagcaacuucuucaacuuuaucuucuaacucuuuuauugcgguuuucauuucaggcacuaugauuuuaguuuucagaaacucuuuuauauucucugaguuuuuuucccacuuauuuuuaagaaauaaucuauucuuggccaggcgcgguggcucacgccuguaaucccagcucuuugggaggcugaggugggcggaucacaaggucaggagauugagaccauccuggcuaacgugguaaaacccugucucuacuaaaaauaccaaauaaaaaaauuagccuggugugguggcaggcgccuguauucccagcuacucgggaggcugaggcaggagaauggcgugaacccgggaggcggagcuugcagugagccgagaucgcaccauugcacucgagucugggcgacagugcgaggcuacaucucaaaaaaaaaaaaaaaaaaaaaaaggacauaaucuguucuuauuucaugcacgaaacaucucucauguuugucaguauguuaaugauaauuuuuuucuuuuuuuuaaauauauuuuaaguucuaggguacaugugcacaacgugcagguuugucacauauguauacaugugccauguugauaugcugcagccauuaacucgucauuuacauuagguguauauccuaaugcuaucccuucccacuccccccaccccaugacaggccccggugugugauguucccuuuccuguguccaaguguucucauucuucaauuccaaccuaugagugagaacaugcgguguuugguuuuuuguccuugggauaguuugcugagaaugacgguuuccagcuucauccaugucccuacgaaggacaugaacucauccuuuuucauggcugcauaauauuccauggugucuaugugccacguuuucuuaauccagucuaucauugauggacauuuggguugguuccaagucuuugcuguugugaauagugcugcaauaaacauacgugugcauaugucuuuauagcagcaugauuuauaauccuuuggguauauacccaguaaugggauggcugggucaaaugguauuucuaguucuagauccuugaggaaucgccacacugucuuccacaaugguugaacuaguuuacaguccaaccaacaguguaaaaguguuccuauuucuccacauccucuccagcaccuguuguuuccugacuuuuuaaugaucgccauucuaaauggcgugagaugguaucucauugugguuuugauuugcguuugucugauggccagugaugaugagcauuuuuucaugugucuguuggcuucauaaaugucuucuuuugagaaaugucuguucaucuccuuugcccacuuuuugaugggguuguuugauuuuuguuguaaauuuguuugaguucuuuguagauucuggauauuagcccuuuguuagaugaguagauugcaaaaauuuucucucauuuuguagguugccuguucacucugaugguaguuucuuuugcugugcagaagcucuuuaguuuaauuagauccuauuugucaauuuuggcuuuuguugccauugcuuuugguguuuuagacaugaaguccuugcccaugccuauguccugaaugguauugccuagguuuucuucuaggguuuguaugauuuugggucuaacauuucagucuuuaauccaucuugaauuaauuuuuguauaagguguaaggaagggauccaguuucaguuuucuacauauggcuagccaguuuucccagcacuauuuauuaaauagggaauccuuuccccauuucuuguuuuugucagguuuuucaaagaucagaugguuguagaugugugguauuauuucugagggcucuguucuguuccauuggucuauaucucuguuuugguaccaguaccaugcuauuuugguuacuguggccuuguaguauaguuugaagucagguagugugaugccuccagcuuuguucuuuuggcuuaggauugacuuggcaaugugggcucuuuuuugguuccauaugaacuuuaaaguauuuuuuuccaauucugugaagaaagucauugguagcuugauggggauggcauugaauguauaaauuaccuugggcaguauggccauuuucacgauauugauuauuccuauccaugagcauggaauguucuuccauuuguuuguguccucuuuuauuucauugagcagugguuuguaguucuccuugaagagguccuucacaucccuuguaaguuggauuccuagguauuuuauucucuuuuuagcaauugugaaugggaguucacuuaugauuuggcucucuguuauugguguauaagaaugcuugugauuuuugcacauugauuuuguauccucagacuuugcugaaguugcuuaucagcuuaaggagauuuugggcugagacggugggguuuucuagauguacaaucaugucaucugcaaacagggacaauuugacuuccucuuuuccuaauugaauacccuuuauuucuuucuccugccugauugcccuggccagaacuuccaacaguauguugaauaggaguggugagagagggcaucccugucuugugccaguuuucagaggggaugcuuccaguuuuugcccauucaguaugauauuggcuguggguuugucauaaauggcucuuauuauuuugagauaugucccaucaauaccuaauguauugagaguuuuuagcaugaagggcuguugaauuuugucaaaggccuuuucugcaucuguugagauaaccaugugguuuuugucuuugguuccguuuauaugcuggauuauguuuauugauuugcauauguuguuuaaaaaguuuucuuucuucugcguaaccucuguuucauauuaccuuuuuucuuuguuugaguuuccaucuuucacauuagccauguuccucagcucucccauagucccugguccaaaggaggggaauaagaagcagagaggucacucuaggcucaugggggaggcuuguuaacugaaagcuuuccuauaggaugauacagcugaacuuuuuaauuagggaaauggaaaauccacaucuuuagguuuuuuuccucuugggcuuguuaagauucccuugugaagaccuuaucuaucugcauccuggagggccaaguccuagcugucagucgggcacgguggcucacaccucuaauccuagcacuuugggaggccgaggcauguggauugccugaggucaggaguucgagaccagccuggccaacauggugaagcccugucucuacuaaaaauacaaaaauuagcuuggcaugauggcgggcaccuguaaucccagcuacucaggaggcugaggcaggagaaucgcuugaaccagggagguggagguugcauugagccgagaucaugccauugcacuccagcccgagugacaagagugaaacuucuccucaaaaaaaaaaaaaaaaaaaaaaaaaaaaaaaaaaaaaaagaccugacugucagcauucugggagggaaacaggaggugagggaaaauaaggcugggaccucaguaugagguagguaaaugcucaguucauccccuuguuuuuagaagaguuucugugccuguuacugugccugguaucucuugaguccuggaaccuuguguucuacucucuccagaaaauaaaccuccaguguuuugccaggguagagaagagacagucacuuggcuucacaaagaugguaggugacuugugggccaaacugcuucuuaagcagauuuaaaauuuuuccucuuuauuccugccaccugccccuccuuauucucuauagccagagguaccuauuacuaccaguuucuuaucuccgaggaauucuacgguguaaaaaggguugaucucaguuuuuucuguugccacuuuaagauucaguuuucugagauacauugagucauuuauuacuucaccaauuucuuuucggcuucuaaguuuugugcagucuccuuucccaguuccauugucuguggguuuaugaauuaaaaaaaaaaaacuacuuucugugggauuuuaggagggagggaaaauacgugcauguauucagacuucuuaccugaaguuuguugauggcuucugauuuuaaagauaagucaauucugguguuauaggucuaguuuucauuccuuugaacauuugaacauguggagaauaaggauuuaaaaguccuucacuagcucaugcauucucaaauuccuuauauuuuuaguaaacaccaaauaaauauuuaucaaauaagugaagaacuugagagcuaacauaagagaagguauugacgcuuacuaucaaauuuggcccuuaaaaaaccuuaugaggaaggcagggcucagagagcuaaaugguuugccugaggucacacaacagaaagcagcaaaaccaugaucucauccaccgugagcauggugagcugaugaagacuuacugcuagaauuuaucaaagacauuguuaaaggaaaauaacuuacauugguuuacuucuuaaauggaaauaggacauauugaaauauugaauauacaaauaagcaaaagguagaaaauaaauauuuccucuacugucaauauucuggauaaguaacuguugaaaauuucaugaauaucuuucacuuauuuuuugugcauaugaguguauaauauacaaaaaugguaucauauugacauacugcuuuaaaaccugcugccuuucagccugggcugcauagcaagaccuugucucacuaaaaaaaaaaaaaaaaaaaaaaaauuagucaagugugguggugcaugccugcauuuccaucuacuuaggaggcuaaggcaggaggaucacuuuagccugugagguaaaggcugcagugagcuaugaccuugccacugcauucuagccugggcaacagaaugagacucugucucaaaaaaaaaaaaaaaaaaaaagcuaaaauguaacugcccguuuucaauacuaacaauaaauugugaauacuuuuccauguuaaccauuuuucuacaacauuguguuaaugauauacuauaauuuauuuaaacagucaacaguguuagcaguaaacaucuguaugguuuaguuguggccuccauuuauccuucuggauaaauuuccagaagcaggauuccuguauuaaaggcuucuaagacauuuccacauaaucuccagaaauauauaccacuuuuuaccuucauuugcuauacgugacuguucauuccuucauauguuuccaacaucaaguauuuccauuuuuaaaacuuugccaauugaauagccacaaaacauauuuuuauuauuuaaaaauaugcauuuugcaacauaggcaacauagcaagaccccaucucuacaaaaauaaaaacaaaaauuagccaagcaugguggcguguaccuguaguucuagcuguuugggaggcugaggugggaggauugcuugagaccaagaguucaagguuacaguaagcuaugaacgugccacugcacuccagccugggugacagagugagauccugucucuuaaaaaaaaaaaaaaaagggaaagcaagaauagauuguuacuuugucaucugucgucaguguuugucaauguauuuaauuaguagggacaucuaaaccaagcauccauauaugauaaaugaaaaaaacaaaaguauuagcuggcaguguuuucuccaacccuuccuagcugaucuaaccaguggugcaguugguuuauaugugagagcaaugagaaugaauaugcugcaaaugguacuauacugugcaugguuuuuaauuuacuuauaaucuauuauuuaauaguguuucuuuuagggcuugaguuugaauucaggcuaacuuuuaaguacaacuuaagauuuauuuuuacauuuugucauuacauaugaaauguggaacaaaaauguaucaugugugaggcaggaaagguuuuccacgguguugagggguauugaggcuguucauccagguguuuagacuguuguagggaauacuuuuauuucaaaagcuaaauugccauaacuuuuuuuuucuuuuuuuaaauguuuaauguuacagaagccaaggcugcccccaaagauuguuucauugaagugaauucuaaaggugacagauuuggcaauugugguuucucuggcaaugaauacaagaagugugccacuggguaaguggaggugcggucauaauggaauaugaaagauuauaagauccgucaucucuaguaucuuuuuuuuuuuuuuuuuuuugagacggagucuugcucuguugccaggcuggagugcaguggcgcgaucucggcucgcugcacccuccgccucccagguucaagugauuccccugccucagccuccugaguagcugggacuacaggcaugugccaccacgcccagcuaauuuuuuguauuuuaguagagaugggguuucaccauguuggccaggauggucuugaucuccugacuucgugauccgcucgccucagccucccaaagugcugggauuagaggcgugagccacugugcccggccgucucuaguaucuuuuacaacugcucucugugaccgcugauuuucucccccuuaaauaccuaacuuuucaaacauuuuacaaugcaaagcuucagagagacucugguguuaggaaaagaacugguaacauaauuugucccuuuagacaucaacuacaaucuagugguuuuuagacucuuauuuuguuuauccuugauuuauaauaagaaccccaacuaaacaccauuuucauuuuccuuuccauaaaagauuauguuacuaagucccuagauaaagguaccugcagaagaaacucugaacuucauuauuuucuucuagcuuuguauaauuucaagaugaugaauuuaaaauauuuuauauuucuacaauuaacauuugcuuuuuguaaaacauuaauaaugaaacauuacaaaggaggaaaaagucauguauaaucucaauccauauauguucacuaauaucagugaaauuauuuucuucuucacacuaacauuuuacauaguuggaauuauucuguaauauuaucauugcuucuacccauucuaccuccuaugcuaucaguuaagcuaagcaacuacaguaaaacagugcuugcuaagaagaaauagcaacaaagacccccaugucacucaaucugacagucguuuuuaggucuucauacaauaguacuugaccugucaguagcauucaauuaugcuggccauuuucuccuucuugaagaaaccucuuuuuuuuuggugauuguguaggguguucuucuucuccccugaccccaugugauuucguuuacuuccguggcuucauuugccuccucucugagaagcuccagcccugcuggccugcauguggccugcggccacagggcucugcaccugcuguucccucuguucagcaugcugucuuucccccucucagccugcucaguucuucguccuccagaucucaggugaagugugguuuccuuacagaagacuucuuccacuuccucaacaggaccagcucucccucugacagguguucuugaugcuguuugcuucuuuuucauagaauuugauauguuuucauuauuuuuuaguucauaguauuuucuaauuuacacugauuuuuuuccuuugacucguguuauugaaagccuauugcuuaauucccgaguaguugggaauauacugguuaucuguuugguuuugaugucuaguucaauuccauugagaacacauucuauaugauuucacuuuuuuggaauuugagaugugcauuauucaguuacacuuggaacauucauccauacagacuaauaugugggccagccucuuaauaccagaccaauauauggucuguauggguaaauguuccauguauaauugaaagaaaaaguauauucugcaguuguuagagauguuauucuauaaaugucaaguuaauagucuuauucaaauauuucauaucuaugguguacguguguuauaucuguuccuucaauuucugagagagguguguugaagucuccaguuaugauuguggauuugucuauuuaucuuuuuagguauguaaauuuuugcuguguauguuuuaaauuuguuacuaggugcauacacaauuaggauuguuaugcccuccugaugacuuggagggcauuagcaaauuuaucauuagcaaauucuuuucauuucuggaauauucuuuugaaguauuugucaguuucauuaauuauguagcucuuuuguuaucgcuguuccucacuaaacuguaagguucagugacacauuuuaucuugcauuuagcauaaugcuuggaggaaacauaauaaaugacuauuaaacauugaaugaaugaagguacagaugauauggaugaagaaugaauggguggagaauuaauauaaccgauugaaugaacugauuuaaaaucuagggauaaguggauuaaugcagacuuggaaagaauuugcuggacauauaccauauucuugucuuuagccuugucuuguuucauauuuuuaugaauaucuuauugaaaauagcaacuauacuuaucaaacuuuaaaauuacugagucauuuaggaagcauuuuauguaauaguaguauacaaacaauauagucauuaagaauauacauuugaaguuagacucuuuggauuugaauccuuguucaaucacuuaacaucucugagucuuuggacaaauuacuucacauacauaccucauuuuucuguucuguaaaauggggauaauaauggcaccuguuuccaaguguuguuuugaacugaaugaguuaauggguguuaguacuaagaggaauaucugguucauugucacauucaucaucaucaucacuauuuuuguugucauccuccuuggagaauguguaaaaucuggaaaagucuuuucuacccauugaaacuaccaaaaacaucuagaaacauuuaaagaaaggauucacauaugguccuaccauccagagauauuuccuuaaguuuuuguuguauuucuuuuuuauguguauauacauuuauaaacauaagccaaauguuuccuuucacuaaaaggguuaucuuuuaguacauagacaaugucauuuuuucaagcauuauaaaaaagaaauuccaaauauacagaggaguagaaagaauagugugaugaacaccaauauaucccagaccaagacauuauuaaugccuuaucauuauuugcuucaucaagauuuugcugaaccauuuuaaguaaauuauagacaugauacuuuacuccuaaauuccucagcauccgucuucaacaaauaaggccauucacaugaucacaucacaccuaacaaaaugaaugauuuccuaauaucaucuaguaucugaucaauauuaguauuuccauaaguguccucaaacugucuuuuauagccggcauuuuccaacauccggacucaaucaaggaucacacauugcauuuaguuguuaugucacuuaagucacuuuuaauccagaauaccuuuuagacugauuuuuuuucuuuucagugacauugauuuauggaaauggcugggccagugggcucauguucuggauuuguuuuaguuuccuuuugguguugcuuaacuuaugucucuaucauccgaauuuuauuuaaaucagaaguuaagcccaaaaucuuuuuuuuuuuuuuuuuuuuuugaguagagccucacucucucgcucaggcuggagugcaguggcaugaucucagcucacugcaaccuccaccucccagauucaagugauucuugugccucagccucuggaguagcuaggacuacaggugugcaccaucaugccuggcuaaguuuuguauuuuuaguagagaugggguuucccuauguuggccaggcuggucucaaauuccugaccucaaaugauccgcuuaccuuagccucccaaagugcugggauuacaggcgugagccaccgcgccuggcccuaagcccaaaaucuuaauugaauucagguuaaauauuuuuggcgagaauguucauaagcaaugcauuauaucaaggagucacuuagugcuggguagucuuauuaauauuagugauacuaaguggcaaugaccagaucuugcuauuguggaguuaugcuuuuuaaaauugcagcugucagguaauauguggagugaugaguuugugccauaugaauauccaguuccugaccaguguuucacuuuauggaugauccuugccugaagcaauuauuuuacugaggguuguaacugaauuuuguuucuguuaguauuauucaacagugaaugagcaucucaguuuuguuggcuguuuacauuucuuauuuuaugagcugccuguuuacaucuuugcuaauuuuucuguugaagugauuuucuuugucuuaaugauuuguaacagcuuuuuauauucuaagaguauuuuccuuuacuuuuuaauguaucaccaagccuauguaugaaauacugaguauaucauagcaaugugaauuuugguaggccccaacagaucuuaacugaggucuacuuuaugcuacacuuuguuuuugagguuuucauaucuaauuucagcuaauuaugugagauaggcaucauuuaucucauuuuuuucagcugaagaaacugaagcucagaaaauguaagcacuucucucaggucagcuagcaaauaaauggugacauaagaauaaauguaaaguugggacaaaauuauuaacucuuaaaugcaggaugaagggaagaugaagacuuaauagcagcacaacaaaaauuaggaguuuuagugauauauucaaggacaucaauaauauaauguaguuauaaaagcuauuguaaucuugaacuuaauagaaguacaguaucuagaauaaacaagagcuccauuuuuuucuuugcucaccaggcugucacugaaauuucaugcuccauucugagcacuaugcuucaagaggcagugaggcaaacuggaacauauuuaggagggagcguccuuguugcaugaaaagugauuguaggauagugaccuggugaaguaaguauuuaggagcugcauaauaauuguccuaaaauagcugcugugugaaagaaggaaaagauaucuguguagucucauggggaagaucugggaccaaugaggauaaaugcuuuacagauguagauuuuuaccuaauaagcagaaagaagaacgugaugggagcuagaaugggcaguuucaggaggguguaaauuagagauauugggaaaauauauccuaugaugacugggcagugauaucauagagaagauucagauauagaguaggugcuuggaucagaugacaaucaguuaaacaggaaaucucaguacagcaucauaagaguuauuguuggaaauaccuagaguguuaugaaaggauauaggaagggcauuuaauucacacagccuuggcaauaagaauuauggucagggaagccuucauagaguucugauauuuaauuaaugaauuaacgaguuaaugaauugauucuuuaaauaaguaaccaagaguuagccaggaaaagagggguggaauccuuucuuaguuauuuugcauuauagaaucuaauuucuucuuuaucauaacucuguaagaagacauaauugaauuuugauauugcuauauuauuuucuguauaauagaauuuauaaaauuauacuuagaaacaacuuuauuaguuaggcuguugagcucuagacagacagugaagaagauuaagugugguaaaagaagaagcaucagcaccagcuggugcccuaauuugcaucuuagcauccacuuaacucuuuuuucgccuuuucugccguauuuaaagagagcuacuuugaccucucuugcucucauacacuuucucuguugagauucccuccauagcagcaaacucuguccauaugcaaauauauaaauuuuuucuuuuguuauguauacuggaugcauuuuauguugcauuauuucucucucuuuauaggaaugcuuuguguggaaagcuucagugugagaauguacaagagauaccuguauuuggaauugugccugcuauuauucaaacgccuagucgaggcaccaaauguugggguguggauuuccagcuaggaucagauguuccagauccugggaugguuaacgaaggcacaaaauguggugcuggaaagguaaucaaaauauuuuuuauuuacaaaguaaaaugaaaaaaauuaaaaaaauuauuauacauaguaagugguugcucuuuucugauuguaaaaguaaucuaaauucauuauagaaauuuuagaaaauacaaagccaccaaaagaaaauuaagaacuauaauucuguuauccacauuuccuuacuggggucagauaaccaguguuuuccacuuugcaauauacugugcaugguucccuccccuacugauaugcuacaauuuauuagccaguuugcuauuacugggacacuuuggcgauguccugaauuucagggugugugucuguguacuagaaaugucauggagcuuguccugcccauguuccugaccaccugagcucugcuguuuggauuagauagaaggccagagucagucagcccaugacuuauuacuagugguuucauaugagaagaugcccugggccaaauuccuuuuuuuggagaauauaaaauuaaggaggguaauuaagagugcgggcagaaacuguaagaauucguugggagaugcugugaaguaggagcugggguagaagggauguggcagccuuaagccauauacaagagauaugagggagcaggauuguugaguaaguugaagaaaccaacucagaggagagagagaaggagaauauaugauugacugauuagcccaugaaaaagacaggugggugggccuucaaguuacuucacuuucucccaaguuuucaguuccaauucuguuucucacuucucuuuacaagaagauccauauauuuuugguccuguccuugcaacuaaauaaacuugaucguugcagcuguuauaaacaaugauaagagauauauacauuuaaguuuuugauagugcaauuucccuuucaauaaggugguaacaaucuauaucccagccuaggcagcagaggaagacucugucucaaaaaaaaaaaaaaaaauugugcugaaaggcucaugacaaaaacaacucucugacaugcucuuaucuaaucugccagucuagacgccuagaagcaacugugguuacuucuguuaauuaccucccuauuuuaaauuagggcugggcacgguggcucaugccuguaaucccagcacuuugggaggcugaggugggcggaucacuugaagucaggaguucgagacuagccugaccaacauggugaaaccucgucucuacagaaaauacaaaaacuagccagugugguggugcaugccuguaguccuaacuacucaggaggcugagacaggagaaucgcuugaaccugggaggcacagguugcagugagccgagauuaugccacuguacuccagccugggcaacaaagugagacucccaucuaaaaauaaaguaaaauaaaauaaaauaaaauaguaugcuauuucuagauuuaucuauuuuagacauuauccacuaguuuuauuuuugauagauaagaauucaauuuucuuaugcaaaucccaguuucccugcuguaccuuuucaaaauaagugcuuaauauuuacauaauuaauauugggguguuauugaaugaguccacaacaucucacuguucacugggcauauuccagacgaggugagagaaaacaggggaggcuaaacaauuggagaucaaaggaucauuuuuauuaggaagaaagcauguaacaugacuuaaguagauagcaaaaaugggcuuccuaaugcugcccuacacaguuaaacuuaccuguccagccuuaccugcgaaguuuaacugcaugguugaaagggcagaccagaaugcacccuuucugccaccucagcuuacuacuagcuggcaccacagguguaaccagcaugccuggcuaauuuuuuuuaauuuuucuguagagacaggaucuugcuauguugccuaggcuggucuucagcuccugggcucaagcgauucucccuccucagccucccaaagugcugggauuacaggugugagccacugcaccuagcugggcaucuuuccaugucuuuauuagauccauguauuuuuuucugagaaguucauauugauaucucuuuuucuauuagcuugccauuuuuugaggcuucucauaugagaagaauauuaacugucagucaguuauaucuauguaaauaugaucaacaauuugacauaagccuauuuuaaaauaucaugaauuuuuuuuuuuuuuuuuuggagccucacucugucacccaggcuggagugcaguggugcaaucucagugcaaccuccgccucccaggcucaagugauucuugugccucagccuccccaguagcugggauuacaggcaucugccaccaugucuggcuaauuuguguguuuuuaguagagacgggguuucgccauauuggccagacuggucucgaauuccuaaccucaagugaucugccugccuuggccuccaaaaguguugggauuacaggcgugagccauggcauccggccuuaaaauaucaugaaauuauaucagucuuaucuguuuugucuugguuucaugucauguuuagaaaagcuuuuuguaucucaguauaauaugaauaucuggcuuuuauuggcacaauuuauuaacauuucauccuauuucucugaucuuauugcugcuguuaaauauuuucuugauauuuucuacuuuaucuuccucuugcaguauuacacaaauuauuuauuuguguguggggugugugugugugugcacauacacuuugguaguuguaugucuuucuauucugcuuguuuacuuaauaacaaaaaaaugaauauauuuuucucaaaguugucgugauuaaaaauaguaucuacugauuguugcaguguaagcuauaccacuauuacuuccaaacccccaugucccaguuuuuacuugguaggaaaaauauuggcuuuagauuccagguuguuauuaacauauaucaauguauuuuuaagaccuuuugucuuucuggauuuuauugcuaacugcauaguuuucuagcuaugacaauaauauuuauguacaagaaaggauagcaagugguugguguguguaccuggacugauacaccuugacccaaacugacaugccguugagaccauauaccacacguucuguacagcuguaacuuuguaacuguugguuuaaucuaugagucuaacacccaaguuuucacacggcagauaggauccugucccuucugguauguaccaaagccuagacuggacaguuugagcagacugacaacuugguacuucuucagaucuguauucuuuauauauuuauucaacauuuauuuccaggacaagcuaaacgugggguagggggaaaaguggaaaauaagaacuccucaccuucauuuuuauugucccagguaguucaauuuugcuccccacuugcauccugaaaucaguaaaccagaaguccuauagucaaguuugcucuacuugcugcguggugguuguuggugguggccaugggugguagggggagugguaguaguaugugagaggauggucuuaccuucccacugugagaguuuuuuuuuuuuuuuuuuuugaggcagggucucgcucuuugacccaggcuggagugcaguagagugcagaucuuggcucacugcagccucugccuccuggguucaaacgauucugcugccucccagguagcuggaauuacaggcuugcaccaccaugcccggcuaauuuuugugauuuuaguggagauggggguuucaccauguuggccaggcuggucuugaacuccuggccucaagugauucacccaccucggccucccaaagugcugggauuacaggcgugagccacugcacccgguccccacugugagaguuuuuggguguauuccuuucaguuugauuuuucccauuccacaagguaaacacugccaaucagaacacccuuucucuggaggacuuggaauuuuccugccccuuaaaguaaaucugccaguuauuaacacauuucaucuuauuuaacacuucagguguccgcuaugaaucaauuauugacaggaaaaucuucuuuuaacugguagggaaacucuugguaaauaucuccucuaaagacuugcggauguaagaaaaaaguauuuugaaaucuuuauucaggaguagugcauggcuagaggacacaugaggagugacuuacuguagaaucuucuguaauuuuggaauuuuaaaucauauauguccuauuuaaaaauuaauggaaaauuggaggaaacaguguuuggagaucuuuugacuuuaaaaguacaauucuguuuaaaccuguguauuuuuuagagugguaaggcuaucgauauuucguuguagguuuguucucuaauuguucuuuauuucauuugagcauuuaaauauucugaucuuguacacaagaucaguugguuaguuaccuaauaaaauuuuaaaauagcacucaacagucuuuuaaaacguuagucuucuuuuuuuccucuaacaucacaacagagcaguuuucacaaagaugucaacuaaaaaauuucuaaaauguguugagcugauuucuuuagaucuuagguuuaauauuuuuuucugagguaaugguuuuuaucucucaguagcuaggauucauuucuguuucauaucucaucauaugaacuagaauuucuugaaccauguaagauuauaacuuauuuucaacagugcuuuuaauagaaauaucuaaucaugguacuagaaaacagauuuuaucuugucaacaaaguacccuuuuauuuuugaaagaauuuuaaaaauuaaaaugaguuuuaaauauuauccuuuugauaucugucauaguaacaacacuuuaugagagguguaauagaaauagaccuucuauccuugaaacuuucuuguaguccugggguuaacucuaucuaguuacuuuugauuugaaaaagucuauuugugaauauuuuauuuaggaucuucacaucaauauucacauggaaggauagauaauaguuuuaucuuuguuuuuggucuuuaugucaucuuuguguuuuuugauaauuaauuuuguaucaauuaauuaaugccacuuauuuuucugcauuuuuaaaaauauaauaugggaauuaaugguuccuugaaaguuugaaagaauucugcaaugaaauaaucuguacccaggucuuuuuucuggguacuuuuuaaugacugugcucaaucuuucuuuacuuaguucauuuuuuuuuuuuucagaucuguagaaacuuccaguguguagaugcuucuguucugaauuaugacugugauguucagaaaaagugucauggacaugggguagguaauguuuucuuuuggcuuguuccugaaaguagugcuaaauaaugagaaaucucaggacuagaugagaguucccaggauuuucagauguuggggaauuuagauuccugauaaaauuuucauucuuaaacagugucaguaagcuuguaugaauuuaguccuuucucuugguuuccauucuugaguugaugauauagagcaacauucacaauuaacaaaagugguauuuugauuguuuugaagguauguaauagcaauaagaauugucacugugaaaauggcugggcucccccaaauugugagacuaaaggauacggaggaaguguggacaguggaccuacauacaauggcaaguaauauagaagaaaauuagugugaucucccaguggcccaaggcauaaauugggcauccucguaccucucccucacuucccacaucaguuauacauuuaauuauguugauucagccuccuaaauuccuugugacuguuuccauuuuucucauccccauuuauuacuuucaauuucuugccuggacauacaucauagccucuuauguaggcucccuauuuuucaucuugcuuccuauaauccauguuucacucuacauuacaguuucaguguuuuccuacaagaauucaguuuugauuuugucagcgucuugcuuuaauucagugcgucugcauugcuauuagaaugaaguccacaacuccuuaacauggguuaaaugcccugcaugacuugccccuagcuugccuuucaagccucauuucacuauguugaagacauauuguaacuucuuugauuuccuguacuaggcuacuaucuuuuaccugugggcuuucauaccguauuauuuucacauuguuggcccuuggcuaauugcuauuuagguuucagauuauaccucauuuucuaaagaaaguuuccccuggcugcuuaaaucuaaauuaucauuuccuucuauugcuuuucuaguacuguuagcacuaucuguuagcacuaauugcuauacuaauuacugauuugcuuuuuaaaauucccugauagaccaugagcucccaguuuaucgguaucuuucuagugacaucauaugcuuuuuuucucuuggguaacuaccagcuagaaugacuagucauauaguagguguauguuaagcuuuuaaagaaacugccaaacuguuucccaacguggcuauaccaguuuacauccuuacuagcuguauaugagagaauucccccaauuuccccacauccucucuaacaguugcuauugucagucuuuuuaauuuuuagccauuccaguagguauguagugguauuucagugugguuuuaauuugcauuucucuaauuacuaaugauguugagcaucuuuucuuguacuuauuugccaucuacauaucuucuuugguuaugugucuguuuaaaucuuuuuuccaguuuuuaauggauugucuuaaugaguuuugaaaguucuuugcaugucacugauucaaguauucaaguucuuuaugaaauaugugccuuguauauauuuucucuuagucugcuuacuuuggguuucauuuguucuuuuucuaguuucuuaagguggaggaugaggucaucuuuuuuuuuuuuucugauacagacauuuuauugcuaucaguuuuccuuuaauucagaaauuuugacauguuauaccuccauguucauucaguucugaauaccuucuaauaugcuuuuuuuuucuuugacuuacagguuauuuagauaugugcuauuucuuuugaaauaccuguggauuuuuuaguuaucuuaauguuacuaauuuaaauuuuacuguagcaagagaacauauuguguaugacuugaauccuuuuuuuuuuuuaaacuugucuuguagcccagaaugugguuuaucuuaguaaaaguucuguguacacuugaaaagaaugcguauucuacuauucuuagguggaauauucuguaaguuauuaguucaugucaguuaauagguagucggaucuuucauauccuuacugauuuucuggucuacuuacucugucaguuauugagaggaauauugaguucuuuggcuauaacugccaauuugccuauuucucuuaauaguucuaucaauuuuugcuuuauuuauuaugauguucuguuauuagguacauaaacacuuagaauuauucuauccucuuuguaaauugacucuuuauccuuaugaaauagccuucuuuuucccuaguaauauucucugcccugcaaugagauauuguuaauauagcuacuccagauuccuauuaauuagucagcauggaaaaucuuuucccauccuuuuacuuuuaauuucuuuauaucaugcuauaguaauuaguacauauaguuggaucuugcuuuuuaucuaaucugccauucucugucuuucaauuaaguuguuucgauaauuuauauuuaacuugacuauugauguguuuauguuuaaauuuacugucuugauauuuuccaucagucuccuuguagugauauuguaacacuucaguauauuuccauuucucucauuuugugccauuguugucacauguuuuacuucuacuaauguuauaaaucccacaauucauuguuacucauuuugcuuugaacaguugauuaucuuucagagacuuaaugguagaaaaagucuuuauauuuacccauauaauuaccauuucugguguuuuucauuuauguaaauuugcauuucaaucugauuuaauuucugcuugaaggauuuccuuuuacauuucuuauaauaccagugugcuagugacaaauauuuuuagcuuuuguaugucugaaaaagucuuuaauuugccuugcugcuugaauaauaauuuaacugggcaaggauuuugggugauaguuuuccucccguuuuacuucuaaggauauuccuugucuucugacuugcauuguuuuuccugaaaaaucugcuaucauccuuuucuuuguauauaaugucuuccguauaugucuuuuucuaaucucuggucacuuguaauguuuugcucuuuaucucugguuuuuauauugugccuugguguaguugggauuuuuugagcuuuuuggaucugugcuuuuauaguuuucuucaaauuuggaaaauuuuuggccaucguuucuucgaauauuuuuuucugucuuccucuuucuccucauccagguccuccaauuuuauguauauuuggcugcuugguguuauuucacaugucacugauuggcuguugauuuuuuauuuuuguuuuuuuuucuuaaauuuuaauuuaacuuuacuuuuuuugagacagagucuugcucuaucacccaggcuggagugcagugguaugaucuuggcucauggcaaucucugccuccgggguucaagcaauucuuaugccucagccuccugaguagcugggacuacaggcgugugccaccacgccuggcuaacuuuuguauuuuuaguagagacaggguuuuacgcuguuggccaggcuggucucaaaguccuggccucaaaugauucacccaccucagccucccaaaguucugggauuauaagugugagccagcaugccuggcuggcuguugauuuuuaaaaauuauuccuuauucuccauguuuaauuuugaguaacuucuguuacucuucaaguuuacauuucuugugugaagucuaauuugccauuaacuugaucuaguguguuuuucauuuuagacauuguaguuuuuauuucuggaaguuccauuuguuucuuuuauauaucuuucaugacucuacauaagaugcucaaucuuuacuuuuuugaacaaauagaauacaguuguaauaacugcuaauguccuugucuacuaauucugucauauggguaauuucucaguuuugauauuuuucccucuuuuauuuucuguauuuuuguaggccuuauacauuuuuauuagaugccagaaguuuuaaauccuacuuuguggguuauuggauauuuuuggauuucuauugaugagguuuguacuaguauguuugaguuacgucgacauaguuugauccuucugggucuugcuuuuaagcuuuuaaggcaggaccugaauagcauuuagucuagggcugauucugcuucauuacugaggcaaaaccacuucuguuuauccugcuuaguaccacguuaauuaugagauuucccacugaauuauaggagcaagugcucuuccuaguccugugugagcuguggggcuuauuuccaccaaucuuuucacaugguucuuucuccagcuucauguggucuccuuacaugcauauauccaucagcaccgaugcagaucuuucagcuuuuucucuguagcucucuucccuuugguacuuugccuaggaacuguagcugccuugcccucuucagaauaccagcuccaucucuuuaacugagggagaccacuggguuuugcuuuggugcccacacccgagugucuguuaacuuucuuuaggcacuaaccuuggacaauucuaaggcucacauuuuuuuuuucugccucucagggaucauugcucuuuguugccugauguccagugucuugaaaacuguuguuucauauauuaugucugguuuucugguuauuuuagcuggcagaguaaaucuggucccuguuauuccaccuuggcuauaacuggaagucagaacuauggauuuuaauggcuguguaucauuucauccaguggaugugcuauaacuucacuuagcuguuuucuaauuauuugacauuuagauuguuucuaagguuuugauaacucacuguuaacauuguaguguacauguuaauguguaugcauuuuuccaauugaagaaucaauugccaguaaugagauuaguuugaagagaauaauccuuuuuaugguucuuuuaggaguaaaaauuccuaauaaaugauacauuuguguaaugccacuaacagugcgaagguaucaguuucaaaauaaucuugccaguguugaaugcuuuaauuuaaauuuuguguacucauuaguaaguauaaaaugauauaugaagcuugcuuuaauuuuuuauacaguugaccguugaacaaugcaaagguuaggggcuccaacucccugcauaguugaaaacccauguguaacuuuuggcuuccccaaaacuuaacuacgaauagucugcuguugacuggaagacuuaccaauaacauaaacaguugauuaccauagauuuugucuguuauauguauuauauacuguauuauuauaauaaagcaagcuagagaaaagcaaauuuauuaagaaaaucauaagagaaaauauauauacuauucauuaaguggaaguagauuaucauaaagaccuucauccucaucaucuuccuguagaguaggcugaggaggaggaggaagaggagagguuggucucagggguggcagaaacacaagauagccugcauauaaguggaccugcacaguucaaacccacauuguuccagggccaacuguauuuugauuuucaguugggauaaauauuguuucauauaguuuuauacaacuuuuuuuuuuuuugagauggagucucgcucuguugcccacgcuggagugcaguggugcaaucucggcuccgccucccggguucaugccauucuccugccucagccucccgaguggcugggacuacaggcgccugccaccacgcccagcuaauuuuuuuuuguauuuuuaguagagacggggcuucaccauguuagccaggauggucucgaucuccugaccuugugauccgccugccucggccucccaaagcgcugggauuacaggugugagccacugcgcccggccaguuuuauacaacuuuuuacagaaauuucugguucuuuuacaaacuuaaaauuaugaaucaguuuaccacucccguuuauaucuacuauauuguuucucaaaagaacacagaacagauaaaauacuuaaagaauuuguaaaaguucuaaugaaacuuaaaaucuagaaggcguaaaaauaagauugauaaauucaacuauacaaaaauaauaaacuuuuccguggagaaaagcauagugccauagguuaaaauggggaaaauauuuccaacuuguaucauggacaaagcuaaucucucuaauauauaaagaacuuuuagaaauuaagaagaaaaaagcaagaguccaguagaaaaacagucaaaggacugagcagaaaaaaauaaauaauguuuccuuaagaaaaaagugaggccaggcacgguggcucacgccuguaaucccagcacuuagggaggccgaggcgggcagaucaugaggucaggaguuggagaccauccuggccaacauggugaaaccugucucuacuaauaauacaaaaaaauuagcugggcgugguggcgcauaccuguaaucccagcuacucgggagguggaggcagcagaaucgcuugaacccaggaggcagagguugcagugaguggagaucgugccauugcacuagccugggcaacagggugagacuccaucucgggaaaagaaaagaaaaaaaaauuaucaacucauaguauaaaaaaauguaaauuaaaauucuauaagagaaaauuuuucaccugccugguuggcaaaaauccggaaauuuggcucugugggugaggcuauggggaauucuuauauauugcuuguaauauucuuauaaauuguaaccauuacuauugaaagacaauuugacaauaccuaaaagaaaugaugaaugcacuuauuuauugauacagcauuucugcuuuagggaaauuauucuguaguuauuauaccugcacuaauaugauacaacauaugugcaagguuauucauuauagcaguuuuuuugguaguagcaaaagauuggaaaaauauaaguguuuaucaguaggguacaaguuaaauaaacucuagaacaucuucacaauggaguuucauauagcuguauggaaaacgaggagguccacuauguacagauaaguggaaaaaaacugaugcaccaaaugguauauaaauaguaugcuaccuuuuguguaagaaaguguugacaguagaaacguauuuuguucuugauuguuugcucgaagaaauacuguaagguuacagaagaaacuaauaaaagugguuauuuuugugaaggcagaaguaaagcggacaggaaugaacuuuguggaagacuucucaauauauucaauuaauaucaguuugauuuuugaguaaugugaaaauuaauguaaaguguuuauaaucaucuaguauuuucugccuaguaugaguuuggugacuguugauguaaaauucuucucucuagaaaugaauacugcauugagggacggacuucuggucuucuucuuccuaauuguuccccuuauugucugugcuauuuuuaucuucaucaagagggaucaacuguggagaagcuacuucagaaagaagagaucacaaacauaugaguacuuagauuuuuuucuuuuaauuccuauauuaaauauauacauacauuuucugagacagaaucucgacuucccugggcucaggugauucccccugccucagccuuccaaguaguugggauuacaggcacaccaccacacccaguuaauuuuuauauuuuuuuguagagaugggguuucgccauguugcccgggcuggucuugaacuuuuugaagccauccaucugccucagccugccaaagugcagggauuacuggagugagccuccacgcucagccuauauuaaauaauuuauaaaguauuaaugcugauagucauaucaccagagauugguaauccucuaaaauaggguucuaaguuauuucucugaccuuuugacaugauuagcauggguugaaaggugguggugaccaagccaccucuuuuaauggggaggagaaaggcuuauguuggucagccuuuaggcugcugaaagugacccucaggguucauuuugcuuaacaccaauuucugauagaggacuaaguagauacuucguaucauacuuccaacugaccagucuaugcaaauaacucccccaucugcauuuuugaaguuugaguuccauaacuacagcuaucuuucauacaucuccacugcacugauuugcugucacuucagcaugucuaaaacuuaccuauuaccuuuccagccaauccauucacuacccuuggauuuccuaauuuuuaaaaugacuacuuggcaaccugagaauaugcuuuuacucuucucugauuuuaggaagacuugagaaaaguuagggaacauuggccuaauugaccaaauuucacaauuucuuaaaauuucaguuuaauuauaaaaugugguuaguaaugcuuucuaauaccauaaggauuaaaaauacgugaaagcuguuaaaaugcccuaaaaauuuaaaccguaucaugauuaucauccccaccacuaccaacaucauuauucuguauuugggaaaaugcaaaauguguguaauauuucauguagaaauguuuuuaucuuaauuuagaucaaaaguaauuguaucuuucaggucagauggcaaaaaucaagcaaacccuucuagacagccggggaguguuccucgacauguuucuccagugacaccucccagagaaguuguaaguauaaaaugaaaaauuauuuuucuuuacuguauuaaaggaucaaaugcuuaaggauuaaaaacacaguuauauagcuauagcuagaaacauagauaccuucuuaagaauucaagaguauuguagguggucccugaguuuuuuguuuuuguuuucgagacagagccuugcucuguugcccgggguggaguacuguggcacaauugcgucucauugcaaccucugccucccaguuucaaaugauuucgugccucagccucccgaguagcugggauuacagguguguaccaccacgccuggcuaauuuuuguauuuuucauagagacggggucucaccgcauuggccaggcuggucuugaacuccugaccucaagugauccacccgccuuggccucccaaagugcugggauuacagguaugagccacugugcccugcccccugaguucuuuaaaggaaaaccagcggaguccuuggcucagaggacacagaaaaagacagcuggacauuaggaaugccuugccuagcaaccaggauugggaaaugacaugggacguaugcuaucacugcuuuuuucugugucugcucuuuuccuauuuucaauaccugucuccaucucccuaugggauguuaccaaagaccuggugcugagcucuuggaucggccuaauugucuaagcuguaggacugauagucacuguucugcaaguguauuagggaguguuuagaucaugauauacuuuuauugaguguuuagaucaugauauacuuuuauugaucugcauguaucccuaagcaauauguaauuuuuuaauguuuuaaaacuuuuaagaacguuuuauuugauaauuugcacauauaucugcaaccuguuuuuccccuuaaugucacuuugugauuuaucucuaucgauagauauagcugugauucauucauuuucacuguugaaaaugauuagaaauccuucauuuuuuaauauauuuauacacacacacacacacacacacacaaucucccuauuccacccccuuuaucuuuauaaaaaggagacaaaaaucguuaggcccuuucuccucuuaaccauguaucuuggagauuuuuccauguuguuauguauacaggauggccacaaaggccauaugcaugcuaguucaaaauuaucuguauacucuucuucaucauugccauauauguauauauuucuuauuugguuuuggcaaaauauauauaaaauuugccauuuuaaccauuguuuucaagauuuuuuuguaaauuuaacaguagugguaaaaaaaaaacccacuaauauuuaccaucuuaacaauuuuuacauguacagugcaguacuccuaagaauauuuaccuauguuuucuuuuaguaguuuuauaguuucaggucuuauguuuaaaucuuuaauccaguuugaguugauuuuuguauaugguaugaaauaccaguucauuuucauuuuucuucauguggauaugaaguugucccaacacuauuaauugaagugacugucccuucuucauuguguauucuuggcaccuucguugaagauuagcugaccauaaaguuguggauuugggguucucuauucuguuccauuugucuuuaugucuguuuuaugccaguaguaugccauuuuaauuaguauagcuuugcaguauauuuugaaauuugguaaugugaugcuucuagcuuuguucuuuuugcucaagauugguuuagugauucugggucuuuugugguuccauaugaauuuuaguauuuuuucuauuguuacaaaaauugucauuggaauauuaauagauauugcauugaaucuguaguuugcugugguuauuuuaauauuaacucuuccagucagugagcaugggauaucuuuccauuuauuuaugucuucaauuccuuucaucaauguuucauagauuuccuuguacagauacuuauuuuuugugguuaaauuuauuccuauauuauuuauguauguauuuuugaugucauucuaaauggaauuuuuuuucuggauuucuuuuucagauagcuuguuguaguguauagaaauacuagugauuuucauauguugauuuuguauuaugcaacuuuagugaauucauuaguucuaacaguuuuuugguugacucuuuaggguuuucuauauaaaagaccaugucaucugcaaacaaggacaguuuuacuucuuccuuuccaauuuggaugucuuuuauuucuuuuucuugccuaacugcucugguuagaacuucuaguacuauauugaguagaagugguaggaguggacauccuugucuuauuccugaucuuagaggaaaagcuuucaguuuuucauuguucaguaugaaguuagcugugggcgugugauguacagccuuuauuguucugagguucauuauuucuuucuuucuuuuucuuuguuuuugagauagagucucgcucugucacccaggcugcagugcaguggcacgaucucggcuuacugcaaccucuuucucacagguucaagugauucuccugccucagccuccugaguagcugggauuacaggcaugugccacccugcccagcuaauuuuuauauuuuuaguagagagacaggguuuugccauauuggccaggcuggucuugaacuccggaccucaggugauccaccugccucggccucccaaagugcugggauuacaggcgugagccaccaugccuggcccaguuuguucuuucuauacaaauuuguugagaguuuuuaucaugaaagaauguugaaauuugucaaaugcuuuucccucauuucuuaaaaugaucacaugguuuuuguuagucuauguucuucauuucuguuuuuuguuuguuaauguuguuauuuauugauuugaauauguuaaaccauccucgcauccccagaauaaaucccacuuggucauugggaaauauccuuuuaugugcugcugaauucaguuugcuaguauuuuguugaagauuuuugcaucuguguucauaaaggauauuggccuguaauuuucuuuucuugugguguccuugucuggcuuugguuucaggguaaugcuggccuuguaaaaugaguuuggaaauauuccuuccucuucaaguguugggaagaguuugagaaggauugcauuaguucuucuuuaaauguuugguagaauucaucugugacuuuaucagguccugaguuucuuuaaugggagacuuuuuaaaguuacuaauucaaucuccuuacuuauuauugaucuuuucagauuuuuuauuuugucuugauucagucuggauagguuguauguuucuaggaauuuauuuuuuucuagguucaauuuguugguguaugauuguucauagcagucucuuauaaaacuuucuauuucugugguaucagcuguaaugucuucucuuucauuucugauuuugauuccucuuucuuuuuuucuuagucuacuuaaugguguguuaauuuuauuuaucuuuucaaaaaaccaacucuuaguuuuauugauucuauuaauacuauuuuuccaguauuucauucauuuuugcucugaacuucacuauucccuuucuucuacuaacuuuaggcucagauuguuccucuuuuucuaggucuugagguguaacauuagguuauuugagauuuuuuaaaaaauguaggcacuuauugguauagacuugcuauaaacuucccccuuagaauugcuuuuucuguguugcauacauuuuguuauguuguguuucuauuuuuguugucucaagauauaguuguuucuugguacacauuggggauugguuccaggaccccuacauauagcccaaucugccuauacucaauuaauucuguuggcccuguagaacccacauauaggaaaaguuggcccucuguauaugugggucaugaauacuguauuuucaaucuguguuugguugaaaaauaucugcauauagauguaccugugcaguucaaacccguguugcuuaagugucagcuauauuuuaaaauauuucuuuuuaucugucauugaccaagugauuguuuaggagcauguuguuuaauuuucauguauuugugacuuuccuaaauuucuucaguuauugauuuugaguccuaauauuguaguuggaaaacauacuugaugucagucuuuuaaaauuuguuaaggcuuguuuugcaguuuaacauauuauuuguccuggagaauguucugugugcguuugagaagaauguguauucugcuuuuguuggauggaaugugucuauuagaucuguuuuguuuaaagucuaguuugagccaaauguuuucuuacugauuuguugucuggaugaccuaucuguuguugaaagugaaguauugaaguuuccuaguaguauuggguugcuauuuagcucucucuccagauuaauuaauauucgcuuuauauauuuaggugcucuaaauuggcugcauauguauuuacaguuguuauauccuugugaugaaucgacaccuuuaccauuaaugcacuuuuucaucucuguuuuuauuguuuuugauguuacaucauuuugucugauguaaguauugcuauccuuguucucuugguuuccauuugcacagaauacuuacucauauuuaaaagaauuacugauagauggggacuuacuauugcuauuuuguuuuugacccuuccuucuucccuugcugcauucuuuuguauuucuuuuuaauuaaaaaaaucaauuauggauacauaauaguuguacauaucacaugggguacaugugauauuuugaaacaagcauauaguguguaaugaucaaaucaggguaauugggauagucaucaccucaaggauuuaucauuucuauguuaggaacauuccaacucuacucuuuuagcuauuuugaaauauacaauaaauuaaucauuuucuuuguuuuuuuguaguaauauuuugauucucauuuuccuuugugcauauucuauagcacauauauugugauaucuuugcaauuacauaaaauauuuuauaaauuuauagcaaucuauuuuaaacugauuacuucaaucacaaaaacucuaccccuuuauauuucuucuucuuccacuuuauguaacugaugacacaaaauuaccucuuuuuauauugcuuaucauuaacacagauucauuacuuuuuaugcuaugcuuuuaacauucuaacaagauuuaaaagugauuuucacacucacauuacaguacuacaggauucucugucuauacacuuaccauuauuaucgaguuuuauauuuucauaugguuuuguguugcuauuuauuuuccuuucucuucaccuuuuuugcuccucugccacuuugauuuugaauauacuagucuuugaguccacugaugcuuucuucugccucaucauguuuguuguugaauccuuuuagugaaucuuucaauuuagcauuacaguaguuuucagcuccagaauugcuguuugguucuucuuuauaguuccugucucuuuguugauauucucauuuuguucauacaucauuuuccugauuucuuuuaguuguccaucugcauucucuuuuaauuuuuugaacaucauuaugaugguaauuuuugaauucuuugguaauuuauauauaucuguuuccuuagggucaguuucuggagauugaguuuguuucuuuaaaugugccauguuucuauuucuuuguauuauuugucauuuauuauugggauuuuggcauuugaagaauuagcugccuuucucagauuuugcagccuuguuuuguacaaggaggacuuacgcuacucagccuggcuagagauucugguagccucucaaaucuuuuuuggggauguguccucugugagguuuuuuucugcagucuccuaauuguggagguuugcuaguuucuacucaagagcacccccaggugucugugauacuguggucucucugacuuuuuuuuuuuuuuugagacagagucuuucucgguugcccaggcuggagugcaguggugccaucucggcucauugcaaccuccgccucccagguucaagcaauucuccugccucagccuccugaguagcugggaauacaggcaugcgccacuacucccagcuaauuuuuguauuuuuuaguagagaugggguuucaccauauuggccaggcuggucucgaacuccugaccucgugauccgcccgcccuggccucccaaagugcugggauuacaacuugagccacugagcuuggccuguugucuaguauuuuaagucuuuuuuuuaaaaaaauucuacaauauagauaugacuauugaauuaugaaauguuuguuuagguuugugaggccauacaccaauuaaauuaauuaagaggauggacugugagccaaacugcccaguuugaguacugccuuugucacuuuauaagcugugacuuuaggcaagauucucaaacucuuucuguacuuguuuccucaucuguaaaauaauaauaguacuaaucacaaaugacuuuugugaaaaucagagggauucguauguguggagcacugagaagugcuuguggcacaugugaagugcucugugagcuuuagcuauuuucccauguguugauugucugcuuucaaccuuauugaaucucagcuuauuuuucugauauaucuacuucaacuggguaucuuuuagaaguucccuuagcgaagguauuuugguaguaaauucugucaguuuuugucuuuuccggauguuuuuggcugacagcuuuuuuuuuuccuaagaacuuuaaauagacuauauuuuaacauccuuuguugcaauuuaaacauugucuguuacucuaauugaugcuguagaugauaucuuuuccauguggcuuuuucuucuguaucuuuagacuauuugguguagauguggacuuaaaaaaacuccuuugccaguaaauagacuuccggaguugauuuacauuuuucaguucuagcaaauucuuagcaauuauuucuuuauugccucugucucauuaucuaauuaacucuuucaugcauuucuugcauguuagacuuuuuacuaucucuguuucuuaaccucucuuugguauuuccaauauucuuguguauuccauucugauuauauuggaucuaccuucuauucacuaagucucuacuaaacuaugccaaaucuacuuaaccaacucauugaauaucucauuucacuaguuuuauaguacauuuaauuccuguaguucuacuuaguucuauuucgaaucugccugguuauuugugauuguuuguuauaguuuuauuaucuguuuuaaagcuuuuauuucuuaaagcauauucaaacaccuaauuuuugugcuguaucugaucauuuuaauauguaugcccuugguggguucucagguuuguuauuucugcugacucucgugauggcucauuucuuagugcccuugugauguugauuguaaacucaccuucuuuggaacuuuauauuggaaauaaauauauuugaauccugaauuauaguggguuccuaccgagaguauuuuucuuugccagaugcuugggggcauggucaaucuuugaugucuuuaaacugaaauuuuuguugauauauauauauuuuuuugccacacaaauguuaggaacucugguccccaaacucuuaugaggaugggugugugguaagaauuucuccauggagacuauuuuuuuaguuccccaucuaucagcaccaaggcaguaucaccacgggccuuccuugaggcagguuuuuguuuuucuaguuaacccauggggauaccacccuucauaugucuaggcuuuguauagggccuuguauucaccauuccauccagcucaggccccagcuuuugccuccuuuaucuaugggucacugaaaacgcauacugccaccugccaaggauaggaagauuuccacaggacaaaggcaacuccguaguuuggacucuuucauacguucuugguuuuuuuuuggccuguaagauguuucuuacuucccaccaacccagccaaguguuucaaaauaccuuuuaaauauuuuaggcagcauuuuagguguacuguacugggaaguuuccucuggacauuugguccacuauuugcaagaagugaacauguacuucauuguuuuuaauaaccgcaugcuguucccucuuauaaauuuaccagaaauuuaaaaacagguuguuuccagucuuauaccauaaaaaaauguggcaccaagcauccuuguaaauagaucuuugcauacauuuaaaaguauaugucagauaaaugccaaaaaagauuaaaauuuuuuuaaauuaauuuuaguuuuaauuggcaaaucauaguuguauacauuuaugggguacagcaugauguuuuauguaaacaauguggaagugauuaaaucaagcuaauuaacauauccagcaccuugcuugcuuguaaucuuuagcuuguuuucauuaauuuauauuuaauugacaaauaauaauuguguauauuuugggguaucguguuuguuuuuuuuuuuuuuuuuuuuuugagauggagucucgcuguguugcacaggcuggagugcaguggcaugaucucggcucauugcaaccacugccucucggguucaagcaauucuucugccuuagccuccugaguagcuggaauuacaggcgugcgccaucaugcccgggugauuuuuuuguagagacgggguuuugccauguuggccaggcuggucuugaacuccugaccucaugugauccaccugccucagccuuccaaaguguugugauuacaggcgccuggccacaaugugauguuuuggucuauguauaccuuguuguaagauucagucggcugggcgcgguggcucauacuuguaaucccaacacuuugggaggcugaggugggcggaucaugaggucaggagauggagaccauccuggcuaacauggugaaaccccgucucuacuaaaaauacgaaaaaaaaauuagccaggcgugguggugggugccuguagucccagcuacucgggaggcugaggcaggagaauggugugaaccugggaggcggagcuugcagugagcugagaucgcgccacugcacuccagccagggcgacagagccagacuccgucucaaaaaaaaaaaaaaaagauucagugaagcuaauucccauacccaucaccucaccacauugucauuccaaaaguggacuugaucccuuuagagugcuguuccuauggcuuguggaaagggauggagacauuuuguugcauuuuucacccauuuucacaguacauauaaaucauucuguggggaaaaaaauugcagaugauagaccaccuguucuaugguagaagccagagggugcucaaggucuucaccaccacugugcauucucugccagucauagaacuuuaggaguuaacaguagauaguaaagaacaucuuggucaaggucacuucaucauugauuuaguaauuccaucugaucauuccuaacgucuuauaguguaaugugauaugugaaaaauauuacuuuuacuuucuuauuugaggcuaaguuauacaguuucacuuuguuguaaacuucaacuacuucaucaaggaaggauauaaugaauuccaaaaccgaggauucuagcugagugguuuuuauaguauuaguuagauacuguauagguuuggcaauacauuuuggaagauuuuauuuaaaauacauugacauaggaaauauguuaccuucuaacuaauacaguugguuugaaccaagaucuuaguacuuugguauuacugaauuuaaaaaaauaccuuaaaagaauuaaguauuccacauucagugguaaagauaugucaaauaagcaaaauauuuuugacugucagcauuauaaauaaauacagguugagcaccccuaaucugaaaauccaaagugcuccaaaacccaaaacuuucugagcaccaacaugaugccacagguggaaauuuccacaccugcccucaugugaugaguugcagucagaaugcacuguuuaguacuuauaugugaauaaaucuaagaaaaugauugcuuaccaguaguauauaaauucagagucaggagugauggugagccaaacaaccacagauuguccacaugaggggcugagagaguaacaccuuugcuuucugaugguucagcauacacagacauuauuuuaugcacaaaauuauuuaaaauauuguauaaaauuacccugagguuauauguaugaggccuauaugaaacaucaaugacuuuucuguuuagacuugggucccguccccaaaauaucugauuauguacgugcaaauauuccaaaauuggaaaaaaaaucugaaauuugaaacucuucugguucuaagcauuucugauaaggaauauucaacuguagucuguuuauugauuuuaaauauguagauuucuucuauuuagaaaucauauuuaugagcacauagugguaauaaccuuauuuuuuuuuucuuuuuagccuauauaugcaaacagauuugcaguaccaaccuaugcagccaagcaaccucagcaguucccaucaaggucagaagaaaauuugcuuagauuuuuuggccagaauaaaaccuagggguuaaugucuaauaauuuccccuguauuuuaauguaauuuagugaaagguauuuauugucaacaguuuacaagaauaugauuugcagaaagguuuuaaaauaacuuuauauaaauuuuaucauauugguacagggucaaaaugaaauauuaaauaagcuugagcaagacagauucugcugccacagcuuucaugugcauacgauuuagaagcaagggccuuugagauaaccagcaguaggaaaccagauggguuggaacagccuucccgucaaaaacagcuaaaaaagcuggacaauauaagaaaauauguguuugaaggcauagaagacuaaagaagugaggaauuguggggguaaggucaggagaggaaggaaaucuagaaaugaucccagcuuugggggccacuuuuccuuccuagaugaguuuaccuguucugacaacagagaggcuaggaagcugaggagagcuuucuacaaacucacagggcagaggggacaaaauuuagaauccugccaaagaggaggcacccuggcaaacaucucagggucugugcugggacccagaaguaagagugaacuagaccuucaacugauuucuacaauuucuuauguuuugcucaugaucaaaaaaagccaaguguaaaagaaaagaaaauaugacuaaaaccaagaaacaauagaccauagaaacagacugagaugguauccaguuaauagacauggacuuuaaaauaacuaugaugucauggaauuaaaagucaagauugagaauuucagcacagaacuaaaaacuaaaagaaucaaugcaaauucuagaacugaaaaacacaggaacugaagugacucaauggaugggcuuaaaaucaucaggaaggaagauaauuuauuacuucauuuuguaucacauaaaaugcaaaugcaugugacccucccauccccuagaagucuuucaaauuacaauugcguugcaacucugaggacuaucuucauauguaaucuuuauuauacaguaagaauacauugaaauccgacugaggaucagggaaagaguauauaaauugugagggaaacauucaccagguaguguucuaguguuacuggaguagagguguacuagaauuggaugaugagguuaggagcggguguccacagguggaaguaugagguuugagauggacagguauagaagucauaacacuuuuaauucucagagugaaucucauguugagggagcuauaaacagcuagguuuacaccagcaguaauuugcugcccucaaauucuaacagcacaggcaagugcuugaucacuuaguguacucacuugucuuuuacaguuuaucuuuaccauuucaugugcuuuuuuuuuuuuugaaaaaacauguaaacuagaaccuucauacaacauuguugauuauggaguaauauuauuuaaaguaguuauuccauuuuagacucuaauuggagccuuuuagccauugaauaucacccuaauacugaucucagaauguacaguacccuuuccuguugucagagauguugaggaugguguuauguugagcuuguaaugaauauggcauuauuucacccagucuaaacacucuauuaacuaucucuuuuccccucgcaggccaccuccaccacaaccgaaaguaucaucucagggaaacuuaauuccugcccguccugcuccugcaccuccuuuauauaguucccucacuugauuuuuuuaaccuucuuuuugcaaaugucuucagggaacugagcuaauacuuuuuuuuuuucuugauguuuucuugaaaagccuuucuguugcaacuaugaaugaaaacaaaacaccacaaaacagacuucacuaacacagaaaaacagaaacugagugugagaguugugaaauacaaggaaaugcaguaaagccagggaauuuacaauaacauuuccguuuccaucauugaauaagucuuauucagucaucggugagguuaaugcacuaaucauggauuuuuugaacauguuauugcagugauucucaaauuaacuguauugguguaagaguuuugucauuaaguguuuaaguguuauucugaauuuucuaccuuaguuaucauuaauguaguuccucauugaacaugugauaaucuaauaccugugaaaacugacuaaucagcugccaauaauaucuaauauuuuucaucaugcacgaauuaauaaucaucauacucuagaaucuugucugucacucacuacaugaauaagcaaauauugucuucaaaagaaugcacaagaaccacaauuaagaugucauauuauuuugaaaguacaaaauauacuaaaagaguguguguguauucacgcaguuacucgcuuccauuuuuaugaccuuucaacuauagguaauaacucuuagagaaauuaauuuaauauuagaauuucuauuaugaaucaugugaaagcaugacauucguucacaauagcacuauuuuaaauaaauuauaagcuuuaagguacgaaguauuuaauagaucuaaucaaauauguugauucauggcuauaauaaagcaggagcaauuauaaaaucuucaaucaauugaacuuuuacaaaaccacuugagaauuucaugagcacuuuaaaaucugaacuuucaaagcuugcuauuaaaucauuuagaauguuuacauuuacuaaggugugcugggucauguaaaauauuagacacuaauauuuucauagaaauuaggcuggagaaagaaggaagaaaugguuuucuuaaauaccuacaaaaaaguuacugugguaucuaugaguuaucaucuuagcuguguuaaaaaugaauuuuuacuauggcagauaugguauggaucguaaaauuuuaagcacuaaaaauuuuuucauaaccuuucauaauaaaguuuaauaauagguuuauuaacugaauuucauuaguuuuuuaaaaguguuuuugguuuguguauauauacauauacaaauacaacauuuacaauaaauaaaauacuugaaauucucuuuugugucuccuaguagcuuccuacucaacuauuuauaaucucauuaauuaaaaaguuauaauuuuagauaaaaauucuagucaaauuuuuacagauauuaucucacuaauuuucagacuuuugccaaagugugcacaauggcuuuuuguuaauaaagaacagauuaguuuugaagaaggcaaaaauuucaguuuucugaagacagcauguuauuuuaacaaucaaguauacauauuaaaaauugugagcaaucucaa

SEQ ID NO: 191851 - RNA, 57697 nt, Homo sapiens
ucaggucaauuucacugucuuuuauuugacagcuagcgcagucuuuggggaaauuugugggugauuugaguaguaacagcaaggacaucacuguaauuaugauagugccuuauauuuuucuagcaccucucccaaggacuuaugaagacuuuuagauucuucaucccuucacacaacauugcuucaagguagggccaaggcagaaauuaucaucacuguuuuacaaggaaagacacuccugugcggucucaaagcaaaugcuuuuaagagcuaaaaauucauuuccuaguucuguucaccaaaugaugccuucuuuaaacauaaauacaaauuguaauguuagcaggugcuauuuacagagagaaacaaagagaauuuuacaauagucgccaacacugcagcugccaaaaaaucccuagcucagaaauuuaaagcagcaaucccauuuucccuacagaaaugaaaacauauugaacuuucuuuuguauuuagcaguaauccagcaaaauauaagcuuuaauauagcgacugaggagugguaguuugagccaugagguacgggggagccagaauccacuuagugaggacagugaugaccagcagguggcagaaguaaauuccaagcagccaaaaaaccaaaaacauucggagaauuuuccccccguuccugagggacaggauggaguuuggacaggaagaacuguaagaagccaagaucugcgacagucccaacaaauacagucuggucacauggauacaggaaggacgaucuggggaggcauaccaacaagaaacgaagccagggaccugaaugcaaaacuagccucaggugacauguucuccugcacuuagaagcacuggcaaaaccaugcccacauagagggggcagacacaugucuggguuucaguuucugcagaccuucaucauuuguuuuccuuuuuguuuucucuguugcccaggcuggagugcaauggcgcaaucucggcucacugcaaccuccgccucccagcuucaagggauucugccucagccuccuguggagcugggauuacaggcgugugccaccaugccuggauaauuuuugcauuuuuaguagagaugggguuucacuaaguuggccaggcuggucucaaacuccugaccugaagugaucugcccaccucggugucccaaagugcugggauuacaggcgugagcaaccgcgcccuugcuuuccucuuaaucacuguagcucuaccccguggcuauuccuagguaggugcccccuccccagcccaaccccaccgguuuccuuggaggaaaccauccauggucgauggcugcugggccuugacucucugcccagcgccucuacugcauggaugggguuccugcccucgaagcagacaucuucuuuuucugacuuuccaaaagcagcggagaggcaggaggugcgucgugaggucugggugcaggaccuaggaagaagagguuacaaggaaccugcgccgggagcaugcggugcccucgggacagaccuagccccagggcccgugggugucccuucuuuccaguggacauucccacccuuuucauacagcccauagauaaaugaagcagcagcaauuuuuauugagggaccuaaacugaaaauagguuuagaacauaauuuaaaaaaauaaaacagcaaaaguagcaaaaaauauaugaccuuuuuaaaaacauuuuccuuuuuuuucuuuuuuguuuuuaauauauagcaacugaugccucccagccaccaggagcaucuuacccgauggguaaaucucugguaacgacccuuuuaaaaagacauguaaauauauacucagauuuauacacuuuguguuuucuucauagcuauauacagagcccccaguuuggggcugggccccagggccacaacacugcccccaaccuggccuucgccucaccauccucugguaccaggcauuuggucagcaaagcaaacuaguaucggaauuaauaagccacuggcaccaccuaucuggggcagaggucaccuucaaucgaggcacgaagcacugaccucccuacugcuguagcccugaggacaaggcaccugccaccagagugcgaggggcuuaugggugaaggcaaaacagaccaaaccgacaggagaaagcucaggaagcucucacuugcaugccuguucauuggcucccacucccugcccuccaggcagugccugguggcagggagggguguugguccaacaucugggaggggaugaaguggcuggcagcaaagaucugccucuuugcaccucucaccagcagguggagaggagguggagggagaggugagcugaguggggugaaggcaggccacacaggaaggccccugguaggcagccggcuccugccagcaggaaaggggacagggacggacagguggugggcccagcaggggcugugggugaggguuacagcugacgguggagucuggggagggcguguggguggcagucagcggcguuugaguccgccauuggcaagcugggcugggugucggggcaggcagggcuccucgggcagcggcucaugagagaagacggaauccuccccugaggagcacguagagcuccgggugucgggaaagcugggggaguacugguccaggggcauggacagguccagguacuccugugaugggcgagaggaagcagcgaugggccgggccccuccucccugcucagggaggugcgugcacgcaguggggacggccugagcucuggcucuggcacgggcagccuuaccugguuggaggucaaggccacgaugcgguccaggucuuccaccagcugcuugaaggugggucucugugagggcacugcaugccagcagucccgcaucaucauguaccugcggcaggacuguaaggucagggacgucuccuggagauggauacucucuagucuagcccccugccccucaagcccacucuugccccaaggccuggcucagggccuccgacaucuccucgggcuuacagcucguuggugcaguuacugggcuuguccaugcggugacccuccuucagcagcuugaaaaguuccuccacaggcacaccgggguauggggagccgcccagagugaagaucucccacaggagcaccccgaaagaccaccugcaaaugggcggagagccacaggguguuagagcuucuccgccuccccucccccagcacaaauccucuacccagggcagugccaggagacagcauggagaacagaucagccuuucaacaucuggagcagagggaauggccacagacaauguuuuguuuuucucucuggggcagaaagaggacuccucaguccagggagaaagcaggacucuacagugcuagaagcucucuaucccacaccucccuggcaauugcuauuacaaacucacacaucacucugguggguguagauccggucaaauaaugccucgggugccauccacuucacaggcagucggcccugaaagcagcacaggggagguuggaguggccccaggcagggccaugagggcacaggugggaagggacugggggguggguucucagcccaccccacuccuugcuucucagaugaaaccaccagcacagggcggccuugucggcacucacguugguugucuuuuuauaguagucgauguggugaaugucccgugcgaggccaaagucugcuaucuucaucacauuguccucugucaccaggacauuccuggcugccaggucucgguguaugcacugaggaaggaggaagggagagcgggaggcggggaggugagggagcuggaaggcucugggcggccgccacccaugcaacuagccgacuugucucauagaacuucugccacacugcucugccccccgaaccuuugcuuucccucuucuaacauucucugccagcuccaggcuucucaucacagcaagcgcuccucccuuccuuccccaaagacuggccccuuaugccucugcugcgucugcagcgaugcaugcuccuagguccugccucccagcacagcaaguccacauggggcugggcucaaaccaggccagcccuuacacaccaaacacugcacucaacacucacagacaguuucauuuuaucuucauaacaauucuacaacagguauuguuauacuuuauuuucuuuugagacagggccuugcucugucgccccggcuggggugcaguggugugaucauggcucagugcagccucaaacucuugggcucaagcuagccucccaccucagccucccgaguagcugggacuaucggcacgcacuaccacacccagcuaauuuuuuaauuuuuuuuuuuuuuuuaaagacgggguuucaauauauugcccaaccuggucucacacuccugagcucaagcaauccucccgccuuggccacugcacccagcugauauuauuauuauuuuguauuugaagaauuuuaagaugcuaaguagcugccugaggcuacgcagaaaguggcagugcacagaucggacccugcaucagucugaccccaaggccaccuggcuacacuggugcuccugacucugcaguucccagagagccuaagacaacacacagggcacacagggccagugcucagugcauccacaacgccaccacaagaugauaagucacaggcuggaagacuaggggggcucuguucccacccuggcauuacccaggggagccuucagguuccacaccuucuuggaggccagauacuccaugccucgggccaccugguaggcgcaggacaccagguccuuggaggagagcugcuccucuggguuguggcugggguuguagcaguauuccagcccugggggccuccgggccugcagguacucccgcagguugcccuuggaggcauacuccacgaugacauacaagggaccugcaggcacaggagaagaggccauggggccagcagcaggugagcagguuuggcuucaccucaaagaaaccccacccccagcagcacaccccggccaaccucccaucuccugccuccucuuaggggaccugggaaauccauucuacuacccaaaaaaaaucagagaaauaauuacucccagcauaguccagaaaauucccgagcaacauugggguaagagccccaguuugucuguuuauuuugagauggagucucacucuguugcccaggcuggagugcaguggcgcaauuucggcucacugcaaccucugccuucuggauucaagugauucuccugccucagccucccaagcagcugggauuacaggcaugaacaaugccuggcuaauuuuuuuuuuuuuuuuuuuuuuuuuugagauggaguuuugcucguugcccaagcuggagugcaauggcgcgaucucggcuaaccgcaaccuccgccucccguguucaaacgauucuccugccacagccucccgaguagcuggaauuacaggcaugcgccaccacgcccggcuacuuuuuguauuuuuaguagagaugggguuucaccuguuggccaggcuggucuccaacuccugaccucaagugauccacccgccucacccucccaaggugcugggauuacaggcgugagccacugugccuggccuauuuauuuauuuuauuuuugagacagcgggaguaucucccaagcuggaguacaauggcgugaucuuggcucacugcaaccuccaccucccggguucaagcaagucuuaugcgucagccuccugaguagcugggauuauaggcaugcgugaccaugccuggcuaacuuuuguauuuuuuaguagagaugggguuucaccauuuugaccagacuggucucgaacuccugaucucaagugaucuuccugccucggccucccaaauugcugggauuacaggcaugagccacugcacccagccugagcgcucuuagaccauaauuacucagcugccucuguuaacacaccacgugugugaaucuagguaucuguauuccugaaugaacaccaaugagcggagcccagaucccgagauaacacauuuuaaaccucugccaaagcagccucucuuaacccccuucccuagcuguggcugagagaggccuugggacugauaccccagcucagaucuucuccccgcugggcagggaaagccagucuggccggcacccaccauccugcgugcaggcccccagcagguugaugauauucuuaugcuucccgaucaucuucaucaucuccauuucugagaucaggucugacaagucuuucucuguugcguccgcuuuaaagaacacguugagacucauuuacuugggaagggaggagggcaggauaaaggcuaagggagugggguaugugucgaggggcugcuuuucccugggacuugauucucuccuccccacuucauccaaacuuguuuucucuucccucucaugggagccguuguugcaauaggugguagugagugggcagggauguggugaggaaagccugcaagcgauggauccaggauaaacaccugaccacagcccagguugacgccaaggaacagagugacgucauagaacaaucucaaggugcagaacacccccuccacucccagguaaccccaagcaggcagcggagcaggugugggcagcaaaggcaccagagaagcuguucugcugggcccgaggccugcuguuugcuuggaaugggacaagauuuucuuugcaaggacagaagcaucacuuacacuucaacaucuucacagccacuuuggucacacgguuggguuuguccuuguccagcccgauagccucugccaacaccaccugcccaaagcagcccucucccagggguuugccuaagaccagucuuucgggggaaacagagaguggcauaaguuggggcuggugaaguucaaaccuugagaggcaccccaucuccaccucucuguauuucacccaacugcgagcagaaaguggaaugaauguuucugcaggcauuucaugaaccuucaccgcccagaagguguuaguauacacaccuuccaccacuagaauagcaagcaaggaaugccuucaaaaaguugggagucaaaguauuauuaccugucccgaggcagcucccagcgagggucuucgggaagcucauacucagagaccccugcuagcaugggagucccacuggaggagagccgugauggccgaaccagaagaaccccagaguucauggaugcacuggagucagcagacaccugcaaggaagaguggggucacccuagagcaaggaggggggacggggugacuccuucccauucuuagucagggcuucccaacaauggcagaggcacaugucuguguaucugauguucuuuccucaacacagagugguccaaagaccaugguaggccaggaggcccaacuucuaggacugaccuauuucugccacaagcuggccuuucuggacuucacucaccuuuaaaauaagcagaccaaaugcaccucuuccagcuugacauuuuauaacugaucauugcaguaacaacucuguucuccugacucuuugcaaauacuuugccuuagcuuauggauuccuaacucccaaagcaccuuccagaaugagcacaggcuucugagggaacggucauucuugcacacaccugugccaucuguaccauuuccucccguggggaagggugggcacacaggggacaaggguaugguauggcugagaugguuuggcuguguccccacccaaaucucaucuugaauucccacguguuaugggagggaccugguaggaggucauugacucaugggggcaggucuucccugugcuguucuugugauagugaauaaaucucacgagaucugaugauuuuauaaaggggaguuucccuguacaagcucucuucucgucugccgccaugugagacgugccuuuugccuucugcaauugugaggccuccccagccacguggaacugugaguccauuaaaccucuuucuuuuguaaauugcccggucuuggguaugucuuucucagcagugugaaaauggacuaauacaaacaguucucuucucuacccugcaucucugcacuucuaagcagcccuuggggacaguucaaauucaugcuauuggcugcacauucuguccaaauaggacuuccucccaauccaugucccaggaguccggaggacuugcagugugauauggagggugcaggaaauucacgggcuacacuagcuugaaacagacucuagagcacuuaguucaugauauuccacugugccuugcccagaagccagaaaauaaggcccaaagcuauaaauuagggacaauggagagggcagggcauuagaggcccagagagagagguggugcugagugugcaaaucccccaucuacuuucuguuaccugucugcgcagagggaugcucuuggccagcuugugcacagccaucuggcuguggaagucacucuucuugguaccacucuucaucuuguagacgaugaccgaccccaccaugcaggagaugaggaaggccccugugcaauagaugaugaucuccagguacaggggcgaggucaucacugccggccucucuuccagggcugagucagugcgaacaggguguuagcaggcuuggagggccccguccaugcgaggucccgcuccauuagaaaagcaacaccugucuccuguccccugggaacuuuuagggagaagaaccauggcaaguucuagcuaggacugggauuguggcacuaggaggaucaggcaacccccugauuuuggaggcugccuucaauggacuugagccauggaaaagggauggccuagaaccaucgugcuacacaagccccaucuucauuaauuccugagccuccuugcucagcuggacuggagagguacaggcacccagggauccugcaagggccagcugagaagucacuucuaugugccuuucuuggucuccucagggagccauggcccuucucugcaaagccucagcacugugugcaugcacuuaacaugcggggacacagauguuucugaguccucugucccuaagaagacacggggucccugagggcaggguuggugccucguuuauuucugcaggccacaguaccuggugaugguggcacucacagaaugaggacagaggacaggaggggaaccagccugugccuugcucaaugucccacuuugggucugugucaucucuguaggggcacacagguaaauauuuauuccuagccaaaccacaggcaaagcugacuuaauuuccaaaaauaagcuuuuuugguaguucuuucaaauucuacucauaggccccaacuccuaaaacuuaaggaaauguggcggcagggggcggaguuccauuuuguuauucucuucucccaccuucugauuaggacucaccccccaccccauugccacagcagcuaagccaguucgguccaccuuucccuucagcacgagaggcugggaggcuuucaucccagcacgcacagcacugguuucauggaacacgcuuugccccacggguguggacggcccuccuccuuccacaggccuccucccaaccuuccccuuuaaaacccaccagccaaccauggaggcggcgccccugggaaccuucccagagaggcaugaggcaugaggcacgacccuagacugagcccagagaacgucccaaggccugacaaggagacagcagagcugaugacagggagaaguguugcuguuuuuucuuucccugauguugaggaacgaagacaacugauugggagcacauggggagcacggacaggaccaagacagggacgaugauaaaaacagaacgcuucucugccuccagcaggggcauccggagacccugacgggcaagcagggcagagugggaaaggaggggagagagaagagggcagugccagcaggaacagccagacccacaugcaggacauuccgagagacagcagcaagcccuggccccgcagucaccagccaccacccugagcaggcugcaggcuccuuccucccuggcucaacacgcagaccuccccucuugggagaggagagacggcagcaggcaaacaggauacauggacaucgugaagccugcugcggcugccugagacaggccuuucugaaggcaacucaguucaccuguccaggcugaccuccuucuucaaaggcaauaggauggcaguacaggagggugggcugcucuuugcaagcagcaagccccaccccugggcugagcacuugagaagggagaagagguguagggcccuaucugagacuuuucagaugcucaguacccagcggaggggggaggcugcuggacccaaggacggaaggagccugcccuggaggagucgggcugcaggguaaacccagaucccgggcaugcauugcaauggccagggggagagcagaggcagguguacgggugggaggccuccgugcgccugcaaaacuagggaagcucuucucugagcugagaggauucagcccucaaagcuggggcaggauguggcaccaggcaggcaggagcccauucuuccagcucuccugccucugugucuccccaagccuggaaaugcaugcuccccccgugcccguggcgagggcaggacaucgagaggagaaguuacaguguguaccuuccagaacggucaaccaugcagagugaugggagaguccgauagaguuacccgccaagcacguauacuccccugcguccucaaaggagacauuucuuaagugaagcaccuccaucucuuugucggugguauuaacuccagcagucuagaagagacaacggaagcaaaauggacaagcacaggacaugagaccucuaagagacgcagagcaagggaaggagacagaaagaagggggacuagaggaagaaaugcucccugacaucuucuuugcaacaaggaacaaacgaaaaccaccaggcagcaaaaccuguuagaggaagagggugagacccugagggaagaacuccggcagaccugagaagacgauggcugguuacgacccuucaccagaugcuggcagccacuggcccauccgagcaugcgggcggugagcggcauggagaaauggggccggcgggcaggggcuguuugguuucagguaaagauagccagaaggugaacacaggagggauggcgggggcugcagacacacacaugcacacgcauacacacacgcacaugugcauacacagccagcagaugcgaguaugcaagggaaugccuaaccccuucucucucuuuuuuaagagaugggguaccauucugucaacccaggcuggggugcaguggcauaaacauagcucacugcagccucgaccuaagcucaggcaauccuccugccucagccuucagacuagcugggacuacaggcacacgccaccauacuuggcuaauuuauuuaauuuguagagauggggucuugcuauguugcccaggcuggucucaaacuccuggcuucaagcgauccucccaccucagccucccaaagugcugggaugacaggcgugagccacugugccuggccuauggccccuucucuuaaucaccacucacucacaacuucagucugaaguaccauuuguaacacagcaaaaccguguccccgugaguccucacauggauccacacaaagccaaggaacacacagaaggcagagagggaacccacagacaccaacacaauaccaaaccaaaccagccucccaggccggguauuuuuccauggcucugggcacuagaaauacaguaggguggcaaggacaguccaguacuggcuuccccgccugccccagcagcuuggggccuacaucaaauccccagcacagggucccauccaucuccccauuaccuuuugccacaggucuggugacagugagccacgcagacugguuagcuucaccaauauaauuggaaaccuuacacacauacuccccgcucugggccucugucacauugaacagggucagcaccuccgcauccgagcuauuaauccccgaaugcuggaacaaaccaacgacacaccagucaguugggcaaagcugagauguggccacgcacguugcucccguguaacuuucaggcaggcccagggagcgaagggagauguuaagugagauuuauuaccuuucccuuuuaguuuuuuuuuuuuuuuuuuuuuuuaacgcagagucucacucacucugucacccaggcuggagugcaguggcgugaucucagcucacugcaaccucugccuucuggguucaagcaguuagcuugccucagccuccugaguagcugggacuacaggugccaaccacuaugcacagcuaauuuuuguauuuuuaguagagaugggguuucaccauguuggccgggcuggucucaaacuccugaccucaagugaucuaaagugcugggauuacaggcgugagccacugcgcccggccuucuuucccuuuuacaaguacagaacaaguggacuucaaaaguccaaagcauuugauuaaaaaaaaaaaaaaaaaaaaagaaucacugcuucaaauggaauguucuauuuguguuuaacccacucccuccaggacuggagcagggguugugaguggagacaguggccaaugaccuacagagcaguuuuagcaccagcagcaaagagaagagaagggagggccaguauaucucugagacagcuaagcuaggggaggaugaggucuaacucugggacaaagagguaaacaacuuucccagcuucugguuccuuccuguugcgagauccacuggagauuuaggcaauuaccuucccuggauuaauggagcauucagggacaaugaaugucugggagugagaggaaaaaggaagaaaaugccauuacuccucguccucauauggcuuagaauuuauauauggcauuuguuuuuccaacucuucguaagagaugcucuuaucaugcaccccauuugccagaaagaucguacguaacucaggacacagggcuaagacugggaaacgcuugguggaaaggcucugguuucgggcaaugaaaaggcagggguccaaaugccuuccuuguguagcugaccccaaagccccagugacguugcucucaaagcuuauuacagaccagcaccacccaucccugcagcccucuguucccagcucaccuccacuuugugaccucuguuacuaguccugggggauguggcuagaucccuacugagauggagugugugugccugaagcgugaggaaugaucccauucgggggcaacugagccugcccacaggaacuugagcccccgagacaguggucuccuucccaguagacuggcccacgaagacuggugccaugauuaccuucaagaucuggacauaaggcagguugucugggccaaucuugcucccauucaccucgaugugcuuuagccacuggaugugcggcugcgggucacuguacaccuuacacaugaacuccacguugcuacccagggccacuguuuuguuggcgggcaacccugcuugcaggaugggccggugaggggaccgcucuguggaagaugggagaggaggcacuugucauggggaccuugccauggcuaaagaggggugggcucaccugcgccccacuuggcuuucccagugauggguuguaaaccucccagcacuucugcugagcccaagccucucaaaacagagcuggggaaagggacacccucucuucaggcccuaagccaucaggauccuccuccccaaggcagucaucauauuuacagucacaguaagucgcucaugcuuuaauggagaaccuucuaauucaguugcacccccagaccucagcacaaccugcuccuccuuaaaaaaccagagucacuuugacuccugcuauucaaagugugguccacgagcagugcuaccagcauccccuaggagcuuguuagaaacgcggaaucucagaucuuaccccaaccucuuggaucagaaucuccuuuuuaccuuuuuuuuuuuuaaaggcagggucucacucugucacccaugcuggagcacaagggugucaucauagcucacugcagcuucgaauuccugggcucaagugaucuucccaccucaguagccucaguuaacucagcugguacuacaaguacaugacacugcacuaggcuaauuuuuaaauuuuuuuauagagacagggucucacuguguugcccaggcuggucucacacuccuggccucaagcaauccuccagccuuggccuccuaaagugaugggaucacaggcgugaguaaucccaucaugccaccuggagcucauaagccacugcuccuggccacaaucuccuucuuagaccauaucaucauaaucaagaagaacacuggcugagagauucuguacccaaugaucucuagggagugaguuucagaacuccuagaaggaaaagguugcgguaauagcuccaagaggcucaauguucuucccagagucuccugugaugcccugaaguuggcacaggugugcaguucugcauuagcaaggugucugaccucucugagccuaugcgccugugcuccugugcagggcuagacuaauacugcccaccuugcaggugugccaugagcauuacagggcagguauuuaaggagccuggcaucuugcuagcauuaagcgacagcuccuauuacgcuacauuuaacaccucuccaacaacgccuccuucaggacagacucugaacagcaccuucaauuucacagugacaaccagcuuugaccguguuacugucugaucuuaacucuauuuuacagauaagaaaagugaggcucaaaagggagaagugaccugcucaaggugacaaagccaagaagugccaaucgcuauccugacucugccccuaagaaaccuggacaccccggcuguguucuccaagccuggcucuucccacuaaacucauuccuccugcugccucugcccucuuacccacgacauccagcugguaugugugguugaugcugccguacucauucuccacaaugcagguguaguugcccuugucagagggcaccacagaguccauuaugaugcuccagguggcauaacggaccugaggggaaaugccaaagggauacauugaggguccagaggaaaaugcaggccccaugacaaugucggcaccccguggcaccugcccuccauaucagagccugguggcacagggccccaggcugcaggguuggcuaggacaaggcguggauugccccccuaccagcccguucacacucugcaagcuggcagaugggguguaaagacuccagaagucuccacugugacguucaagaucauucgugauccggacagaugugccuucugcaaacacucccaaauacaccaagaauguucccaacugugcaccucuccuauuacacuaagaauccagcccccacuguccuugacagcucauuucaaaaaccaucuccuccaguccagucucuggucagaacugugcucacccuuuccucucugccuaccaaagcacugaucacagucuacuuuuuacgguagcugcucauggacauuugccuccuaucagacugcaaaauuuuuaugggcaggaacgcuaucuugcagcauuuaaagcauggugucuugcauguagugagugcauggugaauuaauuuaaaauauuucuggcugggugcgguggcucaagccuguaaucccagcucuuugggaggcccaggcggacagaucacuugaggucaugaguucaagaccagccuggccaacauggggaaaccccgucucuacuaaaaauacaaaaauuagcugggaaugguggcugcacaucccagguacucgggaggcugaggcaggagaauggcaugaaccugggagguggagcuugcagugagccaagauggcaccacugcacuccagccugggugacagagugagacuccgucuaaaaaaaaaaaaaaaaugcuuacacccuuuaaguuaguaauuucacuuguaacaaucuguccuaaggaagcacgcuuaaaaaaaugcugacagagauucacugcaacauuauuuauuauggugaaaaaccagaaaauaccuaauaucacaaaauaguucauuaaauuauaggacuuuuucuguuguuuuuuggagacagagucucacucugucacccaggcuagagugaaaugacgugaucucagcucacugcaaccucugucuccuggguucaagcaaucuccugcuucagccuccccaguagcugggauuacaggagccugccaccacacauggcuaauuuuuuguauuuuuaguacagaggagguuucgccauguugcccaggcuggucucgaacuccugagcucaggcaauccgcccaccucggccucccaaagugauaggauuuuaggcgugagccaccaugcccagccaaauuaugggauuuuaaaauaauggaaucuuauacagucaugaaaaauuauguuucaaauauucaugcuugaaauauaucaggaaaagacucauguuaacaaaugacaaggcaaggaaauuacauacaugaugugaucaacuauguaaaaaccauauuacagaaagaagacugaagaaauguuuaaacuuuauuugcauuuuuuuguauuuaaaaauuuuaaugaauaaccuguauagguggaaaguauuacuuaaaaaaaugaaaagcauguaaucaggacuuccuaacucggccuccccuguucccauuacucuaacuuucgcaugcacacacacguaccuuguagccuccaauucuguggucagguuugaauucuuugccauuuuucaaccagcgcagugugggguuuggggucccacuggaagggcauuugaacuucacugucuuggcagccggcacugcaugcaauuucuuuuccaucuuuucuggggauguccaauauggagcuacggcugcccggggaaagccaagagagacaggcaggguggagaggagcagcuggucaggcucaggagcagggcccaggccaggaccuggaggugucuugcccaucugcccaacaccugugagcagugccuggcacuuagcagaacaggcaccgugaccccaugugcccuccucuuccuccccuuucagccuuccccuccccucuuaaacccaaugcccagacccaaagggcaguaagauaggaaacagugucucacgcauacgguuugguuugguguuaucuguuucuuucuccucugaagaggagucaucaucaucaucaucauccuccgaggaggggagagcaucuaugggaagaagaaggggcacugagguuccuccuagggaccccuagauuucaccaaggcuagugcaguuccagaugaacacggacacccuccccauggggaucccagucccacugcucccuuagugaugaucucuuggugggauggaaacuguuuaagaacaguuccugugcguguuugcuuccuuccccgaagcacugcccccacugccuggaagccuucacacugggugguuccaucagggucagcuguuccuauuuaacuuaauuccguccuacauucaaaggcgcuuucucaacuuguggugccaccugggugugcuggagccaggcaaccuguauucuucuuuggacggcugacuauagggaaacccaggcaggucuagacacacuguggcuagaugcuauuuccaaaggaugggcuaaacaccccacagucagaauuuuucuagcaugugucuacuaagguuugggggcugcccuccuuaaucagagcagauagggcacccaccaccccagcagcugccaacaccucuccccaauaaguauuuauuucuuguaagaacacgcuugauacacauguggucacccaucaggguucaugccagaucuuucuccaguccuuccuaucaccuuuggggaucugcugccaaguccacacccugaggugcauaaauggcauaaagaaaauuucagcuccacuuccucaacuccuaguuuugugaaagucacauucuaagaguggcaaguucccaaguucacagagcuccagggcucccuggcugcccucgcacagcucccuugcggugcaccuggguuccucuccagcagagcagggauaccaccaccuguucagggccucuaaucacuaagccgaguaccaaguccaaauggcaagggagugauggaguggaagcuggccgagcaccacuuagccuccuggagaucugggcaagcugugguggaaaaaaaucacagggucuuaacaucccaagagcccuggcaaucaccuccgagguguguccuggaagccccagaucuccggcccuggggcccaccccaccuagucaccucucugagagccaagccacgcggcaggcagggagcaauguuagugggcagcaguuucugaagcagagugggggcagaucacggagggggaggagguucaccuuccucugaaacuggcagagagggcuggagggggugggucuagggaggggcaagggcagggcuuggcuaccaaccugaaacauugacggagaaguagguggugucacugcccgaggggcugcugguuacgcaagcauagaggccggagucugcgggcacggaguccugcaccuccaccuccuccccugugaugcgggugcgguugcuuuccgccagcugcaccccgucccgcagccaguugaugcucugcacaucgucccgcagccgacagcgaagcugcagcaggucaccgggguggaccaggaaggacuccacuuccacaggggcuccccagggcugggcugcagccaccacggggccgggaagggaagccaaggggcgagagaggaagacagggagaggggaggaggggagagacaaagggaauuacgcuggccacacggagccgcaccauccugggcaucacuuacuggaggcuacugagccagggcagugggaauuggagcaugggucaguggggaaaacagcuggcugccugggaacccccaucucuuuuccaccccacuccuccaaaagucaaaggaagaaagaggcaaaguuaggaagcagcuguagcagcauuaagcgcauuucauuucccccauccuaaggggaaaggucggcccuccccaggacuucuuuguguccggaguugcccccuccccagaugcucaguucuuugccaagauugccacuugccagaggaacaccccauuuccuuugggauagcucagccucacccuucccuagcaacagcugaacaaaccccgccccucaaaaccccagcagccccugcccaagucgagagaaggcaauuugucaacugggggcugaccaggaugcgugugauucggagagggugggggucuggcccucgacgcgucagaugcacaugcugggggggcagcccaaggagaggucagcucagggaaccucucgcuaacaggugucagggcaggggauuuggagcuguugacuauauuaggacgggaggccacagcugccauaaaacccacacuugcucuggcagcaggagcugucgcacacaaagguccuuucuccucagcccucugacugggcacacccucaggccccccaccauccacucucccuccccgugccccauccuucucugucccugggugggagcacuggacccaccggggugucugcaccucacaagaucugauaccaccaagagcaccugucccuccccugaccagugccucuucccgcacgcguucaagaaggcccguggcccggacacaccugaguucaccauccugggcuguuacccaucuccugagcacaccccucugcacucacgaggggaaaugaacuuucuauuuccuuuuaggauguucaaauguacuccuggcaucuuccaccucucaccuaccacccacaucccgcccacagccuuggagaggacuuuucucaccauuuguucacccuaagagacucaguggagcgacugccgcuccccgaugcauaaggcucugaaacagcauguucucccucagccccugcuguggcucacggcugccccaguggccacagggccccugauuuuuuucuguccagcucucacuacucacucuucugucucagccuagcuggugacuucuccuccagggcggugcugacucccagucuggguuaggugcccucccccuccuggcaccugucacacugaagggcaguccucuuucugaaccugagugcggugaugugucaucgguaccuuuaaauccccagcaccuacuacgaugccuggcgcccaggaguugcucaagaaaugcuugcucaauaaauaccacacgugcagucacucuggcucuucacugccuuccuuucuacucucccuuuucucuuucacucccccuuauuugaaacacggucuuccucaagugcucaacaggcuuccgcuagaaaccuuaaaaaugaaaaugggugucccgcgcaucaugaucagcaacugacagggacugacagugguuucucuugggggggccaagguugcagacccaguccugcauugacccaugggcuuuaucuuaaauaagaguugucagaaacagggguacugcuuuaaaagggcucagaaaccacuaggcuugcacacguuuauuuuugugaguccggucaaggggaacaccacaaaggugaguagaccacacaacugauuaaaaauaagcuuuugugggccuuagaaaaaguuauucuuuccauuuuuaauggucugugguuuugccaaacgaagguaaggagaaaagcaguuuagacucaacucuuaaggaacagagcagacacuucuauugaucaaaucucauuucccucaaaugaccucggugauuaaauauuuugcagcuugugaucugugcaacccauuggucaagaguaaacuugaauucuuacccucuggcaucacaaggccuauugcagccgaucccagagaaaaaagcagcucccaaagacaaaaauguagcaaagagaacccccaggcauuuauuuccccccaagagaaugcagcaaaggaacacuggcccuggugagacccgcucuagcugauaccagcuuggauccguaacuuccugcccgucccaaccagaacgugcaaacaaaacuccacuauacgugaucuguaaaagccucaagaaccagcucgcuuuccuccugaugcaaguuuagaccccgguucccuuccaaacguggcucagguaugcucuguccuaucccuuuaccggaaccaucucgggauaaauuuuuuuuuuuuuuuuuuuugagauggaguuuugcucuuucgcccaggcuggagugaagugcugcgaucucggcucacugcaaccucugccucccggguucaagugauucuccugccucagccuccugaguugcugggauuacaggcaugcgccaccaugcccagcuaauuuuuguauuuuuaguagagaaggggaauguuggucaggcuggucuaaagcuccugaccucgugaucugccugccucggccucccaaagugcuggcaugagccauggcgcccagccgggauaaucuuuuaaauggccucccuggggcugcagcucagacuccugcuuccaagcugucaugugcuugacauuauuuuccugaucaaaaucuacccuguguacagaguaaaauccacaucccugccucaccuucaagacucccugcaauuggcuuccacucucuccacccagccccauucucucuaccaggggcugucccuccccaccgcgccccccccccuccccaguugggaugcuuucagcacggcugcauccucccuggcauggcaaagcuuacuccuuccugaggacugucagcgccacuccagaguccuccuaccccaaacuacucaaaguccaccauccaaaacguccaggggcugggugcaguggcuuaugccugcaaucccagcacuuggggaggcugaggcaggaggcucauuugagcccaggaguucaagaccagccuaggcaacauagugagaccucgucucuacaaaaaaauuuaaaaacuagccagacuugguggcacaugccuguagucccagcuacucagugggcugagacaggauugcuugagcccaggaguuggaggcuacggugagcuaugaucaugccacuggacgggaugacaaagacccuuuuuuuuuuuuaagacagaguugcuuuguugcccagucuggagugcaguggcacaaucuuggcuugcugcaacuucugccucccagguucaagccauuuucccacuucagccucuggagcagcugggacuacaggcauaugccacaauggcuggcuuauuuuugcauuuuaguagagaugggguuucaccauguuagccaggcuguccuugaacuccagaccuuaagugaucugcccgccucgguccuugcaucuucaguuagcaagugcugggauuacaggugugagccaccgcacccagccagacccugucuuaaaacaaaacaagaaacuaggaagccuuguuuauaucaaugucucaucucuaauuuucuguaaaacaguuaccgccugaaucacacaaauucacacucaauuacauuccauuuuguauuguuucuauuuuauuuaaacagcagacagguaauucacaugcuguaauauucauccauuuaaugguuuuuguauauucagaguugugcaaucauucaccacaaucucacuuuagaacauuuuuaccaucccucgccccucaaaaaaugccugacccauaguagucacuccuccauccccuauccccagucuaagcaaccacuaaucugcuuucugucuauggauuuggcuauucuagauauuucauaucaauggaaucauacaauaugugaucuuuugugacuggcuucuuucacuuagcauguguucaaacuuccuccauguuauagcauagaaucagcacuuuguuccuuuuaaugaccuaauaauauucaauuguguagacauaccacauugcagucaucaauugacagauauuggguauaauguuucuuucuuuuuuaaaaaauaaguuaaaauuucaaauguugcccaggcuggucuugaacuccuggacucaagcaacccacccaccuugaccucccaaaguguugggauuacaggugugagccgcugcgcucaacccauauugcugcugcuuuuuuuuuuuuuuuuuauaacaaccgcuaaucaguuuauuaaaauaguugacuuugagcaucugcaauggugacuuccaccucaauuccuggcucaacacugauggaagucaacugcuuaacaaucucagaaggacugugcaagucaguggguagcuuguggauucucaucuggaaacgaucccaugucucugaaccuucaccacaaggagauuuucuuauagugauucucaaagucuuggcaggcauucaaacuggucccuucacuuagacauucuuuuccuuuccuccucugaaucaagucagcacacaccuucuccagggauuuuacgcugcggaucauuagagggauucgaauuuggugaauggucaccuccagcuucacagguguuuucugguaucuuuaaaagccuuggugcagugcggcuuccuggcugacuuguucggaacagcgaugagugaggagcaggaaugggcagacugcaacucugcaccacuuaugacugcaucuuucucaaagagcuguauugcuucuuuuuguuuguuuguuuuuuugagacagaauuucacucuuguugcccaggcuggagugcaauggcgugaucucggaucacugcaaccuuugccuccccaguucaagcaauucuccugccucagccucccgaguagcugggauuauuacaggcaugugccaccacgccuggcuaauuuuguauuuuuaguagagaugggguuucaccaugcuggucaggcuggucucgaacuccugaccucagaugagccacccgccucagccucccaaagugcugggauuacagacgugagccaccgugccuggccuguauugcuucuuaauuguccaaaauguccaagucucuccuaggaauuagcaagcaacucagcgcagacguaccuguuauaauuuucccacagugccuaacaaugucaaaaacccagagacuacucaguaaguccagaacugaaucuagcauccagcaaaagcuaauuuucagaggaaccaaaaaucagacuaaccucggguucuagcggcuuuuuuccacggcuaggagugcucuuggugugugucagguucuccguuuacaaagcagggaugaugccacuuucuuacaggagaugaaaccaacugcuuguaugcuuucugggcccugcuugacugcgucacaaccccauccaguggcccugaacuuggggaguucuauguaagguggcugauuugggggcaugacugcucacuagcacccugcaacuaccaugucaguacuuuccauucucuuuuggucuuuccagugucccucacuuauguccucauuagaaagguccuugccucuucagcuccagcugcccugagcuggccuuucucuggucaagaccaacaggccagggugucguuagguguccauuagcaagagaaaagcuaccugacacuuuuauuggacuggccaagaaagaugaagaaagccacuuuauuguucagucacuugaaaccaacauuccaacuccuggagaaccugauuaauuggaaucagauacaaagguuguccucaaaaugcacauggggaugcugugagggaagcagcaccaaaacacuugcuuugugcaucuguuuccugagagaugagguggggaauggaggcuggagggcaucugguaucuggauucccuggugaccuagccugaggcugaaaaagacuggcuguucacuauuacaggcucuaggugccauguguuaacagugcauugcggacugggugcaguggcucaugccuguaaucccagcccuuugggaggccaaggugggaggacugcuugaggccaggaguucaaaaccagcccuggcaacauagugagacccugucucugcgaaaaauaaaaaaauuagccaggcauaguggugcaugccuguaguccccaggcacuugggaggcagaggagggaggaucccuugagcccaggaacucaaggcugcaggagcuauaaucuugccacugcacuccagccugggcaacagagacacugucucaacaacaacaaaaaaagugcauugugaaaaaaaaggggccuuaugcuuugaugccaauagaauggagucaccguucucaucaacaggagugggaaggucaggguuaggguuugccuugaacaucguucgagaacucaggcugcugaucucauuaccacgcagguuccugggucaaagcagcuggcggguggaccuugggaauuugugcaggcugcaaccagugcuccuuuuagugcgagugacaaggauucauacaucaaaccuacccugcuucucuaaggugucucuauccccuaagaaggaauuaggagcccaccggagacccacacuuuuugauaauccucaaggaagcagcuagaaaggacagaggcaggggugggaggggauuuucccauggugcuuucaaguucaggaacacgauuaaugauaaugaggcccuacugaaucccucuucccuuccuacuuuccccccaaauacugcaggcuuguacuuccaacaagccaacagguacagcauuuugcuucuagcaggacuggacaaaaaucucccacagucauuuagaaggcaguucugggaucuuggcucacugcaacuuccgccucccagguucaagugauucucgugccucagucccgaguagcugggacuauagacaagcgccaccacgcccggcuaauuuuguauuuuuaguagagauggaguuuugccauguuggccaggcuggucuugaacuccugaacuuaagugauccacccaccucggccucccaauucuugauucuaaaucugugucuuccaccagucaugggaaccaucagagacccaaacccauacaaaccuugcuauucuuaugacaagaugagaccccaguucucaaaaauccaaggaggagucagggaacuuucaucaacauagcuaccauuaggugacucugggagcccuugucacugugcaaggagaaaugggugaaacaaaggcccagaaggcauaugucuugcccuaacaggggugcucagauuugcacagcaccuuaauauggauuaagauuuuauacugcaacaugagacaaauggagaaugucaggaccaaguacaggcaggucuagcacaggcucugacgucaugaaacauaaagaaaaguaucagcagugagagcagagguuggacaaaaugacggggaagggaaaagagaggauuuagaugagaagugaaaugucuggggggaacagaagagaaugaagugcuuacaggcauggcuguacccuggucugaggggcagugggagaugaggccaggcuguacagcuggccaggaacagaagguucaugggagaaaacaguaacaaauaaugauuucaauuuguaaguugagggauagaacagagccaccaaagauaucccagggaacacaccucucugcagagacuaugaaugcagggcauucaugccacauggacaaacacaccugaaaauguauuuugaaauaccgcuucaccagcccggucccacagcagccacucuggucuggaaguuauccauccccaaaccccacaacuuaacaggaacccagugaagaauaacaacacauuugcauagcacuuuguaauuuaccaugugccuucccauauauuaucuagggauccauaaacaucugaguaaacagcaauacuacuacuggccaauauuuccagcacgcucacuauaucccauaggcugcacaaagcuuuuaacacagacccucccauuucauccucauaggaaacuuaugagguugauccuacuaugauuucuauccuauggaugcggaggcuuacuacauaccagcauaguucucagcauguguuaacuuagaaucuugugaaguauuuaagaguuagaauuauuaucuucgggcccagugcaguggcuaaugccuguaauccuagcacuuugggaggccgaaguggguggaucaccugagaucaggaguuugagaccagccuggccaacauggugaaacccuauuucuacuaaaaauacaaaaaauuagccaggcguggugaugcacgccuguaaucccagcuacugaggaggcugaggcaggagaaucacuugaaccuaggaggcagagguugcagugaaccgaaaucacaccacugcacuccagccugggugacagacccagacuccgucucaaaaaaaaaaaaaaaaaggaauuauuaucuucagagggggaaacuggggcacagaaagauuugggauuaguccaagauggcccagcuagguuguuaaguggcagagcugggauucaaacacagguagccugguucuccagaauccacauacaucauacauccagaguccagcuuuaccgcugugcaaggcagccucaaucuucacagugucuugacuuccccaggugaggaagcccuucugguucagcccuuugauucugucuaauggcacccccugcauccuaccuccucccgugagauucugaaguugguugcuuuggccuuauccuccccuccuucccucauuuccucaagcccauagcucauaucaaucauuaccuuacaguugagugcuuuuaauuauaaaaugcacucuccugccccugcgaguccagcaggcucggcuguccaaauguggcaggugagaaaaugggggagguguucauugugauuguggcagacucaagaccaguaacaaugcccuguuuuggcauugcacuuaauauuucauagggccugcuuccuugugaccaggugacuuguguuccuucccauuuaaacauggaaaaauggcucccaaagucacaaaacagggacaagcucuagaggcugcaucugcuggguccuggccccuccacuguguccagguacucuuccaggguucaguccagccagcacugucgcagcacauggggugaugagggguggcccacuccaggucugugccgcucugccugggccacaggagacagcacccugccucuccuguccucagcucaauccccagcagucaccugacaccuucucuucucgagccccucaccguugauuacagcuuacagcugaugaccccugaugacccacugagaagauuaagaacacgaggcaaaagagcugguccgcccucccccuugggccacauccucaggacugcacagggcucacaagggucccggcuuucaaguccugacugcuccagacccccaacacuccaugacagccccagcuggucuggagccucucaaccacguccucucccaccccugguucggccacuaccccaguuccaccuccccaguggagccaauauccucacugcuccuuucauuuuccuuuucuuccccuaaaugccuuucuccuucucucucuccaacaagcaaucaucuccaucacuuuccuaggccuuaaaacucacucuucugagacuggccaaacugcauucuccaccucuccccaacaugaaugugccuuucccuagagcugaaaauguucaugccugugucuugcacuuacucauguugcuggggugcugggcugacaguagguauuuguauuaccuacucuacguucuacacuccaaagggcuuagggcuuggauaacuggcccccaacaaaauccaggcauccuccaugagcaugaugucucaggguagcaauuucuaucaucccuauuccaucuuuuugauuucugaguuaagaaaauuaggagagaaaggcuaaacuccucagcaacaugggggaaacuggugguccaggaauguuuacagucuugguauaaacuccccagagauaaaugagggggcaauugugggugggggaggaacucgggguggcuuugaaagcaacuuaaaaggagcacagaacagcgcagcggggcuccgggggcccucugcagagguuuuuuuauuacguauuuuggcuuugaaauggaacugaaaacuuaccuucggcuggcaggacccggccagagugcagaagcaucucaccgaaaucccgggucacagcugccauccuacaaggguuuggguggagagagccccaaaaauguguuucucucaacucucggaguccccaaauagaaggagagcugcaaaaauggggggcacagguauguguggaaagagagccgggagcaccaaaucaauuagcagggccugacacccagggccaauggcguccaccagccccccgacccaggggauuuggagaagggcuuuuuuuuuuuuuuuaaauugaagaaagugaaaagaguaagaggggacauuuugcaugcaaaugggccacugccagaagagcccauuaaaauguaaaaacuccacauucagccugacaaaacggugcaaacugcuguguuugccagagggccggcaauaaagcucacaacaaaggggccgggggacaauggcagacugaauggccucugccagcagguccccccgugcguugccauggggaccccaccggggcuuacuaaagguauuuccugaggagaaaggccgagcacacaggcccaggcagcccggcuaauccugacaggaagccauggccauucagcagcccaggggcuuggggcccagaguuuuguuuuguuuuuauuaaaaaaagauuucggccuuuugugcgucccaccucgucacuguaauuuagugccgagccgccugcacuagccaaagccacagccaggacccugcacccgccccgagaccccccaaaaacagauccccccgagcugggcagcaagacacguguagaaucccacuugggaaucgcaggcgccaagagcuauuggccuggagaguuguguguggaucuuaaaagacagagggacucugggugucguaaaggauaacgcagccugagaacugaguuuggggcucaagcuucuaugcacggauucaucugaugccuccuucaaaucuguacuuuuuuccccuagggauuuugccaccuuucuccaaucagcaccagugucccccaccuccucccuaccucucacaauggggaguucacuaccucacugggagaagggcuguaauuaagugauuaacaaaggaaugcacccaagaguugucugaaaagaaauuucccuccuuccucucuccccagcaaaaguucucacccuauuguuuacugauacauuaaggacagagcuguacagaaaacucuuacuacacucuuucgcucaaccuauucccaauacacuuugcuucucucccuccuaucuaaacaggaagaaagcauugcucuggaaagagggaaguucauucacucauccaagaagagcaaagguagaugcccugcggcuauggaggagggccguccaagcucacaguuccuagaaguuugugucaccauuucacauuuagcaccagaauccagccuuggcagauucagggaaggaagccaaggacacagcugguggugaagacagaaacuccugugugacaacugcccccuaggacacaguuuagggucaauuaacauuuccugaacaacuugcaaauggaaagagccauccccaaugaagacugaaaaaugagaggcucaacucaucuauuaugacuugaacccaagucuaucuguguuugcaaaggcugugcuguugcaccuagaccuccacccagaaacauguuuuggggcugacauuuuaauagaaacauagagaggaaaacauacuauuucggagacauuaagacugugacuagcaacugccccggauacccugggaagcuucuaaggccauauuggguggguccuauuuugggaaaagaaguuggggcaucugcacgauaauagaaagcucccaggaucugguaaggaccacuuagguggacuguaaguuggggggaucuaaacacucagguuggaccggggcagggggagugucuucuccugccuuuauuauaauauaaaucacauccuaaacucaaagcaaaguccaacucgucaucaccugugacagugcauaagaaagaacaucuuccaccaaguuguuaaaguggugugugugugugugugugugugugugugugugcaggggucccacugcuggaggggagcucagacucucccaccacuggcccggagcccaggccucccagccaugugucugcagcugcgaccugucaugcacuuccuggucuggguucuguaauggaaagaucauuaagagugggggaggguggagagaugaaucaacggcaaagagguaacccugcagcucccacucuccacugagcucugaccuuaaaguucggucagguuccuuaaggaaaagaauguaucgcccuccccccaccucucccagcuggggccucucgaacaaccuccccucccccaaacucagcagaaauuguauggggaaggaaacgccagcagcugggcagggaaaaguugccgcucccuaaacuugcugaugaauuaguagaggcuucagcuguuucaggaugugucuucuggucccccaagcccgacaugggugcuugagcucacaguucaccuggacucucagcaccccaagugccugccauauccccgcaaucccgucucauuccugcaaugguggggcugggucaccagccucuccagaguagagaaaggaaugggcuucauaaaguuacuuuuucuccaccguaaagaaauucucuuaagguuucacacgaugagacuaaagacaauaaaacauccuuugaaaaugaaaagcuguagaauagugguuaccaaggggcuggaagaggggagaagggggaguuagcguugaacagguaaggugucagggaaggugaaauggaugguggugauggcuacacagcgugaauaaauuuuaugcuacaaaacugugcacuuaaaauuggugaaaaugcaccacaaagaaaugauaaauauuuaaagugauggauacaauacagcaauuaccaugauuuggucguuacauaaugugugcguggaucaaaacaucauaccguacccgacgauuauacauaaccauuaugcaucaauuacaaauuuaaaaauuggccgggcacaguggcucacaucucuuaacuccaauacuucgggaggcugaggugagaggauuguuugaguccagggguuagagaucagccugagcaacaaagugagaccucaucucuacaaaaaaaaaaaaaaaagaaaaacaaaauuagccaggcaugguagcgugcaccuguggucccagcuacuugggaggcugaggugggaggaucucuugagcccgggaggucgaggcugcagugagcugagauagcaacacugcacuccagccugggugacaaagugugacccugucucaaaaacauuacauaaucaauuuaacuuaaaaaaauaaaaauaguuaaaaugguuaauuuuauguuacauauauuuuaccacaacaaaagaauuagauggcgcugggcucgguggcucacgccuguaaacccagcacuuugggaagcugaggugggcggaucacaugaggucaggaguucgagaccagccugaccaacauggagaaaccccgugucuacuaaaaauacaaaaugagccaggugugguggcgaaugccuguaaucccaccuacucaggaggcugaggcaggagaacugcgugaacucaggagguggagguugcagugagcugagaucgcaccauugcaccccagccugggcaacaagaaugaaacugucucaaaaaaaaaaaaaaaaaaaaaaaaaagaaucaggugguaaugguagcaggcagcauuaguuuauuaaaaacguucuuacuuggcaaaaaaguugaugauccuuuguugguuccaaaaaucuggagggaaauuuuacuggccuaugaaaucuaaaaaucugggaccacuggucuguuccacgaauuuccaggagagcuuggacccagagacugcuucauucacaucccaucuauccauaccccacacauucauccuucagucucacuuuuaugcacacaacaugaacguugagcauuuaguacucucaguuuuaagaaauuaaaaacaugguucggguuuuuuuuuuuuuuucuuugagacagggucucauucuguagcccaggcuaaagaacagugccaugauuucagcucacugcagccuccaccucccuggcucaagugauccccccaccucagccccccaagcagcugggaguauaggcacuugccaccacgcguggcuaaauuuuuuuuuuuuuuuuguagagacaggguuuuaccauguuggccaggcuggucuugaacuccugacgucaggugauccaccugccugggccuccaaaagugcugggauuacuggcaugagccaccaugcccagccaguuuagggauuuuucuaccugagaguguguggcucugugguagccaggaagcuaaagccuaguaucuaugcucaggguuccagugaucuggggaucuagaacaauccugggaaaagagcccuuacucucagcaaagucaguauuccccauguccuacuagaagagagagaguauacuuugagguccuuguaaaaccauuuagucccaaacucagcuugagccacagguaguugucacuggcuggguccagccagagagaguaccugaagaaaucacucagaugacagcugaucacuuacugugugaccucaggcaagucaccuccccucucaagccucagcuuccuccacuguaaaaugagaaggcugacugacccugucccagcccuaaccaauguccuguuucaccugggucuugugagaugauagaggggcaucgcuuacuggcaucccuuuccgugcccaucgugagcacaaagcucccucugaugugagggaagugaagagcccucaacuguccuugaguuguccuucagaaaaaacgauucuguguuggucucagggcuccggcuaccagcaccuucaauaaaugcuucuccucuucacccguucucccuggccuggggugcuucuccagaaucuaaggcuggcagaaagcccagcuauacauggaggauucacuuuagugucaucuuuugauggucaugauauauuaccccaugagaauggcuaggccaauaaauuuuuuaaaugcacugggaguuugggguagugaagaagggcuaaaauuauaaaauaaacaucacuuucaagugcaugucaggcauucauacagucucaaugaaauugacauuucauuuuuuggggaacggagucucacucuguugcccaggcuggagugcaauggugcaaucuuggcucacugcaaccuccgccuccuggauucaagugcuucuccugucucagccuccagaguagcugggauuacaggcgccugccaucacgcccgguuauuuuuuuuuuuuuuuaauauuuuuaguagagacacuauguuggccaggcugggcuugaacuccugacuucaggugaucugcccgccucaaccucccaaaaugcugggauuacaggugagccacugugccuggccgcaagugacacuucaaaucaugacuacccaaguuuugaaugccuaacuucauucaguaguuaguaaaggaaacugacucuucuaagguucaaaagcuacuuccuaaaaccuaaggaaaauaaaccuuaauuccaaaaguaaacucuggaguuugacaccagaggaggagaaggacacuucugaagggcuggagugcugauaagcauucuaaaggcagugauaauugacugaaagcuguggcagagcaggagagcauuccaggaaaaggguguccuuccuuccuagggaagcucuuagaucacuucccuguucacauccuucuccucccccaugccuccaaggcaaacugacucagcccucucccaccuuuuuuuuuuuuuuuuuuuuuuuaaagaggaagucuugcuauguagccaggcugcagugcaguggcacaaucucggcucauugcaaccucugacucccugguucaagcgauucucccgccucagccucccgaguacuugggauuacaggcgcccgccaccacacccggcuaguuuuuuguauuuuaguagaaacaggguuucaccguguugcccaggcuggucucgaacuccugagcucaggcaaucagcccaccuuggcccccaaaagugcuaggauuacaggugugacccaccacaccaggccuaggugauccuccuaccuuagccucccgaguagcugggauuacaggcgcccaccaccacgcccagguaauuuuuuguauuuuuuguagagaugggguuuaugccauguugcccaagcgggucuucugagcucacucuaucugcccaccucggccucccaaagugcugggauuacaggugugagccacugcgccuggcccuucuucauuauuuauaaaaaacacuaguagccucaaaaaaauguuaaugucccagccucugaagcuuuugauauguuuacuuccauucaucagagauuguuggaccacauccauauuagaagcaaucuaguuuaugcguccaggcaauacccauaccacacauucuaggcuaacugugaccuauaaagaaaacucaggugucggaucugacaccuugggaaccuucuccauguaggucuuuggcaacaguggaaauggcagcguccauggggauuuuguuccauugauuauucuaggcuagggaaccuuguucauuaaggcaguucacagaccugugacugauguguaaccucucuacagaaugccacaggagauauuacugcaagcaaacacacacacacacacacacacacacacacacacacacacacacacacacacaccccugacaaagggaggggaugccugacuccugugagacaaaggggacugagccagcaauguuuacauucagaaguugguccaccuagauuuuguggggaaacccaauuugauauagaaaaauaguguaauacaaugggaaaaaaauacuauagcagaaccaccugaguuuaaauccuaguuccaccccucacccacuauauaaacuuaagauagguuacuuaaccccucaaaccucaguuuacucaucugauuauggucauaaaaccuaugccuauggaaucauuguaaaaaugggaaaaugucaagcaugcagaguguggagaugauauuuauuauuauuacuuuugagacagagcguugcucugucgcccaggauggagugcaguggugcaaucucagcucacugcaaccuccaccuccuggguucaagcuauucuccugccucagccuccugaguagcugggacuacagguggccgccaucaugaccggcuaauuuuuguauuuuuaguagagaaggguuuugccauguuaccaaggcuggucucaaacuccugaccuuaagugaucugccugccucggccucccaaagugcugggauuauaggugugagcaacugcacccggcugguauuuauuauuauauuuuaaaagacauuuacugguauaaucuuuugggggauauuugguauagugauguaauagugauaaaaucaaaacuuaaaacaaauggaacuauccuuggauacauggacagauuuuauuuguaagaauauguucuauugaaugcaaacuauugaaaauaaccuaaaugcccaaauguagagaacuggaucaacuuuguacacccacacaauggaacauuauguaguucuuaagcauaaugaaaaacauucucuguauggcucuaaaugcugauaucagucacaaaacaucguauacaguauaaauccuaauucugaaaagucagguuuacauaaaugcaagaaaaaagucuaaaacaauaaauucaguuaacagugauugcuuuugaaugauggaauuauaggagucuuccuuuuccucuuuacaggucuguauuuucugaauuuugaaagaugaacccagauuaucuaacaaaacaccaauuuuuuuuuuuuuuuuuuugagacggaguuucgcucuuuugcccaggcugaagugaaguggugcgaucucggcucacugcaacuuccgccucgcggguucaagugauucuccugcuucagccaccugaguagaugggauuauaggugcgugccaccacaccuggccaauuuuuguauuuuuaguagagacaggguuucgccaggcuggccagugcugggauuacaggagugagccaccgcgcccagccuaaacacuaauguuuuuaaaagagugauaaagauauacuugcugacuauagagaacuuugcucuaguggaguaaacagacaucuauuaaaaacuccacauaaugugaggcagaguaaaguaaguguuagaaugaaaguuaaaaagaggccaggugugguggcucacgccuguaaucccagcacuuugggaggcugaggcggguggaucacuugaagucaggagcucaagaccagacuggccaacauggcgaaaaccugucucuacaaaaaauacaaaaauuagcugggcaugguggugggugccuguaaucccagcuucucgggagggugaggcagaagaaucgcuagcaccugggaggcagagguugcagugagccgagaucgcgccacugcacuccagccuggaugacuaagcgagacuacaucucaaaagggcaugguggcucaugccuguaauccuaacacuuuaggaggcugaggccagaggaucgcuugaucccaggaggucgaggcugcagugagccaugaucacuccacugcacucuagccugggcaacagagcgagacuaggucucaggagaaaaaaaaaacacagaaaaaagaaaaagagaaaaaaugggguaauuaauuuggagauaggggaaggcuucaaaagggagguggcccuuaaguuaagcuuuaaucuaaacccaagcuaaaccuuaaacuaagauuugagcaggaauuauaaaaagugaaaaggaagaaaaggacaggaacagauauuuccagcuaagggacuaggauaaaacaauguauaaaguauacauuguauuuacggaaaaaggaagagacuugcuugacuagaugaaugaauaaaugaaugagugaaaaaaaaucagucaaugaauggaccauuagccagaagcuaguuuuugauccuagagaaaagugaggaagggcuaagcucugaauucaauguucacuguugguuaacuccuagaaaccuccguguugcuguuucugaccucuuucucugcccaaccucguaaccacuaagucuacucuuugcggaacuccuugacccucucacccacuucaggcucccugugucuccauguccagggccugggaacacaaauggcacagcccccaccccaccuuuuacacaacccaucccgggaggcucagccacgccacagcaugugaacgaggagagggcguggaguuucaagcucugccaggguggaucuuucucagugccugaaaccagcuacacggagcccucaccccacagccccuaguuugcagggcacaaaugcuuuacaugaaggcaguagauaccuguuuggcaaguggaaaggcaagaacuguugugagccaagaaacaggagaagggagggaacucugaggguagaaguucaaugucucuuggugccacacuggcaaugcuaagaggcaacaggcccacuaccggggaggagggguuagggcaauuggcccugcuacuuggcugccaccagcuguaagucagagcaaaccccaaggucagaaguggcccagacuccagcaggcuucuccuaggaggaaacaguuugggauuuagcccaggcccuucagauccagguagggcaguuagcuuucagcuuaauuauuuagggugcaguggggcuggggaguaugguggguggggagaagggauugccugccugcaaguuggugaaagagccaggcccaggaggaaggccugggccgccccguucaggagcccaggagaaugagagcagcuggacuuccccggucaacagggaaacaguugucucauuuccaagccucagggaaggaagaaagaggcaaagguggugucuacagggugagcuggagcccccaguggccccggaggaacgaggcauugugaaaauagggccagcugcuggucgggcucucugaccccagaccucgcccucccggauaaugacuccccaggacucacuucucccagggccauucaucaccgcccagacacaagccaucacucacugcuucugccuggccaggagcaaacaccccuccgugcuggggccacaggcucccaaagaaucccugaugcugucucuccaguuccugcugacccgacuccagguagucacaggaaccaggugauggaaacccugacagagucuuuguuugggaucccucccuucccccacuggcagcaagaucucuggacagccauuuguucuucccugagaaauuccuccucccugacuucagggagcgggccuggcagagccagaguggaaaaucagugaagcuaaugguguagcaaugcagaagccggagccaagaacacagccucggaguggcuuugcugcgcuugccccagcuuggucaagagggccacgugagcguccucacauucucucacaggccgagggcuggguccucccuguccagcucugaacacuugcaaacaccccuuccaggcacuggagccacuucuccaggggaagugggacagagcugauccucuggggaaaccuguuaugagcuuagcaccuugcagauuucuagaggccuaaauccuccacccuuguucucaagagggucaucugacaucaccuuuugcuccauggaauuccauucgccuucuggcaggggaugaagaaacuccucuuaccauccagguugaaugagaagcaaacaaguucuuuucaucauaagaaaucaugcuggagauggggugggaguaggggagggucuugccugugucccaaggcagccuugggacacaggaccacaguccaguguagaugcuagacuacaggucugauaguggaacagagggugucccacuaccaaaccuguaguaccuauuugagacucucccugcagccaggcugaaacgcacaccccuuugggccaaaggcagcuggagacgcccagggauggaggaccugcaagggcccuaugaucugaggcuaggcaauggcucuggcaccacgcacagccucucccccauaggugcagguuucugcaaaacacagagacaaagccccgcuuuguggugcacacagggcauccagggggcuugaggccagaauggaaaugugugguuuuuccauuaagugcaaccucuccccccucuaacaagccaccagacuccuucaaaucugggugggugggaggagcuguaaaacucagcccauuaaaucacuucugagcugcagguuuucugagcacugggguguuuaacccacaguacugcugaaaagggggcaggacccccaccccaacuaccagcaguggccuugcaagcaguguuguacucacucacuggcuuugcccaccaagacuugacuuauugcaaaagacagacaaaugcacccucugcaagcucagaauguuggggcuuaucaucugaaaccggcuucagucuuuccaaacaacucccucaccacucucaaagccugaucugaaacaagcugaggcucuguaagaucccaaaccaaaggaggggaaggagagggagaggggagggaggcugguuuuccuggaacccuuauuaaaucaacuuuccaaggacagccagaaacuccaggcccuccccaaucccucaggagcacuugcagacugaggggcguugguacugcgcucaguggggaggggcucccgacagacacacagacacacagacacacacacacacacacacacacacacacacacacacacacacacuuaaaaucacagcaaggccuuuuaaauggggaaaacucagugugaacaggguuuuaggugguuugcucucaccuuuuggacaaagcccuuaauacauagauuauaauguguuucuucuuuuuuuuaaagacagggucuccuucugacacccaggcuggagugcaguggcuugauuauagcucacuguagccucaacuccugggcucaagcaacucucaagcaauucucccaucucagccuccugaauagcuaggacugccgaugugugccacguuacccagcuaauuuuuaaaauuuuuagagauggggucuugcuauguugcccaggcuggucuggaacucccgggcucgugcaauccuccugcaucggccuccuauagugcugggauuacaggugugagccacugugcucgcccuaugauuuuuuuuuuaggacaacagcagcauuggccaggcaugguggcuaacaccuguaaucccagcacuuugggaggccgaggugggcagaucaugaggucaggagaccgagaccauccuggccaacauggugaaaccccgucucuacuaaauauacaaaaaaacuagcugggcgugguggcacgcgccuguaaucccagcuacuugggaggcugaggcagaagaaucgcuugaacccaggagguggagguugcagugagccaagaucacgccacugcacuccagccucgcgacagagugagacuccgucucaaauaaauuaauuaauuaauuaaaaaauaucagcauuauuauuuaauaaucagcaggcccaagacuaugcaauauacuuuacacuuacaagguuccuuacagcuuacaaagcaugaagccagaucuccccuuagaauguccugggcacagcaguucucuguucugucacaaagcucaugagagacaggcuaugugaaagcaccacacucacacugagacgggggcuuacuccaccaaacagagaccuggggcuuguucuccaagugcaggggcuuuccguugcugugucccaugaaacaacaugcuccucgccaugugccgucuccccuggaggcccagggaaagggacccacaacggccauugacugcucauggccuacggaccaggcaauguccuaugagcucugcagacaugcuuauuugauauucacaaugaccuuaugagcacacauucauuaucaauauauuuuauaaaagggcacaaagaggaacuuccccaagagccaacagucaguaagguguggagccaaaaucaaaaccagggcaguccaaggaaaaugugugcccacccaggcuugcacaugaagguucacagcagucuuauuacaauagcccaaacuguuauaccuaaauuaaguugguuuggccaggugugguggcucacaccuauagucccagcacuuugggaagccgaggugggcagaucacuugaggucaggaguucaaggccaaccuggugaaacccaucucuacuaaaaauauaaaaauuagccaggcauaguggugagcaccuguaauuccagcuacuuaggaggcugaggcaggagaaucgcuugaaccugggaggcagagguugcaguaagccaagaucaugccacugcauuccagccugggcaacagagugaaacucugucucuuaaaaccaaccaaccaacaaacaaacaaacccagcugaucuuaaacuccugggcucaagugauccuccugccucugccucccacaguacugggauuauaggugggagccaaugugccuuugaaaauuaaguugauuuuuaaaaaauggucauuuaaugucagucuuccuggguacauggcuccuaagagccccauccaccucucuuacucccuuucuucuguucacagggccgguacuuuguccucaucaagaucuucagcccccagguuccagccuccacccugccccagcagcuuccgugaagcccccuccucuacuagcacccccacccuggcccuaaaguuccuuauacucaucccgucgggcuggcucacaagcagccaggcccgagauccacuucucccuucuugggcugcaaaaaaaagaaaguacuuuaggcuccauuauaaauucacauucucaaaccucaacuagcuccuugcuacucuuccacuccuuuaucgcugucuacaauuggcggauucaaaucuaaacuccccucaaaccucccacucugacucacucccuuuacacucucaucucagucuccaguugcccacaguugacacccaaccuacuuaaacccacagaugcuauugcuguagugucuuuacuacuuuuuccuuccucuaucaucucccaguccccauccuggucaguaccugcacuuccucuagccagacacucaaaauaaccugcgaccucauccuucuggcagcagcaguggcagcaauagcaacuauuaacaccuuacauggaagugcuucaucuggauuaccccacuuaacccuuuauuauuuaucccuguuuuacagaugagcaaacugugacguaugguguuugaguaguuuguugaaguaaauaaugcagcuaucaaguggcagagcaggaugcaaacacaggugcaccucacucuuuccucccagccauccacacugagcugccaaauuaacuuucugaaagcugauagugucacuacuugcuaaaaacuuuucaaguuucccagcaucuacccauuuaagucuaguuuucuuuucuugcuuuuuuuuuuuuuuuuuuuuuagacagaguuucacucugucacccaggcugaagugaagcggugugaucauggcucacugcaaccucuaccucccagguucaagugauccucccaccucagccucccuaauaguugggacuacaagcaugugccaccacaccuggcuaauuuuucuauuuuuuguagacacagggucucaucauguugcccaggcuggucucaaacuucuuggcucaagcaauccuccugccucggcuucccaaaauguugagauuaccagcauaauccacgccuggccuaaguauaguuuucuuuuucuuuuuugagacggagucucacucuguugcccaggcuggagugcaguggcgcgaucucagcucacugcaugcucugccucccggguucacgccauucuccugccucagcuggagacuggagcuggaguagcugggacuacaggcgccugccacuacgcccggcuaauuuuuuuguauuuuuaauagagaugggguuucaccguguuaggcaggauggucucgaacuccugaccuugugauccacccgccucagccucccaaagugcugggauuacaggcgugagccaccgugcccggcccuaaguauaguuuucuuagcagggcauuaagccuuccauaugcuaacucaauccaauuuuuccaaguguuguuucccagagcuaccuacucaccaggcaaaccguucuccauaaaccauauacaugcugucucugaacacucaugcuguucaaccuggagggcccuucauuuuuccccuucugaacucaagcccaucucaggugcucucugcuccccucuuccucugcauucccaccaccucugguuguaacuucacugggugguuuaaacacagucugucuuguguuacuuaucccuguacuugcccaucccuccugaccauaaacucccugugggcagacacagucucucccacuuuggguccccaccgugcuccagcucagaccuugccuucgguucuguuacugacagcaacaugaauaugccugcucuagccacugcaccuucuauaaagucucacacaacuuucccuguucauccccaacuccauccagaggacacauauucucacccaucacucaucauucaaacgagucccugaccagcugaguggcagccuuuugcacacagccaccccaucacgcgcaccuccaaccuuucacccacugugugucaaccuucucugugugaccagccacugagucacgaaccacacuauccucuggcagcagaaaugcucauacauuaguuuucaaagucccgcgaaagccaccgguauucuguaccuauaaucucccaagaggccuuuccacagcucacacagaucccaagaauggugggguaaguccuuccuguuaccgaugauggcucugaauuuccaacacgccauaggucuccaugccccuuuaugcuuccugggucucaaucacuucaaaaccccucaaacaguaccuauccaaagcaaaucgcuuggcaggcccccaaacagaaccugugagacacaguuaaggauaggaaaaugcaggcgugaagccaugacugcugacccuuauagaagaugugccuuuuuuucacccaggcuggagcgcaguagugcaaucauaauucacugcagccucaacucuuaggaucaugcaaucuuccugucucagccuccugaguagcaaguagcugggacuagcagcgugcaccaucacacccaguuaauuuccuuuuuuuuuguagagauggggucucgcuauauugccuaggcugaucuugaacuccuggccucaagugauccucuugccuuagccucccagagugcugagguuacaugugugacccacuaugccuggcgaagauguggccuugaaacaauuuucuggaagucagaggucuuuagcaagcucucaccuccuacaacauccccuguagucugacccaaguucuacacgcaaauucuaaggucauucucuccccauugcaccaccagcugcauuuuauacaucaccuauguuaaagugugacacuaggguccucaucagauauucuuuccucagaaagagaaaagcauaaauuaccccccacaaacaugucaucucagguaaauggaugucaccagccuucaugaccccaaccucugaugaagucaguuauguuuauaaccagaccagaaccaacccagguaucuugagaguuucuccuacaggaagggaguucuuugcuccacuugggaaggagccuucccuguugaccacaucaccugcaaccauaucaccucccucccagcccauccuguucccaaggcccaggaguccaggcugcccccagccagcaccuuaccuuguucaggcaaggucggggacggccuagcggugcagaguguggcugugaccagcacagcccagaagaggaggcacuuccagcuccacaucccaguucugcaguuagagguuggugacaaggcuccacaucuccauggauacuccacagugagcucgauccuccuuuucaaacugacccugaggaaaggaaaaaaaccccaaaaguuaggagggucuagguaggggaggggaaaggaaaaacagaagguaaaguaugccaugugguggcugcuuaaaguguggacuuacuaaggcguccagaagaaaauugugaagcuaccccaacaaugaauuagaucauagguccuggcugggugugguggugcacccuguaaucccagcacuuugggaggcugaggcgggaggaucacuugaggccaggaguuugagaccagccuggccauggcgaaaccccgucucuacuaaaaauacaaaaauuacccaggcgugguggcgcgcaccuguagucccaguuacuucggaggcuaaggcaagagaaucgcuugaauccaggaggcgaaggaugcagugagcugagauugcaccacugcacuccaaccugggugacagagcgagauucugucucaaaaagagagguuauaggucuuaauuggacagagggaugcuuuaguucaauucuacagcuauguuuugagugcagauuacgugcaagccugggaauaccaucaugagguuuuccaagguauaaacuucaaaguaguaugugcuacaaagugaauggucucaugaaagucccaaauaguucugcccuuuugugggaaacaguuuuacaaagugugcuacaauugcaggagguuugagcaugcugauggcuccccagcauaagacuucacucugcccaggccaggugcgguggcucacaccugcaaucccagcacuucgggaggcuaaggugggcagaucauuugaggucaggaguucaagaccaaccuggccaauauggugaaaucccaucucuacuaaaaauacaaaaauuagcugggcauagugguacacaccuguaaucccagcuacucaggaggcugagacaggagaauugcuugaacucaggaggcggagguugcagugagccgagaucgcagcacugcacuacagccuaggugacagagugagacucugucucaaaaaauuuaaaaaaaaaauuuuaaaaagaccacuccaucuagggccaaccagucccucuggugagaaauaaggggcaaugaagaaucacggaacaagcuaaggaccaguaaauggaagccagguacagagauaacuaguuaguagcugcuggacuccaugcucaacuccccgaccuaugcaaugaagcagcugaaauaaaugaccuccuggguacuuucuuuuugucucuaaaauuguacgaaucacauccauaguucuaccagccucccuugcagagagaagaaaacccucaccagcuacuuacaaagagccuaagaguguggagccaggagggauccaguucucccugaugcuggaaggugacaagugaugucugacggauaugaguccagaaguugcggggggcaagggggccugggaggucccacugcagaaucaaggucuauugcaagcacugagucaaagauggcucacacuggccccaguuaaaagaacagaaucugcagcccuuuacccuucucaggucuggugggguaaaacuuaaaacuccccagggucuuaaagaacggaucauagcuguuaacauuuaccaagugacaagacuuucugggcacugucaaggcuacgugggggugaccaucucuauuuuccagguggcuucuguccuaaaugcuccagggagccauccaaguuauucagagaaucuacuuccccggaacaugcccuaaugugguacuucagcccugccucccccgagccaggcagggccccucgcaagugagucagugcuggcuggcagaaaagccccuggauucuuggcuucguucacaugugcuuggccagcgggauacacaugccacaccacuagcucccucccaaggcuuacuaaaauguuuuaaugauuucaaaucaaaagagaagucaacauuucucuuucauuuuucuacuuuuacgaaaggaaucagaaaagagaaaaugaaaugaauacugaacacccacuauguaccaaggaugcccuaaguagaauuaauuuagaacuauagugaggaauuaauucauuccucacuauaaacuuaugggggauaaguuuuauuauuccuuuuaugcaauggagaaacugaggcucaaagagguuaaguacuuuacucaaggaaauguagcuagcauguaauagugccucaagguuuuuggauauuagagaacagggugggaggaaguaaauaagggauugaucaagccugacuccaucugaugcaaacucaauuuauccaaaccaaguagauaaggguaaauccaagguaacucugguaacaaaagaggcuugauuugcaguuccauuggucaaagauagacccuugugccagggcauguuggcucauaccuacaaucccgggacuuugggaggcugaggcgggaguaucaccugagguggggaguugagaccagacuggccaacauggugaaauuccucgucuacuaaaaauacaaaaauuagcugggugugguggugcacgccuguaaucccagcuacucaggaggcuaacgcaugagaauugcuugaauuugggagguggagguugcagugagccgagauugcaucacugcacuccagccugggugacggagugagacucugucucaaaacuaacuaacuaaaagaaagacccuuggaagcagaccacagaugggccaucuaggacacugcauggggcacauucccagagcugggauagaagcagugcuugccagaggaugccccuaaacccauauuccacaacuuacuacaucccgaaaauacaccugaugcaggccugucacccagaaacgcacaccugaccaagaaaacccaggucccuugcuaagugucagaauacugaacaaguucucagguuccaaugggaaagaguggugucauguugagaugguuaagcuugcuucgacuuggccacucuguccccagaaaagccugccgccuccucccaggugugggcuggcugcagaccgcccucucucagcucccuggucaaugcacuucaaauucaucugccagcuucccucuuguucuuucccaaaaaagguacaaaaagucucuuccucuccuaccccucuggcccucaaguuugacaucuguaaaacaaggauguuaagaaaaccuggccuccuggcaccaacuccuggaauaagaagucagcauacaccccaugccacccgccugcaaaaaacacagugacacaggccacuaguccaacaugcugucugggacccugccaccuccugcuucaccucaguuucucauucuacuaauuaaugaauuuuuccaaucccuuagaaacaacuuccuuccuucacugcuugacagauagauguaaccugcagccuugcagguguacacagcagcuuccuccaagacccugcagcugguuccccccgccccgucucuccaauaucagcuaggcuccugggauucaugccugcaugcagagguccucgguggggagcagagagggggcacaucucaguuucccacucaucagagggggcugaaauacuugccuugccuccaucacaggugguuaugaagacugaaugggcugcaugggugaaagugccugcugucuucucacuggaguacugauccaacauacaggguggacagugucuggugagauagcaggggcuggacggaccacgugaccuugaagcucucccacuucuaagagaaaaaccuaugaaugucagaucuccuuguccaaaaauuauguaaggaaaacuagcugacgaauucauggccaaaucuuuuuauucuuucugagacagaguguugcucugucacccaagcuagagugcaguggcacgaucucaacucacuacaaccuccaucccccagacucaagugauccucccaccucagccucccgagaagcugggcuaauuuucuguauauuuaauaaaaauggggucucaccauguugcccaugcugguaaugaacuccugggcucaggagauccaccuacaguggccucccaaagugcugggauuacaggcaugagccaccacacccagccugggucuuuuuauucuuguccgcuggagacaguaugaauucacacccuuccacuuaugaucuugccacccugggauagucacuuaaccguucuaagccucgguuucccaccuagaggaagccacaucacaggugauuaugaggcucaaauggguggugugggugacugugcccauucucuccucucuaaaguaccaaccaaauguaaagaauuaugcauuuggauuucagauauaauauuaagauauuuauaauucucuuuguguagugcuuugagucacuccuuaauagcacucucaggagauuugguaauuggcagcagaaggacaggaacuuccaaccuuuccaaaggcauuucucacucuccaucuucaugucuuauauucuagaccuguggcccacacaguggccacugcacacuugaaauguggcuggugcuaacggauaugcuauaaguaaaaaguauacaccgcaucuuaaaaacuuguuaugaaaaaaauguaaaguaucucaucaauaauuucuauauugauuacauguucaaaugauaauauuuuggaaauauaguuacauuaaauaaaaucuaaacaaacaaguuaauuaaaaaacaaauauuggccaggcgcgguggcucacgccuguaaucccagcacuuugggaggcugaggugggcaaaucacgaggucaagaggucgacaccauccuggccaacauggugaaaccccgucucuacuaaaaguacaaaaauuagcugcgugcaguggcgcgcgccuguagucccagcuacucaggaggcugaggcaggagaauugcuugaacccgggaggcagagguugcagugagccgagauugcgccacugcacuccagccuggcaacaaagugagacuccgucucaaaaaaaaaaauuuuuuuuaccuauuucuuucuuuuaacuuaauuuccaauguggcuucuagaaaaucugaacauauacauaacucauguuauaauguuauauuucuuucuuccuuucuuuuuuucuuugagauggagucuugcucugucacucaggcuggaguugcaguggcgcaaucuuggcucaaccaccgccucccggguucaaacgauucuccugccucccaaguagcugggauuacagacaugagccaccaagcccggcuaauuuuuuuauuuuuaguagaaauaggguuucaccauguuggccaggcuggucuugaacuccugaccucaggugauccaccugccuuggccucccaaagggcugggauuacaggcaugagccacugugccuggcuuuuuuuuuuuuuuuuuuuuuaaacagggucuuccucugucccccaggcuggaaugcaguggugcaaucacagcuuauugcagccucugccuccuaggcucaagugauccucccaccucagccuccugaauagccgggacuaccaguaagcacgagcauacucaucuaauuuguguauuuuuugguagacacagggucucaccauguuguccaggcucaucuccaucucaugggcucaagcaauccgccugccuuggccucccaaagugcugggauuacaggcaugagccacugugaccagcugcucauguucuauuucuauagggcgccacagcucgaagcaacauccaugccucugugcaagacuuucuucaugccauuccuuguucugcaacaggccagcccuucccuuuucucugaaccccaccuuaagaagcuguuucuuccauaagacuuucuugggccuucuagcuggagaauuucauuccuccaaauuugcaaaccacauuacuagccccucucacauagcacuuaggucauauuauaugauuguuauuuauguucuucauucucuucucuccccacgaaacugcaggcuccuucagaacagggucugugccucccuaaccuuugcuaacacccucggcaccuagcauguacacaggagaugccaacauguuuguuaacuggaugaaugaguaagugaaugaaggaaaaaaaagggcugaugaaaagaaacugacagagauacuccuccagaaaaagaggcugagaauaucagagaaaagcaauuagguaguaccccuuguuaaccagccaaacucuaguccaaagaacccugagaaaauuucuggacaacuugguucuucagaauugaggaaguaacaccaaaacauuaaucccuucagaugagaauaagacuuauuucuuccccaaagugaccauucucuacucacauguugagagggcagggggcaaguacuuaauaaacauauggagaaaguuacucagcucagcuugcuaaauuuuaguugguccaauggaaaugcuaauuuuuugagucucuuuaaaaaaaaaaagugucuaaauguccuuggaaguaagagacauauaaaaaauuagcaauaaguggucaggcacaauggcucacaccuguaaucccagcauuuugggaggccgaggccagcggauugcuugaggucaggaguucaagcccagccuggccaacauggugaaacaccaucucuauuaaaaacacaaaaaauuagccggacaugguggcgcaugcuugcaaucccagcuacuagggaggcuggggcaggagaaucgcuucaaccggaaggcggagguugcagugaccugagauagcgccacagcacuccagccugggcgacagagcgagacuaucucaaaaaaaaaaaaaaaaaaaaaaagcaacaagugaaacacgaacugcugcacauaaucuagaaaaccuugcucuugaagacaggauguacuaugaguggaaccccaccaaauucuugggauaguucauccaugugagggcuauuaaaugggggagagggcccuaaacaugguuucuuucauugcaggggagagauaaaugguggcgaggagagaauuucuguuuaaaguagaugcaaccuuaggaggaaaaacaaauauccuagcccaagucugacauuucauccucucuggaaacaccagaaucuucucuaaagcucugcaucugggcucccacuagucccuggugcguucaggccuuuuacaaagcucuggggaagacaaauguaagacacaaauuucccaggaggaaauuaaacuaucaagugaugugaggcccuuucagaauaagacauuugaaucaauucuaacuccuuuuccuccagcagcaacaggcucaaacuuugcuaggauguucuauaacuaacagccauuuugacgaaagacacuuuagaaacgaaggcaagaaaaaagccuuuguagaagccggcugcuaaacccccaaguucauaccagcaaaucucucauuuuaggagucuuguuucaggucaauacugaaaacaaagagcacaccacuaaaagcaaaacccauggauuuuccuuggucucuaaggcuugaaucugccuacccaguguucaauucaauuuucuugcccucuggaguccaccaggaauaaagcuagcccagccugagggaugcaccgauguaucuaauccucugccccuagggagugggggacgcuucuccauuucuuccugagccuuugcuucccuugcuaucaaagggccaccuaauggaacugucuaacacccuccauggccagaggccaaggaaaagaagcacccuaagauuguucaaguggugcccacucuggccugaauucccauugggaaaaauaccucgaaaaugagcauuucugcaggcauguuuggaaaagcaggcagugaaguacgcaguccaaguggcucucaaucuggaugaaccucauuaaaaagcugacacucagcuaugacuaagaguaaaugcaacagauauuucaagcagcucgucacugaugcaguucauaacccucccagcuggagucaggccccagcagccucccgguccccaaacacccugcacucggagggucggggcagccccggagcuucuccuaacccacuggggguaggauauguaaacaagucauuagggaggcaggccaucggcaaagacggccggcaauagcagaggcugcugaaccucggucaccgagaggaagguggaugacccgggcgugggggugauuacccagaccaaggcgcgucccacggggcccugcuacuucgcuuuuaaacaagccucagggaggaaaccgggagcccgggccaagggaggaaaauggccacuuucugcuaaacagucucaaggcuagauaguauuccaaaaaaagcgcugguccggaggugcaaaggguagggcacaucugcggaggaaacagucaccuuaauuaccacgucuagagaaagugcgauuucauuacagccuccaaaacuaccgcccaaagaaggaaaccagagaaguguuuucaauuugaaagaggcuggaaagaagcggguaagacaccgacucuccccacccucccggcaacuuuggaccacaaggcgcuuuccugccucaaagacuauuaccaaacacaacucgaaaauccaaccccgcuuucaaaccuguagccguuauuuaaacgguaaaacaccccacuuuaguuuccgggggaugcggcccaaaucaguccuuaaaaacacacagagagcgccucuggcagcagccgcccacgcccccggcccugcgcaccgggcuugcuccgggaggggcgcgugacgccaccgcggggcagccgagaggggaccgcgggcuccgggcagggcaggcgcucccgcagcuccagcuauaacacaagggagagaaagcaacgcuuugguuccagaaacuuccaucgucaaggccaguucuggccagacgcacagccaaagagccccccuagucuagcggaugaaccguucgcgaguggcacccccuaaaaccuuggccccaucucccaagaugccucuuuacugcgcaauccagaaagcacccggaccgccgccacccaccagcggcggcgaauaacuuggugagaucuuaaauaacucgggauccaagggaacuuucuuuucucccccgaaucucaacgccgcaucuccaagucuccagaaauguuaaggagggagguggucaagacaggcugaagaaucugaguuuuaauuugggggagggggaggggaggaagagggaaguuaauaaugcggcugcgguguacccguguggggugaaacggaaccagaugcggcugcuacaucuggaaauugggggugggggagugcugggggagaaaggcaccgugguaauguuuuucaaaaggguugauagcuucugggcucagaacaagaaacaggcuucacaccccaccccccccccaccaccaccaaaaaagugucuggcugccucauaggggguguguguucuauaugaacccccaucuacaagguccauaaaauuccuccgcaaacaugggucguagccucacuuuucucccaaccccaaacauaacgguaggggaagcgaggugcagaggggucugggccagagaagcauacgcaucgcugccgagugaaccacaccggacaaaaacccucaucccuucccccaccucuaggaaccagauugggaccgaacgguccuuccgcccccaucccacaccucggcuuaacgaccguggguuguccucccguuccccaaacuuccgacccuuucagagaccguccaagucauaagaucaccccuucuggaaaggggagucguuuuucgcucucagcucaagcagauucagccauuuggugacgacaccuccuuaaaaccuauuccaagagaagcuaaccuagcccuccacguccuccgcaguucaucucccaccccauccgaccccaacccgcaccccaggcuuucccggggguggaaaaggacuuaggaaugccccggauuuuuagcguugagcccaaagcuaccugcugaauugggggugaauccccaaaaggggaccaaaaagacauggaguggaaugcaacacacacacauaacacacacaacgcaucccaccucgccgcccacucccgcccuccuccccaguccaggaaaccgcgggccucgccgccuucgccccgggccugucccucccgggacucacugaggagccgccgccgccucgccagcucccgagcgcgaguuggaggaaaaguugggcggcgggaagagcggcgggacgagcgcagggagggggcgcaggagacgcggacggagggaagggaggggagacccaaggggcgcggaucgcccgggagggagccaggaggugaaaggggcgggcggcgagcggagggaggcgccggccccggcugggcugcggcgggcaaagcgcgcagccgggaggcuccggcgccgggggccgcucgggacgccaagcccgccccagauccgggggcgccgcggcucuuaccucgcucggcguggagguuccgccucgggagaguccgccguggcuugugcgagcgggcgugugcccgcguccccggcuccggcccgccgcccccgggcucuguucggguccuggcggggucgcaagagcuccgcggccggcgcucgacucccggcggcgcucggugcucggcgccuccagcccgggcgggaacaauggagccggagcuggugccccggaggcggggcggggggagggcucccguccgccacccggggucuccagaccuugugccccccuccuccagaacgcagcggcggcgccucacuuuccuugcagaccgggcuccaucgcccugcggaggccccggcgccgcggcgugcccgacugcagcacggguaccgugcgcccugcggggcgccccgagcucggaccggagaaaaguccuuggguuccgcggcuuuucaagcagcggcgcgcucgcggccggggaaggcgaggucgccgcaaugcgcuacgaggggucucggucccguccggacguggccgcccagcucccggcacacccggguuccuccgcgcgcugcggcugcaccggcgucccggcucccgcuagcugccgcccgccgccgaggacgccgcgccuguggccgcaagagcgcuccgagcgcuaugcgccggcggggcgcgagggcucgcucucucacucccacccgcgcuggucccuccuccgccuccgcccccugcagcugccugcugggccuuguaguuccccagccgcggccccaaaggacggggagcgggccgagcuguccggcgcucugcccuucucuuccuacagccuggucuccuuuggcguuugcgccccugcaucu

SEQ ID NO: 191852 - RNA, 65856 nt, Homo sapiens
gggggcuuugugcgcggcggcggcgggagaggcggcggcggcggccagcacggaggcggaggccgagggggcugugcacaggucgccgcggagaggcgugcgaauuccgagccgagcgccgaggaccgugcuacccaggccgggcugccagccgcaggcuccucucuggcagcagcggcggcgcggcgacccccgucccucggccuccccuucccaucccaccucccgagccuuccucuucccgcagcacgcccggcccggcccggccguggcccuccucagugccggccgccauggcagaggcguccggcgcggggaaaaucuagcccggggauuucaugcggccuagcucgguuccgccuccuccucgcgcggccccagcggcugcccgcaccccagccccacuccgggccuccgugucucuccugugaucgcacugacacggccgggggguuagaauggaacaaacugaagguaaagugcgugugcguguguguaugugugugugugugugugugugugugugcgcgcgcgcgcguguguagugcuaggaagggcugaggagggaacgacggggagggggcgaccuagggauggagcgccagaccccaggaggaauggaaggggaagcggguggccugaaagggcucgaggggaguccugacggaggagcagauggcaaggugggggguguggagggaauuggggggugggccaggggagguggggagugggaugggagucggaguggcgcugagcugggaauugggaaagugggaugggggcggggauaaggauggaucggggaggggcagggaaaggggagaagaguugcauggagauuacagaccuggguggacugauaaauagggagauuuggggauggaguguaggaaccagaagagucugggagaaggggauaaauuugcuggagaaauggggcauuuuaugggaaugaagggagaaaugaggaauggaagugaaggaaaagguggauuaggaaaggggaugaggcaggcugcaauaggagaaugggaaauagacgcaggaaacuggaagacaggauugggcuagggaaggaaauuaacugaaugaugacagggaugagaacgaucgacuuagcgucagagugggaggaagagaaggggauggaggucguuaaaguguuaggaagggaggccuuuuguuccuguauuuguguguauucugugucuuucuuucaaggcuagagaauagagaagcuggugguuaugggauugugauuguugugaaauggggagguguggguuuuacuguuuugagggagaaggcgauguguuuguguuauggaagggaggcagggagagacauggccauaauuugaugguuuuggggagggagugaagauuauuucgauuuaaagggggcaggggcagccauguuugcugccaaggcacugcaguguaaauaaauuccuuuuccucuccgacaucaguaugaaucuggaaggggccaauucagacuguuagcccccuuucuuucuauucaugaacucuuuuccccuuacgucuugggucauuuuaaauuauucauaaccgccaaaggagguagugauguuuuccaucacuaccuuuuugaugcuuuucucccucucuuuacccucuuccuucugguugcaaacaagguaugcuaaugagcugcaguguaaauuuaacccauuuaaucaauuuaaaacuagauuuuuacuagcugaaggaaucauuacuacgcuuacauaucaaacaugaucgugaagucuuuuacguauugaaaauucguuuguuucggaagccucagaagcagucaacauguuuucugcaauucuuuaaguaaacaaggaaauugcaucgguuauuuuacuugggccugugcucuuggcaaagcgcuguguccgggugaaagggguaggaagcucugcuugugguagauuaucggcuugcuguauuuugaauguugaaaaauuagaaauguauguauuuuuaaauaguauuucugauagcucuugcuuauaggugaugagcguguuaagugaugaguguguuaagaauaguauuuucuuuuuuaaauaaacucucuuuuccccaucucuucucuuugccuucauguagcuggcucaauacaaucuccagaugccaguucagcacagugcaaugaucugugaaguaggcaugcaguucuuagagucucauugagaugccaggguuuuuuuguuguuguuuuguuuguucguuuuuugauugaaacuucaguugacucucaggaaacuacaguaacuaauauauucaacuguaacuacuuguacaauuugaaauaauuacuauucuaagguuuaaauccugacaaauuuacagaacauacauugguguuaaguagagccuauuuuauuucauauuggauuaaaugugugugugaccuuuuguuuuuauuauagcaguuggaguaauccaaacuuuaaccuaucacauugauauugaaacuguucucuaauaccaagaaggccuguuaacauuguaauaugguggacucaaaccaguugaacuacauuuaaccuaccuaaauggcaacauccucucaguuguuauacagaagcuuaggauauauucuugguuuguuagaaaaaugaaauugaauguuguuaaagugguacuuuguaaaucuggcuuuuacacuaaaagcacccucucagcuuguaguauuuuaauuugauaauauucagccugaauuuguuugaaauucugugaggaacaguugcauuaaaaaaaaaauucagcaugcuuuuucuggaauuuauuuuuauggcaauuuaaguuuuauaucuccuacuugauugacauguuauuuguaauuagcugguaaauugugugcaugagcuaucagugcugcaaauuuuuaggaaaauaagcaaucauuaaauagaaaaauuuguguuggaagcuuucauugcuuaaaaaaaaaaaaaagaaaaaguuuauuuuuauguaugcagcauccuuuaaagaucaggguuccugcccagcugucauaaguauccugguuccuuggacagguauucauauacgaagaagccuacucuuguuaaauaacacuuauaaccaauuaauauguccaucagcccaccuguuaccuguguuggcuuuuuuuuuucuuuuuuucccuaacccuuaaauuaacaaaugccgucucuuacacugaucagauugaaugaguuuuggauaaaggaaacugucuuugagauuggugauuguugagugaacugucaaaucugauucuaaugacagcguuucuggaauuuauaauaauauucauaauccacuaauagcugcucacaguuguccucacacugugcuaugcugagugucucacaugcaugauuuccuuuuauccuccuaacaguuuuaugaaguuaguacuuuuuuuuuuuuuuuuuuugagagauggagucucacuccuguugucuaggcuggagugcaauggugcgaucucgguucaauacaaccuccaccucccagguucaagugauucucgugccuuagccucccgaguagcugggauuacaggcacacgccaccaugcccuucuaauuuuuguguuuuuuuguuuuuguuuuuguuuugagacggagucucgcucugucacccaggcuggagugcaguggcaugaucuuggcucacugcaagcuccgccucucggguucacaccauucuccugccucagccucuggagcagcugggacuacaggcgcccgccaccacgcccugcuaauuuuuuguauuuuuuaguagagacaggguuucacgguguuagccaggauggucucgaucuccugaccucgugauccacccgccucggccucccaaaguccugggauuacaggcgugagccaccgugcccggccaauuuuuguauuuuuuuuaguagagacaggguuucacuauguuggccaggcuggucucaaacuccugaccucgugaucugcccaccuuggccucccaaagugcuggaauuacaggcaugagccaacacgcccggccaagauggaguuuguuuguuuguucguuuguuuguuuugacacggaguuucacucuuguugcccagguuggagugucucaaaaaaaaaaaaaguuauucacauauucacauauuacagaaggcuaagaaguuaaaaaaauaaaguuagcauucuucuccacugauaaccacuugaaguuucuuguaugucccucuggaaaacuucuaugcauguauguguauauuucucuuaaaauauuuucaaauggaucauacuaucugcauuuugcuuuuuuguuuuuuuguuuguuuuuugagauaguuuugcuguuguugcccaggcuggagugcaguggcgcgaucguggcucacugcagacuucaccucccgguucaagcgguucuucugccucagucucccgaguagcugggauuacaggcaugcaccaccgugccggcuaauuuuuguauuuuuaguagagacgagguuucccaaagugcugggauuacaagcgugagccaccgcaccuggccacuuuuucauuuuaacagccuaucugggacaucuuuuuaaauuaguaccuaugaauccacggcugggcgcaguggcucacgccuguaaucccagcgcuuugggagggaggcugaggcgggcggauugcuugaggucaggcguuugagaccagucuggccaacaugacgaaacacccaucucuacuaaaaauacaaaaauuagccaggugugguggcggcgccuguaaucgcagcuacucggaaggcugagaugggagaacugccugaaccccgagggggaaagccgcaguaagcugagauugcgccaccgcacucuagccugaaugacagagcgagauuccgucucaaaaacaaaacaaggccaggcaugguggcucacgucuguaauucccgcacuuugggaggcugaggcaggaggaucacuugaggucaggaguuugagaccagucuggccagcauggugaaacucccgucucuacuaaaaauacaaaaauuagccgggcaugguggugcgugccuguaaucccggcuacuccggaggcugagacaggccaaucgcuugaacccaggaggcggagguugcacugagcugagauuguaccacugcgcuccagucugguaggcaaagcgagacuccgucucaaaaacaaaacaaaacaaagaacaaaaacaauaaaaauuaguacauauggauccacagcuuuuuuuuuuaaagagucuuguaaguauuucauuguuuaaaacaucgauuaacauuuaguuuguuagcagguuuugcuauuauaaguaaauaauaguugguccugaauuaaguuccuaauagccuguuaaauggaagagagauaguacaacuacuuuauuuuagaagagagaaaacugaggccuauggaagugaagucuggggcuuuuuugacaaacccguuacuugguucuuuacagcacaaccuauuacuuccuuaaaguauuggagcugccuggccgggcgcaguggcucacgccuguaaccccagcacuuugcggggccaaggcggguggaucaccugaggucaggaguucaagaccaaccuggccaacauggugaaaccccgucucuacuaaaaauacaaaaaauuagccgggcccgguggugugcgccuguaaucccagcuacucuugaggcugaagcaggagaaucgcuugaacccaggaggcagagguugcagugagcugaggucgcgccauugcacuccagccugggcaauaaaagcaaaacuuugucucaaaaaaaaaaaaagaaagaaagaauuagagcugccuaugaaaacucaaggugagggggcaaacuuaagguuaaguauauuuaguagaaagaguuaaaggggaguaagcugcagugaggcaagagaucuuguauuuuuucauauuuuauucaccauguugugaacauauaugcauaaaauauuuuuacaugcaaaaaugaauuguguccaaguuaucuugagguguguguuuuuguaugaaguggauuuuaguggacuuuuucuuguuugaauaaaauuaucaauaaaauaagauagcgaugaaacgaaaaaaauuagagguccaucauggucuuagaaaaggaccuggaaaaaaaauagagacauugguaaaaauuuuaaagugagcuaaaaaucccuauuugaaaacaaguuaaaaaucuuagcauggacuguugcuuacuuuauuuaauuuuuuuuuucuaucaagaagaaaauggguuacuuauucauugggaucuuuuaaaacaaaaagauagucuugucuguuguagauacuucagaaauuaaaauuguuaaaacuuuaaaaaugcuuagaacuuggcaucuguccauaaaaucuguuuuucaaugcaauucuguuuuuaguuuuacuuuuuuuuuaaaagcagucuauuauuuuuugaaaaagcaacuaagaugauucauuuauuuguuaauaaacauguccagcauuugaguuuuuaaaugaauggugaacuuuauuucugcaggccaaucuuuuuaugaauuauauuuauaaguuauaaauaauuauacuuauauuguuauauuaacaaggacaaauguaagaaauugcuuauacuaacauuaucuaaccuuuuuuuaaaaagcuuacaguuuuguuuucauuuuuacuguugcuguuaguaaauauguaauaaagacuuuaaacacuucuguaguauguuguaccugcacuguguagcaugaaaagaagguaaagguauauuuuaaauuuuguggacuuagagaauguucaguuuuuaccacauggauguguuguuacuccuaaagcacaacuuuuuugauaagauuuugaauuugaaaaagcucuuugaaaaaguauucuuagcuuguuuuuuuagauguggaucuuuaucgucauuaacugaucuacagugauaacuuuucccccuucuaauauuuaauuacuagguucuuuuuuccaucuacauuuagggcuacuuagagcaagugacuaggaaaaugaaaauuguuaauauucauacuguuucaguuuuagccauguguagcauggaaagauaaaacaugaauaauaccuuacauuuauguggcaucuucugagguguuugguagaauucccacagaauaacuuggcuuuuuaaaaaugugaaguuagaaagcacaagaauuauuauuuauuuauuuauuuuuaaauuuuuuuuucgagacagagucucccucuguugcccaggcuggagugcaggggcgcgaucucggcucacugcaagcuccgccucccguguucgcgccauucuccugccucagccucccgaguagcugggacuacaggcgccccccagcacgcccggcuaauuuuuuguauuuuuaguagagauggguuuucaccguguuagcuaggauggucucgaucuccugaccucgugauccauccaccucggccucccaaaguccugggauuacaggcgugagccacugcgcccaggcaagaauuauuuaacucagucuuaagaugggaaaauuaagauuucagagaccccuucaggccaaauagacugucauguuacggagaauaaaauuuucagauuuccguauaauuaaucuuuucucuuuuuuugugagacagggucuggcucuguugccucugcuggacugaaacucuugggcucaagcagucuucaugucucagcuucucuaguagcugggacuacaggcaggugccacugcgccgggcucuguaugauuacuuaaaacaaauuaagacuguguguguccugauuuuucuucauagcuuauauuacccacauucuaauagauaauuaaauauuaaguaacaaguauuuuucuacauaggugugcuuuuucuuauuuugguguaaguuauauacauauuuccuaagauauauagauuuauuuauuuuuuuuauuuuuagagacagggucuugcucucuugcccaggcuggaguguaguggcaugauccuagaucauugcagucuugaacuccuuggaucaagcaguucuccuagccucauccucuggaguagcuaugacuacacacaugugccacccugcccaacuaauuuuuuuuuuuuugagacagggucuuccucuaccaccuaggcuggagugcaguggcacagucauggcucacugcagccucaacuucccaggcucaggugauccucccaccucagccuccugaguagcugggacuacaggcgugugccaccacacccagcuaguuuugcuuuuuuuuuuuuuuuuuuuuuuuuuguagagacagaguuuugccaaguugcccaggcuggucuugagcuccugggcucaaccaauccucccaccucguccucccaaaguguugggauuauaggcaugagccacugugcuggucccccuagcuauuuuuuaaaauuuuuuuguagagauggagucucacuuuguugccuggcuggccuugaacacuuggccucaagugauccuuauagggaggcguuuuaaauuuaagaauggguagcuuauugggauuucauagguuaaaaaaauuaguuuaucaaauugauuugagauuaagaagaucauauggagauacuccuaguggcauuugggccauagccaagacaauauugugucuauugaaucuuauguuaucuaauuucucuuagcuguggaggcuuaagaaagcuauauguaaaaaacaaacaaaaacuuuaagaaauaggcauuuuaaagccuuuuacguuaugaaaugugaaauauaaaaaaaagcauauaaaacuugaauguacaguauaaacaaauaauuaggaagugaaaauacaaaaauuaggcgugguggcacacgccuguaaucccagcuacucgggaggcugaggcaggagaaugacuugaacaagggaggcguagguuguagagagccaagauugcgccacugcacuccagccugagcgacaaagcaagacucuccaucucaaaaaaaaaaagaagugaacaucggguaacuaucacccagguaauaaguccuuuaagaaaagcugcagagacaaccucauugguuuagcugguauugcuuuggugguaguuggacuuuagggacaaaaauguauugauguccuugguuuuucuuuuuucuuuuuuucuuucuuucuuuuuuuuuuuuuugagaggagucucgcuguguugcccaggcuggagguccaguggcgcaaucucggcucacugcaaccuccgcgucccggguucaagcgauucgccugcgucagccuuccgaguagcucgacuacaggugcccaucaccacacccggcuaauuuuuguaguuuuaguagagacuggguuucgcuauauuggccaggcgugaaccgccgcgcccggcuggugguuuuuuuuuuuuuuuuaauaauaguaagaaccugcggccgggcgcaguggcucaugccuguaaucccagcacuuugggaggccgaggcgggcggagcaccugaggggaggaguuggagaccagccuggccaacauggcgaaacccgucucuacuaaaacuacaaaaauuagccaggcgugguggcaggcgccuguaauaccagcuacucaggaggcugagccaggagaaucgcuugaacccgggaggcggagguugcaaugagccgagauuacgucaccucacacgccagccugggcgaaagagcgaaacugugucucaaaaaaaaaaaaaaaaagaaccugaagaauucauaagcaugcgaguucaacgaauauaaaaacugaauaaccaguuuuuaauuguuauugccagaaggggucucugaacaauauuuuuaagguagcuuucuaacauuuauugucaguguuuagugauuugaaaucuuaguaccuuaccgaugaauaacaaaaaauaauacugaauccuguaagaaagugccauuuuauacaaaauguuguuuguuuagaguucaucucuguugcacuuuuugguaagauucagugauuagguuuuaaauuaacaugcaaacucuaaaaugacuuacuuagaaaaugucgauuugucuauauuguuaauuucuuagcuuaacuaucuuaauuaacaaaaaugaguuugacacuccugcuuuugcaguauuggaaccauucaaaaaguauuaaccugagaaguaaucagugaugacaaucuauguuugacccuucauccuugguacuucuugaguuuuaacuuuucuguaauuugggcaagagaaccaaauuucuuuugaagcuggagaaacugcauuaugcuuuccuggccuucaagaauauuuucuuagguauuuggaaagguuaaguguugauuuuugaggauuaggauagcagaaaaauuugaaugcuuuuuucccacugaguaccugcugaauacggucuauuugcguacaacucugccaugugaacuuugagaaaggcauuuuuauaaauuaaagccuuuauuugguuauuauaauuuugucacucuaaguggucuccuuuuguaugaucucugcaagauucaaaugcaucagaauauaguauuucauauuagauuguggugagaaacuucuugcuuuguuuuauuguauccuugaauucuuuucuguagugcaauagcauguuauucuuuuuuacucccacugaagguuaaauauauuucuugcuaauuuuuccccugcaugggcgauagcgauuuuaaaucuugaacguguauguugaguuuuccuagauguggaaguaaucauaauuugauauuuuuagaaagauaaauuagguaauguggcuuuguguaugcaguagaguuaauaugcuuuuauucaccucaugguuucuaugucauuaccaccuguugguuuuuauuuuuuaauggaaaacuugaacuucuccaaagugacuaguuuuaaaauaacauuuauguaaggauuguuuauacagagaaauugaaaaccagaagguauaaagacaauuaaaauuaucuaaaauucuacuaguuagaaguaacuacuauuaauauuuuguucuauauccuuccaauauuuuuucauauguauuuuuuuuacauaguuggaauugugcauccauauuauuuuguaauauguuuuauuauuuaauauauuaugaaauaaauguuugugauuuaaaaaaucaauauagaauuucaguguacaggugugcuauuaucuguuuaccauucuguguugaaggucuuuuaggcaguuugcaauuuugggauauuguaaguugauggacauccuuauacauuaaaaaaaauuauauggcugauuauuucauuacaauaaauuccuagaaguagaauuacuuaaaagauauaaacauuuugaaagcuuuugauacauauuuccaaacuguucucuugaaagauuuuuuaaaauaauaguuuuauugagauauaauucacauacccaaaauuuauccauuuaaaguauacaaugcaguggcuuuuaguauguugacgggguuauauaaccaucaccacaaucaauuuuagaacauuuccagaaagguuugaaccaguuuaaacccagcaauauuauaaaguuuuguuuuaaaaacagcauuuauucauaacauuuaaaguaguacaguauacaggaacacaacagcuugugugauauauacuuuauaugcauuugagagagauuuuagaaaguccuucaugagaagaugaugcuccuacgucccauuuuaagaaaaccugacauauuaagcuuaagcugauuaaacaaaauaugagguauauuuuuuugaauuauaaaauuauucuccugagccugggcgacagagcgagacucugucucaaaaaaaaaaaaaaaaaauucuccuggacagucagaaugucuuuauugagagaguauuguguaugguuuaaaauuuuuuuaaaaaauucaaauuugauuuagaaacacuuuauuuuagaaaacaucuguggaaaguauguuuuaccuauacaguuaacuguagcaaacuuaucaccuuauagaaaauaugguuuucuuuuaagagagguuugcuuuguucuaauugaccuuccccccgaaaguuguucuuuuguuauguucgcuuaagccguuuaacaaaacauuuuuuaaaaacugggugggcuggcugggcgugguggcucacaccuguaaucccagcacuuugggaggccgagguggguggaucacuugaggucaggaguuugagaccagccuggucaacauggugaaaccccaugucuacuaaaaauacaaaaauuagccaguguuguggugcacgcguguagucccagcuacucaggaggcugaggcaggagagucgcuugaacccagaaggcagagguugcagugagcugagaucgugccacugcacuccagccugggcaacagagcgagacucugucucaaaaacaaaaacaaaaacaaaaacaaaaaacaaaacugggagggcagugaaguauagggcaagagucaaggagaucugaguuccuauccccacuucacuuuaccacugaagaucaguguucuuaucucuaaaagugcaaaugaaaauuauucuuggaguuacagggauucaaauuagaaguacuagagugugcguagaacuguaccagacacauaguugauaaugaauaacuuuuuuaauagaagaaaaauaguguacacaaaaugaacuagucuuuagucacauguuuaauggaagaagaacugaacucaauuggcuaaacucacuuucauagaaguuaaaaguugaacaucaacuaauaccugaagagaaucuuugccuagguuauaugaguuuuucuuaauuguugagagaauucaugcugguucaaguuugaacaugaaguuaacuuuccaguccaauuuuacuuccacuguuuuauuacaacucaugauggcuaaagcuucacuaaagcuugguguucugauuaaacaaacaggugaugugaaauuuggauauauaguaugaaauucugaauuuucuaacuuuuauuacuuauuuugaaaacuacauguugaauacuaaaauacuacauguugaaccuaaaauacuaaagcgauaaacaaaaaaaacaaaacccaaacuggucuuuauagaaaagauaaacuuaguaaauuauuauuuagauauaauaaauugcuuagugccuuaaaaacuacauaucaucuuuggcauacauucucuuuugccuuuuuugggggaauggaggauacaagcuaaaagaaaguaaauuugaaugcuugcaaaauuuuaagaaccaaucucaaaccauuuuaccauaauuuaaaaguuuguccaggaaauagguaagaaaauauguggaugaacuuguuaguuuacuagauuucauagugaauggaacaagaugacugaugaaaguuguuuguaguaauuuucauugugagcaacuacccuugcuguaaaggauuggaaaauaauguaauuuccuucaagugguaauaccaugucuguuguugcuggguguggucagcaacaaagcgaagacaguugagguuaaacuagauagauaagggaaacaggguguuuuacuaguaagcuuuguauugguaaaaggcaguucaauaguaaugugguuuagucaggaaaaaaauaugaacuacaaagccaccuaaaauguuguauaacuuaauggaaucauagucaagugaaaacuguaugauugaauuuagugacaggauuuaugguuaaaugaaacacuuuuuuguuguuguuguuuucuuuuuuguauuuuguuaacuaaguucuacuucacgcagguuacuuccuaauucaggauauuuuaaugucuuuaaucaucauccuucucuaaacaucuuucucuaaauuuuuaguggaaaauuuaaagugaacacauuucagaaaauauuugaggugacaacgcuaaaguuaaacagauuauggaguagcacaguuauucuuuacagauaauuugcugccuggugcaguggcucacaccuguaaucccaacacuuugggaggccaaggcgaguggaucaccugaggucaggaguucgagaccggccugacuaacaugguguaacccccuuuagcugggugugauggugcaugccuguaaucccagcuacuugggaagcugaggcaggagaaucacuugaacccuggaggcagagguugcagugagccgagauugugccagggcacuccaaccugggcaacaagagcaaaucucugucucaaaaaaaaaagauauuuugcuuuauuaauaguuuaaacucagaaaaguuuaaaaaaaguuaagagaaaacauacaacuucucuaacacaccuugauuccuuacuaggauuuuguaaagagaaucguggccaugcugauuuuacucccuaaaauccuaucuaugucacuaacuguauugguugugaauuucauauaauuguuugauauuacaaauaauggucaucuuaaauaauguuaaggugauagaugagauuuaaaguuaguuuuuuauuuauuuauuuuuuugagacagagucucacucugucacccaggcuggagugcaguggcacaaucucagcucaccgcaaccuccaccucccggguucaagugauucuccugccucagccucccuaguagcugggaccacaggcaugcaccaccacacccaacuaauuuuuguauuuuugguagagacaagguuucaccauguuggccaggcuugucuugaacugcugaccucaagugaucugccugccucggccucccaaagugcugggauuauaggcaugagccaccacaccuggccaaaaguuaguauuuuaaccacauauauauauauauucuuuucagaaugaaaacucaagcccuacacuuauguauugauaauaggaggaaucacagcucauuuucccauuuuucguggucauuuuauauauguggaucaccugauccaaccuuucuuaugauguuaaaugaaaacccaaagauacugucuguccucggaauuuaugcagcuaaguuagggguagaagcagaacuaaaauucaagucuuaugacucuaagaccaauguuagaguacauccuucuacucuguggacauuuugcuugucccuagguauaugaguuugucuuacucuggcauagagaucuauuugcugaacuuccucuuaugugacuucuuucuagcaucacaguaauauuaacagauuucuuuaaaaauuuauaauucuuauuuaauauaagcuuuuaaaggauguuuuuguuaagguaaaauuugaaaaauaauguagaucagcacugucuaauagaauuuucuaugaugacagaaauauucuguaucugcacugaccaauaugguaaccuuagccacauguugauguugaaugcuugaaauauggccauuguaacugaggaacuaaauuuuuaauguaauuuaauuuuaacuuguuuaaauuuaaauagcuacgugugguuagcccagaauuagcuauucuuagugaagggaaagaauuaaguagauauaggcugggcacguuggcucacaccuguaaucccagcacuuugggaggccgaggugggcagaucaugaggucaagagaucaagaccauccuggccaacauggugaaaccccgucucuacuaaaaauucaaaaauuagccaggugugguggcgggcgccuguagucccagcuacucacgaggcugaggcagagaauugcuugaacccaggaggcaaagguugcagugagcugagaucauaccauugcacuccagccuggcgacgacagagacucuaucucaaaaaaaaaaaaaaaagaauuaaguagaugugaacauaauuguacauucuuugccuugugauuacuauauuuguguguuuuugugggcuagauguuuaaaaucucauuuuuccaguguguuugcuacguuagaugguaaauaaauucuucauggcaaagaaagauaacuauaacuuaucaguaauaguuguuugaaagcuggaauauuuuaaaagucuuuuaaucagugcaauuacuagcagacuauagauugccgaccaacaaaaugauuuaaauacagaaugcauugccuucauuucagcuuuuuuuuuuuuuuuuuuuuuugagacagagucucacacuaucacccagacuggcgugcagaggugcgaucuuggcccacugcaaccuucgccucccagguucaaaugauucucaugccucagccucccgagaguuccauuucaguauauuuuggaucaguuauguuuacauaacauuuaagauuuaaacuuuauacuacauggaauacuugaguaaaccguaauuuaaaucuuuuuacuauagccauaacucagaagccucugaaacagagugaacgucaaaggaaauaaaaguaccugaugaucaucuuuuuccuugucuuuuuccagccucucuauaugacugauuccugguuuugguuucauuaguuuuuuaauaagaaucuaagccgggugcgguggcucacaccuguaaugccagcacuugaggucaggaguucgagaccagccuggccaacaugcggaaaccccgucucuacuaaaaauacaaaaauuagccaggcaugauggcgggcaccuguaauugcagcuacucugguggcugaggcaggagaaucgcuugaaccugggaggcagagguugcagugagcugagaucgugcuaguguacuccagcuugggugacagagcgagacuccgucuucaaagaaaagaauccagccccccgucccuguauuguauuacccuguuuuauaguagcauaucacuaucugaaauuuccauguuuauuuuagcuccaugagacuagaaucuuauuucuuuggauuucccaagaucuagaacagggucugguacauaguuaguguucaguagugaaccacaucacagacaaaaacaaaaauaagacucuacaaggagaaagauauauaacauggcacuuggagucugggaauaggcaaggugagacucagcuuuugcuuaucuuggcaguguuggugugggugauucaagcugguuaguuuaauuuuguauagaaauguuucucugcgaacucaauuaaaaacaaaacuuuuguccagacauacaauauauacuaaauaaauucuaucugccucauggagcuggaaaagggaaacaaacaugagaaaauauuuccguggucaguuuuugacuagucagucucauuuauuugggaaaacagagguuaugggauuuacucaaaugccuguucuugaguaguguuuuaaaaugugaaugaaagucuguuuauuuaggaaacuugcacauuauuuaucuuuacaaaauaaauuuccaccuagugauuacucuuuagaaaaauuguuggauuaauauaauucuuugugauggcuaugaggggcuuuucuuaaaacugugacuauuauauguuuaaauuaacaagacuuuaaaaaaugauucuuacuauagugcugucuuuauuacuacaaguuuucuuucucccuauauauuuuuaugaaaaucagccacaaaauucaauguggcccagagauuuugguugucagaaauggaaaaucuuaaauagguguuuuaguaguaaaaggacccauagcauuuuauuaugucaugcauaguaguggcuugacugccauuuuguuauuuguaucaggucuaccccuagaaugagaguaaacuccagaguauagaaagcugcggcagcugugccaaugaaaugggagaaauucuuuccauuucuucugcuuaugugagagaugacaguaacacccuaccagcaauuaaaaucuaauggcuuuuccugguuguccagggacaaauuguaggucacaucaucaugccuguaucuauagauaaaacuauuuauguuguaauggggcaagacuucuguuguuguuguuguuguuguuguuguuguuguuguuugagacggagucuugcucugucacccaggcuggagugcaguggcacgaucuuggcucacugcaaccuccaccucccagguucaagcgaucgucccaccucagcccccugaguagcugggacuacagacgcgcaucaccaugccuggcuaauuuuuuuuuguauuuuuaguagacacgggguuucaccagguuggccaggcugaccucgaacuccugaccucaaagugauccacccaccuuggacucgcaaagugcugggauuacaggcaugagccaccgcgccuagccuaagacuucuuuuuuaagugauauuucuauuuuggguacaccaaaucuuagguuaaugaaucuaaggauuccccuccuucuguuuauagggaugcuccugaaacugaagacaaccaagugaguggaaaggcuuucagaaaaacccuuguugcugcuguaacaaauuacaacaaacuuaauggcuuaaaacgacacagauuuauucuuuuacauuucuugaugucugacaugggacuaaaaucaaggugucagcggcagaggugcguuccuucuggaggcucuaggagagaaacuguuaccuugauuuaucuagcuguuuccuucccuuuuuuuuuuuuuuuuuuuuuuuugagacggagucucacucuguuacccaggcuagagugcaggugcaaucucagcucauggcaaccucugccucucagguucaagugauucuccugccucagccuccagaguagcugggacuacaggcacgcaccaccaugcccagcuaguuuuuguauuuuuagcagacaagagucucaccauguuggccaggcugcucucgaaguccugaccucaagugagcccccgccucugccucccaaagugcugggauuacaggcauaagccaccaugcccggcccucuuccuccauuuucaaagucagcagucuucaaaucucucucugacucugauccuucccaccaaaaggaugauaaggauccuugugauuauguuggguccaccugaauaguauaggauaaucucuccauugcagcauuguguuugcugccauuccuauguucauuuagcagcuuucuucccucacauacuaggggauggggauacagcagugagcaagauguagaaguacgcaguaccuucguuaacacggaaguaguuuuguuuuguuuuucuuuccaugacugaaggcacuaccacacuuuacuuuggaaacuaaagauaaaucugaacuucaguuaucagcgcacauuuggcaauucucugagcacugaaguuacucaaagacaccuaaauaucucgugacauuccaaaauaaauugauuuuauguugagcacagguuuuguauuagucuauaaaugauacaaaaaaggaagucuuuuuuuagaguuucagauucucaucauguguuauguucuacagugaugauguugugacaguuucucuuacgcuguucauagugaauguagguuuuguauacugauacaaaagacagagcuucgugucauaauaucccacuguuuaggaaaauaugaaucacaauauguugucaauuguuuauauaugcuuguagaauuauuauuagauucaugguagagcauauuuaaugugguuauguaaauguuuaaaguuucuuggaaaaaaauucuugacaagucgugacucuuuuggaugauguacuuacacucguauuuugagcacuuaauaaaauaucuaauuuuaauuuuccaaugaaaagauuacuugcuaaaauuaaaaaauuacauacuaaacuuuuuaaaaaguuuaaaaauaauuggggcaaauuuuuuuucuguuuuccucugagugacguuacauuuaugaggucuuucuuaggaaggaagaagcaaaucuguacucucaguucaaaauccaugccauuaaaaaacagccugugauauuucaauaauacugcuuaaugguauuagcacauauuaagcuuuuuaaauuguuaauccaaucuugugcccccccccccccccccgccuuacuguaauacucuauucuguuuuggauugauuuguuuauugauaaugugccaggcacuauaguuggcucugggaauucaaggaugaacuaguuucauguccuguaacuuucagucuguccauauucucuggcaucuaaguuguuuuuauuuccuggaauuuuauagugugcuuucauuaaauacuuauaauuugguuuugcaacauaugaagaaaagcccuucuaaaaaucuagaucauuugaaaccugugauauuaagaagccaagaagguucucaauggaagucuuuagguacugguuuauaauaggucuuuggaaaggagcuccucucucuuccacuacagguuagaacuuguuuccuaagccaaaaaugccugagguccccugcauccucucuccccgucgucacacccccagcuucucaacccuggauauuuuccuuugucauccaggacacuugucccuuucugucuuuuuuuuuuuuuuuuuuuuuuuuugagacggagucucgcucuguagcccaggcuggagcgcaguggcgcgaucuuggcucacugcaagcuccgccucccagguucacuccauucuccugccucagccuccugaauagcugggacuacaggcgcacgccaccacgccuggcuaacuuuuuguauuuuuaguagagacgggguuucaccguguuagccaggauggucucgaucuccugaccucgugauccgcccgccucggccucccaaagugcugggauuacaggugugagccaccgcgcccggccccuuucugucuuuuguuuuuauuguucaaguaucaaacauaauuuauuucuggccgggagcagugccuauaagccuagcacuuugggaggccaaggcaggcggcuugcuugaggccaggaguuggagaccagucuggccaacacggugaaacccugucugugcuaaaaauagcaaaauuaggcugggcgugguggcucacaacuguaaucccagcacuuugggaggccaagguggguggaucacuugaagucaggaguuugagaccagccuggccaacauggugaaaccccgucucuacuaauaauacaaaaauuagcugggcuugguggcgcgugccuguaaucccagcuacucgggaggcggagguugcagugagccaagauugugccgcugcacugcagccugggugacagagugagacucugucucaaaaaaaaaauuauuucuccuucauuuauugaaaagagugguccuucuuaugcuuuugcuucguuauuuaauaacuaaaugucauauaacaaguccuguucuggaaggguaacuucuguugauacaucuugaguuuauuauauauagauggagcuagacuacuuuguuuuggaugcauguuguuaguaauuauacaaaaauggcauaauuugcuucacgucuuggaggaaagugaguaaaauuacaugaaaauauaaagggaauguauuuuucccaaauuuuuuuuuuaagcaagcagauuuuccaguuuaacccagaaauuagucagcagcuuagaguucuuucuaaaaggcuaccauggaaaguaccuuuaagucaagauauacagauaagguuuacuaauauagaacauuuguuuuacauacuaaaaugcuguaagcccuuuuugucauuuggagaauugauguuuuauuaguauaacugcugaaaaguaguacaggaaaauguuuuccccuaaaucauagccuuaaacuuugaaagagucagccucaaccagaaugguaguaaaccucuuuaaaugauucagaguuugaccagcagucuuuucaaaccucauaauuuugacauccucaaguuuucauuaaaaaagcuauaggagaacuaaaaauguguuaagugcuuauacaauuaauauauaauggccuuugaaucugagaaguccaaguauaugcauuaccaugggaauuuaagaaauuauuuggacuggcacaguggcucauggcuguaaucccagccaaagugggaggauugcuugaguccaagaguucaagaccagccugggcaacauggcaaaacccugucucuacaacaaauuuuaaaaauuagccaggcaugguggugcacgcccauagucccagcuacuugggaggcugaggugggagaaucaccugagcccaggaaguugaggcugccaugagcugugauugcaccacugcacuccagccucagugauauagugagaccgucucaaaaaaaaaaaaaaaauuguuugagaggaaaugcccacauuuuagugagaaauaauuugcauuuguacuaucgugguucaaacuuuuuggauaacuguaacugccaacuguauaacacuuggaugccacuaaaagcacuguauuuuguuuguggaugaaauagugagaucuauuuuauagaugguguuuguucccucaaaggauaaaauaaucuaaagacaaauagaacaaucacuugcauuuguaauuucauuuuuauuuccuugacaaaacauuuucaagcaggauccguuuuguuugaaaguuaacauugaguuguauagucacuguaccaaauuugguuauugcuuuugucuguagugagggcuagauuagauccuaucgauucuagcugcuuucagugaauaaaagacaaacauuuuuguucauuuccuuuuugguaccauaggggcguggucaaguucuuagaaccaggugguugguuuuuacuuuuuguuuccuccagaaguccacacccacaucucugcuuuuucuuguguauguguggggugagggugaaguuaaaaugugauuagaaaggacucauggcuuucaaaggaagaauauugauuuuuaguguaauuugugcccuguccuuaggguagaaauugacuuuugcuucuguucauacuucauagcaguuugguuuugcugauuucuaaagguauguguuuggguccuuuaaaaauauguauguacuacuucaaaaagggaugaggggcuugcaguuucacaauaaauagcauuaaaaacuuaccuccauuauuuuuaaacaauacacauuuguuacuguauuacuaaaaauuuuuuaauuaugaaaaccuaaaugggcaauaccagaauuuauaacuuauagucaaaggguuacucugaucauauauuuagauuaaaauauuaguagaacacagaaccagaaagaauggagucuuuuuuaaaaacugacauuagaggauuuuagcaucuucuauaguuacgcauuuuuucuuuguagaguuucugguuucacccuaccaaacccauauacugaaaauaauggagcauauuaaaaaaaaaauuaacuguuccuuuccccccauuuacuucuuggugucaauuuggggaaaaauuguaaaacgagaaucucccuugaugcugucacccggagaucuuuauauucugugaucaaaugugagucacauucagaagauguuuuuaggggggcuuugcguguauguacauauuaaauugauuucaaagacaggauccaaauacaggaucacugaaacauuaagugaucauucaguuagaaauuaguauaugaauauauuugauagcuuucucuuuauacuucacagaaucuaugcuuaagcuugucuuuauguacugcguuuaaaacaaaaugacccucuaguuuuuuaacauuauguaucuuaaaaaaaauuuuuuuaaauaauguuuuugcugcauaaauugccaaacaugcuagguuuucaagaaccagcauagcugguucauuacuguagacugucugcauguacuccauuccuguuacuauggaaacacauugaguguggauuuaucauaaaccuugagaaauauuccuugcaacaguucauauaaagaaacaucuggaucccuuguuuauccuggggugaaggaagaccaccgucuuccucuguguugugaaaaucauauuauauuccaccauuuuuuucuagcuguaaaaauucucauguacaucuaucaaguauacuuuguuuuauaguaugauugauuauguuuacuagaacaacuuuggaaaauagauugauuuucaugcugauucaguuaacuacaacuaugacaauuguauuuugagagcuucuacauucugaauuucagaccuacauuaauaagguuuuaaauauauauauacauaugaguuucuuuuuuuaauauauuuuggucuuugguuggguuaacacucccucuggaaguuuauuugacuucauuccagucucuuggaacuuuaaaccuucaugaaaguuaagucuagaacuaaagagaaucucagugacaucuaagugagcuaaguuguuagucucauuuuaccaaggauauuaccugaggagacuguaacugcuuuuauauucuguuacuaccuccaugcaaagacccacagcagcucugugaagcauuucauuuauauaaaauaacuucuuuaaguuuauguaguuuaguuuaaaagauucauugaagccccuccucugagccuuugaguuagguuccaagagcauauaugggaauaacauuacuuccugcucuuaagaaaacucacauaaacagaucauuuuaugguuaauucugagaggcacgcauagaauaucuuagaacacagaggaaaguuacucagacuaacuuagagcuuaagugacuacuucuuggaaaugacauucugagcucaaaagaugguuaagagucaagcaaaaaaaauaaaaaaggaaaaggguauauuauggauaggauauaauauuaguaaaggcacagaggagugaaaucauggugugcagagaaauuuccagugauuuuauauuacuagaguacaaaaaugacuugagguugaagagguagguuagcgaccuugcuuggagggccuuauaugaucugucagucuaagugcuuggccuuuuucugggcaaugggaaaccauugaaggauuuuaaucaauagaguguugugguuugauuuacagauuaaccuaggaauguauuuguagaguagcugugucugaaaacagaaauagacaauuuauaugacaucuuaaaaccacuucuaauuccaaaaugcuuaaauaaugauaucaauguaaggauuuuuuuuuuuuuuuuuuuuuuuuuuuugagauggugucuugcuuugucacccaggcuggagugcaguggugugaucuuggcucacugcaaccuccgccucccagauucaagcaauucuccugccucaccuucccaaguagcugggauuaccggcguguaccaccaugccuggcuaauuuuuguauuuuuaguagagacgggguuucgccauauuagccaggcuggucucaaacuccugaucucaguugaucuacccaccucacccucccaaagugcugggauuacaagcauaagccacugcucccagccuaaggaauuuuuaaguauaauuaaauauaaaguuucuauuauugagaagagacuggcauuuuaaacauagaaaaaaagaauauauacagcacaacauguaauucuauagaguagaaucuagcaauacauuccacagaaauaauuguuuaugaauuuguuauagugacuuaaacuauaaauuuagcacauuaugaauacuuaauugauauuuauaggcucaaguuguucaucugaaacacguaacaugauuucuuucuuucucccucuugcucuuuuuuuuauuuuagagaaagaguuuuacugugucacccaggcuggucuugaaugccuggccucaaacaggcccucuacuucagccuccuaaggagcugggauugcaggcaugagccaccaugccuggcuugauuucuuuuccuguuuuuguuuuuuucaacucuguaucugugauuuggcuuaaggauucuauaaacuuuucuauuaucagcccaccaucccccaccaccaugaauaaguugguaaauaauaagagcacuaaagcuuugauugauaauuuucaacuuuuuuuugcuuauuuaaaacuguauaguuucagcaaaauuagaaguauucauugauugauuuaucuuuuuuaaaaaauuagccuagaaacauuguucagaggaugaauuuaucagaaauguuuuuguguggugauuucauuuacuugaaaguacauauuagaauggauagauuaguacaauuauuuagucucccaccaaauuguuaguuaacucuggggagugggaguggagaagggugaagugagguucuguuguuguuuacauauuuagggauugugggaaguaagcuuacuuguuaagagccaaugcuguggaacagaguguguguuugaacccuccauuuacuugaucucagacuauggcaaguuauuugaucauacuggccuugauuuuucauuuguaaaaugggauaguaauaguauuuccucaaagggguguucugugaaguaaaauaauauaacaaauguaaaauguuuagaauaguauugacacuaagcucucaaauguuagccauuaaaauuauugcuuuaaaaauaaauugaacacauuaucuuuaucagggauuuauuuaggacaaagguuuaagaauuucugauggccuguaccaaguaauuugaaaagcaaugugugaagaacaccuuacuuccacauccuacuuguuucucauggccuaaaugccuccuugcccagcauuuuucuucuccuuagaugucuguuauaauuguaguaguaacacaauucaauucuuagucaucuucuguuucacauuguuugcuacuauuuuaugugucuuacucacaaaaucuuacauuaucuugcuaaagagauugaaaguaccuuuaggucagugauuuuuuuuuuuuuuuaacuuuuuagcaguucuguaugcccagcauugcaaugaaugauaauaauagccaacaaguggccaggcucuaacuguaugccaggcacugucuuaagugcuguucauggauuaacucuuaauucuuacggcagcccuguacaagguacacaauugcagguauccacaauuucuggcuaaggaaacugaggauuagagaugcugaauaaguugccugaagucacacagccagcaggacuugaaguaugcuuuugaacuuaguuugauucugaaccugcacucucaagcacagugcucaguagagcccccuaaucuaguaaggucuuaaccauuuuaucaguuggugugucugcugcgugaaggcuggccgccagacuccgcugcccauaaaaaucacuauguaaagaaauuuacauguagucccaaaauaucuguuuuuaugaacuaccaaaacugcuuucuugauugcauuguuguauuauuuggaggcauaauaugaagaaguauggcccucuuaaugcuuacgguuucuagaaaauauaacaauguggccccuuuagcuuguuugcuuagaacauggcaccagaauuuaauggaggcuuauaccacuuuagguaccuguagcuuuuuauuuuuaguacuucuuccaaacacuagccaaaucauuuguuuuuuuuuuccccgaacuuuucaguuuaaaaauuuucaaaccuuuagaaaaguuaaaagaauauuacauucaacaccuagauucgccaguuguuaaaauuuugucucauuugcuuuacucuagguauauauaccuuuuuuaaaauccucaaccauuugaaaguuguagauaccaugacacuuuaucacauauuucagcauagcucuccuaagaaugagaacauucucguauauaaacagaauagcauuaucagaaccuugaaauuaauagcuccauuguuuaaagccaguucauauuuuaaaauucuuuaguugucuccacaauaucuguuuaaucuuuguguuuguguguauuuaaauccaggauuuaaucaaaguucaugcauuguauuagguugauaaaucuugucucuuuuaaucuagaauagucuuuccaccuuucauuuguuuuagacauuagccucuuugaagagcccaggccaguugucugggagaauaucccccauuuuggauuugucugauuauuuccucacuuuagauucggucuaagcacugggaagaauacuucaaaggaagaaaaugcgagauuugcuaaaugacugguuuuauggcuuaacaaagagggaagaaucaaucaccugugagccugagauuucuagucugggaagcuagaaaagugguggaagcaaugacagacugggguagucugaaagggacauugcacuaggaaaaggacagugcauucaguuuuggacuaaugaccuuuagcguuuaguguaguuguccuuaaguaguugguuauucucuggcgguaggauguugugaaaaagagcacaggauuagaaaucaggagacugauuauuuuucaagcuuuaucacuaauuagcuuuguggucuuggaaagucaguauuugaaguguucuaugugguuaccuaaaaaaugaaguuaaugcacaccuugcccugucagucugacagaguuguuuugaggaucaaauacaaauguauaugaaaacacucugugauacaaauguauauguguucacuccauggacuccuguguaauuauaagaagguaauguuauuuucuuaguucagacuaaaaugaaauauuuggaguuagggcuagagaagacaggaaaaggggaaaauauaaaacuuuuuguguuugaaacucaaucaaaagcaucagaaaucucagucucugaauacauaugccugaaaaacccugaagacuauaauuugggaggcgaaucuggaagcugaucuuguauacaacaguuacaagaaccaaaaacacagguugcaucuuguuagaugucauuauuugacuugccuucaaguuggaaguauaaaugagaacuuuugaauucugccuguguaguugguccaugcuuguuaacagaauuuuuaaacauuuccuucuuaugucuguugcugugagcuauacauuuuugccaaaaguuaaauuaagguaauguuucaguuguuaaacauugucaguaaauaugguaugcuaaucaagagcacagacccuggaacugcgguuuuuuugcagugagccaagaucgugccacugcacuccagccugggugaaucuuggguugaaucuuagccaugugcacuugagcaagucauuuaacuucucugugccucuauuucccuauguauaauaggagauaauagcuacaugaauguuguugggaggauuaaacguaguacuuaugucaagcacuuagaauggugccuggcauaugcaaagugcuauguaaguguuaauggugguuauuagaauauuugugauuuugguagugacgaaggaauaaaguaccugaacaaaagaauucuuuucccagaacugauagcugagggaaacagaagugauacaguaguaaaaaucauggacaucaggagcucgagaucagccugggcaacauagugaaacuccaucucuauaaaaaauacaaaaaauuagccagguguggcgcaugccuguagucccagcuacuugggagccugaggugagagaaucaucugaacccaggaagucaaggcugcggugagcugugauuguguguuucugcacuccagccugggcaacagagugagacccuaucucaaaacaaacaaacaaacaaacaaacaaaaacaacauggacuucagagucagacaugccuagauccaaauucaaguucucccacuuugugguuuaagcaggccaccuagccccucugaagcucacuuucuuuuaccuaugaaccagaaaucacaaucccuaucuugcagaguugugauuauuaaaugagcugauguguaaagugccugacacugaggugacacuaagaaaaugagagcgcucuggaucccucccaccccccaccaauguaaagcaauacauacaguucaauuucuugugugcagucuuauucauuuguuuguaauuuuaggacuuccaaaaucauuuccauuugcuaacagcagaagaaacaguggcuguauaauuggauacaccuugaaaaguguauugucagcuuuguuucccucuuccauuugcuguuugggguuauuuguuuuauuauuacagcagauccuacuggaaccaagaugguagacacuguuaaucagucuauuauuaaucuauuaauaauaggcauuguuaaugauucuguuauuaacagagucgaacuggaauguagccucaggauccuuuuuuuuuuuuaauuauacuuuaaguuuuaggguacaugugcacaaugugcagguuuguuacguauguauacaugugccauguuggugugcugcacccauuaacucuucauuuaacauuagguauaucuccuaaugcuaucccuccccacuccccccaccccacaacaggccccggugugugauguuccccuuccuguguccauguguucucauuguucaauucccgccuaugagugagaaccugcgguguuugguuuuuuguccuugcgauaguuugcugagaaugaugguuuccagcuucguccaugucccuacaaaggacaugaacucaucauuuuuuauggcugcauaguauuuuuuuuuuuuuuuugagacggagucucacucuguugcccaggcuggaaugcaauggugcgaucucugcucacugcaaccucugccuccuggguucaaacaauucuccugccucagccucccaaguagcugggauuacaggcacuugccagcaugcccagcuaauuuuuguauuuuuagcagagacgggguuucacuguauuggccaggcuggucucaaacuccugaccucgugauccacccaccucggccucccaaagugcugggauuacagaugugagccacggcgcccggccucaggauccuucuucacaguauucuaggaagcuacaaucaguucaucagaguugauauagcugugaaaacugguuuguccuuccugcuuuagaacuuucuagaagaggccaggcaugguggcucacaccuguaaucccagcacuuuggcaggcugaggcgggcggaucacgaggucaggagaucgagaccauccuggcuaacacggugaaaccccgucucuacuaaaaaaaaaauacaaaaaaaauagcugggcaugguggcgggcaccuguagucccagcuauucgggaggcugaggcaggagaauggcgugaaccugggaggcggcgcuugcagugggcuaagauugcaccacuguacuccaaccugggcgacagagcaagacuccaucucaaaaaaaaaaaaaaaagaacuuucuagaagaaauguuuguuggauuaucaaaauauuauauggauuguccauuaaucuucuauucugugaugugcacgugucaaaccuuaugacaaggcaggguggucuuguagcauuuucuaacagauacuuaucuauauuguaacguuauuacauaauguaggcaucuucggacaccuacuggaggaggugcaauaauugaaagauuauaaugcaaugaucuaaccaagaauaugcaucaaaguuaccggggauauagucuuaaaaaacuuaugcccaggaccccaccccagauuuauucaauuagaaucuucaggaggcagacccugccacguacauuuuguaaaaguacuccagaugcuucugcuauauauaccacuuguuaaaaauaaguagauacuggcaaaaaagucaaacauauuuacaagaaaaaaacaaccccaucaaaaagugggcgaaggauaugaacagauacgucucaaaagaagacauuuaugcagccaacagacacacgaaaaaaugcucaucuucacuggccaucagacaaaugcaaaucaaaacuacaaugagauaucaucucacaccaguuagaaugacaaucauuaaaaagucaggaaacaacaggugcuggagaggguguggagaaauaggaacacuuuuacacuguuggugggacugcaaacuaguucaaccauuguggaagacaguguggcgauuccucagggaucuagaacuagaaauaccauuugacccaggcaucccauuacuggguauauacccaaaggaauauaaaugaugcugcuauaaagacacacgcacacauauguuuaucgcggcaguacucacaauagcaaagacuuggaaccaacccgaauguccaacaaugauagauuggauuaagaaaauguggcacauauacaccauggaauacuaugcagccauaaaaaaugauaaguucauguccuuuguagggacauggaugaagcuggaaaccaucauucucagcaaacuauugcaaggacaaaaaaccaaacacuguauguucucacucauaggugggaauugaacagugagaacacuuggacacaggaaggggaaugucacacacuggggccuguugugggguggggaaaggggggagggauagcauuaggagauauaccuaauguaaaugacgaguuaauaggugcagcacaccaacauggcacauguaugcauauguaacaaaccugcacauugugcacauguacccuagaacuuaaaguauaauaaauacauauauauauauauauauauauauauaaagaaagaaauuacaauaaaaaaauaaguagauacuggcaacuauagagaagcacacacuauugguaugagaguucauugacauaguauaaccuauagaacaauuuuacaguaucucaaaauuucaaaucuguccuauagaaauauauaugugcacaaaaacagaguuuagagaauguuucaggccaggcguggugacucaugccuauaaucucagcacuuugggaggcugaagcaggaggauuacuugaguccaggaguuugagaccuaccugggcaacauagcaagacccugucucuauuugaaaaaaagaguaaagaaaagaaaagaaaaauaaguaaaaaauaaacgagguuuucugcagacguauuuauuauaucaaacaauugugagaaacugaugaucaguacauaaaugguuaaauacaaauaccacguuuguuuacuaugcaaccauuuaaagaaugaauauguaugaaaauugucuauacaugcugauguagaaguauaucuaggauauauuguuaaguuaaauaagcaagucacagaauaagcccuauuuuaaaaauuuauauguaaaaauguagagaaagaugugaaaguauacccaucaaaguguuuauagugguugucuuggcauagaagagugggaauaaugaaguggggacaggaacaggccuuuucacuuugguguuuaaaauauuugcaggccagucgugguggcugacgccuauaauccuagcacuuugggaggcugaggcagguggauugcuugagcccaagaguucaagaccagcuugggcaacauagugaaacccugucuacaaaaaauacaaaaauuagcugggcgugguggugcaugccugagucccagcuacuggggaggcugagaugggaggaucaccugagccugggagguugaggcuguagugagccaugauuguaccacuacauucaagccugggugacagagugagauucugucucaaaaaaaaagaaaaaaugcaauaacauuuuauuauuuuuguaauaaaaacaaccacuggacaaaauaugaaugauuuuaaaggaagcucuuauggaagcagauugauaugugucaggacacugcuuauuuugcaaacaccaguuuuaaccugagacgaucucuaacuugggaaauaaaaaggaaugucaaaacuauuucguguguugguggugaugauaaaaucuuguugccacaguuguugugaaaguaaucaggaguuucaaacagauaagcauugaagauaaaagguauuugcccugugucagaauuauaucaguuaucuguuuuagaaauauuuaaugucuaugcauaucuggauaugaaaauugaguucaaaacauuuuaguuuaauccuuuuucaguugauuagccucuagccuaugagaauaguaacaccuucuaauccccucuuuuauaauuuuaggcccgaugagagaaagggaaaguuaaggaugcuggagcagaacaauggauuucucuuucucuuucaugcaagggaucaugggaaacacaauucagcaaccaccucaacucauugacuccgccaacauccgucaggaggaugccuuugauaacaacagugacauugcugaagaugguggccagacaccauaugaagcuacuuugcagcaaggcuuucaguacccagcuacaacagaagaucuuccuccacucacaaauggguauccaucaucaaucaguguguaugaaacucaaaccaaauaccagucauauaaucaguauccuaaugggucagccaauggcuuuggugcaguuagaaacuuuagccccacugacuauuaucauucagaaauuccaaacacaagaccacaugaaauucuggaaaaaccuuccccuccacagccaccaccuccuccuucgguaccacaaacugugauuccaaagaagacuggcucaccugaaauuaaacuaaaaauaaccaaaacuauccagaauggcagggaauuguuugagucuucccuuuguggagaccuuuuaaaugaaguacaggcaagugagcacacgaaaucaaagcaugaaagcagaaaagaaaagaggaaaaaaagcaacaagcaugacucaucaagaucugaagagcgcaagucacacaaaauccccaaauuagaaccagaggaacaaaauguaaguugaaaagucguuuugaaaaauuuuguuauauuucacauuuacuggaaguucaagagaucuuuuugguuuuuaucucuuuaaauaugaaucugucugauaacuucuuuaaucacuagcaacgugcucagaauauuauaauaggugcugaguauuuguugaauauaugaauggacaugauuaguuaagaaauauuuuuaaaacauguaaaacgaaucuuucugcuuauguuucuuuguccugaugaccucgguuauuuuuauuugcuuacaauagacuguugguuuuugaaaaucaagaggaaaggcaaagagaagauagcuaauuauauuggguuuucauuauuuuagaccaacuuuuuccaguagagcuuagauuuaacacucauugcuaauguuugcuacaaaauaaccugaaauaauagaaaucuuuuuauuaaaaucagaguuaguauuaauaaauauugauuaaaacuucaggugaguuuuuauaaaagucauccuuuauagguaacuuaagauauaugcugcugaauuuuuuaauaucugagauuucagcgugaauuugcuuagcaauaauauaauaaguauguaacauaauucuagcuuaaaugaagaguucauaauauaaauugcaaauguuuucuaaacuuugacuugggaaaacuauauuuauuuuuaugacagcuaucugcuuuuauauguguuauaccugaauaaguuaauuuauuuucuguucaaagaaauguuuacuucuuaccuauucaucuuuuccuugguagcuggcuucuauuacuucauacaacucacaugugauguuuuucuggaguaaaggucacaaugcuucuagacucucacaagucccagugugacauuucaacauguuuucucacuuuuuauaguuuucuuauuuauucauuaacaaauguuggugaaaugcuccuccuacugugugcuaggcaaugaucuaagacuuaaagguaugacaaugaaugaaaaguagagaugccugcucucaggaugcuuauauucuagugaggggagccagaaaauacacacacauauacauauauauauacacauauauacauauauacaauauauauuuauauauacauauauauacauauauacauauacuauauauacuauauacauguguauauacauauauacauauacauauacuauauauacuauauacuauauauguauauauacauagucuucauagcaucuaaagcuaacuuauguacacacauauacauaugcauauauacauaauacauagguauguauauacauauauguauauauacauauauacauacauaugcauacauauauguauauguguguacauaaguucucauagcuuuagaugcuaugaagacaauaaaacuggguaaugagauaaagaguaaucagugauguuucuaguagucauuuugcaaugagauucuaaaaccaguucugucucuguuagaugucugcuauaccuaguucuuuauaucaccuaaaccuucaguuaacuauuauagcucaggauuagaauguuuagauuuuauuuuauuuuauuguuuuugagacggaguuucacucuuauuguccaugcuggagugcaguggugcaaucuuggcucaccgcaaccuccgccuccaggguucaagcaauucuccugccucagccucccgaguagcuggggacuacaggcauaccaccacgccuggcuaauuuuuuuuuuuuuuucaaguagagacagggucauguuagucaggcuggucucaaacucccgaccucaggugauccaccugccuuggccucucaaagugccgggauuacaggcgugagccacugcgccuggcccagauguuuagauuuuaauuuaaggguuuuaauucauuuucccuuuuauugaaucaugaugagcaaaauuuacuauuugauuguuuaggaucuuacaauagcuugggauaaaggaauaucaacuugaccaaaaguauagcuggagaaaguggcauugacugccuggaauauuacuaggagcauugccugaaagucgagucuuggggggaaauccagguuuuuuucuuguucguucucucucucucucccucucucccugucuccuucucccccucuuccucucccucccucucccugcuccccucucugccccauuccucccccuuuccauccuacccccucgucccuucccccuuccauuccuuccuucuucucucccuucuucucugccucucuccucucucucucucccucucccucucaccccuucuuucuucccuuccuucaaagaaguaaagagguaaguucuuguuaauugaauuuugauuaauuggaacuguaucacacacgggggcaguuguagaaguuguaguccauucugaccacagaccuucaaagccagagcucccacagcucuugccuaucguuaaugucaugcuuuugcuaagcuagagauguguauaaauuaauguuucacaacugcauauauuuuuaaauuagauuuccuuaacuugaacaacaucuacagugcuuccuucaggacaguuguuuuaaguguuuuaauagucaauacccuaugccuacugguuguccauaggggucccagcccuugguguuuagcauuguagagaacugagaagugaaaaggaagcccaaagaagcauccacugacuucacuggacagcuucccucccccagaugccucagggaaacauaaugaaaaauguauuccuggagaaaaaagucugauuuaaaucuccuggagcuggauuugcuuuuauauagauuuuuucuuuuacuuuacuuuguuguuguuguuccuuaaaagcucacucauagguucauagguucuuuuuugagcaaacaaaaucucauauaguugaguuccauguuuaaguccgggcaugguggcucaaucuguaauaccagcccuuugggaggcugagguggguggaucacuuaaggucaggaguucaagaccagccuggccaacauggugaaaccccaucucuacuaaaaauauuuaaaaauuagccgggcguggugguggguaccuguaaucccaacuauucgggaggccgaggcacaggaauugcuugaaccugggagguggagauugcagugagccaagaucaugccacugcacuccagccugggugacagaaugagacucugucugaaaaacaaacaaauaaaaaaacacaacaccuuaagauuucaccugcuacuuuuuuucuuaguacuugauguguaaguauuucccccuaauucuaagcuguuuggccuucugaagaguggcuguuauuuggaacaaccuaaguauaucuucucagcaaugaaaauguguccaaacaucuaggcagcaggagaccugagaucacuacugaaauuguauauuuuaaaaaucugcaugagcuguuuuuccucccaccaaaucagaaauauguggcuguguuucugcaugucuuccuccuuggcagguggaaugccucaggcaugugagcguaggcccuauuauucaaacagucacuggucuccuaucagcacuucagugggcuaauccacuaaggcagagucucauuaacccuuaguuugccauauccccuuauaaaaagcagaguggcuggaucagucccgugaacacuaagguagcagguuugguucucuagccucagaguauuaggccuuaaaauucuuagaaacucuuuauaugcaaaauguucuuuauuguacacauuuuuuauuugauuuuauguguuuauuuuugagacagaaucucacucuguugcccaggguggagugcaguggugcagucucggcucacugcaaccucugccuccaggauucaagcgauuauccugccucagccuccucaguagcugggauuacaggggugugccaccacgccuggcuaguuuuuguauuuuuaguagagaugggguuucauuauguuggccaggcuggucgcgaaccccugaccuuagggugauccacccaccuuggccucccaaacugcuuggauuacaggugugagccacugcacuuggcccacauuuuuuauuuuuaagguuacaaacuuaagucauucagaaaguaaaauaaaaaugcacaauuuauuaccuuuaaaauuuucuuuccaacuuuaauguugacaucaguuuuuuguucuuuuagggacuaugauuuuacucuauguuuuugaaauuuauauaaguaauauuauuaaggcuuugaaauucugacagauuugauguguauuacuaaucuuuuuuuuuugaggcagagucucugucacccaggcuggaguacaguggcacgaucucggcucacugcaaccucuugccucccggguucaagcgauuccuaugccucagccccccagguagcuggaauuacaggugugcgucaccacacucagcuaauuuuuuuguguauuuuuaguagagacgggguuucgccauguuggccaggcugaucuugaacuccugaccucaagugauccacccaccuuggccucccaaaguucugggauuacaggcgugagccacggcaccuggccuguaguauacucaucuuaaugaaugucuuggguuuuaauaaaaguaauaggcugaaggccgugguggcucacggcuguaaucccagcacuuugggaggccgaggcgggcggaucacaaggucaagagaucgagaccuccuggccaacauggugaaaccccaucucuacuaaaaauacaaccaggcgugguggcgcgugccuguaauaccagcuacuugggaggcugaggcaggagaaucgcuugaaccugggaggcagagguuguagugagccgagaucaugccacuguacuccagccuggcaacagagcaagacucugucucaaaaaaaaaaaguacuaggcuaaaauuuguaaaggaauauuuaggauaauguaauuuauuuuagcuacucuuaacauaauuuuuagguguucuuauguggagucaauuaaaaauguaaaaaagugguauauacccacaaaaucauaauuuuaaaauuaagaugaauugaacauuaaggagagcuaacucacugucaucuuuuucucugauguuuucucuuucugacaaagcaguggaauuaguacccaaagaggguaucucugucccuacuuaauuuuaaugucuuaaacuugucucugucucugaaugccuaccagguauaucuguuuugcucacguacauuuuauaauagauacucccucucuauuauugcagcauccuuacuugaauucuuuuucuucucuuacuuauauagucuugaaagcuuagaauaaauccucuugggcauccuucgcucccuagccacuuauuucuuuuaaaaugacuguguaaaaaacuuuaauucuuugaaagugauuuugaugguguuucaaaccagccugaaggaaacaccaacaaucuggaacaaaucaaaaaauuaaaaaagauaagacauuugaauuauaagauuuggaaggaaguccuuuuuuuuuuguuuuuuuggagacagggucucacucugucacccaggcuggagugcagugacgugaucauagcucacacagccucaaacuccugggcucaaacaauccucccaccuuagccucccgaguagcugggaguauauagguacacaucacuacgccuggcucuuuuuuuauagagauggggucucgccauguugcccaagcuguucuucaguuccuaggcucaagugauccaccugccccagccucucaaaguccugggauuauaggugugaaccacugugcacagcugguaccguuuuuaaccucagguaucucacacaugcuacuccuuccuccuggaauguucuuuccuccauguuuacuaagcuaauucuucguccuuugauucuuagauuguaauuuuucuuuuuuuuuuuuuuugagacggagucucgcucugucacccagguuacaguccauugguguaaucucagcucagugcaaccucugccucccagguucaagcaauucuucugccuuagccucccaaguagcugggauuauaggcacccaccacagugccuggcuaauuuuucuauuuuuaguagagacaggguuucaccaucuuggcacggcuggucucgaacuccugaccacgugauuuacccaccuuggccucccaaagugcugggauuacaggugugagcuacugugccuggcagauuguaauuuauuuucuuagagaggcuuuuccugaccuucauaucugaaaauacauauacacuuacacuauuauuuaucuuucucuuccuagcacuuacuuuuuuuguuuguuguuguuguuuuaagagacgggguuucgcuccaucacccaggcuggagugcagucauagcccauugaagccuugaacucugaggcauaagcgguucuccugccucagccccucagaguaguugggacuacaggcauuuguuguuuuuagguacugggccucacucuguugcccaggcuggucuugaacucuuggccucaagagaucauuccaccuuggccucccaaaguacugacaggugugagccacaccaugccgagccauagcacuuacuuuuuaacuggauguuuguguuucuguuuuuuaaugucagucucuccugcccagcuguaaacuccuuggggucaggaaucacaucuguuuguuucacuauuauauauagccuauauagcuucuagaacugggccuggaacguccuaggcacugugaagugaaugauacuuggguuuggggacauuagucuggcuuauagaacauaucauuuuccuaaaacuuaaaaaucuuuuuaggccaggugugguggcucacaccuguaauuccagcacuuugggaggccaaggcaaguggaucaccugagguuaagaguucaagaccagccuggccaacauggcaaaaccccgucucuacuaaaaauacaaaaauuagcugggugugguggugcgggccuguauucccaguuucucaggaggcuaaaggaggagaaccacuugaaccugguaggcagagguugcaaugagccgagauggcgccaccacacuccagccuaggcaacagcagaguaagacucugucucaaaaaaacaaaaaccuuuuuauacuuuuuuuaauuuaauaaaacuuuguuuucacaacagugucuuuaaauguuuugaaauaauagaaugagaauuuuaaguagcuuuuagaauuaaucauauucuuuuaguggagugaagaccuacuuuaauggcuauacccucuuuuuaagccaucuaaauuaaauucuguucucuaacaaguaacauauuuuaaaaaucuuuuaaauuguagaaguaauuugguuuuuuuuuuacagaaaagacgaauaauaaaaagguauagaauaucuuccuucaccauuucccucaugucauucccaaaagauaauuacugguaucaauuuuguuuacauuguaccaaauauuuucaaggcauguauaaauuacauauuuuuaaauaaaaaauuggaagauauugguagacaugcagauuacugacaugaaauaauacuguaguuaccauuccucugcuuagauuuucuuguuuuggauauuucuauagaauaaauuucuacaaugugauugcuagauggaagaguguacauaucuugaauuuugauagcuacuuccaaauugccucccuaaaggguuuuagaaacuucuuucuuuccuuuuuuuuuuuuuugagauggagucuugcucugucaccaggcuggagugcaguggcaugaucucggcucacugcaacccccaccucccagguucaagcaauccuccugccccagccuccugaguagcuuggacuacaggcgcacaccaccacacccagcuaauuuuuaguguuuuuaguagagacgggguuucaccauguuggccaggauggucucaauuucuugaucucgugauccaccugccucagccucccaaagugcuaggauuacaggcgugagccgccaugcccagcccaucuagauuauguuuaauacuuagcucuuguaaguagcaaugguaugcauaucuucauacuuauccauauuuuuuacaucucucagugcuuuucaaauauacauucuuagaaguagauuugcaaggucagagucugaaaauuuaauguuuuucauauauacaaccaaauugcucucagaaaaguuucaaguuacaucuuacuaguaaucuuagagugcccauuuuuucuagaaucugagcauuaaaaagaaaauuaccaguuuauuuagaaauuaaguggguuuuuuuuuuguuuuuuuuuuuugagacagagucucacucugucacccaggcuggagugcaguggcacaaucucggcucacugcaaccuccgccuccuggguucaagugauucuccugccucagccucccaaguagcugggacuacaggcaugcgccaccaugcccggcuauuuuuuuaauuuuuaguagagacgggguuucaccaugcuggccaagcuggucuugaacuccugaccuugugaucugccugccuuagccucccaaaaugcugggauuacaggcaugagcuacugcacccggccuagaaauuaaguuuuaaaaguaacaaaauaagaaaaaggagauaaagcuaugauaugggguggaaaaugaauguugagacagcauuagguauugaguaaguuguauucuuacuccuuacauuguucaguuaauaaaugcccuuuauucucuuuauuuaguuuucuuugauucuuuuuauguaugucacuguuuuuuguuuguuuguuuauuuaaugccauuuuauucuacuuaccuauaccuuuucaccuagagaccaaaugagaggguugacacuguaucagaaaaaccaagggaagaaccaguacuaaaagaggaagccccaguaaguuguuuuacugaauacugucuaaccaaauaugguggaagaaggugaaacacagugauugaauugcaacacaauuguauugguacuacgcuucuuaauuucagaaauuauauugaaauaagucuuggagcugguuugauagguggauauuuucagugaaucauuuuccuuuucaaaacuaugaccuguuuuuuuuucaauugaucauguguauuuuuuuuuuuuuucuuuuugagacggagucucacucuguugcccaggcuggagugcaguggcgcaaucucgacucacugcaaccucugccuccuggguucaagcgauuguccugccucagcuugccgaauagcugggaugacaggcacgugccaccauacccagcuaauuuuuguauuuuuaguagagacgggguuucacuguguuggccaggcuggucucgaucuccugaccuugugaucugcccuccucacccucccaaagugcugggauuacaggcgugagccaccgcgccuggccgaucauguguauucuuaacaugccuuguuaauaauuuggcaacagaaaccaucaauccuaucuucaguauuugggguggggcuuauuaauauuuuuccuccuucccuuuugcuaguuuuagauaggaggcaucagagaaaaguauaauugaagauaaauuuacauuguuagcacuuuuaauguacuuuauacauaguuucuuuuuuugaauuucugauguuuuuugacccuuuccuguaucaaaguauaauugaagauaaaauuacauuguuagcauuuuuaauguacuuuauaucuaguuucuuuuuuugaauuucugauguuuuuugacccuuuccuguaucaaaguauaauugaagauaaaauuacauuguuagcauuuuuaauguacuuuauaccuaguuucuuuuuuugaauuucugauguuuuuugacacuuuccuguaucaaaguauaacugaagauaaaauuacauuguuagcauuuuuaauguacuuuauacauaguuucuuuuuuugaauuucugaugaaguuuuuugacccuuuccuguagguucagccaauacuaucuucuguuccaacaacggaaguguccacugguguuaaguuucagguuggcgaucuugugugguccaaggugggaaccuauccuugguggccuuguaugguuucaagugauccccagcuugagguucauacuaaaauuaacacaagagguaagaaaaggcauaaacagauacuaaguaaaagguuggaaauaaaagugacuuuuaaauguuguaugugaauauaagaauacacacguaauauauaaucugauacaaaaaugugcauauccguaucaguuuuguggauuuuuuuuuuuucuuuuuuuuuuugagacggaguuuuugcucuguugcccaggcuggagugcaauggcgcaaucucagcucacugcaaccuccgccuccuggguucaagugauucuccugccugggccucuggaguagcugggauuacaggcacccgccacaauuccugguuaguuuuuguauuuuuaauacagaugagguuucaccauguuacccaggauggucuugaacucucgaacucaagggaugcaccugccucggccucccaaagugguaggauuacaggcgugagccacugcgcccggccucuguaucaguuuuuaaaaccagugaaauacugauagucauuuuaaauugcagagugcuucuauggcuaaugcaguccuuguuucccuuaugauacccuacauuugcuuauaauuugcuuacacuugcuuuuuuuaaagaccuuaaucugacugaaaauaugaccucauauuuccuaaagaaagcauauggacaagcgaucagauguuuuauaugaacuuaauaagcauuugcgccaagccuucuuugaacauuuuuauuucaucguugacugcuauggauaguaauuuuuuacccagacaaguacuuuucauccuggcaaauuuugcaggaugcuuuuuuuuccucuacacuccauucuugaaucgguaaauuuacuggggcauccuuguaaauuugauaugacauguagccugaagguugcuauauaauauagaauccuaccuuaggaauguuaauaaaaauuaagaaagacaauucuaacuuuucucuacuccuuuucugggauuugaccaaagaaugauguggaguagauugcugagauucuagcauuugaaaugaacuugcuuaguagccaaagaaagguuugagcuuggaacuuacuucuggguguuaacuuugugaauugacucuugucauguguagaguuccucauugucugugacaaguuuguaccuguuucuuuuucuuuuacuuuaaaccaucugucuugguccuuguucacucuucugaagggaaaaaguaucucuuuaugucuggcaaggcacauuugugauaggaucagccauaucugugauucuugugcugcauaaccaagaaucucucccaguauagaaggccaucuggcucaaccauuuuucgucuugucaaugugaccugcugauuaaagguuaggagacgggaugugucagcgaggcagaagugaaaaaccagcauuguugggugucugcuuuagugcaagguccuguguucaguaguucucuuauauauuuucuuauccaauccucauagcagcaacacagugaaguagguacuuuuauuaucccauauuuuaaauagguaaacagaaucucaaagaaaucuuaauuucauaaccucuccuccuaaacacugccuuauauuacagggaaagcaguuaaauucaccuagucaucauuuacagagguuggaggaggcagucuuauuauaguuccuucauuuauauaagaaggguauuggacuagucaucucugaaguacccuaccccucuaauaaucuaugguuauaugagugggaaaagaaaagacaaggauuuuccaagaagaccaugcuuucuuaaauaaaacaauucauguccacaucuaggccuccagaacucucuaagaaguuacaucaugucagaacucuggaucuucacuucuguccccugaggaaagcauacuguugagauuauauaaagaguuucauauucaauuacuuuaugaaaaccugcagauuucagcuuuuuucaagauacaaaugaaagcacaauuuaugucucaucuguauuucaaaggaaguauuuacauuuaguuuuauuaauuaaccuaaucucagcugggcaaggugccucaugccuguaaucccagcacuuugggaggccaagguggguggaucaccugagguuaggaguucaagaccagccuggccaauauggugaaaccccauaucuacugaaaauacaaaaauuagccaggcguuuuggcgcaugccucuaaggucucacucaggugacugagacaagagaaucacuugaacccaggagguggagguugcgguugcagugagccgagauccaccacuucacuccagucugggugacagagugagacuuggucucaaaaaaaaaaaaaaaaaaaaauucuagccugguacccccaggcaguuuccuacuuuagugcuggaaaaaccgauuuuguuuauauuacuaccagaagucugaaauuuuagguuaagaaaugcauauauuuuaaccuauauauuuuaauaaaaauuuaaauuauuuuucuauaguaguuuuaaaaacuuuauugaaauauaauucucauaucauaaaauucaccuguuuuuuuuguuuguuuguuuguuuuugagauggauuguugcccaggcuguagugcaguagcacgaucucagcucacugcaaccuccgccuuccagguucaagcgauucuccugcuucagccucccaaguagcugagauuacaggcacccaccaccacaccggcuaauuuuuuuuuuuuuguauuuuuaguagagacgggguuucacuguguuggccaggcuggucucaaacuccugaccuugugaucugccugccucggccucccaaagugcugggauuaaaggcguaagccacugcuccuggccaauucacccuuuuaaaauguacaguucauugauuuaaaaaucuguacauucacagaguugugcaaccaucaccacaaucuauuuuagaacauguucaucaacccccaaaaauccuguauccauuagcagucacccucauuucuacccgcuaagcagccaguaacuacuuucugucucuguagacuuaccuauucaucuggcuucauucacuuaccauaauguuuuugagguucauccauguuuuaacaugguaucagugcuuuauuccuuuuuauugccaaauaauauuccauuuauggcuauauaguauaguuuuaaaugcaguaguuuucugacaguuuuucugaaaaccaaaaaaacacagccuaaaaauucuguuaauuauguuccacgcaugaugccuauuaagcauuuuaugcugaucauuacuuuuuuaauagcacauauacugcauguauacaugggagauacccagagaaaugagugaaucuccuguguugcuuucuaucuaagcaacuuuguaaaauuuaucuuaaucauauauaguaaucacugguuuccauauuguuauuagucaguauuuuuuuuuucuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccauuagucaguauuuuuauuagauucuuagcacuggaaaauguacuuaacaguuuuucacacauaaagauguaauaauuauuuguaagagcauguugaaagauguuuggaucacaauucuauuuuaaguuguauuuuauuauuuaggacucauuaaaaauuuagcucuucagucagagacagaugugcuuguuucuugacuuuucaggucuguagcuucuuauuucagucuuauuucauaguuuuccaggugucaggaaacaaagugcuaacaaauaggcaaaauguuugucuuguuuccucucuaguaaaugauuuaaugggggaagaaguugaaaauacagauuaaaaugaaauuguguuaucuauaaauuucggcuuuuauguuaaguccuuugggauuaucuguucauaucugaagaaauaacucugauguuuggaaacauuauguacuauguuuuuuuaaucugaauaccuguacccacuacccuguccuugaaauucacuuauuaguuuagguuauauuucuauuuuuccccccaaaaacccuuuggauuucagauaaaucuucuuugacuaauuauaauuagauuugugcuugggucuuuauucucagaugagaugauaugaaaaucugaguccacuguugccuuuuucuuccuaauuacuuuggguucucugaaaagaucaguuccugcauuucuccauugaucuaauacuuuuucucuagaacaguauuuuucagacuauuuuucgcaaaagaucaguuuuuuuuuacuuuuuucaaaugucuagucuacuauguacuaauaccucuguaaaauacaaccaaacuuaauuauuuaaaaaaaaaagaaugcccuuccccugaaaaaacaccuagugcaagauucuugaucaugugucuagauaucauaacaaugucaaauugcugucagagcuucucaaugcuuacucaacuucuguacuuacuuuugucccagacuggcuuguuugucaaaccaauuucagaguagcauugcccuuaaucagcaguucucagauguuguggucccaggaccccuuuuacuccuaaaacuugaggacucaaaaaggcuuuuguuuacguggguuauaucuaauguuauuuaaauuuagaaauuaaagcugagaugcaggcgcaguggcucacaccuguaauucuaacacuuugggaggcugaggcaagaggauugcuugagcccaggaguucaagaccagccugggcaacauagcaagaccccaucucaguuuaaagaaaaaaagaaauuaaagcugagaaaauuucaaaauauuuauugauuuauuuaaaaauaagaaccuaucauaggcuggggccaguggcucaugccuguaaucucagcacuuugggaggcugaggcaggaggaucacuucaggccaagcguuugagaccagccugagcaacauaguaagacucccaucucuacaaaaaaaagcaacaaaaaaauuuauuaauuaacugagcauguggcauaugucuguagucuuaccugcucaagaggcuaaggcacaggauugccugagcccaggaguuugaggcugcagugagcuaggaucaugccacugcaguccggccugggccauagagugagaccaugucucuaacaacaagaacuccuuacaugcuaucauuaauuauauuuuuaugaaaaaugacuauuuuguuaaaaaguuaaugagaagaauguuauuuuguuuuguuuuguuuuguuuuguuuugagacaagagucuugcucugucacccaggcuggagugcaguggugcaaucaauuauuuguggugauuuuuacaguagcuauuaguucuauaacugguggguauuggaacauaucuuuggacaauccaaacauacaaguuuuagugggaguaauacugaggaaccuggguuagauucccauuuuuggcaaaguagaugugaaugcuuauguucugaaaugguuaauaagaauuuuuacuuacaggugcccgagaauaucauguccaguuuuuuagcaaccagccagagagggcguggguucaugaaaaacggguacgagaguauaaaggucauaaacaguaugaagaauuacuggcugaggcaaccaaacaagccagcaaucacucugagaaacaaaagguaacuaacauguuaauauuauuuaccuaguaugguuuuuaaagaacuuaauaauuuagaagaauuuuucauacuugaauucagauaauuauuagaauccuuuuuuuaaaccccuuucagcuguuuuaaucguaaugguaaaugacuaguaaguuuguaaguacaccaaugaguuuuauaugucauauaaacgacguauaguacuauuaaaaacuuuagcuaccugcuuaauauugaauucuauugugaguuucauuaaugugcauaaguguaccagaugcuagugaaauguggauuuuugccagggauuuuuacucuuuuuucuauuucagcauguuuccauaauuucuuuucauucuuguuuaacaaaauuguuuuaugaaaguaaacuuuuaaaaauauuuaaugagugccuauugugaaacagguaugcuuuuaagcauuuuacauauauuaacucacuuauuauucauaacaaccuguaugagguagauacuauuauuccccuuuuuacagaugaagaaauugaggcacagaaagcuuauguaacugguucaaccgagaucacacaagugauggaaucaggaaauauauuugauguggugguggauauuuuagaauuuugacaugaacucuugguaaucugguuaagaguuuaaacucaacuaaauuagugugggucucuuaugauucagaaauuugucauuuuuuacacuugaaaaacuaaauuuuaucacagaauuuugauuaauuuuaugagacuuacauuuuacagauuuauauaugaauauuugacauaugcuaucucauaguuuuauuaacuaauuucuggcuacaucagucuagccaccuggauaauuccuaauugcucuggccaucucacacaucuuuauucaaaguauuuuuaccccucuugccaauccaaagucuucugauugacucuggaccuagagaccuauggaaacuauaauucaggucuaccuuuuuucucauccaugccuguucuccuuugucuuguuaauuuucauuuguuccuugaggcucuguccuuucacuucauucugucccugcaugcauugugguucaaacucugccaguagcuuuguugugaucucuguagcaccccugacuugcccucugcccgagauaugggagagaauugggaguuucaggguaucauuuuuaauguuaguguuuuauuagccacugaaaauaaccauuucuguaaucauuguucucuuuucccucauuaucacuagcuuuuuauguauaugagaggagaaggaugucucccucuuggggaccuuguccagcagagugaucagcaaaggaaggauauaaaagagaguagauccucauguuaucgaauaucuuuuuaucagaauuauggagauagaacauuccacuuguuugaccaaagaaccugaagauauuuauguagaccugaaaagauaacaggaucacaugggaaauacauaucaauuuuaauguaccuauuagaguaaagcaugucugauaaucucuaucuuuuuuaaagauucggaaaccccgaccucagagagaacgugcucagugggauauuggcauugcccaugcagagaaagcauugaaaaugacucgagaagaaagaauagaacaguauacuuuuauuuacauugauaaacagccugaagaggcuuuaucccaagcaaaaaagaguguugccuccaaaaccgaaguuaaaaaaacccgacgaccaagaucugugcugaauacucagccagaacagaccaaugcaggggagguggccuccucacucucaaguacugaaauucggagacauagccagaggcggcacacaagugcggaagaggaagagccaccgccuguuaaaauagccuggaaaacugcggcagcaaggaaauccuuaccagcuuccauuacgaugcacaaagggagccuggauuugcagaaguguaacaugucuccaguugugaaaauugaacaaguguuugcucuucagaaugcuacaggggaugggaaauuuaucgaucaauuuguuuauucaacaaagguaccuccuuuuuucguggaguuuuuugggggaugguauuuuaaaaguggucaaccuuggcauuuaaaacaaugaccuuggcauaauuuaaauacccuuucuacccacugaauuugaaacauacagucauuguacucugugggcaaaaaagacaggcaaaaaggcuauguuuuucuucuuuuuuauccccuucuuuugugauuuucccaucuguaguagauuagucuugagcugugcagccaaaauugagcuuagcucccuaaagucauggaaaaaaacugggcacuuugccuguuucuaguuugcguaguuagcuuuucuuaguugcaaaguguacuucuuauuaaaaucauuuuugucaauuauaugaauuaaccauuguuauaaaaaccacuguaauaauuguaccugcugaccuguuugguuccaccagcaauuuuguuagauucuuaugggcuugcgauaucuaacugccuuucagagaaucccagaacuguguuuguucuguaacaauuagcuguggcaauaacuuggguaaugggguaaaaacagccucuacaaacugugugccuucaucaguuuguccugggccuccauuuagggcacuuauacuuuagcuugaagacuuuaaaacucuuccauaauauugguagguauuuauuccguguaccucuucacuaccaucccaucccaucccacuguguugaguuugugauucugauuuaguugcauuucauucauguguauuaaagaauucuaugcuuauuuuuuccuaauauagucauaugcagauuaauuaguuaaacaggggaaugcuuaauuaguaauacaucuuccuagagaaaugucaagggugcucuuuuaaccuggucugcccauagguucagcugacuucaguuaaggccaagcuaccugcaaaaacuugaauugcaguccccacuugguucucuugauagcaaaugaauauuuuucaucuuucaaauagcaaaugaguauguugcaucuuuuuugaguacaaauuggcuuuauucuuggagcuaguuuuacugcuucugaugcacaagucaaacuuugucacuaccaccccaaagaaugcuauuuaaaggaaauucaagauaaaacugaucuuuucaaaaugaagacucuaaaaauauaugcauguauauauuuauauuuauuuuuuuccuuuuuaagagaugaggucucacucuguggcccaggcuggagugcaguggucaauaauagcucacugcagccccaagggaucuucugccuuggccuuccaaagcacugagauuacagucaugagccacugugccagaccuuuuaaaaauuuuuuguagagacagggucucacuauggugcccaggcuggucuugaacuccuggccucuagcuguucuccugccucagucucccaaaguguugagauuacaggcaggagccacggugccuggccaaaaaaauacauauauguuuauaaaucacuucuuuacuucuauuccauugcauuaaaaauaccuaaaaggagaccuaaguuaauuauaccugccuucuuucugcuucggauuacuuauugggucacauuuuggucaccaugagugacauauuucuguaucuagggguauucuugucucuuaagacauauuggcauuuuuuucuguguaauagagcacuuuaccaaaugcaaaugacuagaguucucuuacugugauauguauaaagaccagaaaauauuuuguuuuuauagaaaauugagugauacagguauauuuuuuagugacauuuaucaccuagacuuagacaaauacucuaccucacgugaucuuacugugcauuuuaaaauguaucuuggaauuagcugggcaugguagcacaugccuguagucccagcuacucgggaggcugaggcagaauuacuugaaccugggacgaggcagagguugcagugagccaagaucacaccacugcacugcagcccaggugacagagccagauuccaucuuaaaaaaaaauuuuuuuuggccgggugcgguggcuaacgccuguaaucccagcacuuugggaggccaaggugagcagaucaccugaggucaagaguucgagaccagccuggccaacauggugaaaccucaucucuacuaaaaauacaaaaaaaaaaauuagcagggcgugguggcacgcaucuguauucccagguacuuggggaggcugaggcaggagaaucacuugaacccaggugguagagguugcaaugagccaagaucacaccaugcacuccagccugggcgacagagggagacuucuucucaaaaaaaaaaaaaauuguuuuuaauuuuuaaaaaaaguaucuugaucacuuaaucaaauuucugauaaaggcuaagauaacuuaauugcaaucaaagaccauauaaaauuuaagcaaauuaugaucauuuuaagccaucuuuauaagcccaugaugccacuugccugguaaucaccuguuuuguuguuuuuucuuuugccuuauuuuaaagggaauugguaacaaaacagaaauaagugucagggggcaagacaggcuuauaauuucuacaccaaaccagagaaaugaaaagccaacgcagaguguaucaucuccugaagcaacaucugguucuacagguugguaugaaugaaaaguauauauagguccauuuugagaaauccuuguucuguucugcuauaaugugguagcuguguuucuaagaaacucuuaguuaucaaaaguaaauuauauuuaaaaaucaaaauauaaaagcaguuacuuuaauaggaaaguggguuaggggcuagagaacuuuauucauagcaaguuauuuuuuguacaagaauuaaaauaauaggguucuauaauuaaaaguguauagcuauaaaacucuauauguaucugaguaaauacaccaucgacuaucucucuuugcauaauaacagcuuuacuuuucccacucuauuagcacacacauaccauuuccuccuuuaccccuguuggaaacaaauggcugaugccaaagcucuugucauuauuccuaguugugcuagauacuaguagcugaggggccuagagccuaauuguccuaauguaaccuguuuucugauuagcagacaccaugaauugaaaaucaagccauguuauucuugcuuaaaggagaagugacuguauucaguaagauugugccuuuggaauguuuaacuuuuuuuuuuuuugagacagagucucacucugccacucaggcuggagugcaguggcucaaucucgguucgcugcaaccuccaccucccagguucaagcgauucuccugccucagccuccugaguagcugggauuacaggggcaugccaacacacccagcuacuuuuuguauuuuuaguagagacaaaguuucaccauguuggccaggcuagucuccaacuccugaccuugugaucuaccugccucggccucccaaagugcuggaauuacaggcaugaaccaccacgucuggccuuuuuuuuuuugagacggggucucacucugucaugcagaguggaguacaaugguacgaucauggcucacugcagccucgaccucccaggcucaggugauccucucaccucagccuccuagguagcugggaccacaggcaugcaccaugauaccuggcuaaguuuuuguacuuuuugccauguugcccaggcuggucucgaaccccuggauucaagcgaucuaccugccucggccucccagugugcugggauuauaggcgugagccauugcacccagccaacauaauuuuuuugagacuaacuuacuaaggauuuuagaguuucaauugaaugucugguggguuugguuuauguaacaguauuauauuaguaguauuucuguaauacugcuugcuucauauagccaucaagaaaagaguuaaguauuaacuagcguguucauuuggaaucuuaguuuagaagaaaggaguuuguuucauuuuguucuuuaaaaauuuguuuugaaucuaagaagcgacuauaguagaaaaaaaaguuaaacuauuuucugaacguacuuauagacccauauauggguuucuuuguuuucccacacugaccagcuggguguccuaugauucaauuugauucucacacuaucucccugguguuagaguccaaucccucagguuaagcgcucaauccuaugagacugcccccacuucagaugucaguugcaagucuggggcuucagagcuucugacugaccagcuauaaauuggagguucucgugacccccuccuuggguuuagucauuugcuagagcagcucacagaacucagacaagcccuuucuuuacauuuacugguucaugauaaagcauauggcaaaagauacagaugaacagccagauggaagagaugcacagggcaagguauauggaaagggcuguagagcuuccaugcccucucuggccaugccacccuacaggcaccuucguguguucagcaaccuggaauuucuccaaacccuguagcucagggauuuuuauggaggcuuuaucauguaggcaugaucaauuauuaacucagucuucagccccacuccccuucucggaggauggggggguggagcuuaaagcaucuaaucauagcuugguuuuucuagugacuagcccccaacuaggaacccaccaagaguugccucuuuagagcaaaaaacacuuauauuaugcaggaaauuccaaguaggagcucugugccaggaaccaggggcagagaucaaauauauguuucuuaucauaucacaauaucacagugaccaaguaauuuucuggauggaucaaagucuuaagaccugaagugguaaucuugaaucaguaguaacucaggcaaaccugugacugaguggcauaaaguguaaauauuuuuguaagggaaauuuaaauaagauucuaauuauuauaauagcaaaguaaaaaaaaaucacuguucacaaaaguacuugggcuagcuuucuuaaaaagaaaauaaugggagcugcaggacagggagagguaaugccaguggagaugcagcacauguuggauggggcauuuuaaacagccuuuuucaauauggaauugggaaggaaaguugaguuaaagaaaggagggagugaauagcaaaguccaguacuacauuugcaacuuguaucauuucaaaauacuuuauaaaaagaugaacuuacaaugucaaaggaaugaguagauggacuuagaagauuucauauuagccauaauugagaauguucccuucuuugaauauuaaaagaaucuuuuggccuccacuuuccaaauuagguaugucaguuuuguuaccucuuuacacuaaaugauuaguaauuugucugaauuuaaaugggauaccuaggaggaucuuuauuugaaaucagcaguuuccuaaggagaaaguaaauucuuccuauauuagacugaucuuaacucaaauauuaugcuuuuauuuuggauggagcuuguuuuucuuucuccucugaaaguuacugaauuuuuuuuuuuuuuuuuuuuuuugagacagggucuugcacccaaguugaagugcaguggugugaucuuaguucacuguaaccuuaaacuccuggacuccagagauccuccuaccucagccuccuggaguagcugagacuacccagugccugccaccaugcuuggcuaauuuauuuuauuuuuauuuuuuguagagaugagugucucaccuuguuccccaggcuggucucgaacuccugggcucaaacgauccuccugucuugcccucuugaaguguugggauuacagacaugagucgcugugcccagccugaacauuuucuuuuuauauaguauuuucauuguaagauuuaaucucugcuaugaauauuuccuuuuuuucuuaaguggaagguuauacuucuuuauaucuggaaaaaggcaguguuguuuuuugcuuaagcaggaacguagaauuuagguuguaaauuaagauugaaaacuuaauuuagggccagguaugguggcucacaccuguaaucccagcaguuugggaggcugaggcaggcggaucacaaggucaggaguuugagaucaccuggccaacauggugaaacccugucucuacaaagguacaaaaaaaaaauuagcugggcaugguggcgcacgccuguaaucccagcuacucaggaggcugaggcaggagaaucgcuugaacccuggaggcggagguugcagugagccaagaucgcgccauugcacuccagccugggugacagggagagacuccgucucaaaaaagaaaagaaaagaaaagaaaaaaaacuuaauuuagggacuggugcucuaaagcuuugagcuuguuugaaguuugguuaacagcugugguugauaagcauaccuugucuuuuuaagugaccauuuugcuuuuugugaaaauaacuucaguaguugaaaagucaaaauagaaacuuguucacccuucagaaaccaauugcaucaucucagcugauguuaacugcuuaaggaaauuauugagccuuuucuuaguaaauuucagggauauauaaaauguuuggcacugucacauuuuugucguuugaagaacuguacuuguauucacacuagauuucaaaguuauuuuccaaacccagaaaugcucaccuccucuuucuuagaacaugaacauaauacucuucaaugguuuuaaauguauauguucuuuggguaacuuucagaauaauuuuaagaaaucauguugcuuuauccucuauaagacaguaaaucaaaucucaucugcucuucauggugugauuauauuacccucaacacaaguaaauauuuuuuuguucguuuuuaagcaauuccauuuucauuuuugcccuuccuaguaguaguugaauauugacacuuuaauacuaaaguauggaucucggauccucagguuggucugggaggguagcauaucugcugucuuaguaaacauuuucgucaguguaaggagaagagugagaguaaagaaaggagccaauaccuuuauuugugauuacuauaaaucgauuaaccacagcucuaaaacaauauauuguuaucaaacuacccgcuccuucccaaaaacaaaacaaaguagugggauccuucauuuuggcuuugaacuaaagugagggaagucauuuauacauagccaagagcaaugaaaccagaaaauauaaagguuauaugaaaggcuuuauagauagagcuucuaucugauuuuauaggucuuaguggcuucuuccuauggcaagccagaggugauuaugauuuaggaaggaauacguaggugguccaggcacugaaaacauggagaacagcugcacugcagguaucauuccuccucaggcucacagaaugaaaucauuccugacaauguucuuucaaguuguguucuucaauuucaguuuuauccuuuccaaaaaugggguccaugugaguuuucuucaauucgcuuuuaaagaauuguacucuuuaaaaaucuuaauaguuuguuuuaccauuuaacaugaaaaagcuugauaauuuguuucaacuaguuuuccacgacuaauuauuuccagaguauaacagaucccuugauagucaaauuaaugauuagguuuuggucacauuuuuugccuucccugcuuuuccugcuuuuguuauuaauaacaacagcaaaacuuacauaagugcaacaagcacuguuaaccauuuuauguauagaauuaauuaaacucauuuguuaaaaugcagaauguguggcacugauugaauuuugaaccaauaauuucuaacaucagguggauaauaaaguuuauuuuuaugcauccuucagucccuucauucccuaauuauauuuaccuaaagauguuuaugugccuuuaaaacuaaugugucugcuguuuuaguuugacuuuucaauuuuuaaaaaaccaaucccccuuuauuuguauaauuuaggacccuuugugaaucccagucucagcuuaucagccuuuacaauuugaucuguuaaauaauuuauaugcuccugaauguuuagcauuuuuuaaugauuuuaauuaaaauuccaaaaguaauggguaagaaaagcaaggaauguggucauaucuuaauuacauagaugucaagguauccuuaagugaguuuuuguuuguguguuuaaaucauuucuuaggcucaguagaaaagaagcaacagagaagaucaauuagaacucguucugaaucagagaaauccacugagguugugccaaagaagaagaucaaaaaggagcagguuggcuuccuacauguagagaguuaaaacauuguauuuguaaauguuguggcuuacauuccugucuuaaaagaaagagaaacuuucccccacacugaguuuccuuucuggacuaucuuaacgcuucuguccugguggguuccagugcucaguuuuaauacagccaucccugugauucugcuucaagcauuuucacagaaaacagguuucaggagaugggaagccaguggugcaagacuuaaaaaauccuucacauuuauuuagaaguuucuguuaucagcagaaugauuucauguuuuuaugauuuuuauuuggaaccaucauugaguuccuuuuuuuuuuuuuaaguuugauuuuugguuuaagcugcugguauauauuguuuuuuauuuuuuaaacaaaucaauuuaauuuauauucuuauauuuaagaagcagauauucauagaugaucuguuuuuucuguuaauaucgcagauuuuuuggaauguuauuuucccaguggaauauucaccugauaucagguugucagauaaauaauauuuagguaaaaaaagguguguggggggguugcauuuugacugaaguguauuaaaccaguguaaucaauguaguaagauacauuuaaaucaacuuuucaaauaaaauuuuagaagccauucuucuuuaaauuaaacucacaaucagauuuuuucuuaauuuuuuuguuaaagaauauccauucuuacagccuaaacaccugcuagcaaacaaaacaaauucugaauagaauuaguuccaauaaguuuuauauuuuuuaaaccauuuauauggaagaaugugagcuuuucuauuuaaaauauuuccuucaugauuuuaaacuuccaaauuuaaaagcuaacuuugugggugcucugugguaucaccaagcaagugaaacaguuuuuccagaauauuuaacuaaaauuuaaauaguauacuaauuugucauucauuuaucauauuaacuuucauauuucauacuuaggaaauuauauuccaaaaaaucuuucuaagcucuugaaaaucuauaguuauucauuaccaaaaugaaguugugauuuugccagcugguucccaaaaucagucugugaccagucaguuuuaaacuaauaagcagaaugaguauaaaaagugggacaaauuguuaaugccacuguguuauaguuaguaguagaacaauaccagugauuguuuagaagauuuuauauuuguauuacuaauuguaucuuauaaaagcguuucuguuguauguuuuuuuaccuguuguaaaaaaaauaaaauuuuuuuuaaaaagcuuagaacaauccuuaaauauuuacaaaauguguuucaacauucauauuucaccacaucuuaaagaaacaugaaauucaauuuauagcuuaaacaggaacuccuccaaacagccuccuuucucuaauuccaaugguucaauccucaaauuaccacguguuuuacauauacauuggcagaauaacuucugaucucgcucuccuaauguaggaucaagacacuguucauaagacacucaagaaagugcuuuugcaauaucacaaacuuauuuucuuaaguuuguacuagcagcaaaaguauugagcuuccagcuguauggagcccuguagcacucucuacagagaggguccugauucccagcaacuuagcugugagugcaggcgcggaagggucuuaaaguggcgugaguuacauuaaccugaguaucauaguaaguaaaaauuuauccuaacgucuuuggggcgggagggguuuuuagcaacauuggggccgguugcagaaacaaccccucuccugccuuccagacacugaggaaaguauucuuguucucuucauauaccaagggaauggugggaaaagucuuugcuagagagcauguggcuguguguugucacuugauauucagcacaggcagcuaggauuuaaacccucccugaucuugagacagagaacuuuacccaaaagaugggacugaguucagauuucagauacauuaaucacucaucauugcuuagauugaugaaaguaucuuuucccucuguuaauaauuaaaagggaaaaaaauucuuuguuaaugcuguauuuuucuguccaaacagguugaaacaguuccucaggcuacagugaagacuggauuacagaaaggugaguuaauauuauaauguugcuuugcauuuccuugauuaaaaccaauuuuuaagaauuauuuguacuucauguauuuuugucugucucuguaaaucguuguugcucuucagugugaaauugcaguauuccccaguguucgugugugugugugacuuuuagaguugaucuuauucuguaccuccacgugaaaagucuuacuuguuuugguaaauuggagaacacaacguagacuugauacuguuuccaacuuuucuccauaagauucugggguuucacuggcuuauaaacuagggaugugacgaauccacuuuuuuugguauucgacugaauaccgaauaguagcuauucauguuugucaaacauggacuaugacaaaucagacaagacaagcugauugaaaaaaucuugccacauuuauuuuuacagugcuguaaaaucuuuuuguaaauuaaaaugauucauagcauuuauggccacuauuagaugaccuuaugcgaaucuauuugagauaugcacaaaguuuaagaaagcuuaaacuuauaucuguauuuucugugugcaauuugacuacaguacaaacuccauagcaugauucgugcguuuuuggugagaucaaacuguauuuaauaccuguaguuuacucugggcaaauugcauuauuuaaaaauaaaauaaaacaacagccucucugcauucucggggagaagucugcagcgauggucuccguggagauccucagcagaacugaacagccucucggagggaacacugcuuggcggagcuccaagaaaagacaucgcgaucgcugcgagauuaggaggccugauugcguuguguuuccaccauuccacagggucggcggaccggggagugcagggcucugucagauucagugacagcuccgucuccgcagcgauugaggaaacuguggacugagauuccuguacaauuucaucccagaaacuccagacuuguagucuccaugcaagauuucuuugucggcggcuugauaaacaguuucuuuguuuucgauuuugauuucgccaaucaucauuauuggcauuuuccugccugguuucuucuucaagacucugaacaauugcuuuaacagucaaaugauuuuuuuuuuucgguuugagcuggauggguacagcuuaaaucauggguccagccuaaaaaccaccauuuaacuuacacugaucaauuucaacauggacuguuuuugguuuuuuguuuuuaaauaaagcaucauuaaugcacaucugcagggguuugccaaacagcccaaacuguauacauuacaaucauuaaaaguucuuauuuuuuuuaauauuagugccguuaucauggagaacagcaugacagcugucuuuggcagucugucauuuuucuagcauuuucagaaacucaucggaaauggcgguaccuguguuucccuucgaaagccucucaguacagcacuccuguuccucuguuaaaacuccuuguuaauccagugaucuuuuaggccaaggaaauauuuugugaugguguucuggguccauacaccagcaaugaaggagauagauuuguguacuuguguuuuuuaaucagcauuaacaugggcaggcacccucauuuauagaugucaggaaacauucagugaaaaacuuguagaaugggaugugauaacgagguuccaguaaucugagcagucuaacgaggcccaccuccuccaccacagaacguggcuauguuccaagugcuacucucacucagccuguugcggaucuucauggccucaggagacuuguuucuccaugggcucuucuggacugcacacuuccaccauagcuugcuggguugaucuagaugucuguuuguuguauggaaauuuugggggaaaaaauccaaaacacaaacuguggguugaaauauuaaccgucuccuugguuccuugguauucaccgugccugaucugcacauuucaucguggcuguuucuguauagccuauacugcauuagcccaagagauuguugcuuuguaacuuuuugcacuauuguuuuggcuggauuuguauuacacacaguuuuaaaaaaaacaauuccacacuauucucugccuuuuuuuuccuauuuauuucuucccgcacaaauuccacauagaggccuucccauccagcucuacgugauuuggcugcacuugaacacugauuguccauuuacagcccucagcaaugugccuucuaaauggcaugacauauguagaugugcugcagcgcuuguuaauggucacaauaaaugccacuucaccaaggaagucucagaugaacaauuaugaacauccaaauuuuauuggggggcaauaaucaacugaauugcaaaauuugggggaaaauggcacuauccguguacgaaucgaauacaaaucaaagauuugucacaucccuaauaaaaacaagauggagaugucucugcaaccauauuuguaagcua

SEQ ID NO: 191853 - RNA, 6089 nt, Homo sapiens
uuauuugaauaucagguuuacugaaggaaaaagauacauugaaaauauaggaacauacacauaaaagacaaugucauauuuaaaguauaaucacaauaaagagaaagggagcuguagguccuauggcauccauucugaugacaucccauaauuguuccuuauauuccauugugaagaaggggcagaaaaagauucaucuguccuucagaugacgauaccugucauuuuucuuuucuaccuuagucacuuggcaguguuggugcauuugagcagaucuucagucaugaauggaaggaaagaagcucacaaguacaguuauggucaaaugagguagaaacagucaucuguuaguagugcugaaaccacacuccugaccauuuucuucuuuauuauuguuuucacuuaguaauucaacaaauuguuuaugcccacgguguucaaaaugcacagcaguaccagauggcuggacucagauaagaugcacacaaaagugauaaauuacccuagauucgacauuuuccuauuuaaggcuugauggaauugucaucagagaagguaaacagaaucaaaguaauuuaguuggccaugcccuagauuuuaagauuuugagcuauaugaaauggaaauuaaguuuugauaaugaacucuagcuucugagacaagguggggcuauguaaaggcuucuuugugacaagauccuucuaagaauggcauuuaaauuaaauguaaaaacacuguagaucuucagauauuaaucugauagaccagauucauaagguguuggacaccuuugaaagauccuuuuacuagaacauguggcauacaguaguggaaaagaaccguaacuccucaagauagaugagcaggggcaaaaguguguaaucauuuggaggcagaauacaguguggcuuauguccucacuugcaccuuggaaggggaaaaaaaggcuagaauuucuugucuugugcaugguccgguuaggagggcuaguucaccuguucucuauugagauagauucaauuuuuuuuuuuuuugagauggggucucacucuguugccuaggcuggagugcaguggugcgaucucggcucacuggaaccuccagcucccagguucaagcaauucuccuaccucagccucccagguagcugggauuacggcacacaacuccuggcuaauuuuuguauuuuuaguagagacaggguucaccauguuggccaggcugguccugaccucaggugauccacccuccucagccucccaaaguguugggauuacaggcaugagccaccacgcccggccagauucaauuuuuaaauaucaaaacaauaagaauccccaggcuucugugcaguggaaaguacaaguuugucuugaaaugguuuauggcauucugcaucagucagaggaggauaauacugccgauagcagacauaggcaaaugucauuccaaucauggauccaacuaguacaucugaagagaguggaaacaaggucuucucuuaauauuaggcuccuaaauccuauuacauacacauagcauagaggaccuggcccuccaggauacucuacuguggggcuaaaauaaccucaauuccagacuuaugauuucuaaauaaaaucuuuuuauucucaauuuuaucauaguuacaguauuaucauugucagguugcuuucugaacaccaaaucaaaacacaucuuaaguaaguauaauaagcuuuguucagaguguacuaaauuagaauuuuucuaacucagaagaguaacaaagguccacuuauugcuauucaucugcccauuuucaccauuuaaaggguccuagaggaaggaauaaaguauuuuaagaguugcuucucgccgggcacggugacucacgccuguaaucccagcacuuugggaggaccaggcagauggaucccgaggucaggagauugagaccagccugaccaacaagugaaacccugucucuacuaaaaauacaaaaauuagccgggcgugguggcaugugccuguaaucccagauacucaggaggcugaggcaggagacuugcuugaacccaggagguggagguugcagugagccgagauggugccacugcacuccagccugggcgcagagcuagacucugucucaaaaaaaaaaaaaaaaaaaagaguugcuucucuuugcaaaaaacuaguuuauuuaaaaauuuaaaauaggguuccugaggaccugugggcaauaccuccagcguuuuuuuuggaauugugucagguucaagccauucuccugccucagccucccaaguagcugggauuaaaggcgugugccaccaugcccagcugauuuuguauuuuuaguagagauagcguuucacuguuggucaggcuggucuucaacuccugaccucaggugauccaccuaccucaccuucccaaagugcugugauuacaggcaugagccacugcaccuggccucaauuuuuguauuuuuaguagagacgggguuucaauauguuggccaggcuggucucgaauuccugacuacaggugauccgccugccucagccucccaaagugcugaggugugagccaccgcgccaagccagguguucuguaauuuggauauuuuacuuacuauagcauucagcuuaaauuuguuugguuuaauuauaauuuuauguuuucuugaauuuuacuuauguuuuugaacaaaaguccuaugacaaugaaccugauuuuuaagagaguaaauugaacuuugagguuuuaaauuuccuguagaugcaguuuaacuugaacuuacaaugcuucaaauaauggaaaaauuaggauguuuaucuuugguaaacucuuuuugucuuaucuuuccuauaauuuuaaauguacuuaguacagaacccagaccauccauacucauuaauuuguucauucagcagauauuuaguaagcaucuccucugugcuaggugcuaggaauaaaaugagugaaauaugcaagcuuccauagccugaguacuuugcuuaccuugccagugaugcuuguagucacaugugcgggacagugcaaucacagcugcaaaaaguagaggugacagaaaggcacagaaccuccaagauuucccacggccuuguggugugaagcaguguaacuucccugccagguagaaggacgcaaaggccagaccagcaaaugcaacuggaacaagaaaaacuuuuaagugguuugucuuuuaaaggaagcuaccucauucauccccacauaggaggcuaggaagcaugaguauguuuuuauuuauuuauuuuuugagacagucuugcucugucgcccaggcuggagugcaguggcaccaucucggcucacugcaaccuccaccacccggguucaagcgauucuccugccuuagccucccgaguagcugggacuccaugugugugccaccaugcccagcuaauuuuuuuauuuuuaguagaguugggauuucaccauguuggcuagccuggucuugaacuccuggccucaagugaccugcaugccuuggccucccaauugcugggauuacagguaugagccaccacacccggccaugaggguguuuuaauccuuuuuuguguauacuuauaguguaagucauugugaaggaaagggaaacaaaaagaaaaaugaaggacuuagugccccaaaguuaauguuuuaucugaguauaguuuucgguauacuagcuauauguaucaacuuguugaugcuuuaguuuccucaucuauaaaugggacucauaaauacaauaguccccaccucauuggauuauugugagcuauaauuagguaagaaaugaaaaugcuucaaaguaccugacacauagaaacucuucguuaaagguauuuuuauugcuaguacaagauugcaggaucuaggcaaauaauauaacaauuaaaugugcaaaucucaugaagguaaacuaccuuucuguucuguaauauuuacccaaauagucaaggcucagacuuguuaaacuguggaguuacuaaagaaggggggauuuuccaaauuguagaaacaagaguagucagauuuucccaucccuacuagcuuucuagguuaaauucaaugaugugaaaacaagcauaggguagaguccauaugauauucauacaggaagaauguccacuggggaagcucuuucggcccucauucaccacguccuuauccccuguacacaucaagucagaaugggcuagcccaucagggaagcagcgguagaagaaaucugggcguggccuggaagaaagcagcaugguuggaacguaaaucauuaacuccagaaauuauuuuucaguuguagcagacauuaauaauccuguuaacuauuggucaaauagugccccaggcaaaauaagguaacuggcuuaguauagucaccacacuaagagaaaagccuuucaaggugagcauuuaaauuaggggaaaaacgcccauuccagcacaugauuacuuuuuagggcaaacagcaaaugacacugcagcuucaggaggugcucaagaggacacugaccgacugcuguggccguuggugggaaaugcuguucaggcagaaaagagcccaggugucaccuggaggacugagguauggggaagggaguaagcguugaaugacaaaagaaaaaucagagugaagauaaaggagaaaagaaugagaaagacgugugguggacaccauuaaccucucuguucugguggguaagggcugaggcagaugcuggggugguuagcuguugucacuuaccucccuacgaucaguuuuauuguguugguaaagacgccauucagagccagggcaaggcuggcagcugcaaagcaaagccauuaguugaaaggaucugucuaggaggaaagguauggucauggccucguuaugagagcagccgugcuguuucugagauggauagaauccaaccaggccugggcacaaaaauaauuaggguccucagugaucacucuuuuguagccgagaacuuuuguacuaggccaaagacauuucugagguacaaauaacccagugcauuuaggcacagggcugccugccguguagccugcguaaccaagucccugcagugcuauuuuccucucccgcggggauagaguuccuuuaggaaugcagaacucaguggccuccacacaggcucaccguggcugaaucccacaacgaccuccuagguucccagcacgaagaaaccggcccgaaagggcuagcgcucacccaggcaggcuugucugcugucucuugugucugccuucuugagaaauuuggccaggaagaucagagacaguggagagagaaaugcaauaaccugaaucagaaugucagagguuaaaaacaauccaaaaaaaagccacacucgugcuccuacaggaaagagggaugugacacagcaggacucacuggagcuaacauaaggucucugagugcgcguaaccgggcgccaggcagcgccaccagugaacagcagcgcccgugcggcucgggccccgguaccucaggcugaggcacagagcgcccgggaaaacguugucucagcccaaagaggcucggacacccuccucucucaaucaggaucuuaaacacucgagcccuaggaggcggaacccagcgcacagcagcggagugggcagugggucccuacaaaggccgucucgggguggaaaacgcacaggugcccgcgggaagccgggucauggggagggaggaaagacgaucuuucuccacgcacaaacaucggcuugguggggaaauacuccgccuccacguagggguuccgguagagccacaucuccuccggcuggaugagucucuggaacggggggagcagcuccgucacccuagaggggaacaaagaagcgcagagcaggucgccuggcuuccuccccgcuuccccacugcccgacccgccgccccgugccgcccgccugccugggaagcggggccgcccgggcccggccguggaucuuucuuacaggaaggccgcgaacagcgcgagccgcacgcccacuucggccccaaaggccaccgccgccgccgccuuccccauccggccgcgagcuccgagcga

SEQ ID NO: 191854 - RNA, 13168 nt, Homo sapiens
gaaguggguaaggguaauauggaggagcuuccggcagcccccggcggcugaaagccggggcagaagugcuggucucggucgggauuccgggcuuggucccaccgaggcggcgacugcgguaggagggaagagguuuuggacgcgcuggccucccgccgcugugcauugcagcauuauuucaguucaaaaugaacuauaugccuggcaccgccagccucaucgaggacauugacagugaguaguuuaucuccucccgguggagcccgggguuagacccuuccucccgggcgggcgccucuuccgaagaagcuuguagaaugagucccgggcggggccgguguguucugagcucaauccgggcguuccgcgucgauguccuccacagcugcgguacacaccgcuugcccacccaguagccugcugcuacuucugccccucgcagccuccgccagcccucuagcuggugagccccaagcgauggaacucauucuugcuuccguggaucgcggcagcagaggcccgaacacgaaagaagcccggggagggggggggcuucucccccguccacuccugccugcaguauuucgaaguaucagcguguuaccgguggauggaucggaauaccuagagagaggauucauuaaaaagcgaaaauauuaagacagcggcaguuggacuuaauuggcaguaaauguaggcgcucuacgguguggccauuugcuagcuuauuuuacugugagggucauuagcaccuucagguuauuguaguagagaccacuguuagacaugguauugacuuuucuggaaagaccaaaucacuugcaaccuuuuuuuuuuuuuuaagacaauuuacuuuugcuuuuacuaagaagaccucccuuauuccugguuuuuguccggaagaggagcucaguccuauacaaaagcgaaaagaaccgucugcaguuguucuggcuuuccuuuuuucuaaauuccgucugugcauuauuccucaagcaacauuuuuuauuguuuuaaucaugugaucuuucucauuaacuuguuucaagaugauuuacacauaguuuuaaauaaguugcaaucgucucaguuacucugugaauacgcaauuuagaaucuaugguuaaaauuucauuuuacgggccuggcgcgguggcucacgccuguaaucccagcacuuuggggggccgaggcgggcagaucgccugaggucgggaguucaagaccagccuagccaacauggugaaaccccguuccuacaauuagcugggcacuauggcggugccuguaaucccagcuacucgggaggcugaggcgggagaaucgcuugaacccgggaggagaagguugcagugagccgagaucgcaccauugcacuccagccugagcgacagagcaagacuccgucucaaaaaaaaaaaaaaaaucauuuuaugguugacagaucuuuuuucuuuucuuuucuuuuuuuuuuuuuuuuuuugagacagagucuugcucugucgcccaggcuguagugugcaguggcgcgaucucgacucacuggaaccuccaccucccggguuuaaacaauucuugugccucagccucccaaguaacugggauuacaggcgccugccagcacgcccagcuaauuuuugcauuuuuugguagagacgagguuucgccaugcugggcagucuggucuccaacuccugaccucaggugauccacccaccucggccucccagaguacugggauuacaggcgugagccaccgccuccggccgacagaucauuuuuuuaaacacaaauuacuuauugugcuauguaagggaaauguaguguaauuggacuaaauauauauuaacaucuauaugaaccuguuacguguaacaggauguuuuaguugcucgaggaugcucuuuugcccucaucucuccuuauauauccucuaacacauccugccauuuuacuaaaaaucaguuuugcucuuugguccucuaaccccuaccucuuuguagauuccagacccccuacuuuaugaaaacuuugaagccauuugauaugcacccuuugcuccccaacccuaacacacaguuuccuccuuguguuucuguauuuucacccauccuuuaauuugaguaggaaggauuccucccuuuuugucugucuguuguuacugucuccucucacugcuucuggaaccuuuuuucguuguuagccuuuuucuuuuauauccucugucuccccaaccccugcguucuuccccucauguguuacugucuauccaucucaaauauuuucuccguucucuucauaugcccaucccuuuuuucauaucuuuauccccaaaccucgagucauuuucauuuugucuguuucuugaucaccuucaauagacuacuuacauuacuccugcaaucuaauuuuuauccugaaauuacucaagcugcauucuucaaaguuauucgucuaaggucuucuucuguguucucuccccuuugcagcacugugauacucuccccaccagauucuuuaauucucuucucuugauuucucuaacaacugguacuuggugauuuucuuacuucucuggcucuuacuguucuccaaaauagauggucacuuggauuacauguggccuacuucuuuaaaucuuuaguagaucuccuguacuuuaguuuuuuauaucaccucuuuguagauuuauccaaaauugcuuucucuaaucuugaugucuuugguuuuccagucuuacuguuuccaacuaucugcguguguuucuauuaaguguccugauagcacuuuagaaucacaaagagcuaauaaccuucacccugagcuugcugcuuuuauucccaacucuugguaaauaguuuugugaugucucauaaaacuccuacaucuuuaccucacaucuucagcaccccacccucucacacauacccacuuauacaaacucaguaaacagacuccaucacuuaauguuuucuuguucccuaugaagucaaauccagaugcagccugcgcccaguacuuuucugacuuuaucuacuguucuuucccuucacacccucagcuuuuagcuaaacauggauguauagcccuuuuuuccuccucuuuaauuuacagauuuccuucuccccccccgcccccuuccuaucacucuucuugugcccuaaaauuaucuaccuuuuaagguccaacucugauaccuccuucagaaauacaguuucucucucuguagucucauauaauuaagauuugcuuucugugguacuuauuuauagcgcaaggaagaguauaaauuccuucagggcagagucacuguguuuuuccucuguucugcaucuagaaaguacuuuaggcauggaaugaaagaaauuuugcugggugcgcuaguaacuggcuuauuuucauucuucagugucagcucaaagucaccucuucagagaggcuuucccuugccacccuuccuucuguaaccacuucucucccuucaucauacugccuugcuaguuuauuauuccauuguccuaaucacaauagguuauuuucuuauuuauuuguccuccuccaacaugaauauaaauucauaagguuggugacuuucuaagucucauucucuacuguaugucuagaccccagaacagcacaugcccccucaguaaacauugaauuucugcucuagcuuauuauuagucuucauuuuaaaugccugaagcauuguguuuuuauuuaaagccuucuaugguuacaaacaaaaugugagauagaagcucaucuuuugaggacaaaauaauucuacaaauaagauaauagucaucuagauuaaauuugucaauuuacagauauaaaaacugacaugacaugagaugguuuaagugucaaacauaagggucuuuggcuaggcgccaugguucacgccuguaaucccagcacuuugggagguggagguggauggaucaucugaagucaggaguuugagaccagccuagcuaacauggugauacaccaucucuacuaaaaauaugaaaauuagccaggcaugguggcaaacuccuguagucccagcuacuaaggaggccgaugcaggaggaucgcuugaaccugggaggcagagguuguaguaagccgagauugugccacugcacugcagccugggugacagagugagacucugucucaaaaaaaaaaaaaaagaaaaaaggaaaaaaaaaaaaccaacauaagggucuagagccagcuagucaggcuuccuggugccacgcccuguccuuuucccacucugccacacugcucugauucuuuucacuacugauguuaucuaaauccgcguugcugugcugcuuuuuucaguuuuccaaugaacuugaacuucacauuaaaugcauuggccgaggaagugguacagcuuaaacuguuaauuauuauccuaaauacucgcugaacuugucaguuuucauuuaaaagauuuuuuccucucuccccagaaaagcacuugguucugcuucgagauggaaggacacuuauaggcuuuuuaagaagcauugaucaauuugguauguauuaauuuauggacaucucuuauacucuggauaauaacagcagcccauugcauuuuuuguuauuuaauauugaaauuuaucugcaacuuuuucacgugugugaccuaguaggacugauuuuagugaguacaucauuguuuucuauacauucagauuaggugguucaaagcuuauauauauuuccaagcucguuucuaaaacuggcuuucaguagaauccccaguagggggagccaaaugauagaaauaaacucaguccaccgaagaggcuuguuuuguuuuguuuuguuuuuuguuuagacgcgcucucggucacccaggcuggagugcaguggcacaaucuuggcucacugcaaccuccgccucuuggguucaagugauucuugugccucagccucccaaguagcugagauuauaggcuccagccaccacccccagcuaauuuuuguauuuuuaguagagacgggguuucgccauguuggccaggcugguuucaaacuccugaccuuaggugauccacccacccagcugagcugggcaguuguucugcuccucaugguuuuaggacagucccuuggugucuagaaggugagucagcugguuugaaggagcuucacucacaugucuggugcaucaguggggacagcuggaaggcuggucuuagcucccauagugcugagauuauaggcgcgagccauugugcccggcccaaggcugcuuauuucuacauuggcaggguaaaaugacuucaaagcaguuccggaagugaagguaaucccucccuagccaaugaaaauuggguagaaggcauuuccuuuauuuuaaggaccccaacauuaagcuuaauacuuuacauauagggauacauuggaauaagaggccucugucuuuguuucgcauccugcauuuuucuuaaguuaaaagauuauguuuccuucuguuucaaggaacuucauguucaugcuaacauuuauuggauaucugcgaaaucacuggauuugagcaugaggaagaaacguaauuaaaacacuuaaaaggauuauggaagauaugaacauagauuucuccuuuacuucaaauaggacaaguaguacuaauugaaagaggaaaaauaauuauuguuaacaaauuggaguccugauucuuaagucagauucaucagaguacuuugagggaaggguaguggcuauuaaguugacuuuuagauuacaaauauaguuaucugucaaggugaaaaaauagguuuuugcuguaucauaacccauggauaccugcguugggucaaaugaauccuaauuacuaaaagaaaguugaaucuucagcagaucaucacauacacacccacacaaaaagaaaagcuguuucuuuccagaaaacaaaaguuuugaucucugugguuguuuaggcccaaguuuuccaaguuccuuauucauuuauauuuuccuaugguuuuuuuugguauuagcaauuaacugauaaaggaauuuauuucucuuauuucugcugucauucauguauuagcccaacauaaucccagacaucuccuaacugguacgucuuacucaaugaaauaggagaagauuauuugaaauuuuagccuuccccagaauuagaaagcuugggggcccggcacuguggcucacgccuguaaucccagcacuuuggaaggccgaggugggcggaucacaaggccaggaguucaagaccagccuggccaauguggugaucccugucucugcuaaaaauacagaauuagccgggagugguggcaggcaccuguagucccagcuacuccggaaucugaggcaggagaauugcuugaaccaguaggcagagguugcagugagcugagauggcgccacugcaguccagccugggugacagagcgagacucggucucaaaaaauaaauaaauaaaaauaauuagaaagcuuggaaaucauguuuaccuaaaucuuuucaaaauaacugauuauugaguuaugggccuuuacccaguaguuuaaacuaaauaucuuugguuuuucccuauacacuuacagcaaacuuagugcuacaucagacuguggagcguauucaugugggcaaaaaauacggugauauuccucgagggauuuuuguggucagaggagaaaaugugguccuacuaggagaaauaguaagugaaaacuauuaagcugcuguagaucuucauauucaugcuaguuagacuucuuuuuuugucuuuucaaaagagaauaaaaauauucuccacauuuaucuggcuucuccuaggcaacuaccaaauuaauuuagggaagcuacagagaauacuuuguuucagugccuuaacaaauguguucauuaauauauuuguuuaauagcagaaaauugacaaagcuugauuuauauaugcuggggaaggugugucuuacauacguuggaauauuuugcagucauuuaaacaauugguuacaagugguuuuucauggcauaaagcuaaugcacaguauuucagggaaguacauauugccuguacaguacaaugugauauccauauuaguaaagggggaaagggaaagaguagcuauaggaaaagcuuuuccguuaccuaucccgagaauggaguucagucuuacuuggauccuuagcucacagccagggagaggguauuuugguaucugugccagaaagaccagcuggcaggugaaagguuaaaucagauuuucugagguauuguugcuguaggucuucgugugugcagacauacacacacacaccccuacuagaaguacucagauuuuuuuuuaaaguaucuuauuuaaaaccuuugauuucaucuuguuauuucugauuauuggguuugcaaggaaaauaaaaaucucuucaagaguaguugaaauuaaggguugagccagcacugucuucuuuuuucuuaccaaaaacuuugguguuugcuuaauuuuuaaaguuuuuaauacuguuuucuaaauaccuagccaugucuuaaaucaguuugcagaaaucuuuagagugguuugguuuguagccauuuuuaacagccauuugagaaagcaaggagauaauucugcuaggguuggguugguucagagaccucauauuggaaauagcuagaaaugacuaauccagacuaucaauacugcccaagugaaauauaugaaguauaugaaauauaugaauauaugaaauauaugcugugaaauauaugaaauagcuuuuucuuacuuauaaaauauuuauaaguaauacuuauaaaaauuuuucuuauaaaauauuuuuguaguuuguacuuuuaguucaguguaucauuucuugcauguuuaagcagcagaaauuguuuuuuguuuuuuggguuuuuuuuuuuuuuugggacagaguuuugcuccuguugcccaggcuggagugcaauggcaugaucucagcucacugcaacuuccgccucccagguucaagugauucuccugccucagccucccgaguagcugggauuacaggugcccgcaaccaagcccagcuaauuuuuguauuuuuaguagagacgggguuucacuauguuggccaggcuggucucgaacuccugaccucaggcgaucuacccgccucggccucccagugugcugggauuacaggcaugagccaccgcgcccagccaagcagcagaaauuguuaucuucuugugucgcauaaaggcugaaacaaggccaggugcggugccucacgccuguaaucccagcacuucgggaggcugaggcgggcggaucacaaggucaggagaucgagaccauccuggcuaacacagugaaaccccaucccuauuaaaauacaaaaaaguuagccgggugugguggcgggcgccuguagucccagcuacuugggaggcugagguaggagaauggcaugaacccaggaggcggagcuugcagugagucgagaucgugccagugcacuccagccugggcgacagagcaagauuccgucucaaaaaaaaaaaaaagucugaaagcaccuaguaccaugguacccauggggagacacuacaugacuguaaaguagucugccaguauuuuuuuucuuccagagauggggucucacuauguugcccaggcuagauucaaacuccuaggcuuaggcaauccuccugucucagccucccaaguagccgggacuauagguacaugccacugugcuugauacugccaguauauaggggagcugacccaucucugcauggugggguuauagaugauuuuuaaaaauacuuuucugaauuuaauuuugaagaggcaacguaucagaggaaaaaacuuaaguuaaaauacuggggugggugcaguggcucacgucuguaaucccaguacuuugggaggccgaggcaggcagaucgcuuaagcugcaagagaccagccugggcaacauggccaaacccugucuuuacaaaaaaauacaaaaauuagccaggggugauggugcacaucaccagucccagcuacuugggaggcugaggugggagauucaccugagcucagggaggucgaggcuacagugagccaugauuguaccacugcacuccaaccuggguaacagagcaagacccuuucucaagaaaauauucacagauaugcuucuguuuuauaguaguaaacauagcagacaugcuuuuuauacugguuacauuggcacaaaguuacaucuaaguagauguguguguuugugcagagaaagaggugaacguguuuguucuugaaguuuaauuguuuccuuggaucccuuuugugaggaaaaguucccuuuuuuaaaaaaauauguuaugguuuggaugcugcagaaguuuuacagggguaccacuacagaaacuugguuccaggaaugccugcauuguuaugugaaucagcaaucaggagaaauuauguaccaaccccagaggaauucauacauagaaaucaguuucuguaaacacuauauugguuaagaaaucccugaauucugccucaaggacgaugaugaugacacagcauuaaguaauaagacuguugggaagaagcagcaacagcagcaugaauugcuuagcaagucacauacugaaaagcccaagaggcagugcauuaggccgagaacacugugcucucuuuagcugcuacucauggguugggagggcaggugguaauauauacuuugcugggugcuguuaacuuuggaccuagagcagggcuugcuuauguaauuuguguggcuuucauuguaacuucuguggugagaguccucucugacugauaaugccacugccugugaguucugagaccuuggcagcaugugguaauaguaugcagggcagagcaucuggagaagugugucaguaccgucccaaacuuuuaucauugaaagucauagaggaggguaagaaacaggaauacuuuguauaggcuuuccaucuuacaaaaacaccaaauaauaccuguacauucauuuuaaggacaauaaacugaaucuauggacagugagauacuuuuuuagcaagguucuucugcauuaugacauugguuagcaaauguuuauaagggccaggcacaguggcucacacuuugggaggccaaggcaagaggaugcuugaggccagaaguuugagaccagccugggcaacauagcaagaccccaucucuacaaaaagaaaaaagauuuaaugccagaugugguggcacaugccuguaguuccagcuacuuaggaggcugaggcaggaggaucacuucagcccaagaguuucagaucauggugagcugugauugugccacugcacuccacccugggcaacagagcaagauccugucucuaaaaaaaugaaaaaugugcucacauuggcagcacaucuacuaaaauuggaacaacacagagaagauuagcacggccccugcuuaaggaugacacgcaaauucaugaagucuucuauaucuuuaaaaauaauuaaugaaaaauguuuauaaaacauucaaaaauaaaaauauuaagcauacuaugccacauuuaagugaaaaaacgaauuaaagucaguauuugcauuguggguuuuugggagggguuuguuuuugaggcagcgucucacuuuguuaucuaggcugacugcaguggugugaucacagcucacugcagccucaaacuccugggcucaagugauccuccccccucagccucaugaguagcugggacuauagguacacguuaccacgcccagcuaauuuuuuauuuuuuacuuuuuuuuuuuuuuccuuuugagacagagucuuacucugucgcccaggcuagagugcaguggugugaucuuggcucacugcaaccucugccuccuggauucaagugauucucgugccucagcuucccgaguagcugggauuacaagugugagccaccacaccuggcuggguuguuuauuuuuuuuaagucaguauauauguagaaaaauuguagggauauuaucaaaauguuaauccuccauacuggaauuauggauaauuuuuaaauuuuccuuguuugucuauuuuccauauuaucuacgaugaguguguauuuuuuaaauaaggaauuuuuuauuaggcaacaauuuuuuguuuuuuuuugagauggaguuuuacucuugucacccaggcuagagugcaauggcgugaucuccgcucacugcaaccuccgccucccagguucaagugcuucuccugccucagccucccaaguagcugggauuacaggcaccugccaccacgcccagcuaauuuuuuuuguauuuuuaguagagacggggguuuugccauguuggccaggcuggucucgaacuccuggccucaagugaucugcccgccucggcuucccagugugcugggauuacaagcgugagccaccaugcccaaccuaagcagcaauuuuuuaaauaguggagaaaaauauugggaccaaauugguuuaguaaccuaaauggucugccgagguucucccuagaagacuuguugccguaaagggaaaaagagucuuguuacaguuuagaucuagacuacagagcugguacgguggcgcacaccuguagccccagcuacguaggagguaaaggcaagaggaucccuuuuuauuuuugucuuuuuacuuuuuuugagacggucuugcuguugcagaggcuggagugcagugacacauucauggcucacugcagccuugaacuucaaccucccaggcucaagcaguccuuccaccucagccuccugaguagcuggaacuguaggugaacaccaccacaccagcuuuuuuuuguuuuguuuuuugguggaguuaguuagggucucacuguguugcccaggcuggucucgaacuccuaggcccaagugauccucccaccucagccucccaaagugcugggauuacgacugugagccacuccacccguccuuaaaauaauuaaaaaaaaaaaaaagucuaaggccacauugccucaauaaccucccucuuggauucucugcagugggggagauagcugucuauaagcagcccuaauuuuuuuuuuuaaggaaauuaaucguggacuaauagaaaauuaauccugacuaauaugggauuuuggaucacauaaagcucuguuauacaaauacuuauuacugccuauaaucccagcacuuugagaggccaaggcaggcagaucaugaggucagguuucgagaccagccugaccaacguggugaaacccugucucuacuuaaaauacaaaaauuagccaggcgugguggcacgugccuguaaucacagcuacucaggaggcugaggcaggauaaucgcuugaacccaggagguagagguugcagugagcucagauugcgccacugcacuucagccugggugacagagagacuccaucuugaaaaauauauacauauacugaucacuauuaaccucauuguaaguauguauccuauaguaguguugucaggcauuucuuugaaaaacuuaccggucccuaggagaaggauauuucaguuccugucacaguuaugaaaaauaaucugagccugauagaggaauccauuugccuugagaucugugcuuucuauucuuggucuucaggugaaguuuucaaaccugucucuuuuguaggacuuggaaaaggagagugacacaccccuccagcaaguauccauugaagaaauucuagaagaacaaaggguggaacagcagaccaagcuggaagcagagaaguugaaagugcaggcccugaaggaccgaggucuuuccauuccucgagcagauacucuugaugaguacuaaucuuuugcccagaggcuguuggcucuugaagaguaggggcugucacugagugaaagugacauccuggccaccucacgcauuugaucacagacuguagaguuuugaaaagucacuuuuauuuuuaauuauuuuacauaugcaacaugaagaaaucguguagguggguuuuuuuuuuaauaacaaaaucacuguuuaaagaaacaguggcauagacuccuucacacaucacuguggcaccagcaacuacuucuuuauauuguucuucauaucccaaauuagaguuuacagggacagucuucauuuacuuguaaauaaaauaugaaucucaa

SEQ ID NO: 191855 - RNA, 8383 nt, Homo sapiens
guauuuuuaguagagaugggguuucuccauguuagucaggcuggucuccugcccucaggugauugccugccuuggccucccaaagugcugagauuacaggcgggagccaccucacauaaauucucuugacuccugggaaagggaauuugcuuucaccauauuaccccuucuuccagccacuucucccagaauacuaaacuuuuagccuguuuaagcagagaaguugccagccccaaacaaaguugacagcuguggaauuaucuuacuacuaauuggcaucauaaauaacagaaauguuaacuaauauuguuuauccucucauauuuggcacugccuuuccuuuuaauuagguaaauaaacaguuauaaucuucaucuuccagggcccauuaaucagcuauugcuuauagaauucuuuaagaacucauuuagguuaugauuauggaaauuaaauuuuuaugaaagauccugguaacagagucuaaauuauugaauugcauaauuucccaguaguuccuuuccuuuuaaugagccuuaauuuaguuugacuaauuaaaagcuuuguccagaacuccucuagugugaaguuguaaucuacuagcauagauuuuuuuuuuuuuuuuuuugagauggagucucacucugucgcccacgcuggagcgcaguggcacaaucucggcccacuacaaccuccgccuccgggguucaagugauuccccugccucagccucccaaguagcuacgacuacagguuugcgccaccacacccagcuaauuuuuuguauuuuaguagagacgggguuucaccauguuggccaggauggucucgaucuccugaccuugugauccgccuaccucagccucccaaaaugcugggauuacaggcgugagccacugcacccagcugcauagauuuuuuuaacaguacaauauuaaaacaaagacugauguuugugugaauuaugauucuuuauucugacuggugccuaugaaagcaauagggaaacaugucuacuaaugaguuuugucuuuuuccacagagaaagcuuggacuauauuucuggaaggcacccacuguggggugcugcuuguucugugguguugcugugcagcggccgggaggagcagagggcugcaggagacccucugagauucugcuuugugcacauguacugccagcgcauggcauucuugagcccauaaagcaagacuucucaggcccugugguuagcaucccccacacccauaucagccacuagcauuuuaaagaugguuuuagguggguacauaagggcccagaaaaaaaguuuuacaauuauuuuaggggccugaacccucaugucauagcuaaucagugaaugaaguuaccuuuuaauccaagagccucaucccuguuuucuugguacuaaaaacuuucaccaaucugaauccuagugucauacucuaaacacgaaccccacccaucccacugucaccagauggagaucuuagacuugcaggcuuccaguagggauucuccugaugagcguguguaccagugcagcugggcacaguugggaacagcaggcuggucuucaacaccuggcuucagaggcagggugggacuccaggcgcuugcgcaggugguuggcaaaauccaccugggucugggacaggaccugguugaugaugcucuugggcagccaccccugcaguaggagguaggagaauuuggccaucuuguggguuuuggcccacucuugacacugcacccuaucacaaacaggcugccaggggcuuggucuucgagcucuguuaauaggugcagccuuggaguugcccagucaagggcgggaggacugcauugcuccucugcugucaugacuuucagaagcacaagacuggccaacaagauguuucagccugguguucccagcugugugacccugaaccaguuauguugccuuuuucacccuucagaucucuggaccuaaguuuccuucuuucuaaaaugauaacuacauauaagaguugaacuuugcugugagacagaagagggccaggcgcaguggcucacgccuguaaucccagcacuuuuggaggcaggcagaucacgaggucaggaguuugagaccagccuggccaccauagugaaaccccgucucuacuaaaaauacaaaaauuagccaugugugguggcacacgccuguaguuccagcuacucaggaggcugaggcggaagaaucacuugaauccgggaggcggagguuacggugagcugagaccaugucauuguacuccagccugagugacagaaugaaacugagucucgaaaaaaaaaaaaaaaaaaaagaagagggggccaucacaggcuuuggagaugguagaguagcaguuaggccaucacuccagacccuucccugucuuacagccugugauucuaucagaauagaagaggauucuuucugcagcauggggggaaugggaagagccuguuuuucucacuaccaccugccuuccaggucccccucccaugcccuucaccuugaggucgaugcugaguagccacguaaguuuggucuuagagggacuuccagccaacgggugaagcaccaugcaagugggaccgugcuccgcccuggcaaauggagaagucaagucaggaggacaguugcgaguucucucuugcacuggcugcuuacaccaguaccauagauaacacguuucuacgguaccuugucuuuucugagucucaucagggaagugcccuuugcaaaggguaauuauuuggcaguuggcacaguuaccagcucaucagaauaaaggcugcuuguagcuggagcagccccugcggccucuugugcccuuuaguugcuggauuacugggaugucagggaaaggauucaggcugguggcugggcuggggccuugggaaauucaggaggcugugguguacugagugguauggauuauuucaauauuuuagucuacauuacagcuguuccugagcguaccaggugaaccucagcccugccccaugcuucagaaaauuauuaagguucuuaaacuuucugggagggucaugacaagcugucuggcuguccaaguagggccuaucuugucuuugucccuccuuugguaaauaaguaucuucuuuuguagaaggaagccaugggugcaccaaggguugguuucuuggagcuggggaugcaguccacaugcuugggugcacaccugcaggccuguguuagaagagggggguuuggagccugcugcccguauuaccugaugacacccuucugcucaggcauguucccgaagucuguggccaugccagccagcacacagguggagccucggcgcuuggcacagcgcacgcucacaaagucacggggccccaccagguuuccugcugccucggcagccagcucgugaguaaugaauguaucuuuuccgaucuucugcaggaccuaccaggccauggggaaccagaaucacgacucagccuguguugggcuaagcaccccccacagcuagggguccucucuuugauacagcauucacacugggcucuccugggccccugccaccugcaccuggacuuugcucaccuugaucuccuugacauugggguuccacucccccauugcuuccaugcgcuccacgagcucuucauagagccucuccaugggcugguccaccacgaccuccagccggaacaccuugcccacaucugggaccacuuuacucaucacuuuguccccauuguccugucagagaaaggagcccccagaaggugguuagacaaaaauauucuuggccgggcauggugguucacgccuauaaucccagcacuuugggaggccaagguggguggaucacaaggucaggaguucgagaccagccuggccaagauggugaaaccccgucucuacuaaaacuacaaaauuagccagacaugguggcaggcgccuguaaucccagcuacuugggaagcugaggcaggagaauugcuugaaccugcacggcagagguugcagugaguggagauugcaccacugcacuccagccugggcgacagaguugucucaaaaaaaaaaauuuuauauauauauauauauucuuagucuaggucccauaggcaauacaaggcaagauggggaggggaacagcaaaggaacuccaaguugagcacgaggaagccuggaacuguccuaagauagagucgguaaucauuguugccauggccuugugcaucugcugacaacuggaggaaguuaccugcugccacuggacccuuuuuaagauuuuuuucuuguuuuuuuuuuuugagaccgucucacucuguuguccaggcuggagugcaguggcacaaucacgggucauugcagccucaaccuccuaggcucaagaaauucuccugccucggccucccaaguagcugagacuacaggcaagcagcauuacaccuagcuaauuuuuaaauuuuuuguagagaugugaucucccuguguugcccaggcuggucucaaacuccuaggcucaagcaauucuccagucucggccuccaggcguaagccacugcacccagccccacuggacccuuugucuugguggugaaugauggugguauggguagguccaacugaaaagacucuuacuugacuucagaagcucaaagaucccaagagagaaaccugggagugggaaaaguguuuuacaccagcuuaauuagauacauagaauguugaaugggaucuucaagauuuguuuuaguucaauaccucauuccacaccagaagaauguggggccagagaaggucagugauuggcccagggacccuuaacuaagagcagugccgaccuaagucccaguuggcucccaaacuaguagucuguuaacuccauuacucugagaacuuagggaaggaaggguucuaccugaacuuuguguagugggcagcaugucagcuuuugcugaagguaaagccaccaaaaucuccauaacagagccaccagccuuuaccgugaaccugguuacuguccccugugaugggucagugcucaagcgcagagaaccccagaaggccauggaccacucuguguucuaguccaggccuguuguagggugagcccacaucaccccugcaagcccagccacaggugggcugacagcacagacagugcacuuuggcaucguugggauaucugacccagggcaaugaggcacuuggaguuccccuugcaugaugucugccaagugggcacacaaugcaauccuauucuguaacuaaggacacaggaauaguguuucucaaacaggacucuccagggugucuuuuaugggggaagagcauuaucugaggauauauucucgagaaaggagaguucucaagauaaaaccacuugcuacccagugacugcugcaugagacaggaauucugggaaaaauaguaaccccagcuggccuugaggauggcaguggagcauggaggaaccacaggcuucuccccgacacuuaccugcugacucuccuucuuccagcccucuugguugcuaaggaugcccaaggccuucugcauggccuccucccccugcuggagauaggccagcuccuggucacuguagagagucucuucuagccgagaaccuggauacacagccgaggagagacagagcuuccuucuucucccagccuccaccagcucucaucccuggagcucugggucugcucauugcucugaagagcccggacuaaagccauaggggccagccugcuggucgaguuaaucacagccgccccaggugaccagagagggaucuggccuugaggaacucuaggcuggggacguccucucaaaaugaaggaauggcaggaggggagccaaagccacaugcaccacaucacccuccagggaaccuccugccagcagcaccaggagcccagaagccucagcacuuaccgaguagagagcuccgccgccgaaccugguuaauccacgugcuagggguggggccccccagggcccuccgguucagcuccuggcugauggccaucacagccuguugccucagcccugcagaagggaauaacccuugucuaggagcuggaaagccccuuagagauggaccacucccacccccucaucuugucucaaaugaguaaguugguuuggagagggaagugacuugcucaggagcacacaggauucuagcagggaccugaacuagagccaggcccucaacucccauggcagugcuccaggguccagaaaucugccuuccaucugggguggucaggccuggcccugccuggagaugggcuauaccagagccugcuggaguuucugucucuaaaaggggaaaaagcuguguucaagcaaccagaaaaauccuacuucauaaggagaauacaacuccugaggccugugugcuugcaugagucugugugucugcacgagucugugcuugcaugaggucugugugcuugccagaaucugauugcaugaaucugugcuucugugagucugugugcuugcaugcauaagcuacucugugugccccuggauucugggccagggaagcccuguccaucuagugaggacgacaacaccacugccagcugcagaucuaagcauggcuucucgcucuaaagguagcuaauucaauccaguguaauuggaaagaucgugccuagauugacuuguguacccuucaguggcagcaggggauugauucaaaugaccuuggaugcgaaucagcucuacaaaaguggccucuuguagcugguuucugccccuuccuggcuauucaaugauaaucagucuuccgucuuaucucuuuaccuugcccuccugucuuacuccccuaugucucuucuccgucuuuuuuugccugugggagucaagucuaauauuuacucugccacugugggcaagacuuuccuguguaccccugcuacaagacuuguccagcucugaaggaaggcaaagucaggaauaguucaagaaagauggccaggcaugguggugcacgccuguggucccagccacucaggaggcugaggcaggagaauugcuugaacccaggacgcagaggcugcagugagccaagauagcgccagugcacuccagccuaggcaacagagcgagacugccucaaaaauaaaauaggcugagcgccauggcucaugccuauaaucccagcaguuugggaggcagaucaccugaggucaggaguucaagaccagucuggucgacguggcgaaacccugucucuacuaaaaauacaaaaacuagccaggcgugguggcaugcaccuguaaucccagcuacccaggaggcggagguugcagugagccgagaucgugccacugcgcuccaggcugggcaacagagugagacuccaucucaaaauaaaguaagccagguguggcggcucacaccuguaaucccagcacuuugggaggccaaggugggagaaucccuugagcccagggggucaagaccagcgugaccaauauagcaagacauugucucuaaaaaaaauaaaaauaaaaauaaauaaauaaaacuagcugguugugguggugcacgccuguagucccagguacucaagaggcugaggugggaggauggcuugagcccaugaguuugaggcugcagugagcuaugauuguucuacuguacuccagccucugugacagagaccuuuauucaaacaaaaaaaaaagaaaaggcggaagaaaaaaagaacgaaugaaggaaaaggggaaggaagaaaggaagaaagaaaggaaaggaaggagggaaggaagaaagaaaaagaauaaaaaugaaagaaaaggagaaaaaaagauuggaguccuggaggggagaccagaaauuauagaaucuggaagggauauaucuuaguaaccagcccacuucuuccgaggggaaaacugagauucaagaagggaagaaacuugcccagguucacccaguaagaggcacaacuaggaucagaauuggguggccugagccucauccgcugagagcuggccaaccccucaucgccuccuucccgcagcgcucacccuucauguugcgcaugugucuguaggagcucccagcgcacagcuugaaugucgcuagcagcauuguuuccuggcaaauguggcagugguggggucgcugccgcugcugcugccgccgcugcugcugccucuucucucaagggugguucuucguccuuccugagccccucaagcuucgccucugagucccgcagcugcagccuggaccugguguucugcgucuuaaaugucccccgcugaaggcugugcaucaucaucaggagauaaaaacgccaucacucacugugcaaaggaaggggucaaggauagagcgauugccucacacugc

SEQ ID NO: 191856 - RNA, 33880 nt, Homo sapiens
ugucacauaaacuucaaaacaaguuuuauuugggaaguuucucauuuuguuaaagcugcaagcaaguuucuuucacaauuacacuuccagagaucuaguaguuuuacggaucucaguguucaaaaguguauuucaaaaugaacaaaaccaaacccacaccaaaaggaaauagcguuuagauugguuuggaauguauagccauugauuucagguguucucagaaacagguuaccauuuccuuggaaaacaggugggauacagucaaugcccacagaaggaaaugucuuuuaaauaaguuaguuacucggacaauauuauucacuccuuagaaaauauaguaggauaacaagucacagcuggcaggguaugcaguacagcaccgauuucacagggggcuuaugcaauccuggagucagcgguuguuggcuuaugguacacaaaauaagagcagucacuggaaguggggagaaaauggugaaaggcaggcagucucccgcaguccuacccagccuuuuaacuugcuaaaaggagaggcuguguuuuuagcaucuuugggagaacauuugagacaguucaaaaacaaaaacaaaacccccaguauuauucccagaaaguccuugacagaaaagagggaccuggucaggguucccaugggggacugcgccucccauccacuucugucuccacgugauacaagacgucagccagggugugcucuaccacggcgccccagcccaugucacucaucugcaggaggaaugagaaacagaacacggugacuacagcagccacggagaugcugaggacacaugcagccauuuguaauguuacucacagggcgguaagugagauccuucggaggauacuugaagcaugguccaaaguuaauggaaaccuggagcgaauucaauucaagcagacauggaaaaaauggacaaaaaauauuggaaaaguuaauuugacacaggaaauuuucacuuuaaauguggcuacaauacucgggggauaaauggaacaaauaagauauauauuaaauauuacuaaaaguggucaacauccugauguccaucaagaauuagguaacuaaaagagaucuguguugauuucuguugucaaagaaaaauaaaaauucaggaucccaauuugcucugucaaaaggaaaaaauuaagcugaaagcugagucaugcaagaaacugccuuuccuuuuguugcuaagcagacaccuacagauaaaacguuaaauauccccacaggcagcuacuuuauguucaccuuaccuuaugugaagugccgauuuaccgggcaugagaugaauacauaauugacuuuccccuaucugcuccuuuucucuugcaacauguggaugaccauacccuccuacuuuccccuccagcccgcauuuccccuuuauuuuacuuuuuauuuuuuuugagacaggcucugacucuguuguccaggcugcagcgcaacaaugcgaucacggcucacugcacccuugaccuccugggcucaggggauccucccaccucagcuucccaaguagcugggacugcaggcauguaccaccacgccuggcuaauuuuuuguauuuuuuuguagaaaggggguuuugcuauguugcccaggcuggucucgagguccugggcucaacugauucucuuauauuggccucccaaaguguugggauuacugccgugagccacuccguccagcccuuuuucuuuuuaaaacuuuuaagcccucaaauucauccuuggagaaaggcacagaccacagacuguuucugugauucuguuuuuuucuuacaggcagguccuuaacuuuggcaaaauaaacuucuaaauugauugagaucugucucagauaguuuugguuuacacuguuuaaagauuuccuuuuuuuuuuuuaccugcuucaauggugccuacugacagacuaaaaguacauggaaaucuucaugcauuaacuuuuucuuucuuuuuugagacggagucuugcucugucaccaggcuggagugcaguggcaugaucuuggcucacugcaaccuccaccucccagguucaagcaauucuccugccucagccuccugaguagcugggacgacaggcgcgugccaccaagccuggcuaauuuuuuauuucuuuuugagacagagucucgcucuguugcccagguuggagugcaguggcacaaucucggcucacugcaagcuccacuuccuggguucacgccauucuccugccucggccuccugaguagcugagaauacaggcucccgccaccaggcccagcuuuuuuuuuucuuuuuuuuuuuuuuuuguauuuuuagagagaugagguuucaccguguuagccaggauggucucgaucuccugaccucaugaucggcccgccucggccucccaaagugcugggauuacaggugugagccgccacacccggccgaugcccggcuaauuuuuguauuuuuaguagagaugggguuucaccacguuggccaggauggucucgaucucuugaccucgugaucugcccaccucggccucccaccaaagugcugggauuacaggcgugagccacugugcccagcgccacccccgcccuuuuuuuuuuuuugagacggagucucacucuauugcccaggcuggagggcagugguguaaucuuggcucacugcagccuccaucucccggguucaagugauucuccugcgucagccucccccacagcugggauuauaggcgcguggccaucacaucuggcuaauuuuuauauuuuuaguagcaacgaggucucaccacauuggccaggcuggucuugaacuccugaccucaaauggucugccugagucacccucccaaagugcugggauuacaggcaugagccaccgcgacuggccuaaguuuucuuuucuuuucuuucuuuuuuuuuuuuuugacacagagucucguuuugucacccaggcuggaguaguggcacgaccucagcucauugcaaccuccgccuccuggguucaagugauucuccugccucagccuccugaguagcuggaauuacaggcaugugccaccaagcccagcuaauuuuuguaucuucaguagagacgggguuucgccauguuggccaggcuggucucgaaccccugaccucaagugauccacccaccuuggccucccaaagugcugggauuacaagcgugagccagugcacccagccccaacuuuucuauauaucuguaucuaucuaccuaucuaccuauauauuuuuaaaaccaacaggcccuaaugauaguacccuucuucauguuuggaucauauuuaaaaaaaaaaaaaacuugccagaugugguaccucaugccucucuguaaucccagcacuuugggaggcugagcugggagaacugcuugagcccaugacuuugagaccagccagggcaauguagugagauccugccucuacaaaaacaaaaaccaaaaaauuagcacaccccaccuacucaggaggcugaggugggaggaucacuugugcccaggaggucaaggcuauggugagccuaugcaacagagugagacacugucucaaaaaaaaaaaaaaaaaaaaaaaaaaaucauuguaagcaacaaugacuaauaaugguggguuaucaugacaucccaggaggauuuguguauguguauuuauauccuuccuacugaacgguaacaccacaccacgugcucaagggaaaaguauggcgcacacaaacugcaggaccuuuuucuauccagcaaauacucccuaagaugcccaaacuguuucuggacuaaacaguaaugguaacaacacaugcgcaugccacucugaggcugcuuggauuucguuccagcacucaguaacuuugucaucacaacccauucaucugcuucccucaaguuuugcucaugggauggaaacauguacguaccgugcagcucuuguacagugagauggcugggaaguaaacccccucaaaaauaucuuuguaagccacaccuugauugacaccauuuuuauaaaauauuaucugaaacaaaaaccaugguuuuacuucagaacuguaaaaaagaacaaacaaaaaaagaacucucuaggaaaauauguuagaagugcugcugccagacugcuagucacucacccaagaacagugcauaacuuguguaauaacaacaucuucaauuuuuauaauacuuucgauuuuucaaagcauguuaauaugcacuauucaggcuuuuuuuucuuuuuugagacagggucucacucugugacucaggcuggagugcaguggugugaucuuggcucacugcagccucaaccuccuuggcucaagugauccucccacaucagccucccaagcagcugggacuacaggcauacaccaccauauccagcuaauuuuuaaaauuuuuuuauagagacagaucucacuguauugcccagacuggucucaaaguccggggcuuuguuuucugaauuccugugcuacauauaccaaacauuucuauauuuuauuauucauugcacuguauuuauaaaaguaagcugggaggccgaggagagaggauuacuugaggccaggaguugaagacuagcuugggcaacauagugagaccucaucucuacaaaauuuuuuuuuuuuuuuaaaguaagcuggccuuccauggacuccuugggaccacaccuguuuaagcgugcuuguuuaucaauuccuuuccccgagucaguucucacuucugcuuuuucacuuugaaguucucuaagacucuuaugucacaucucugaauccucauguuccuccuuucucucccagaauuacacugaauauccucucuugaccacuucaauucuucagaaaaggcugccuucucuucccacaagagggggcuuucugguuauugcaucuuuagaucuaauaauuauuucucuuuaguauuucuuuccuaaaaacagcugaaacucguuucuuuauuucaccuccaucuccuucuauuaguguccuggguggccucacagcauuagcauuuuuaugaaaaaaauguuuccagcuuaacuuucuuccucuacaucccacuucccuuuuuauuuuuggugcuuguggcuggcccagaugugccagccuuucucugacugugcuaugaccuugggcagacauguuuccagcaaccccggaaguggaggcagagaaaguucugaaggacacugagugagacguuacagcuccuagugccccugggccacaccacaaggucuacucucccacuccagguucccucccuuuggacuugauaccuccucugauaaagaauaaagacacuggacuugcuuccucagucucuuguagauuucccaacaggccacuauuuuuuuuuuuuuuucauugaucauucuuggguguuucucacagagggggauuuggcagggucacaggacaacaguggagggaaggucagcauacaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccacccuuaauccauuuaacccugaguggacacagcacauguuucagagagcacaggguuggggguaaggucauagaucaacagcaucccaaggcagaagaauuuuucuuaguacagaacaaaaugaagucucccaugucuaccucuuuccacacagacacagcaacaaucugauuucucuaucuuuuccccaccuuucccccuuuucuauuccacaaaaccgccaucgucaucauggcccguucucaaugagcuguuggguacaccucccagaugggguggugcaggccacuauuuuuauacacuuuucucuacagaguuauccugaaagaacaggaucaugucucuaacagcagaagcaugguacuacauaaagagcaaaacacaauaagcagagggugagcuugccgcuggccaguggggcuaccagaugccccuucauuccccuuugggccucguguuccucacuuuuauaaugaaggaauggguccuaacgcucaaggccuuaugauucuaauguucuuauggccaugacucaccucacuauggggagucugcuucaggcucuucucugcuuuauccacaaagucuuuuuccucaaaauacaaauaacucuugaauuuuaucaaagccuugaaaaccaagaaagaaaaaaaggcacaauaaagcaucagcuccaucaucaugaaaaaaacgcauccgcacacaaauaguguuaaccccuugagcucuacaacagauauuaaaaaucuuugcaguugaguuuugcuagauuuugaacuauuacacacuucuuaaaaaauaccagauggcacauguuuauuaaaacauuuucaguaggccuuuaguaagaaacgugagaaaauacauaauacauacaugcuuaccacaauaaaaauacccauaaaaguggcuaaauucacacaucuuuuccaauaaucucacugaaaaaaaugacguuuauugagucuacaaucucuuauucuuuuuuuuuuuuugagacggaguuucacucuuguugcccaggcuggagugcaauggugugaucucuucucacugcaaccuccgccucccggguucaagcgauucuccugccucaggcucucgaguagcugggauuacaccacacccggcuaauuuuuuguauuuuuaguagagacaggguuucacuauguuggccaggcuggucucaaacuccugaccucaggugauccacccgccuuggccucccaaagugcugggaucacaggcaugagccacugcgcccagccuauucuuuuuuuuuuuuugagacagucucacucugucacccaggcuggaaugcaguggugugaucuuggcucacugcaaucuuggccugccagguucaagcgauucuccugucucagccucccaggcagcugggauuacaggcaugugccaccacacccgguuacuuuuuguauuuuuaguaaagacgggguuucgccauguuggccaggcuggucucgaacuccugaccucaggugauccacccgccucagccucccaaagugcugggauuacaggcacgagccacugcaccaagccuacaaucccuuauucuaugaaaauauuuugaaggucaccuucuuccccguccuaguuucccaucuguucccacagguggucucugggucaccucuuucuuacugguucuuaagagucuauuuaacuauucacuuccagagaaauauaugacauuaauuuaaaaaauuucaauuucuuaacauauauauguauuaaacaugguuagaaaagaagaauucccaagauauacaagcauauaaaacgagagucucucuuucuaugucccuuauacccaguuuccccugccaaaaguaaucacuguuccaguguccugguauccuuccagagaaucuaggcauauauugucuucaaaauuaaaacacacacauguggccgagcgcaguggcucacgcuuguaaucccagcauuuugggaggcugaggcaggcagaucacgaggccaggaauuugagaucagccuggccaacauggcgcaaccccgucucuacuaaaaauauaaaaauuagcugggcgugguggugcacgccuguaauccuggcugcucaggaggcugaagcaggagaauugcuugaaccugggaggcagaggcugcaguaugccgagacugcguaccacugcacuccagccugggcgacagaaugagacucuguuucaaaauaaaacaccagauaaacauacaaaaaaaaaaaaagcccaaaaagccauacaaaugguaacauauuauaaguuuugucuugcaucuugaguuuuuaacuuggcaacuacauuagagaccauuuuauaaucaguauauaugcggcuuuugaauagauccauaguauucugucguguggacaugucacuaaaaauuauuuauuuauuuauuuauuuuugagacagucuugcucucugucgcccagucuggaguucacuggcaugaucuuggcucacugcaaccucugcccuccaggcucaagcgauucucaugccucaaccucuugaguaacucagauuacaggagugugccaucacauccaacuaauuuuuguauuuuuuuuguagagacaggguuucgccauguugcccaggcuggccucgagcuccuggccucaagugauuugccugcuuuggccucccaagcauggagccacagugucuggucaaaaaauuuguuuuuuuuuuuaauuaaaggaaaaaaaauuuuuuuuguaauguaaaugaaucauugaaaaaacaccuacagaauccuuuuaagugcagaccucuguguucuguaaaaccaggcaucagugugguauacauuuaaagaguuccgggaggcaggaugguacaauaagucacuagugugauauaaucaauaaaaaugagacuguaggcugcuuauuaucagaauaaacucagaguauuuccacuaucaaauuuaaagacuuacucuaaagcuaugauaaccaagacacugugauacaugcauaaaggacaagaaacagaucacugaaauacagagcucugaaguaaaccuuuccuuaacacaaacaucugauuuucaauaaaggcaucaaagaaauccaguggagaaaggaaagaguuaacauauggugcugggauaauuguguaaucauauggaaaaaaaaugaauuuccauacuauacauaaaaaucuggucgggcacaguggcucaugccuguaaucccagcacuuugggaggccgaggcgggaguucaagaccagccugaccaacauggugaaacccugucuccacuaaaaauacaaaaauuagcugggugugguggcgggugccuguaaucccagcuaaucgggaggcuaaggcuggagaacagcuugaacccaugagacggagguugcagugagccaagauugcaccauugcacuccagccugggcaacagagcgagacuccaucuaaagaaaaaaaaaaauuaauccaagguaaaucagacaccuauguguaaaagcuaacaccaugauguuuucaaaggaaaacaugggagaauaucuucaugacagggaguagccaaagauuuuuuuuuaaauucauggaaagaaauaaguauaaaagaaaaauuugauaaaucagacuucauaaaaacuaaaacuuugguuccucagaagacacuauuaagugcagugacucaugccuguaauccuagcacuuugggaggcugaagcaggugaacugcuugagcccaguaguucaagaccagccugggcaacauggaaaaaaaaaaaaaaacaaaaaauaccaaaccuguuucuaccaaaaaaauuuaaacuuaaaaaaaaaaaaaaaaaaagaacagagaagucucagaauagcaauauuaacaggcaaaauauuugaagagaaacuucacaaaaaacauaugaguggccgaaaagcacaugaaaaaugcccaguaugucaucaaagaaaugcuaauuuaacucacaaugagauacuacuacacacccaucaaaaauggcuaaaauuaaguugacagacaaucauaaaugucagcaacuaaaacccucauauaugguaggaaaagaguuuggaaaauuucuuauaaagcuaaauauguaacuauccaaugauccaaaaagacuguacaagaauauucauagcaucuugcucauaguagccccaaaccugagacggcccaagugucugucaguaggaaaaugcauaaacacacuggggcacauucaugcaauggaguacuacccugcacugaaaagggugcacagauauaugcagcaaaauggaugagucucaaaagccagauauaaaagacuacagacugcaugagcccauuuaaguucaagaagagguacaaauuaaaguauggugggaaagaaaguuaaaacagugguugccucuaugugggggugaggacuaacugugaaaaggcaugaggaaacuuccugaggugaugguaaguguccacaucucuuuuuuggggggagugcaguggugugaucacagcucacaguaaccuugaacuccugggcugaaugauucucccaucucagcuuuucaaguagcugggacuaucggcacuuuuuuagucuuuuguacagauggggucucgugauguuacccaggcuggucuugaacucgugggcucaagcaguccucccagcuuggcuucccaaauuguugggauuauaggcgugaaccaucaugccuaguggauccuacauuucaacaguuuaggucaaacucaaaacucagugaauguacacuuaaaauuuguguacuucauuuuauauacauuuuguaucaaaagaaugaauuaaacaggcugaauucuagcuuauguauccugaaguacuuagugggaaaguguccugaugucugucauuuucucuguagugcacuaaaaaaagacaaaugauagauggguagaagaaugaauggaugacuauuugugcaccgauuguuacuguuauucugaaaaugucauagcaacagguuaggaaaaaacgugagcuguggcucaguuccuaagagaucacacaagccagugauaagcacuggcugccacaggccuucaaagccaggaaucugccgggagaggacaaacucaccuuaucuuuguaugugucuggcaaugacuuggcugucucugugucuucaggaagauuaauauaaaaucccaggacgucucccuguccauagccagaagaguaguguuugccaauggacugguggaacuugguucccuuuuugcuccgccaagaauagcuaaauuuaucauaaccuaaaggagcuugaagguuuccugucccaauaaaaacauacacaggaagucagaagauugcaagucaaaucuaguuugcugaaggaaaaagauccuauuucuuuuuauguuuuuuggucaauuuuguaaaauugcuuaaaaacuuucucacaagcaaagaauuacaaaaauaucccgggaauagcaaaccagcucaacccucaggaacugaauucuaugcccacaaucugguaaacccaacagccuugaagccuuagcccuuggccagauggucuauccucucuaucugcugugauguccauauuaaggccccagcuuaccuaggggcugggaccaacccagucuggcagcgguaucugguggcaucucauccacagugauuucaaaauaccaggcaccuuuccguacuccaugagaggcccucaccauagaguagcccuucucuccaaccacagucagccggucaucugagaucuuuaacuggggagcugcggugacagagauuaaaagaaggccugcaacuuauuugagguucuuggggacaauugccacaaaaacauuaguccaauaaaacaauuuaaaaaucacaaauaucaggucagguguuugaaauauuaguugaggaguuuaaaaaucucagcauaagauacuggcaaggaaugagaaagcaacaaaaaagagaaaguuguuagguuacuuaguuuuuauuacaugugauuaucuuuuuuuuuuugagauggagucccgcucugucgcccaggcuggagggcaguggugcaaucucggcucacugcaaccuccaccucccggguucaagcaauuuuccugccucagccucccgaguagcugggauuacaggcgcgugccaccacgcccagcucauuuuuguauuuuuaguagagacaggguuucaccauguuggucaggcuggucucgaacuccugaccucgugaucugcccgccuuggucucccaaaguguuggaauuacaggcaugagccaccgcaccuggcuuaucuuuuuuuuuuuuuuuuuuugagacagagucuuguucuguagcccaggcuggaguacaguggcacgaucuuggcucacugcaaccuccgccucccaaguucaagcaauccuccugccucagccugaguagcugggauuacaggcgcccaccaccacgcccagcuaauuuucguauuuuuaguacagacggguuucaccauauuggucaggcuggucucgaauuccugaccucaggugauccaccugcacugaccucccaaagugcuggaauuacaggcugagucacugagcccagccuacaugugauuaacuuuaagacaucugauugauauuaauuauauugcauauucccucaaauauaacaaaccaauggugaugaguuuggaacuuaauuugaauaaaucuucauuuaaaaaauuuaacuuuuuuuuuuuuuuuuuaagagccagggucuugcucucuuacucagucgcacaaccacagcucaccauagccuugaacucguggccucaggcgaucuucuuguguuggcccaagugccaggauuacagguaugagccacuguggcuagccucuugacuaguuuuuuuuuuuuuuccuugagauaaggucucaugcuguugcucaggcuggaaugcaguggugucaucuugacucacuacagccuugauuuccugggcucaaacaauccuccugccucagcccccaaguaguugguacuacaagugcuaccacauccagcuaauuguuugaagagacaggguuugaacaaguugcccaggcuggucucaaauccugaacucaagcaaucugcucuccuuggccucccaaaguucugggauuacaggaaugagccacagcaccuggccuuaacuguuuuaaaacaauuucaaacuuucuuucuuuuuugagacagagucucgcucuuuugcccaggcuggagugcaguggcgcgaucucugcucacugcaagcuccgccucccggguucacgccauucuccugccucagccucccaaguagcugggauuacaggugcccgccaccacgcccggcuaauuuuuuauauuuucaguagagacaggguuucaccguguuagccaggauggucuugaucuccugaccucgugauccgccugccucggccucccaaagugcugggauuacaggcgugagccaccgcgcccggccaacaauuucaaacuuucaaaaaauaguagaguccuagugugugcuucacucaguuuucccaaauguucacaucauguauaaucauuaacauaaucaucaaaaccagaaaauuaacaauaauacuauuaaauaauccauggaccuucuuaaaauuaagccaauuauccaaguaauauccccuucucuggcccagguucuaauccuagauuccacauuucacuuaguugucaugucuccuuagccucuuccaaucucaaacaguuccucaaccuuucauaagcuugacacuuugaagaauauuggucauuucaguuuguagaaugucccucaguuacauuugucugguguuuucuuuuguuuuuuuuuuuuggagauagagucuugcucugucauccaggcuggagugugauggugcaaccucggcucacugcaaccucuggcucccggguucaagcgauucucccaccucagccucccaaguggcugggauuacaggugccugccaucaugccuggcuaauuuuucuauuucuguagggaugggguuucaccauguugaccaggcugguaucaaacuccugaccuccgguuaucuacccacuuuggccucccaaagugcugggauuacaggugugagccaccaugcccggccuggcguuuccucauuuuaaggucaagguuauuguuauucuuacucaggaacuccaaugagguaauguugugccccucagugcaucauauaugcuaucaaaauagugauguucacccuggucacuugauuaagaugaugccugccagguuucuccacugcuaaaugacaauuuuccuuuuguaauuaauaaauaucucaggagaugaaccgguauuuaagacaaucaaggaaaucugauuaugaacugaauuuggaugauagcaaggaauuauuuugguuauaaaagaaaauaucugcauuuuuuuuuuuuuuugagauggaguuucacucuugucgcccaggcuggagugcaauggcgcgaucucggcucacugcaaccuccgccucccagguugaagagauucuccugucuuagccucccgaguagcugggauuaccaccaggcccgcaauuuuguauuuuuagcagagaagggguuucuucaugauggucaggcuggucuugaacucucgaccucaggugauccacccgccucagccucccaaagugcugggauuacaggcgugagccacugugccuggccccaauagccgcauuuuuaaagagaugcauaguuuuuaguguacauagggugauauauauauuuuuuuaauucagaaaaagaaaaagaaauaaacagauaaagcaaacauggcaaaaucuugaacuguuaaaaucugggugaaaaguguacaagguaucgcuauaguuuggguauuugacccuaagugcagguugaaauuugaucacaauguuggagguguggucugaugggagguguuugggucaggagggcagauaccucaagagcagauuaaugcggaauguggggaugugagugaguuuucacucuauuaguuucugaggagcugguuguuaaaaagagccuggcaccucccucccugucuugcuuccucucuugccaucuaacgccugcuccgcuuugccuucuaccaugacuggacaugccugggauccucaccagaagcaagcgcuggugccaugcuucuuuuagccaaauaaaccucuuuucuuuacaaauuacccagccucaaguccuccuuaguagcaacacaaagggacuaagacagguauucacuguaauucaucucucuaccucugcauaugguuugaaucuuacuuuauuaccaggccauuaugugagauaagggagcaaucuaaauaaucaggggagaaccccaugacuuccacagaaagaaaaaauggcaaaaggugggagagaauuucgaggcuuugcaggcugauuuuaacaggaaagguugaggcugcagugagccaugauuacaccacugcacuccagccuggguggcagagugagaccccaucuugaaaacaaacaaauaaacaaugaggccagaugcaauggcccaugccuauaaucccagcacuuugggaggccaaggaaguaggaucaccugaggucaggaguucaagaccauccugggcaacacagugaaggagacuuugucccuaaaaaaauaauuaaaauuuagcugggugcagugaugugugccuguagucccagcuaccugggaggcuaagaugggaagauugcuugagccaggaagucgaagcugcagugagcugagauugcaccauugcacuccagccugggugacagaacaagaaccuuucuaaaaaaaaaaauaaaauaaaauaauugcauggagcaaagacuauauauauagcacgcugcuauucauguauaaaaaaggagauaaggcugggcgcaguggcucacacguguuaucccagcacuuugggaggcugagaugggcagaucaccugagcucaggaguuugagaccagcccggccaacaugacgaaaccccaucucuacuagaaauacaaaaauuagccacgggugguggcacacaccuguagucccagcuauucgggaggcuucagcaugagaauugcuugagccagggaggugaaggcugcagugagccgagaucacgccacugccuucuagccucaaaaaacaaaucaaaccaaaaaaacacagaaacagacaaacaaaaaagggagauaaaagaauauauacauguacuguaucugcucauuugugaagaaauacagcaaggauaaacuagaaacuagagugugagugggaagaugguggaaaaaagagagugagaagggcacuguaggggugaugagggagugacauuuuguaaaccguucuguacagcucugacucccagaaccauaguaauguuucacacauccucacuccaaacauacauacacacaaacaaucaacaugugggagaauccaaaauggcaucaaacacuagcaaauaaaccugacuuaacuggacaugacccacuaaaggaaguggggaagaaaagaacuaaucuaaguuaccaguaccuuggacugaguacggcaagucuaaagacaaaaagagcuauauauaaaugcuauaaucuacuuaguaaauguuucucccagggauuagaaauucugaaacuggcuggguucaguggcucaugccuguaaucccagcacuuugggaggcugaggcgggcagaucacaagguccagaguucaagaccagccuggcuaacacggugaaaccccgucucuacuaaagauacaaaaaauuagccgggcgugguggcacgugccuguaauuccagcuacucaggaggcugaggcagaagaaucacuugaacccgggaggcagagguugcagugagccgagauugcgccacugcacuccagccugggugacagggcaagacuccaacucaaaaaaaaaaaaaaaaaaaagaaauucugaaacuacuuuaugugcauauuaaauaugagcaaggucaagaaugguggcucacucccaagacccugggaggcugaggcaggaugacggcuugagcccaggaguuugagaccagccuaggcaacauaguaagaccccaccucuaaaaaauuaaaauuaaaaaacccagcuaggugugguggcgugugccugugaucccagcuacucaguaggcugaggcaggaggaucguuugagcccaggagguugaggcugcagugagccaggacugcaucacugcauaccagccugagugagacucugaucucuauaacaaaauaaauauauugaaauaaaguaaauauauuguagauaauuaucuaauuauucacauuucccacuguuggagaaagaccuuacaaauaaggaaaggaggaaggcugucaacccagguaucaauauaaauuguuaucuguguacaugcagguuuguacauacacacaugcacuuccuaccucugaccacugaggaagucuagaagcaaugacgccuaguaacagcacaccuaacaccuagauauuaauugcuauuuguuuauuuacuuuauuacuuaaaaaaaaaauaaggaacgcuucacaaauuuguguguuauucuugcacaggggccaugcaucuucucuuuaucauucuaauuuucguauaugugauauauggaagugagcaccuagauguuauuccuaaacaacaugcuccaaucaaaggaaccagggcucggugaaagaaguaggccuggggcacagaaaauauaagauuggccaggaacaccuuuugaugccucaaaguaaagaaauuuuuuuuuuaaaaaaagacacggcuuaucgaaagaacacaagaaccaacuucuugaagaagcuccuacuugccaaagcuggaauaauuuaaacaacaaaauaaucaaaguauuggauuauacucccugaaauaaaguaaauauauaugaguccauacugauauaaauaaucaauuaacagaaaagggaaagaggaaaucgaaaaucaucauacaacacagucauaauuguugcagacaauauccacugaugggugcuaaaauuagugaacauaaguuuaaaaacaaacaagauauuugcauagauagacucgauguauuuuugccuaagacauuuguuaaguauaagggaaagacgguaguuuuuuacaguggagaaagcuagcagaaucaccuuaaccaaaugaucauggucaacguaaccaauaagaccuacugacaucaugaaucccaugagaugaugcuauaagacauuguuuccguguuauucuuccccaaacugccuaacuucagucuaaucaugagaaaacaucagacaaaucuucacugaggaauauucaacaaaauaacugauuaaaacacuuaaaaauaucauggucaugaaagauaagcaauggcuuuggaacuguuaaagacuauaauagacuaaagagaaauaauuaagugugaguggaaaaacugguaaaauugaaaggucuuucucuaguuguguugauaauauuuaccaauguuaauuucccaguuuugauaacuguacuaugguuuucuaagauauuaucauuaggaaaagcuugaugagaaagaaaacuuauuuuuggcaacuuuacugcaaguuuaaaauuaguucaaaauagaaaguuuuaaaaaaccauauauauauauauauauauauauauauauauauauauauauauaaauaaaacggcuggagcuuauaggaaggaacagaauuucuugcacauucuggaugaaucuagacagagaugggggugaggcaguggcaacagacugagauguacaccuaauucuagacugacaaggcuaaugauggcaguucaaaguaacccugcauccauaugaucuccaauacuuuacauaccucgaucauguagggcuaacaaaacccguucauacaagcaggcucuguagaggucuccaggaauagguuuuccugcccagcagucaaguuccagcuucucggggucaggggcgugcggaucaggcucagcuagaauauaccgauagccaucuuuguuaaacggguguuccaauggguagccaugagggggaaggcgcugagcagaaaacaaagggucacugcagaaaggaaaaaauaacaucaaaaaacuaaaacccccuuuagcucaaaugcauucaacuguguaagaaaggccucugguuuauuucagcuagaauacaugcaacuucacagcaaauacuucucauuacucaaauaaguaacucugcccucuucaggcaaaacaaggaagugaaaaggauuagcuuuauugagcaagguaguuuuggugaaauuacuuguagauuguggauaucuucccaguggucuuuaaacaugaauugaugucuaugaaacugagcugguacauuaugcggggggggggggggggggaagggaggagaggaaugggggugauuagggugauagucuuuaguauacugauuauuauaaaguaaugaacagaagcucagagacauaagcacuugcuaucuugcuaaucuaaguaaauaacuugugcagugagccgagauuccaucacugcacuccagccugggugauagagcaaaacuccaucucacaaaaauauauaaauaaauaagcaaccuggauuucaucaccucagcuuuagacaaagggaagggaaaaggcaugagaagggagaagcagaaaguuaaggagcuaaaggagcuaacauucaacacugguuucacucccuccccaccuauccuuucucaagucgccuuaacagaacuucacucccuagguuccccaggcuuaucaccagaagacacuauacuuguuacuacuauaaauuuuguacuaacaaauguauguacacuuaaauguaaaacaugacacuuaaacuuggguuuguuuuguuuuuuugagacaguuucguucucguggcccaggcuggagugcgauagcgcgaucucagcucacuacaaccucugccuccuggguucaagcaauucucccaccucagccucccgaguagcugggauuauaggcacgugcccccaggcccagcuaauuuuuuuguuuuuuguuucaguagagaugggguuucaccacauuguccaggauggucucaaacuccugaccucaggugauucaccugucucagccucccaaagugcugggauuacaggcaugacccaccgugcccggccugggguuauuauuuuuguuuuuuguuuuguuuuugagacggagucucauucuguugcccaggauggagugcaguggcaugaucuuggcucacugccacccgccucccagguucaagcgauucuccugccucagccucccaaguagcugggauuacaggcgcucaccacuacaccugccuaauuuuguauuuuuaguggagaugggguuucgccauguuggccaggcuggucucaaacuccuggccucaagugauccacccuccuugaccucccaaagugcugggauuacacgcaugagccacugcgccuggccuccaaccugggguuauuuugucccucaaagugcucaagguuuagaaaaaauggacaggcuuuuuaaccuccgacccuugaacucucuucccucugcuggacuuucccagcaccaaauaauacuuaaauagugaggggggcagggugggcacucuccccaccuccgggccuucuugguggucccuguggucccuccauccugcuguuugcgcuuggcuccucguccuuuuccgcugcuuccugcugcaauucccccuuugaagagaaggcagauugcuuucaaugagccacaagggaaacaccauguggauacugaaauuccauagggaccaacacacccaaugugcauuuguguaacaccacaggaggauuuccuuccaaaggcauauuggauuucacccuaguuuucaaagaaucuacugagcaucucauagccugggaacacuggguucuggcaauaaacucaaaugaauccagcacuaugaugguuggguuacaguuuucaaccuuuguuccuaauaaacugcaacuauugguauacuuucucagggugugacacaaaugcauucucacucauucagaucccaaacacccacagcuaaaaagaaugaaaacaacuguaugggcacauuuuuuuucauccaaauuaauacaaacacccauaaagagagaauauccucacuguaagucgauguucacuugcuugaacuacacaauacaguccauaaacaucauaaaagcacaguaucugcuaaagcauugaaccugaauauccaacaagacaaaauacauccaacauggaaaacggaaacagaaguacuaaaaagguguuucucuccaguacugcuagaucuccaucgugguugcacaugacacaaauaagaaagaaggcuuucgauuugcuaggcaauuuuuaguuccauacccauucgucaaauacaacauuuauuaagauugugccaaugcacuaaaauucagguuagauuaaccuggcuuguggaacuaaaagcaauaaauaggaauagacaauuuacauauuuuauacaaaaaauuuagcuacauacuaaagccacaaggaagauuaccuuguguauuucugaaauagguacuuugaaauuuuuguccaguucaaauuccucucaauuaguuuuauuuuucccucuuccaggaaaugucccugaacugcaggaaaacaccuuuacguaaacaacugcagaguacuaaaucuuaauuuggggcaagcuugggaauuacuagcaguucugcugcaauaaaaaggaucaagacauugaagguggcucauauucugcauauacaggaccagacuuuuuaugcagaauuuccuuuggugaacaccucagauguuauuccuauuuuucauaaaaguuuaauguuaaacugcugcaaugucaucaucucuaguuuaaguaaccauaaucaaaaaacaauuaaauuuuuguuuuuuugagacagagucuugcucuguugcccaagcuggagugcaguggcacgaucucggcucacugcaaccucugccuccuggguucaaacgauucuccugccucagccuccugaguagcugggauuacaggcgccugccaccacacuuggcuaauuuuuuguauuuuuaguagagauggggcuuugccaugguggccaggcuggucucaaacuccuggccucaggugaucugccugucucggccucccaaagugcugggauuacaugcaugagccaccucgcguggccacaauuacauuuuuaauugucauuugcauuuugauuauuuuaagaaguuucagauccaaccagaacagagcaaacaguacagaagugggguggcuggccauguuaggcagaauaugacaacauacaagcucuuaaauacuaacauuaaacucaacuacuguuucauauuaagugcuauugccgccauuuucauaaugcuucaaauuauguaguuuuuagcuucuaccauagcucagcaaaaagcauuuuccaaaccacaaaauacuuaagucugagaggcugaaagaagacaguggaggaauucaccuccaaaaguggcuccaccuguaagaacagaaguggcaccauguauuugucaaauuuuaacaauuaaaacgggaaaauauguuguaaaaagauaacacacuagcuauuuccaacccaccuuaaaauauuaguaacaguagaaaugaucagauauuuaagacgcgaccacuccaaaagacagguuaaugaucccauauaucagaugaacagcuaaauaucucucagccaccccaacucuuauuaaauaaccauuaguaacgagggguuuucccgcuauuagauggguuaacagaagaacaagcugcaaugggugguuaauauagaaaugcuaucaugugaaugagcugaaguuucagggcaagaaaaauuagaagaugggcacaggaaaucuguuaaaaguaacagcugaauugcagaaaaagaguggagaggagaugaaucuuucuaaauuuaauguuaguuauaaggauacagauauaaacacagcaaaucugaccuugaaaugguuccuugucuuaugcuaaaccugucucacucaagaccaaacuguuguaaagugacaaaaaguucuccucuauuaccaucugccaaauccuuggcuaguuccuaaaaauugaguuugaacuauaaaagcauuuuaguaaguauccagguuaagggucaacccaaagaauggccaguucuaggcacaacuggauucaauagcuuccaaauauuucagcaaugagauauguaaacacuuaccauuuaaauucccacuaguagacacagcacugcucuguuuuugguugucauaagcaggaccaauguuacuaagguccugcaaaaauacauccaauuaaaaaaggagucuacguaagucagucaaucuggaugcucauaaaacaagagaaauucuaacagaaugggaacuaaaauugacaauucuuuuuuuucugagauggggccuuacucuauugcccagucuguaguacaguggcgcgaucucggcuuacugcaacuucugccuuccagguucaagcgauucucuugguuuacccucccgaguagcugggauuauaggcacacaccaacacgccuggcuaauuauuauuauuuuuuuuuugagagaguuucacucuugucacccaggcuggagugcaguggcgcgauaucggcuuacugcaaccucugccuaccagguucaagugauucucuugccucagccuccugaguagcugggauuagaggugccugcugccauacccagcuaaaguuuuguauuuuuuaguagagaugggguuucaccauguuggcuaggcuggucucaaaacuccugaccucaggugauccacccaccuuggccucccaaagugcugggauuacaggcaugagccaccaugccuggccuaauuuuucuauuuucacuagagauagaguuucgcuguguuggccaggcuggucuccaacucccgaucucaaaugaucugcccgccucagccucccaaagugcugggauuacaggcgugagccaccaugcacagucugaaauggacaauucuaaacaaugaagcuugcagagucccaaacuuggguguuuuaaggaccagcaagcaaccuugcaaguaugugugagguaggccaaguguaaggaucagaauaguuucagaauggcgauaaauggcaauuaaucaaucaacuuggguagaggcaggagagggcacagggcaaaccagagugccuaagccccauucacucagcuccugugggaauucaggccccaugcagucagauguuuucauuuuacaagacagaaaucuaaauuucuaugugaaaucuugcauuuucuuuuuugagagacaggucuuguuguauuguccaggcuggucuugaaugccuggacucaagcaauccuccugccucagccuccaaaagugcuaggauuacaggcaugagccacugcaccgggcugaaucuugcauuuucaaagcuggcaaaucaaacauguaaagacacagcuuuaagauuugacauucugacuugccaaaugugaacccugcuguugaacaaaaaacagcaauuuucguuugccuguuauguuagauaugcaacacaaauucuucaaaacaaauucuuuucacaacaaagaaaguuuuuaagagcaaaauuuaagauggcaggaagauuagaaguaauuugaaauagcauuuuuacauguuacaagcgaggaaacuaaaguuaaaaaaaaaagugauuugaagaaauucauaacauuuuggggaagacccacaacaaaaacacuauacaacacuggucucuugguugaaggugaguacucucauaucagucacuauuuuuuuggaguccaccaugcuaugugcauauaauggcaguguguuauguggcaaauauacaaauguaaacagaaccugauuaccuauccccgaguggcuuaaaaucaaaaagaaaauguaaaacauauuaauguaccugauccaaaaguccaaauuugggguaaucuucuucuggaucuuuacugccuggaucuggguguuccuuuaccaagaauacaucucuuucuuuacucuaaaaagaaguaguguuuuacuauuaaugaacauuuuauacuuaaaaguauggaauuaauaaucaaccacuaacucuaaaagucaauuccuaggugcaguguccaaaaaagauaguaucguuuuuccuucuaagaaauaaucagugaccaucaaaaaauucaaacaacagagaaacacaaagagugcccaaguuuuucauaauccucaccuauccuucuauuucacaaagauaagcacuguuaacagcuugcuguugacuucuccccaggugcucucuuuaauuuuaaggacaauauugccuauaacuuuuuuuuuaauagaagaaaagaaauggucucuaauuucaauacaaaauuauucuuggaaaaguacuguggacaaguuucaauacauaaaaccagguguaugcgggcaauguucauauaagacaauaugcaucucacugauucugugugugaaaacuacuaaaauucacaauuagcuguaucucacacucaaagauuuaacauuaaguuguucuaauuuuaucauuucacaaugagacgauauuauugaauucuuacaaaaaacaaugguuuuuuaaaugucaagucuaaucaauuuuaaucuacuuaccauuguuuuaacaauguuauuuggccaagucauuuucccaggucucugucugguugucaugcacucccaguauuuaucaauaaaugguauaauauccuaauuuucaaaauaaauuaagacuauuacugcugcaaucaaagauaugcugacaaagaaagaaaacagcauuuuucgaagaucuuguuagaaucaagagaaaaauccauguuaguuuuuccccccacgguguuauacaagguuuacauguuugucuuuuaaucucugaauauuucauugcauacacacaauacacagauuauggggauuuccacaaguauaaacaaaccuuagccauguagggcuuacacuccaauuggagagaaaagcucugucacagucccuuggcugucaauuggaagaugacucccaaauuauucucucuugaacuccuauuucuaccagcugagacaucucuaucuggacauccuaaagggaccucaaacuucuugugacuaaaauggaacuugguauauuaccucauaaaucugcuuuauggauuucuauucuugcuccugauaacuuagaaccagucaucacccagaauaagcuagacacauuaagaguuguccuugacucuucucucacaauuuuuacaccuaaaugcucaccaaauaaauuuuaaaauuucagaaaugucacuucagucaggacucccuuccauccccacugcugugacuguggcucucaccaacuccugcuugcaugacugaaacgacuuuugaccuucaucuucuggccuccuauuuagauaaucuucaaaagcaccaccaccagaguuagcuccaugacaacuaaaucuuuacugaaaggaaccagggaaaguacaaagaaagccuggaauauuuuguuguuccagaaaguaaggaagaguucaaaaacggaugggggaguaucaaagaguuucaggagucagucugauagggcuacaaugguugaaucugggacaaccugagggucagaaaugaaaaaauccaacaagagcugggcgugguggcucacgcuuguaaucccagcacuuugggaggcugagguggguggaucacuugaggucagaaguuugagaccagccuggccaacauggugaaacccugucucuaccaaaaaauacaaaaaucagccaggcaugguggcaugcgccaguagucccagcuacucaggaggcugaggcaggauaauugcuugaacccaggaggcagaaguugcagugagccgagacaucgcaccacuacauuuuagccugggugacagagccagacuccaucucaauuaaaaaaaaaaaaaaauuccaacaauggacuauaacacacugauuuuuaaaaaauaauccacagugauauuuaaaagggaagaaaaagaaugagggaaaguuauuuacagaagacuugcaaccaaagaauguauucugauuuacaacuacuacucuaacaacugauucaggguuggauaaucaaugggggcuaaaaaucacugguugaaaggaguaggaaaauaaaguacucacauaaucuccauguauggcuuaaggauuacuuagcacaaagauaaaaaugcucccuccuuaaccaacuagucaaauuuaggaucacuaauaauaaaacaaagcaauaucuuauauaccuccugaugugacagucuaaaaaacacacaauacuuauguaauauucuugccaaagauguuuaacacauggccaggcacaguggcucacaacuguaaucucagcaccuugggaggccaaggcugguagauugcuugagccuaggaguguaagaucagcuugggcaacauagugagaccugucccuauuaaagcggaaaaaaaaaaguuuaaccugaacauaaucaugaagaaagucaaaugcaaauugaggaauaucaugccaaacaacugccuaagcacuuaaaaaauuuuaauucauuaaauaaauaaauaaauaaauaaauaaauaaaggggcuggguguguugguuuaugccuguauucccagacguuuggaaggccaaagcaggaggaucacuugaacccaggaggucgaaaccagcuagugagaccacaucuccacaaaaaauuuuuuuaaguuagcuggaugugguagcaugcgccuggaaucccagcuacucgggaggcugaggugggagaauagcuugaacacaggagguugaggcugcagugagccgggccugugccacugcacuccaggcuggguaauagagcaaaacccaacugaauaaaggaauuguuuuauuaauagauuagagacaaaacagucauuacaacuaaauguaaugggugauccugaccagauccuggauggagaaagaagcuauagaggaggauauuauuaacacaaaaauaauccugagaaacuacaaauaugaacuguaaauuaguaguacugcaccaauguuaaauuuuuuuauuaugauuauggcacugugguuguauaacagaauauuggguaaaguguacccacaauguagccucauauagcuuaagggaaaaacagauauauggggacauaaaacaaauguagcaaaauguuaacuguuaaaucuaagaagaaaugggccgggugcaguggcucacaccuguaaucccaacaccuugggaggcugaggcggacggaucacuugaguacgggaguucuaccugccugggcaacguggcgaaacccugucucuaaaaaaaccauaaaaacuagcugggugugguggugugcaccuguagucccagcuacuugagaggcugaggugggaggaucaccugagcccaggaggucaagucuucggugagccgugauggugucacuacauuccaccuugaaacuuuucaaaauaauuuuggaaaaaauaaacuaaaaagaggccacgugcaguggcucacaccuguaaucccagcacuuugagaggccgaggaaggcaaauugcuuuagcccaggaggucaaggcugcagugagccaugaucacaccacugcacuccagccugggugacagagacccucucucaaaaaaaacacaacaguccaggugcgguggcucacgccuguaaucccagcacuuugggaggccgaagccaguggaucaugaggucaguuggagaugagccuggccaacacggugaaauccugucucuacuaaaaauacaaaaaauuagcugggcgugguggcgcaugccuguaaucccagcuacucgggaagcggaggcaggagaaucucugggacccaggaggcagagggugcacugagcugagaucgcaucacugcauuccaucuugaaaaaaaaagagaacaagguaaucacugaauccacugucauauauucaauaaaaacugggaagaaaguacuuguuagggaguauauuuagaaguuccaccuaacucuucaauauaacugcaaucacauuaguuccaccucuaccuuaucuuuggagaacauugucuucggauguucauccuguguucgggacugccaugucagguuggccaaagcacuaaggcacauuuccuucaagucuaucaaaaacaaaaaggaagaaacaguuaucuguaguacuacaucucuacuaccaagggaauacucgauaagugguccagaaaauaacaauuauagcagcaaaauggagucaucaugugaccugaaaugggcaauugcaauuauucagagcuaaaccccaacugaauuuauaccagcuacuaggcaaaggucuccugauucugcuacgcccagaucccuuuucuuuuccaguggauaaucaucuucaaauacuccagaguuuguucuuacuugcuugcuuccggaggaaauagguauucccacugugauggcagacguugcaaugaaaacuguaguuggucaugaaagguagacaggaucugccgaagagccaaauuauacgaauuagugaacuugugaacacacacacuucuuuuucuuuuuuuaaagacaggcucucacucuaccacucaggcuggagugcaguggugcaaucauagcucacugcagacuugacguucccuggcucagguugauucucccacuucagccccccaaguagcugggacuauaggcauuagccaccaugcccagcuaauuuucguauuuuuuuauggagucaggguuucgccaugcugcacaggcuguacgccucuuuaugagaaguuaacaugaauccauuccccucagugacagguaaauuaaaauguuaauauguuaacauagucuuaaaauguaaaaagguugucaaaaccaaaacagggcucauauuuuuauaaauaccuggauuuuucugucacgaaaguuaauaagaccuuauccguuauacuggacaauucagcaucuagaagguucucacugguaucucguuaaguuuauuuuuugaguaccuaaaaagaauaugccaggcuagcuguagaagaggacaaaguagucuaagguguaucucuauggugucaauaaugugguuggaaagggcaggcagaauguaagaaaaaaugaauuaaaaauguaaauaacuaggccaggcacaguggcucagaccucuaauuccagaacuuugagaggccaaggcgcauggaucaccugacaucaagagaagacuugccuauuugaaggcaagagaggaagaggccaggaggggaaagacaauauggcagagacggaugcaacagaggaaccaacgcauuugagaagagaaacaugguagugauugcacaagaugacaggaaaagcacaggaguuuagucuugcaaagggcaaaguaacagaaggacagaagaccuuuaguauaaauggcuuaagcuagaagagaagaaaucagaacaaagguuuaucuuggacucugaaacuagcuuaggauauccucagagaagacugcauuuaccaacuauugcuacccucauggaauuacgaaacauucuuacaaauguuacagcugaguuuccuuaccuucacuucucuguagaaccucuucuguuuaacagacuauugugauaagcuuauuuacaaagacaaaaccucauacuaaagauagguagguaaauaguuauuuuaauuuaaauacaaacagguguaaaaagcagccuuuuuuauacccugcuagcucacauucucuaucucaguuguaaaagauaauccaucccaccuaacugggcuuuauuuuucuuuucuuuuuugagacaggguaucacucuguuacccaggcuggagugcaguagcaaucauggcucacugcagccucaaccugcagggcuuaagcaauccucccaccuaaagcuccugaguagcugguacuacagaugugaaccaccacgcccagcuaauuuuuuucuauuucucguagagacagggucucacuauguugccuaggcuagucucgaaguccugggcucacgucauucuccugucucggccuccuaaagugcugggauuacaggugugagccaccaugccuggccuuuuuuuuugagacggagucucacugucgcccaggcuggggugcaaccucugcuucccggguucaagugauuuuccugccucccgaguagcugggacuacaggcacgcaccacugugcccaacuaauuuuuguauuuuuuuuucuggugacgggguuucaccauguuggucaggcugguuuugaacuccugaccucgugaucagccugccuuggccucccaaagugcugggauuacaggcgugagucacugcgccuggccccccaccuuuuuuuuuuuuuaacuugauaccacugauaggaucuaacuggacuuuagauauaacuuuugaaauucaguuacaaacuguugucuccaaagcuaccaaaacuuugaacugugauuugauucuuccuugaauuccucccaguuaucucucuaguaaacuuccuuuccuaaacugucuauccaaacaaauuuuucuggcaaaaguggcccuaucuuaggccucucuaagagaccaggcuugcuuagcuaguguguuuucccagcagauguugcuaccaagaucaauuauuucuuccugauccuucaguauuuuucuuucuuuuuaaaaacacucuuuccuaaaucacaagucacauguuaauuaagacaucagcauuucuaaaacccacuuuaaccuuuuaacuagaaaguauacaacagauuauaaaggaaagcugggugugguggcucaugccaguaaucccaacacuuuggaagggugaggcaggaggaucccuugagcucagaaguucgaggcugcagaaagcugugauccugccauugcacuccagccugggcagcagagcgagacccagucgcaagaaaaaaacaagaaaacauauauauauguauauauauauacauauacacacacacacacacacacacacacacacacacacauauauguauuucuucacaaucucacccaagguggauuaauuucacgauaaugcagccuuauguuuagauagucuuuuauaaauguauuagcauaauacaaaccauaaagaacauuacagagagcgagcaguacaauuauuccaacagacagucaguauaaggaaaaaagucuuucauucucaaucacaauaugauuuuaauucacuagaagagguacaugauuggaaauagguuugcugaggagaguagacaauauaccuaaaggagugagucagcagcaaugagaaaggaaaaaaaggaugguucaggcauaaagagcaugggucaucucaaauuuuggacaacaggcuuuauccacauauauccuuucugaaaaauccaaaacaccaacacaagguuuauauuguucuaaauuuguuuauauaacacuuuguaauugcauuuuuuuuugucuccaaaccagguugucaacucaaaaggaggggcaauacccaccauuguaucuaccagagcugugcccucaguaagcagauaacaugcuaagggaauuaaaacaacuccugauucaacauccuacuugcugaauagggguuaggagacauaggaaauacuuugcauuuauuuugcccacaaaguaacuguugagcauguucagauuuauuuuaccgagcaauucucacaaaaacuaugaaaaguacucacgagguaucuaugccaaaugugucagccgugaaccauuuuguacaaaucccacauugcagcucuaccucacccaacugucggccauucucuucauccacggagcccgccugaguauccaucaccucugauguauccccagcaccuuccugugucagagcaguucgagacucaaaucaguugacuugaauguauuuuacuuuauuuuauuuuuuuaagagacgggggucucccuauguugcccaggcuggucucaagugauccugaggucucagccucccaaagugcugggauuacaggcaugagccaccgugccuggccugaauguauuuuugauucgcuuaaaaauguaaaaacaaggccgggcgcgguggcucacgccuguaaucccaacacucugggaggcugaggcgggagaaucaacugagguuaggaguucgagaccagccuggccaacauggugaaaccccgucucuacuaaaaagacaaaaaaaagaagccagguguguuggcagaugccuguaaucccagauacucgggaggcugaggcaggagaaucgcuggaacccggggggaggagguugcagugagccgagaucgcgccacugcauuccagccugggcgacagagcaaggcuccgucgcaacaaaaaaaaaaaaaaaagaagaagaagaaauaacuaaaacaaacccuauuuugucuugcaaacaacuaaaaauacuuacuaguguaucuuuuccauuagaugauucugucuccaagccaccgcuuacaucgaccaaguuugccucccuauaagauaaugaaagcgcucaaguaagaauucucaagacaaaccucaaaaugccuauucccaaaaaugaugaucaaauuacagccgaacuucauacuccugcagcuuuuucagcuaagccugaucucagacuggaugcccaagguacugucaggauacugagaagguggacaugucagacagucgcggacccacggagcacagggaagccuaaccggccuuuacagucaaaucuaccuggguuagaguugguccugggagagguucaaagagaggcagcucucccacccuguuuucagagugaccguuacuucuuccagucuggcacugcaaagugguuucuuuucuggaauaugugaaggccucccguuaaagugugagcuaccagcuuccugccagggugcaaggaucagagauaacgacaggagccucagcucccaccgcccgugaaaggugcggaaggggcguuauccgagauaugcuugagaggggacgggccaagcggcgcagaggcagggcgagccauuggcggcggggccuggguuc

SEQ ID NO: 191857 - RNA, 33880 nt, Homo sapiens
gaacccaggccccgccgccaauggcucgcccugccucugcgccgcuuggcccguccccucucaagcauaucucggauaacgccccuuccgcaccuuucacgggcggugggagcugaggcuccugucguuaucucugauccuugcacccuggcaggaagcugguagcucacacuuuaacgggaggccuucacauauuccagaaaagaaaccacuuugcagugccagacuggaagaaguaacggucacucugaaaacagggugggagagcugccucucuuugaaccucucccaggaccaacucuaacccagguagauuugacuguaaaggccgguuaggcuucccugugcuccguggguccgcgacugucugacauguccaccuucucaguauccugacaguaccuugggcauccagucugagaucaggcuuagcugaaaaagcugcaggaguaugaaguucggcuguaauuugaucaucauuuuugggaauaggcauuuugagguuugucuugagaauucuuacuugagcgcuuucauuaucuuauagggaggcaaacuuggucgauguaagcgguggcuuggagacagaaucaucuaauggaaaagauacacuaguaaguauuuuuaguuguuugcaagacaaaauaggguuuguuuuaguuauuucuucuucuucuuuuuuuuuuuuuuuuguugcgacggagccuugcucugucgcccaggcuggaaugcaguggcgcgaucucggcucacugcaaccuccuccccccggguuccagcgauucuccugccucagccucccgaguaucugggauuacaggcaucugccaacacaccuggcuucuuuuuuuugucuuuuuaguagagacgggguuucaccauguuggccaggcuggucucgaacuccuaaccucaguugauucucccgccucagccucccagaguguugggauuacaggcgugagccaccgcgcccggccuuguuuuuacauuuuuaagcgaaucaaaaauacauucaggccaggcacgguggcucaugccuguaaucccagcacuuugggaggcugagaccucaggaucacuugagaccagccugggcaacauagggagacccccgucucuuaaaaaaauaaaauaaaguaaaauacauucaagucaacugauuugagucucgaacugcucugacacaggaaggugcuggggauacaucagaggugauggauacucaggcgggcuccguggaugaagagaauggccgacaguugggugagguagagcugcaaugugggauuuguacaaaaugguucacggcugacacauuuggcauagauaccucgugaguacuuuucauaguuuuugugagaauugcucgguaaaauaaaucugaacaugcucaacaguuacuuugugggcaaaauaaaugcaaaguauuuccuaugucuccuaaccccuauucagcaaguaggauguugaaucaggaguuguuuuaauucccuuagcauguuaucugcuuacugagggcacagcucugguagauacaaugguggguauugccccuccuuuugaguugacaaccugguuuggagacaaaaaaaaaugcaauuacaaaguguuauauaaacaaauuuagaacaauauaaaccuuguguugguguuuuggauuuuucagaaaggauauauguggauaaagccuguuguccaaaauuugagaugacccaugcucuuuaugccugaaccauccuuuuuuuccuuucucauugcugcugacucacuccuuuagguauauugucuacucuccucagcaaaccuauuuccaaucauguaccucuucuagugaauuaaaaucauauugugauugagaaugaaagacuuuuuuccuuauacugacugucuguuggaauaauuguacugcucgcucucuguaauguucuuuaugguuuguauuaugcuaauacauuuauaaaagacuaucuaaacauaaggcugcauuaucgugaaauuaauccaccuugggugagauugugaagaaauacauauauguguguguguguguguguguguguguguguguguguauauguauauauauauacauauauauauguuuucuuguuuuuuucuugcgacugggucucgcucugcugcccaggcuggagugcaauggcaggaucacagcuuucugcagccucgaacuucugagcucaagggauccuccugccucacccuuccaaaguguugggauuacuggcaugagccaccacacccagcuuuccuuuauaaucuguuguauacuuucuaguuaaaagguuaaaguggguuuuagaaaugcugaugucuuaauuaacaugugacuugugauuuaggaaagaguguuuuuaaaaagaaagaaaaauacugaaggaucaggaagaaauaauugaucuugguagcaacaucugcugggaaaacacacuagcuaagcaagccuggucucuuagagaggccuaagauagggccacuuuugccagaaaaauuuguuuggauagacaguuuaggaaaggaaguuuacuagagagauaacugggaggaauucaaggaagaaucaaaucacaguucaaaguuuugguagcuuuggagacaacaguuuguaacugaauuucaaaaguuauaucuaaaguccaguuagauccuaucagugguaucaaguuaaaaaaaaaaaaagguggggggccaggcgcagugacucacgccuguaaucccagcacuuugggaggccaaggcaggcugaucacgaggucaggaguucaaaaccagccugaccaacauggugaaaccccgucaccagaaaaaaaaauacaaaaauuaguugggcacaguggugcgugccuguagucccagcuacucgggaggcaggaaaaucacuugaacccgggaagcagagguugcaccccagccugggcgacagugagacuccgucucaaaaaaaaaggccaggcaugguggcucacaccuguaaucccagcacuuuaggaggccgagacaggagaaugacgugagcccaggacuucgagacuagccuaggcaacauagugagacccugucucuacgagaaauagaaaaaaauuagcugggcguggugguucacaucuguaguaccagcuacucaggagcuuuaggugggaggauugcuuaagcccugcagguugaggcugcagugagccaugauugcuacugcacuccagccuggguaacagagugauacccugucucaaaaaagaaaagaaaaauaaagcccaguuaggugggauggauuaucuuuuacaacugagauagagaaugugagcuagcaggguauaaaaaaggcugcuuuuuacaccuguuuguauuuaaauuaaaauaacuauuuaccuaccuaucuuuaguaugagguuuugucuuuguaaauaagcuuaucacaauagucuguuaaacagaagagguucuacagagaagugaagguaaggaaacucagcuguaacauuuguaagaauguuucguaauuccaugaggguagcaauaguugguaaaugcagucuucucugaggauauccuaagcuaguuucagaguccaagauaaaccuuuguucugauuucuucucuucuagcuuaagccauuuauacuaaaggucuucuguccuucuguuacuuugcccuuugcaagacuaaacuccugugcuuuuccugucaucuugugcaaucacuaccauguuucucuucucaaaugcguugguuccucuguugcauccgucucugccauauugucuuuccccuccuggccucuuccucucuugccuucaaauaggcaagucuucucuugaugucaggugauccaugcgccuuggccucucaaaguucuggaauuagaggucugagccacugugccuggccuaguuauuuacauuuuuaauucauuuuuucuuacauucugccugcccuuuccaaccacauuauugacaccauagagauacaccuuagacuacuuuguccucuucuacagcuagccuggcauauucuuuuuagguacucaaaaaauaaacuuaacgagauaccagugagaaccuucuagaugcugaauuguccaguauaacggauaaggucuuauuaacuuucgugacagaaaaauccagguauuuauaaaaauaugagcccuguuuugguuuugacaaccuuuuuacauuuuaagacuauguuaacauauuaacauuuuaauuuaccugucacugaggggaauggauucauguuaacuucucauaaagaggcguacagccugugcagcauggcgaaacccugacuccauaaaaaaauacgaaaauuagcugggcaugguggcuaaugccuauagucccagcuacuuggggggcugaagugggagaaucaaccugagccagggaacgucaagucugcagugagcuaugauugcaccacugcacuccagccugagugguagagugagagccugucuuuaaaaaaagaaaaagaaguguguguguucacaaguucacuaauucguauaauuuggcucuucggcagauccugucuaccuuucaugaccaacuacaguuuucauugcaacgucugccaucacagugggaauaccuauuuccuccggaagcaagcaaguaagaacaaacucuggaguauuugaagaugauuauccacuggaaaagaaaagggaucugggcguagcagaaucaggagaccuuugccuaguagcugguauaaauucaguugggguuuagcucugaauaauugcaauugcccauuucaggucacaugaugacuccauuuugcugcuauaauuguuauuuucuggaccacuuaucgaguauucccuugguaguagagauguaguacuacagauaacuguuucuuccuuuuuguuuuugauagacuugaaggaaaugugccuuagugcuuuggccaaccugacauggcagucccgaacacaggaugaacauccgaagacaauguucuccaaagauaagguagagguggaacuaaugugauugcaguuauauugaagaguuagguggaacuucuaaauauacucccuaacaaguacuuucuucccaguuuuuauugaauauaugacaguggauucagugauuaccuuguucucuuuuuuuuucaagauggaaugcagugaugcgaucucagcucagugcacccucugccuccugggucccagagauucuccugccuccgcuucccgaguagcugggauuacaggcaugcgccaccacgcccagcuaauuuuuuguauuuuuaguagagacaggauuucaccguguuggccaggcucaucuccaacugaccucaugauccacuggcuucggccucccaaagugcugggauuacaggcgugagccaccgcaccuggacuguuguguuuuuuuugagagagggucucugucacccaggcuggagugcaguggugugaucauggcucacugcagccuugaccuccugggcuaaagcaauuugccuuccucggccucucaaagugcugggauuacaggugugagccacugcacguggccucuuuuuaguuuauuuuuuccaaaauuauuuugaaaaguuucaagguggaauguagugacaccaucacggcucaccgaagacuugaccuccugggcucaggugauccucccaccucagccucucaaguagcugggacuacaggugcacaccaccacacccagcuaguuuuuaugguuuuuuuagagacaggguuucgccacguugcccaggcagguagaacucccguacucaagugauccguccgccucagccucccaagguguugggauuacaggugugagccacugcacccggcccauuucuucuuagauuuaacaguuaacauuuugcuacauuuguuuuauguccccauauaucuguuuuucccuuaagcuauaugaggcuacauuguggguacacuuuacccaauauucuguuauacaaccacagugccauaaucauaauaaaaaaauuuaacauuggugcaguacuacuaauuuacaguucauauuuguaguuucucaggauuauuuuuguguuaauaauauccuccucuauagcuucuuucuccauccaggaucuggucaggaucacccauuacauuuaguuguaaugacuguuuugucucuaaucuauuaauaaaacaauuccuuuauucaguuggguuuugcucuauuacccagccuggagugcaguggcacaggcccggcucacugcagccucaaccuccuguguucaagcuauucucccaccucagccucccgaguagcugggauuccaggcgcaugcuaccacauccagcuaacuuaaaaaaauuuuuuguggagauguggucucacuagcugguuucgaccuccuggguucaagugauccuccugcuuuggccuuccaaacgucugggaauacaggcauaaaccaacacacccagccccuuuauuuauuuauuuauuuauuuauuuauuuaaugaauuaaaauuuuuuaagugcuuaggcaguuguuuggcaugauauuccucaauuugcauuugacuuucuucaugauuauguucagguuaaacuuuuuuuuuuccgcuuuaauagggacaggucucacuauguugcccaagcugaucuuacacuccuaggcucaagcaaucuaccagccuuggccucccaaggugcugagauuacaguugugagccacugugccuggccauguguuaaacaucuuuggcaagaauauuacauaaguauuguguguuuuuuagacugucacaucaggagguauauaagauauugcuuuguuuuauuauuagugauccuaaauuugacuaguugguuaaggagggagcauuuuuaucuuugugcuaaguaauccuuaagccauacauggagauuaugugaguacuuuauuuuccuacuccuuucaaccagugauuuuuagcccccauugauuauccaacccugaaucaguuguuagaguaguaguuguaaaucagaauacauucuuugguugcaagucuucuguaaauaacuuucccucauucuuuuucuucccuuuuaaauaucacuguggauuauuuuuuaaaaaucaguguguuauaguccauuguuggaauuuuuuuuuuuuuuuaauugagauggagucuggcucugucacccaggcuaaaauguaguggugcgaugucucggcucacugcaacuucugccuccuggguucaagcaauuauccugccucagccuccugaguagcugggacuacuggcgcaugccaccaugccuggcugauuuuuguauuuuuugguagagacaggguuucaccauguuggccaggcuggucucaaacuucugaccucaagugauccacccaccucagccucccaaagugcugggauuacaagcgugagccaccacgcccagcucuuguuggauuuuuucauuucugacccucagguugucccagauucaaccauuguagcccuaucagacugacuccugaaacucuuugauacucccccauccguuuuugaacucuuccuuacuuucuggaacaacaaaauauuccaggcuuucuuuguacuuucccugguuccuuucaguaaagauuuaguugucauggagcuaacucuggugguggugcuuuugaagauuaucuaaauaggaggccagaagaugaaggucaaaagucguuucagucaugcaagcaggaguuggugagagccacagucacagcaguggggauggaagggaguccugacugaagugacauuucugaaauuuuaaaauuuauuuggugagcauuuagguguaaaaauugugagagaagagucaaggacaacucuuaaugugucuagcuuauucugggugaugacugguucuaaguuaucaggagcaagaauagaaauccauaaagcagauuuaugagguaauauaccaaguuccauuuuagucacaagaaguuugaggucccuuuaggauguccagauagagaugucucagcugguagaaauaggaguucaagagagaauaauuugggagucaucuuccaauugacagccaagggacugugacagagcuuuucucuccaauuggaguguaagcccuacauggcuaagguuuguuuauacuuguggaaauccccauaaucuguguauuguguguaugcaaugaaauauucagagauuaaaagacaaacauguaaaccuuguauaacaccguggggggaaaaacuaacauggauuuuucucuugauucuaacaagaucuucgaaaaaugcuguuuucuuucuuugucagcauaucuuugauugcagcaguaauagucuuaauuuauuuugaaaauuaggauauuauaccauuuauugauaaauacugggagugcaugacaaccagacagagaccugggaaaaugacuuggccaaauaacauuguuaaaacaaugguaaguagauuaaaauugauuagacuugacauuuaaaaaaccauuguuuuuuguaagaauucaauaauaucgucucauugugaaaugauaaaauuagaacaacuuaauguuaaaucuuugagugugagauacagcuaauugugaauuuuaguaguuuucacacacagaaucagugagaugcauauugucuuauaugaacauugcccgcauacaccugguuuuauguauugaaacuuguccacaguacuuuuccaagaauaauuuuguauugaaauuagagaccauuucuuuucuucuauuaaaaaaaaaguuauaggcaauauuguccuuaaaauuaaagagagcaccuggggagaagucaacagcaagcuguuaacagugcuuaucuuugugaaauagaaggauaggugaggauuaugaaaaacuugggcacucuuuguguuucucuguuguuugaauuuuuugauggucacugauuauuucuuagaaggaaaaacgauacuaucuuuuuuggacacugcaccuaggaauugacuuuuagaguuagugguugauuauuaauuccauacuuuuaaguauaaaauguucauuaauaguaaaacacuacuucuuuuuagaguaaagaaagagauguauucuugguaaaggaacacccagauccaggcaguaaagauccagaagaagauuaccccaaauuuggacuuuuggaucagguacauuaauauguuuuacauuuucuuuuugauuuuaagccacucggggauagguaaucagguucuguuuacauuuguauauuugccacauaacacacugccauuauaugcacauagcaugguggacuccaaaaaaauagugacugauaugagaguacucaccuucaaccaagagaccaguguuguauaguguuuuuguugugggucuuccccaaaauguuaugaauuucuucaaaucacuuuuuuuuuuaacuuuaguuuccucgcuuguaacauguaaaaaugcuauuucaaauuacuucuaaucuuccugccaucuuaaauuuugcucuuaaaaacuuucuuuguugugaaaagaauuuguuuugaagaauuuguguugcauaucuaacauaacaggcaaacgaaaauugcuguuuuuuguucaacagcaggguucacauuuggcaagucagaaugucaaaucuuaaagcugugucuuuacauguuugauuugccagcuuugaaaaugcaagauucagcccggugcaguggcucaugccuguaauccuagcacuuuuggaggcugaggcaggaggauugcuugaguccaggcauucaagaccagccuggacaauacaacaagaccugucucucaaaaaagaaaaugcaagauuucacauagaaauuuagauuucugucuuguaaaaugaaaacaucugacugcauggggccugaauucccacaggagcugagugaauggggcuuaggcacucugguuugcccugugcccucuccugccucuacccaaguugauugauuaauugccauuuaucgccauucugaaacuauucugauccuuacacuuggccuaccucacacauacuugcaagguugcuugcugguccuuaaaacacccaaguuugggacucugcaagcuucauuguuuagaauuguccauuucagacugugcaugguggcucacgccuguaaucccagcacuuugggaggcugaggcgggcagaucauuugagaucgggaguuggagaccagccuggccaacacagcgaaacucuaucucuagugaaaauagaaaaauuaggccaggcaugguggcucaugccuguaaucccagcacuuugggaggccaagguggguggaucaccugaggucaggaguuuugagaccagccuagccaacauggugaaaccccaucucuacuaaaaaauacaaaacuuuagcuggguauggcagcaggcaccucuaaucccagcuacucaggaggcugaggcaagagaaucacuugaaccugguaggcagagguugcaguaagccgauaucgcgccacugcacuccagccugggugacaagagugaaacucucucaaaaaaaaaauaauaauaauuagccaggcguguuggugugugccuauaaucccagcuacucgggaggguaaaccaagagaaucgcuugaaccuggaaggcagaaguugcaguaagccgagaucgcgccacuguacuacagacugggcaauagaguaaggccccaucucagaaaaaaaagaauugucaauuuuaguucccauucuguuagaauuucucuuguuuuaugagcauccagauugacugacuuacguagacuccuuuuuuaauuggauguauuuuugcaggaccuuaguaacauugguccugcuuaugacaaccaaaaacagagcagugcugugucuacuagugggaauuuaaaugguaaguguuuacauaucucauugcugaaauauuuggaagcuauugaauccaguugugccuagaacuggccauucuuuggguugacccuuaaccuggauacuuacuaaaaugcuuuuauaguucaaacucaauuuuuaggaacuagccaaggauuuggcagaugguaauagaggagaacuuuuugucacuuuacaacaguuuggucuugagugagacagguuuagcauaagacaaggaaccauuucaaggucagauuugcuguguuuauaucuguauccuuauaacuaacauuaaauuuagaaagauucaucuccucuccacucuuuuucugcaauucagcuguuacuuuuaacagauuuccugugcccaucuucuaauuuuucuugcccugaaacuucagcucauucacaugauagcauuucuauauuaaccacccauugcagcuuguucuucuguuaacccaucuaauagcgggaaaaccccucguuacuaaugguuauuuaauaagaguugggguggcugagagauauuuagcuguucaucugauauaugggaucauuaaccugucuuuuggaguggucgcgucuuaaauaucugaucauuucuacuguuacuaauauuuuaagguggguuggaaauagcuaguguguuaucuuuuuacaacauauuuucccguuuuaauuguuaaaauuugacaaauacauggugccacuucuguucuuacagguggagccacuuuuggaggugaauuccuccacugucuucuuucagccucucagacuuaaguauuuugugguuuggaaaaugcuuuuugcugagcuaugguagaagcuaaaaacuacauaauuugaagcauuaugaaaauggcggcaauagcacuuaauaugaaacaguaguugaguuuaauguuaguauuuaagagcuuguauguugucauauucugccuaacauggccagccaccccacuucuguacuguuugcucuguucugguuggaucugaaacuucuuaaaauaaucaaaaugcaaaugacaauuaaaaauguaauuguggccacgcgagguggcucaugcauguaaucccagcacuuugggaggccgagacaggcagaucaccugaggccaggaguuugagaccagccuggccaccauggcaaagccccaucucuacuaaaaauacaaaaaauuagccaagugugguggcaggcgccuguaaucccagcuacucaggaggcugaggcaggagaaucguuugaacccaggaggcagagguugcagugagccgagaucgugccacugcacuccagcuugggcaacagagcaagacucugucucaaaaaaacaaaaauuuaauuguuuuuugauuaugguuacuuaaacuagagaugaugacauugcagcaguuuaacauuaaacuuuuaugaaaaauaggaauaacaucugagguguucaccaaaggaaauucugcauaaaaagucugguccuguauaugcagaauaugagccaccuucaaugucuugauccuuuuuauugcagcagaacugcuaguaauucccaagcuugccccaaauuaagauuuaguacucugcaguuguuuacguaaagguguuuuccugcaguucagggacauuuccuggaagagggaaaaauaaaacuaauugagaggaauuugaacuggacaaaaauuucaaaguaccuauuucagaaauacacaagguaaucuuccuuguggcuuuaguauguagcuaaauuuuuuguauaaaauauguaaauugucuauuccuauuuauugcuuuuaguuccacaagccagguuaaucuaaccugaauuuuagugcauuggcacaaucuuaauaaauguuguauuugacgaauggguauggaacuaaaaauugccuagcaaaucgaaagccuucuuucuuauuugugucaugugcaaccacgauggagaucuagcaguacuggagagaaacaccuuuuuaguacuucuguuuccguuuuccauguuggauguauuuugucuuguuggauauucagguucaaugcuuuagcagauacugugcuuuuaugauguuuauggacuguauuguguaguucaagcaagugaacaucgacuuacagugaggauauucucucuuuauggguguuuguauuaauuuggaugaaaaaaaaugugcccauacaguuguuuucauucuuuuuagcuguggguguuugggaucugaaugagugagaaugcauuugugucacacccugagaaaguauaccaauaguugcaguuuauuaggaacaaagguugaaaacuguaacccaaccaucauagugcuggauucauuugaguuuauugccagaacccaguguucccaggcuaugagaugcucaguagauucuuugaaaacuagggugaaauccaauaugccuuuggaaggaaauccuccugugguguuacacaaaugcacauuggguguguuggucccuauggaauuucaguauccacaugguguuucccuuguggcucauugaaagcaaucugccuucucuucaaagggggaauugcagcaggaagcagcggaaaaggacgaggagccaagcgcaaacagcaggauggagggaccacagggaccaccaagaaggcccggagguggggagagugcccacccugccccccucacuauuuaaguauuauuuggugcugggaaaguccagcagagggaagagaguucaagggucggagguuaaaaagccuguccauuuuuucuaaaccuugagcacuuugagggacaaaauaaccccagguuggaggccaggcgcaguggcucaugcguguaaucccagcacuuugggaggucaaggaggguggaucacuugaggccaggaguuugagaccagccuggccaacauggcgaaaccccaucuccacuaaaaauacaaaauuaggcagguguaguggugagcgccuguaaucccagcuacuugggaggcugaggcaggagaaucgcuugaaccugggaggcggguggcagugagccaagaucaugccacugcacuccauccugggcaacagaaugagacuccgucucaaaaacaaaacaaaaaacaaaaauaauaaccccaggccgggcacggugggucaugccuguaaucccagcacuuugggaggcugagacaggugaaucaccugaggucaggaguuugagaccauccuggacaauguggugaaaccccaucucuacugaaacaaaaaacaaaaaaauuagcugggccugggggcacgugccuauaaucccagcuacucgggaggcugaggugggagaauugcuugaacccaggaggcagagguuguagugagcugagaucgcgcuaucgcacuccagccugggccacgagaacgaaacugucucaaaaaaacaaaacaaacccaaguuuaagugucauguuuuacauuuaaguguacauacauuuguuaguacaaaauuuauaguaguaacaaguauagugucuucuggugauaagccuggggaaccuagggagugaaguucuguuaaggcgacuugagaaaggauagguggggagggagugaaaccaguguugaauguuagcuccuuuagcuccuuaacuuucugcuucucccuucucaugccuuuucccuucccuuugucuaaagcugaggugaugaaauccagguugcuuauuuauuuauauauuuuugugagauggaguuuugcucuaucacccaggcuggagugcagugauggaaucucggcucacugcacaaguuauuuacuuagauuagcaagauagcaagugcuuaugucucugagcuucuguucauuacuuuauaauaaucaguauacuaaagacuaucacccuaaucacccccauuccucuccucccuuccccccccccccccccccgcauaauguaccagcucaguuucauagacaucaauucauguuuaaagaccacugggaagauauccacaaucuacaaguaauuucaccaaaacuaccuugcucaauaaagcuaauccuuuucacuuccuuguuuugccugaagagggcagaguuacuuauuugaguaaugagaaguauuugcugugaaguugcauguauucuagcugaaauaaaccagaggccuuucuuacacaguugaaugcauuugagcuaaaggggguuuuaguuuuuugauguuauuuuuuccuuucugcagugacccuuuguuuucugcucagcgccuucccccucauggcuacccauuggaacacccguuuaacaaagauggcuaucgguauauucuagcugagccugauccgcacgccccugaccccgagaagcuggaacuugacugcugggcaggaaaaccuauuccuggagaccucuacagagccugcuuguaugaacggguuuuguuagcccuacaugaucgagguauguaaaguauuggagaucauauggaugcaggguuacuuugaacugccaucauuagccuugucagucuagaauuagguguacaucucagucuguugccacugccucacccccaucucugucuagauucauccagaaugugcaagaaauucuguuccuuccuauaagcuccagccguuuuauuuauauauauauauauauauauauauauauauauauauauauauaugguuuuuuaaaacuuucuauuuugaacuaauuuuaaacuugcaguaaaguugccaaaaauaaguuuucuuucucaucaagcuuuuccuaaugauaauaucuuagaaaaccauaguacaguuaucaaaacugggaaauuaacauugguaaauauuaucaacacaacuagagaaagaccuuucaauuuuaccaguuuuuccacucacacuuaauuauuucucuuuagucuauuauagucuuuaacaguuccaaagccauugcuuaucuuucaugaccaugauauuuuuaaguguuuuaaucaguuauuuuguugaauauuccucagugaagauuugucugauguuuucucaugauuagacugaaguuaggcaguuuggggaagaauaacacggaaacaaugucuuauagcaucaucucaugggauucaugaugucaguaggucuuauugguuacguugaccaugaucauuugguuaaggugauucugcuagcuuucuccacuguaaaaaacuaccgucuuucccuuauacuuaacaaaugucuuaggcaaaaauacaucgagucuaucuaugcaaauaucuuguuuguuuuuaaacuuauguucacuaauuuuagcacccaucaguggauauugucugcaacaauuaugacuguguuguaugaugauuuucgauuuccucuuucccuuuucuguuaauugauuauuuauaucaguauggacucauauauauuuacuuuauuucagggaguauaauccaauacuuugauuauuuuguuguuuaaauuauuccagcuuuggcaaguaggagcuucuucaagaaguugguucuuguguucuuucgauaagccgugucuuuuuuuaaaaaaaaaauuucuuuacuuugaggcaucaaaagguguuccuggccaaucuuauauuuucugugccccaggccuacuucuuucaccgagcccugguuccuuugauuggagcauguuguuuaggaauaacaucuaggugcucacuuccauauaucacauauacgaaaauuagaaugauaaagagaagaugcauggccccugugcaagaauaacacacaaauuugugaagcguuccuuauuuuuuuuuuaaguaauaaaguaaauaaacaaauagcaauuaauaucuagguguuaggugugcuguuacuaggcgucauugcuucuagacuuccucaguggucagagguaggaagugcauguguguauguacaaaccugcauguacacagauaacaauuuauauugauaccuggguugacagccuuccuccuuuccuuauuuguaaggucuuucuccaacagugggaaaugugaauaauuagauaauuaucuacaauauauuuacuuuauuucaauauauuuauuuuguuauagagaucagagucucacucaggcugguaugcagugaugcaguccuggcucacugcagccucaaccuccugggcucaaacgauccuccugccucagccuacugaguagcugggaucacaggcacacgccaccacaccuagcuggguuuuuuaauuuuaauuuuuuagagguggggucuuacuauguugccuaggcuggucucaaacuccugggcucaagccgucauccugccucagccucccagggucuugggagugagccaccauucuugaccuugcucauauuuaauaugcacauaaaguaguuucagaauuucuuuuuuuuuuuuuuuuuuuugaguuggagucuugcccugucacccaggcuggagugcaguggcgcaaucucggcucacugcaaccucugccucccggguucaagugauucuucugccucagccuccugaguagcuggaauuacaggcacgugccaccacgcccggcuaauuuuuuguaucuuuaguagagacgggguuucaccguguuagccaggcuggucuugaacucuggaccuugugaucugcccgccucagccucccaaagugcugggauuacaggcaugagccacugaacccagccaguuucagaauuucuaaucccugggagaaacauuuacuaaguagauuauagcauuuauauauagcucuuuuugucuuuagacuugccguacucaguccaagguacugguaacuuagauuaguucuuuucuuccccacuuccuuuagugggucauguccaguuaagucagguuuauuugcuaguguuugaugccauuuuggauucucccacauguugauuguuuguguguauguauguuuggagugaggaugugugaaacauuacuaugguucugggagucagagcuguacagaacgguuuacaaaaugucacucccucaucaccccuacagugcccuucucacucucuuuuuuccaccaucuucccacucacacucuaguuucuaguuuauccuugcuguauuucuucacaaaugagcagauacaguacauguauauauucuuuuaucucccuuuuuuguuugucuguuucuguguuuuuuugguuugauuuguuuuuugaggcuagaaggcaguggcgugaucucggcucacugcagccuucaccucccuggcucaagcaauucucaugcugaagccucccgaauagcugggacuacaggugugugccaccacccguggcuaauuuuuguauuucuaguagagaugggguuucgucauguuggccgggcuggucucaaacuccugagcucaggugaucugcccaucucagccucccaaagugcugggauaacacgugugagccacugcgcccagccuuaucuccuuuuuuauacaugaauagcagcgugcuauauauauagucuuugcuccaugcaauuauuuuauuuuauuuuuuuuuuuagaaagguucuuguucugucacccaggcuggagugcaauggugcaaucucagcucacugcagcuucgacuuccuggcucaagcaaucuucccaucuuagccucccagguagcugggacuacaggcacacaucacugcacccagcuaaauuuuaauuauuuuuuuagggacaaagucuccuucacuguguugcccaggauggucuugaacuccugaccucaggugauccuacuuccuuggccucccaaagugcugggauuauaggcaugggccauugcaucuggccucauuguuuauuuguuuguuuucaagauggggucucacucugccacccaggcuggagugcagugguguaaucauggcucacugcagccucaaccuuuccuguuaaaaucagccugcaaagccucgaaauucucucccaccuuuugccauuuuuucuuucuguggaagucaugggguucuccccugauuauuuagauugcucccuuaucucacauaauggccugguaauaaaguaagauucaaaccauaugcagagguagagagaugaauuacagugaauaccugucuuagucccuuuguguugcuacuaaggaggacuugaggcuggguaauuuguaaagaaaagagguuuauuuggcuaaaagaagcauggcaccagcgcuugcuucuggugaggaucccaggcauguccagucaugguagaaggcaaagcggagcaggcguuagauggcaagagaggaagcaagacagggagggaggugccaggcucuuuuuaacaaccagcuccucagaaacuaauagagugaaaacucacucacauccccacauuccgcauuaaucugcucuugagguaucugcccuccugacccaaacaccucccaucagaccacaccuccaacauugugaucaaauuucaaccugcacuuagggucaaauacccaaacuauagcgauaccuuguacacuuuucacccagauuuuaacaguucaagauuuugccauguuugcuuuaucuguuuauuucuuuuucuuuuucugaauuaaaaaaauauauauaucacccuauguacacuaaaaacuaugcaucucuuuaaaaaugcggcuauuggggccaggcacaguggcucacgccuguaaucccagcacuuugggaggcugaggcggguggaucaccugaggucgagaguucaagaccagccugaccaucaugaagaaaccccuucucugcuaaaaauacaaaauugcgggccuggugguaaucccagcuacucgggaggcuaagacaggagaaucucuucaaccugggaggcggagguugcagugagccgagaucgcgccauugcacuccagccugggcgacaagagugaaacuccaucucaaaaaaaaaaaaaaaugcagauauuuucuuuuauaaccaaaauaauuccuugcuaucauccaaauucaguucauaaucagauuuccuugauugucuuaaauaccgguucaucuccugagauauuuauuaauuacaaaaggaaaauugucauuuagcaguggagaaaccuggcaggcaucaucuuaaucaagugaccagggugaacaucacuauuuugauagcauauaugaugcacugaggggcacaacauuaccucauuggaguuccugaguaagaauaacaauaaccuugaccuuaaaaugaggaaacgccaggccgggcaugguggcucacaccuguaaucccagcacuuugggaggccaaaguggguagauaaccggaggucaggaguuugauaccagccuggucaacauggugaaaccccaucccuacagaaauagaaaaauuagccaggcaugauggcaggcaccuguaaucccagccacuugggaggcugaggugggagaaucgcuugaacccgggagccagagguugcagugagccgagguugcaccaucacacuccagccuggaugacagagcaagacucuaucuccaaaaaaaaaaaacaaaagaaaacaccagacaaauguaacugagggacauucuacaaacugaaaugaccaauauucuucaaagugucaagcuuaugaaagguugaggaacuguuugagauuggaagaggcuaaggagacaugacaacuaagugaaauguggaaucuaggauuagaaccugggccagagaaggggauauuacuuggauaauuggcuuaauuuuaagaagguccauggauuauuuaauaguauuauuguuaauuuucugguuuugaugauuauguuaaugauuauacaugaugugaacauuugggaaaacugagugaagcacacacuaggacucuacuauuuuuugaaaguuugaaauuguuggccgggcgcgguggcucacgccuguaaucccagcacuuugggaggccgaggcaggcggaucacgaggucaggagaucaagaccauccuggcuaacacggugaaacccugucucuacugaaaauauaaaaaauuagccgggcgugguggcgggcaccuguaaucccagcuacuugggaggcugaggcaggagaauggcgugaacccgggaggcggagcuugcagugagcagagaucgcgccacugcacuccagccugggcaaaagagcgagacucugucucaaaaaagaaagaaaguuugaaauuguuuuaaaacaguuaaggccaggugcuguggcucauuccuguaaucccagaacuuugggaggccaaggagagcagauugcuugaguucaggauuugagaccagccugggcaacuuguucaaacccugucucuucaaacaauuagcuggaugugguagcacuuguaguaccaacuacuugggggcugaggcaggaggauuguuugagcccaggaaaucaaggcuguagugagucaagaugacaccacugcauuccagccugagcaacagcaugagaccuuaucucaaggaaaaaaaaaaaaaacuagucaagaggcuagccacaguggcucauaccuguaauccuggcacuugggccaacacaagaagaucgccugaggccacgaguucaaggcuauggugagcugugguugugcgacugaguaagagagcaagacccuggcucuuaaaaaaaaaaaaaaaaaguuaaauuuuuuaaaugaagauuuauucaaauuaaguuccaaacucaucaccauugguuuguuauauuugagggaauaugcaauauaauuaauaucaaucagaugucuuaaaguuaaucacauguaggcugggcucagugacucagccuguaauuccagcacuuugggaggucagugcagguggaucaccugaggucaggaauucgagaccagccugaccaauauggugaaacccgucuguacuaaaaauacgaaaauuagcugggcgugguggugggcgccuguaaucccagcuacucaggcugaggcaggaggauugcuugaacuugggaggcggagguugcagugagccaagaucgugccacuguacuccagccugggcuacagaacaagacucugucucaaaaaaaaaaaaaaaaaaagauaagccaggugcgguggcucaugccuguaauuccaacacuuugggagaccaaggcgggcagaucacgaggucaggaguucgagaccagccugaccaacauggugaaacccugucucuacuaaaaauacaaaaaugagcugggcgugguggcacgcgccuguaaucccagcuacucgggaggcugaggcaggaaaauugcuugaacccgggagguggagguugcagugagccgagauugcaccacugcccuccagccugggcgacagagcgggacuccaucucaaaaaaaaaaagauaaucacauguaauaaaaacuaaguaaccuaacaacuuucucuuuuuuguugcuuucucauuccuugccaguaucuuaugcugagauuuuuaaacuccucaacuaauauuucaaacaccugaccugauauuugugauuuuuaaauuguuuuauuggacuaauguuuuuguggcaauuguccccaagaaccucaaauaaguugcaggccuucuuuuaaucucugucaccgcagcuccccaguuaaagaucucagaugaccggcugacugugguuggagagaagggcuacucuauggugagggccucucauggaguacggaaaggugccugguauuuugaaaucacuguggaugagaugccaccagauaccgcugccagacuggguuggucccagccccuagguaagcuggggccuuaauauggacaucacagcagauagagaggauagaccaucuggccaagggcuaaggcuucaaggcuguuggguuuaccagauugugggcauagaauucaguuccugaggguugagcugguuugcuauucccgggauauuuuuguaauucuuugcuugugagaaaguuuuuaagcaauuuuacaaaauugaccaaaaaacauaaaaagaaauaggaucuuuuuccuucagcaaacuagauuugacuugcaaucuucugacuuccuguguauguuuuuauugggacaggaaaccuucaagcuccuuuagguuaugauaaauuuagcuauucuuggcggagcaaaaagggaaccaaguuccaccaguccauuggcaaacacuacucuucuggcuauggacagggagacguccugggauuuuauauuaaucuuccugaagacacagagacagccaagucauugccagacacauacaaagauaaggugaguuuguccucucccggcagauuccuggcuuugaaggccuguggcagccagugcuuaucacuggcuugugugaucucuuaggaacugagccacagcucacguuuuuuccuaaccuguugcuaugacauuuucagaauaacaguaacaaucggugcacaaauagucauccauucauucuucuacccaucuaucauuugucuuuuuuuagugcacuacagagaaaaugacagacaucaggacacuuucccacuaaguacuucaggauacauaagcuagaauucagccuguuuaauucauucuuuugauacaaaauguauauaaaaugaaguacacaaauuuuaaguguacauucacugaguuuugaguuugaccuaaacuguugaaauguaggauccacuaggcaugaugguucacgccuauaaucccaacaauuugggaagccaagcugggaggacugcuugagcccacgaguucaagaccagccuggguaacaucacgagaccccaucuguacaaaagacuaaaaaagugccgauagucccagcuacuugaaaagcugagaugggagaaucauucagcccaggaguucaagguuacugugagcugugaucacaccacugcacuccccccaaaaaagagauguggacacuuaccaucaccucaggaaguuuccucaugccuuuucacaguuaguccucacccccacauagaggcaaccacuguuuuaacuuucuuucccaccauacuuuaauuuguaccucuucuugaacuuaaaugggcucaugcagucuguagucuuuuauaucuggcuuuugagacucauccauuuugcugcauauaucugugcacccuuuucagugcaggguaguacuccauugcaugaaugugccccaguguguuuaugcauuuuccuacugacagacacuugggccgucucagguuuggggcuacuaugagcaagaugcuaugaauauucuuguacagucuuuuuggaucauuggauaguuacauauuuagcuuuauaagaaauuuuccaaacucuuuuccuaccauauaugaggguuuuaguugcugacauuuaugauugucugucaacuuaauuuuagccauuuuugauggguguguaguaguaucucauugugaguuaaauuagcauuucuuugaugacauacugggcauuuuucaugugcuuuucggccacucauauguuuuuugugaaguuucucuucaaauauuuugccuguuaauauugcuauucugagacuucucuguucuuuuuuuuuuuuuuuuuuuaaguuuaaauuuuuuugguagaaacagguuugguauuuuuuguuuuuuuuuuuuuuuccauguugcccaggcuggucuugaacuacugggcucaagcaguucaccugcuucagccucccaaagugcuaggauuacaggcaugagucacugcacuuaauagugucuucugaggaaccaaaguuuuaguuuuuaugaagucugauuuaucaaauuuuucuuuuauacuuauuucuuuccaugaauuuaaaaaaaaaucuuuggcuacucccugucaugaagauauucucccauguuuuccuuugaaaacaucaugguguuagcuuuuacacauaggugucugauuuaccuuggauuaauuuuuuuuuuucuuuagauggagucucgcucuguugcccaggcuggagugcaauggugcaaucuuggcucacugcaaccuccgucucauggguucaagcuguucuccagccuuagccucccgauuagcugggauuacaggcacccgccaccacacccagcuaauuuuuguauuuuuaguggagacaggguuucaccauguuggucaggcuggucuugaacucccgccucggccucccaaagugcugggauuacaggcaugagccacugugcccgaccagauuuuuauguauaguauggaaauucauuuuuuuuccauaugauuacacaauuaucccagcaccauauguuaacucuuuccuuucuccacuggauuucuuugaugccuuuauugaaaaucagauguuuguguuaaggaaagguuuacuucagagcucuguauuucagugaucuguuucuuguccuuuaugcauguaucacagugucuugguuaucauagcuuuagaguaagucuuuaaauuugauaguggaaauacucugaguuuauucugauaauaagcagccuacagucucauuuuuauugauuauaucacacuagugacuuauuguaccauccugccucccggaacucuuuaaauguauaccacacugaugccugguuuuacagaacacagaggucugcacuuaaaaggauucuguagguguuuuuucaaugauucauuuacauuacaaaaaaaauuuuuuuuccuuuaauuaaaaaaaaaaacaaauuuuuugaccagacacuguggcuccaugcuugggaggccaaagcaggcaaaucacuugaggccaggagcucgaggccagccugggcaacauggcgaaacccugucucuacaaaaaaaauacaaaaauuaguuggaugugauggcacacuccuguaaucugaguuacucaagagguugaggcaugagaaucgcuugagccuggagggcagagguugcagugagccaagaucaugccagugaacuccagacugggcgacagagagcaagacugucucaaaaauaaauaaauaaauaaauaauuuuuagugacauguccacacgacagaauacuauggaucuauucaaaagccgcauauauacugauuauaaaauggucucuaauguaguugccaaguuaaaaacucaagaugcaagacaaaacuuauaauauguuaccauuuguauggcuuuuugggcuuuuuuuuuuuuuguauguuuaucugguguuuuauuuugaaacagagucucauucugucgcccaggcuggagugcagugguacgcagucucggcauacugcagccucugccucccagguucaagcaauucuccugcuucagccuccugagcagccaggauuacaggcgugcaccaccacgcccagcuaauuuuuauauuuuuaguagagacgggguugcgccauguuggccaggcugaucucaaauuccuggccucgugaucugccugccucagccucccaaaaugcugggauuacaagcgugagccacugcgcucggccacauguguguguuuuaauuuugaagacaauauaugccuagauucucuggaaggauaccaggacacuggaacagugauuacuuuuggcaggggaaacuggguauaagggacauagaaagagagacucucguuuuauaugcuuguauaucuugggaauucuucuuuucuaaccauguuuaauacauauauauguuaagaaauugaaauuuuuuaaauuaaugucauauauuucucuggaagugaauaguuaaauagacucuuaagaaccaguaagaaagaggugacccagagaccaccugugggaacagaugggaaacuaggacggggaagaaggugaccuucaaaauauuuucauagaauaagggauuguaggcuuggugcaguggcucgugccuguaaucccagcacuuugggaggcugaggcggguggaucaccugaggucaggaguucgagaccagccuggccaacauggcgaaaccccgucuuuacuaaaaauacaaaaaguaaccgggugugguggcacaugccuguaaucccagcugccugggaggcugagacaggagaaucgcuugaaccuggcaggccaagauugcagugagccaagaucacaccacugcauuccagccugggugacagagugagacugucucaaaaaaaaaaaaagaauaggcugggcgcaguggcucaugccugugaucccagcacuuugggaggccaaggcggguggaucaccugaggucaggaguuugagaccagccuggccaacauagugaaacccugucucuacuaaaaauacaaaaaauuagccgggugugguguaaucccagcuacucgagagccugaggcaggagaaucgcuugaacccgggaggcggagguugcagugagaagagaucacaccauugcacuccagccugggcaacaagagugaaacuccgucucaaaaaaaaaaaaagaauaagagauuguagacucaauaaacgucauuuuuuucagugagauuauuggaaaagaugugugaauuuagccacuuuuauggguauuuuuauugugguaagcauguauguauuauguauuuucucacguuucuuacuaaaggccuacugaaaauguuuuaauaaacaugugccaucugguauuuuuuaagaaguguguaauaguucaaaaucuagcaaaacucaacugcaaagauuuuuaauaucuguuguagagcucaagggguuaacacuauuugugugcggaugcguuuuuuucaugaugauggagcugaugcuuuauugugccuuuuuuucuuucuugguuuucaaggcuuugauaaaauucaagaguuauuuguauuuugaggaaaaagacuuuguggauaaagcagagaagagccugaagcagacuccccauagugaggugagucauggccauaagaacauuagaaucauaaggccuugagcguuaggacccauuccuucauuauaaaagugaggaacacgaggcccaaaggggaaugaaggggcaucugguagccccacuggccagcggcaagcucacccucugcuuauuguguuuugcucuuuauguaguaccaugcuucugcuguuagagacaugauccuguucuuucaggauaacucuguagagaaaaguguauaaaaauaguggccugcaccaccccaucugggagguguacccaacagcucauugagaacgggccaugaugacgauggcgguuuuguggaauagaaaagggggaaagguggggaaaagauagagaaaucagauuguugcugugucuguguggaaagagguagacaugggagacuucauuuuguucuguacuaagaaaaauucuucugccuugggaugcuguugaucuaugaccuuacccccaacccugugcucucugaaacaugugcuguguccacucaggguuaaauggauuaaggguggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuguaugcugaccuucccuccacuguuguccugugacccugccaaaucccccucugugagaaacacccaagaaugaucaaugaaaaaaaaaaaaaaauaguggccuguugggaaaucuacaagagacugaggaagcaaguccagugucuuuauucuuuaucagaggagguaucaaguccaaagggagggaaccuggagugggagaguagaccuugugguguggcccaggggcacuaggagcuguaacgucucacucaguguccuucagaacuuucucugccuccacuuccgggguugcuggaaacaugucugcccaaggucauagcacagucagagaaaggcuggcacaucugggccagccacaagcaccaaaaauaaaaagggaagugggauguagaggaagaaaguuaagcuggaaacauuuuuuucauaaaaaugcuaaugcugugaggccacccaggacacuaauagaaggagauggaggugaaauaaagaaacgaguuucagcuguuuuuaggaaagaaauacuaaagagaaauaauuauuagaucuaaagaugcaauaaccagaaagcccccucuugugggaagagaaggcagccuuuucugaagaauugaaguggucaagagaggauauucaguguaauucugggagagaaaggaggaacaugaggauucagagaugugacauaagagucuuagagaacuucaaagugaaaaagcagaagugagaacugacucggggaaaggaauugauaaacaagcacgcuuaaacagguguggucccaaggaguccauggaaggccagcuuacuuuaaaaaaaaaaaaaaauuuuguagagaugaggucucacuauguugcccaagcuagucuucaacuccuggccucaaguaauccucucuccucggccucccagcuuacuuuuauaaauacagugcaaugaauaauaaaauauagaaauguuugguauauguagcacaggaauucagaaaacaaagccccggacuuugagaccagucugggcaauacagugagaucugucucuauaaaaaaauuuuaaaaauuagcuggauauggugguguaugccuguagucccagcugcuugggaggcugaugugggaggaucacuugagccaaggagguugaggcugcagugagccaagaucacaccacugcacuccagccugagucacagagugagacccugucucaaaaaagaaaaaaaagccugaauagugcauauuaacaugcuuugaaaaaucgaaaguauuauaaaaauugaagauguuguuauuacacaaguuaugcacuguucuugggugagugacuagcagucuggcagcagcacuucuaacauauuuuccuagagaguucuuuuuuuguuuguucuuuuuuacaguucugaaguaaaaccaugguuuuuguuucagauaauauuuuauaaaaauggugucaaucaagguguggcuuacaaagauauuuuugaggggguuuacuucccagccaucucacuguacaagagcugcacgguacguacauguuuccaucccaugagcaaaacuugagggaagcagaugaauggguugugaugacaaaguuacugagugcuggaacgaaauccaagcagccucagaguggcaugcgcauguguuguuaccauuacuguuuaguccagaaacaguuugggcaucuuagggaguauuugcuggauagaaaaagguccugcaguuugugugcgccauacuuuucccuugagcacguggugugguguuaccguucaguaggaaggauauaaauacacauacacaaauccuccugggaugucaugauaacccaccauuauuagucauuguugcuuacaaugauuuuuuuuuuuuuuuuuuuuuuuuuuugagacagugucucacucuguugcauaggcucaccauagccuugaccuccugggcacaagugauccucccaccucagccuccugaguagguggggugugcuaauuuuuugguuuuuguuuuuguagaggcaggaucucacuacauugcccuggcuggucucaaagucaugggcucaagcaguucucccagcucagccucccaaagugcugggauuacagagaggcaugagguaccacaucuggcaaguuuuuuuuuuuuuuaaauaugauccaaacaugaagaaggguacuaucauuagggccuguugguuuuaaaaauauauagguagauagguagauagauacagauauauagaaaaguuggggcugggugcacuggcucacgcuuguaaucccagcacuuugggaggccaagguggguggaucacuugaggucagggguucgagaccagccuggccaacauggcgaaaccccgucucuacugaagauacaaaaauuagcugggcuugguggcacaugccuguaauuccagcuacucaggaggcugaggcaggagaaucacuugaacccaggaggcggagguugcaaugagcugaggucgugccacuacuccagccugggugacaaaacgagacucugugucaaaaaaaaaaaaaagaaagaaaagaaaagaaaacuuaggccagucgcgguggcucaugccuguaaucccagcacuuugggagggugacucaggcagaccauuugaggucaggaguucaagaccagccuggccaauguggugagaccucguugcuacuaaaaauauaaaaauuagccagaugugauggccacgcgccuauaaucccagcugugggggaggcugacgcaggagaaucacuugaacccgggagauggaggcugcagugagccaagauuacaccacugcccuccagccugggcaauagagugagacuccgucucaaaaaaaaaaaaagggcggggguggcgcugggcacaguggcucacgccuguaaucccagcacuuuggugggaggccgaggugggcagaucacgaggucaagagaucgagaccauccuggccaacguggugaaaccccaucucuacuaaaaauacaaaaauuagccgggcaucggccggguguggcggcucacaccuguaaucccagcacuuugggaggccgaggcgggccgaucaugaggucaggagaucgagaccauccuggcuaacacggugaaaccucaucucucuaaaaauacaaaaaaaaaaaaaaaagaaaaaaaaaagcugggccugguggcgggagccuguauucucagcuacucaggaggccgaggcaggagaauggcgugaacccaggaaguggagcuugcagugagccgagauugugccacugcacuccaaccugggcaacagagcgagacucugucucaaaaagaaauaaaaaauuagccaggcuugguggcacgcgccugucgucccagcuacucaggaggcugaggcaggagaauugcuugaaccugggagguggagguugcagugagccaagaucaugccacugcacuccagccuggugacagagcaagacuccgucucaaaaaagaaagaaaaaguuaaugcaugaagauuuccauguacuuuuagucugucaguaggcaccauugaagcagguaaaaaaaaaaaaggaaaucuuuaaacaguguaaaccaaaacuaucugagacagaucucaaucaauuuagaaguuuauuuugccaaaguuaaggaccugccuguaagaaaaaaacagaaucacagaaacagucuguggucugugccuuucuccaaggaugaauuugagggcuuaaaaguuuuaaaaagaaaaagggcuggacggaguggcucacggcaguaaucccaacacuuugggaggccaauauaagagaaucaguugagcccaggaccucgagaccagccugggcaacauagcaaaacccccuuucuacaaaaaaauacaaaaaauuagccaggcguggugguacaugccugcagucccagcuacuugggaagcugaggugggaggauccccugagcccaggaggucaagggugcagugagccgugaucgcauuguugcgcugcagccuggacaacagagucagagccugucucaaaaaaaauaaaaaguaaaauaaaggggaaaugcgggcuggaggggaaaguaggaggguauggucauccacauguugcaagagaaaaggagcagauaggggaaagucaauuauguauucaucucaugcccgguaaaucggcacuucacauaagguaaggugaacauaaaguagcugccuguggggauauuuaacguuuuaucuguaggugucugcuuagcaacaaaaggaaaggcaguuucuugcaugacucagcuuucagcuuaauuuuuuccuuuugacagagcaaauugggauccugaauuuuuauuuuucuuugacaacagaaaucaacacagaucucuuuuaguuaccuaauucuugauggacaucaggauguugaccacuuuuaguaauauuuaauauauaucuuauuuguuccauuuaucccccgaguauuguagccacauuuaaagugaaaauuuccugugucaaauuaacuuuuccaauauuuuuuguccauuuuuuccaugucugcuugaauugaauucgcuccagguuuccauuaacuuuggaccaugcuucaaguauccuccgaaggaucucacuuaccgcccugugaguaacauuacaaauggcugcauguguccucagcaucuccguggcugcuguagucaccguguucuguuucucauuccuccugcagaugagugacaugggcuggggcgccgugguagagcacacccuggcugacgucuuguaucacguggagacagaaguggaugggaggcgcagucccccaugggaacccugaccaggucccucuuuucugucaaggacuuucugggaauaauacuggggguuuuguuuuuguuuuugaacugucucaaauguucucccaaagaugcuaaaaacacagccucuccuuuuagcaaguuaaaaggcuggguaggacugcgggagacugccugccuuucaccauuuucuccccacuuccagugacugcucuuauuuuguguaccauaagccaacaaccgcugacuccaggauugcauaagcccccugugaaaucggugcuguacugcauacccugccagcugugacuuguuauccuacuauauuuucuaaggagugaauaauauuguccgaguaacuaacuuauuuaaaagacauuuccuucugugggcauugacuguaucccaccuguuuuccaaggaaaugguaaccuguuucugagaacaccugaaaucaauggcuauacauuccaaaccaaucuaaacgcuauuuccuuuugguguggguuugguuuuguucauuuugaaauacacuuuugaacacugagauccguaaaacuacuagaucucuggaaguguaauugugaaagaaacuugcuugcagcuuuaacaaaaugagaaacuucccaaauaaaacuuguuuugaaguuuaugugaca

SEQ ID NO: 191858 - RNA, 29864 nt, Homo sapiens
ggggcgaggcggagcgaggcuggaggcgcgggagggcagcgagagguucgcgggugcagcgcacaggagaccauguccgggggcagcagcugcagccagaccccaagccgggccauccccgccacucgccggguggugcucggcgacggcgugcagcucccgcccggggacuacagcacgacccccggcggcacgcucuucagcaccaccccgggagguaggcgcgggcuuggcgacgccgcuugccggcuccugggcgggcgggaggaucgggaaucgcggauuggaccggguguccaggcucaagggcgccgugauuggaaagaacggaaaaggggcaucggagagacagcgagggucauggaaguggccgcccgcuuccccucugagugcgucuuccagacccgaguuacaaacugccccguuuguuuccucuuucuguuaggugucagacagcugacaccuaacaaacacgcacgccuccaggacagccacaugccgagcugugcugccccuuguggguguugggggcgcucccgaagcgggagagggcggaguuaggguggcccacgauccaggagaggccuggccugguguuuuuaugggauggguauuaucuguugggauaaacgauuccugcagggcccuuuuuccuucccgaagcacgccgaguuuuguguuggacucgcgcgcucugacugagguucggaucugggggugcuugccugcuccagcagcgccucccgggcaccuguggcacguuccccauuuacgcgagugggaucuccgcgggggggacccuggcgccacggccagggcugugcagaaaaacacguucuucuguccggggagaggaggaggcaccgugugaccucccugggagaggaugaggaagaggaagcugagcuggcacgggugggggggccagccucgggcugcccucaggaaccuggcauucccucccagccccggagccccagcgcacagacgcugaugaaaccuacgcgccuguuugcaugaugaaauaaauccucguggcucucuccuccccucucauugucgcacugcccccaccccuuuuugcuccucucccuucauucuccuccacgcugcuuuccauacuacuagaaaacgcgacagauccuggcgcuuggcuagguggcgggcgggggccacaugcuuauuuucucaggcagcugucccaccagcagcgagcgcggccagauccgagguccucugcuguuugauccaaaacauacacuguuagaacgguuagggaucuuguccagcccugccgucuuauucuacagagcccggcauugaggccccagagcuugaacacgugucuguugcccauugucacaccguuuucccagauuggacaagaaauagcaaccaggcagagaagggagaaaugcuuccuuuucuauuagaaaugagccaaggaaaagcucgcaggggcucuuguugccauucccgacucauccucuuucccuugcugggucuuuuguaguccaugcuguucuccuuugucucugucacaauggucuaccaggacaauuccugacaauuuuggaguucuuucaaaugaggguguaagugucugcuggauuuguucagggugggcccugaggccggccugaaggcgcagguagcccuuuuuugcacucuuuauugcuggauuguugggucaaauuggaagccaggauacuguuuauaggcacuucuggcccggguaccaagguucacaccuguaaugccagcauuuuggggagccaaggcaggagaauugcuugaggccaggaguucaagaccagccugggcaacauagugagacuccaucucuacaaagaaacaaacaaaacaacaacaaaauguuguccuagcuacuacagaggcugaggccagaggaucgcuugagcccaggaguuggaggcuguagugagcuaugauugaccacugcacuccagccugggugacagagcgagacccuaucucuaaaauaaauaauaaauauaaaauauaggaacuucaaauccacuuuucacuuuggguugggaaguggggagugggcagggggcugacagaccacagcaaauccccuucccuuugaaggucuuuagcaguagggggaguggggaagggacuucugcaucagggcauagcauauguuucugagaucacuggaagaagcuagcagugccaggagccuaaagccagcucacuguuuggucguccaguggagcagguacagcucacagucccuaagccagggaaaccuggcugacuuccacuaaagucaagcaagccuggucggccucgauuagccaagguguggacucuuccuccaaagcccaccucagcccaccucugccagggcagagaagccaaaauggucacauugcagccaaaauggucacacccuuuugcuccagagcagaauacugccucucagucuuccaggugcuugaggauaacugggggcuucauuuaagugcauauucugauucuguaggugggggugggaacuagauucagcauuucuuucuuuucuuucuuucuuuuuuuuuuuuuuuuuuuugagacagggucucacucuaucacccaggcuggagugcaguggcgcaaucucagcucacagcaaccuccaccuccuggguucaagcaauccucccaccccagccuccccaauaacugggacaacaggcaugcaccacccaugcccagcugauuuuuguauuuuuugguagagacggggguuucaccauguugaccaggcuggucucaaacuccuggccucaagugaucugccugccucggccuuccagaaugcugggauuacaggcgugagucaccaugcccggccuagauucagcauuucuaacuagcucugacugauuggugcacauaccacacucugaguacucaggaauuagugaaacauaacuucccucaccuuucagaucucuggagucuagcaaaaaaaaaaaaaagauggcuccauccagguaaacuuugaucucuaaaucgugguguggagagccaggcuuuugauagagugucugcauggcugucugcaccugcuuacuuauagggacugucagcuucucaggaaaaaccauuggaguaaguaccccccagucacuccugcugggaauggcccucaagugauugucccuggagggaaagaagcagcaguuggguugcacuaucuccauuccuaugacuccaguuugcuuuccuuuuuuuuuuuuuuuuuuuuugagauggaguuucgcuuugucgcccaagcuggagugcaauggugagaucuuggcucacugcaagcuccgccucccggguucacgccauucucuugccucagccucccaaguagcugggacuacaggcgcccgcgaucaagcccggcugauuuuuuguguuuuuaguagagacaggguuucaccguguuagccaggauggucucgaucuccugaccucgugauccgccugcauuggccucccaaaguacugggauuacaggcgugagccacugcacccggcccuuuuuuuguuuuuuuccugagacagggucucauggugucacccaggcuggaguacaguggcacaaacauagcucacugcagucucaaacuccugggcucaagugauccuccugccucagccuugcaaguagcugggacuauaggcacgugccaccaugcccugcuaauuuuuuuauuuuuuuguagaggcagggucucuauguauuacccaggcuggccucaaacuccugggcucaagcaguccucccaccucagccucccaaacugcugggauuguaggcaugagucaccucaccuggccuccaguuugcuuuccauggucauuaaccauuugcacacugaggcucugcucugagguuagcuguccagaguacuuaagauaauuuaauugccgaagggagugucauguaugaauauuugagucuguggagucuuaaaaauauccagcgacaccauaaacagcucauuagccagcagaaccuuugagugggucagaaagaaacuuucccucaucaaucuccacauucccagcuccguguugcauguuugacucugaagccuauauacaggcuuggauggcaguugugccaaagacccguaccuggauaaggugaauccgaggugagcagguagggcugcagguguuaauggcacccuguuugguuaagcaaacaaggucugugcccaggaagcuuaccuuggagcagcucccaagucuuuggacaugaaacaggcagugcugggaagaaggggauguaggcugggcaccaaagccagagcacagcccauguccugaggccuuagucacauggagggaagaaauuauuaaggauggguuaaaagagcuuggacauuaaugcagugagggagaaacgauggacccucuucucacauuuaccugagcuuccuuuuaaaguguuugaaggagcugggugcgguggcucacuccuguaaucccagcuauuaggaaggcugagacaggaaaauuacuugaggccaggaguucaagaccagccugagcaacauagugagacucugucgguauaaauuaaauaaauaaaauuuuuuaaaguguuggaagcauuccacacugugucccuuauuaaagauuuggugggggguuccugguguagagcacuccaaaaucccuccaauccccagacuccuuuuuauuauuauuauuauuuugagacagaguuucgcucuuguugcccaggcuggagugcaguggugcaaucuuggcacacugcaaccuacgccuccuggguucaagugauucuccugccucagccucccaaguagcugggauuacaggcaugugccaccacacccggcuaauuuuuguauuuuuauuagagacaggguuucaccauguuagucaggcuggucucaaacuccugaccucaggugauccacccgccucagcuucccaaagugcugggauuacaggcaugagccaccacacccggccuuauuauuuuauuuuauuuuauuuuauuuuugaggcagucuaacucugucgcccaggcuagagugcaguggcaugauuucagcucacugcagccuccaccugccagguucaggcugagacaggagaaucccggguagcugggaugacaggcacgcaccaccaugcccagcuaauuauuuauuuauuuauuuauuuauuauuauuuuccucaagauggagccuugcucugucgcccaggcuggagugcaauggugcgaucucggcucacugcaaccuccaccuccuggguucaagcaauucuccugccucagccucccgaauagcuggguuuacaggcgcgcuaccacgccuggcuaauuuuuuguauuuuuaguagagaugggguuucaccacguuggccaggcuggucucgaacuccugaccucgugauccgcccgccucagccucccaaagugcugacauuacagccaugagucaccgcgcccggccuauuuuauuuuauuuuugaggcagagucucauucugucacccaggcuggagugcaguggcaccgucucagcucacugcagcauccgccuccugaguucaagcaauucuccugccucggccucccgaguagcugggaccacaaacccggcuauuuauuuuuguagagacagggucaugcuuugcuucugagucugacccucuaguuuuuuauuauuugaaaggagaggccaggugcgauggcucacaccuguaaucccagcacuuugggaggcuaagcagaucaccugaggucaggaguucaagaccagcuuggccaacauggugaaaccccaucucuaauaaaaauacaaaaaaaaauuagccgggccugguggcaggcgccuguaaucccagcuacacaggaggcugaggcacgagacucacucgaacgauucugggugacaagagugaaacuccgucucaaagaaaaaagagagagaguuugauuuuuuugcuuccuaaaagaccaaaaaaguccuucauugccaaaucugaggaaaaagggucagcagagcaauaccauauuuauccauugacauaaaguagcgaggcauuuucucauauagaccuuuauuuucauguucuggaagaugaguuaggaaggcacagcaauauuguuucuucuuuuuuuuuuaauuugaaacagggucucacuuugucacccaggcuggagugcaguugcagccucaaccuccugggcucaagcaauccucccaucucagccucccaaguagcugggacuacaggcaugcaccaccacaaccggcuaauuuuuguauuuuuugguagagaugagguuucgccauguugcccaggcuggccucaaacuccugagcucaaguaauccacccgccuugaccucccaaaguucugggauuagaggcaugcuccacugugcuuggccugggaaggcacagcaauauugaaaaaaaggaacauugcuuucuaaggugaguuuuaaaaaaaaaaaauguucaguugugcacauagauucuugccugugccaacaaacccaugaaaaaccuguuucuuucuggucugacuuagacccaugccuggggucucucuccauuaugauucauagcgaaugaaucacacguuuuuguuuacguguuuguucccuagguuagccaggaaauuuuuucugagcagucuuacucaucuuuguauccacaugaccuaaugccaggucuagugucuggaaggugaagaguugaaaagaaugcuggaaugaaagcguuccccucaggauaaccuaguuuucuuauuuuauuuauuuauuuauuuuugagacugagucuugcucugucgcccaggcuggagugcaguggcaugaucucagcucacugcaaccuccaccucccugguucaagugacucuccugccucgccuccugaguagcugggauuacaggcacgcaccaccacacccagcuaauuuuuguauuuuuaguagagacgggguuuaccauguuggccaggauggucucaaucuccugaccuugugauccacccgccucgaccucccaaaaugcugggauuacaggcgugagcuaccaugccuggucaggauaaccuaguuuucuuacugucaggccugagucuccgcuggcuuaaugaugacguuuaaauuuccuuuucuguccuuucaguugcaggguauaaguguuuaucucagaaugucccaggggcagaaacuaacuuucucuguuuugaugauguugucuguuuuuuguuuguuuguuuuuugagacaaagucuuacucuguugcagguuggaguacaguggcacgaucaugccucacugcagucucaacccccugagcucaggugauccuuuugccucagccucuccaguagcugggacuacaggcacacaccaccacgccuggcuaaucuuuaaauuuuuaguagugacagaguuuugucauguugcccaggcuggucuggaacuccugggcucaagagauccaccaccucagccucccaaaacacugggauuacaggcgugagccacuggaccagccagagaauaaccuucucugaacccuccuacuuauccucauacagauaguccccgauuaugauggugugacuacaauuuuugacuuuacgaugguaugaaagugauauguguucaguaggaauuguacuuuuaaaaauuguuuuaagacagauucuuggccggacacgguggcucaugccuguaaucccagcacuuugggaggcugagguggguggaucacgaggucaagagauagagaccauccuggcuaacauggugaaaccccgucucuacuaaaaguacaaaaaauuagccaggugugguggcacacaccuguacucccagcuacucaggaggcugaggcagaagaaucgcuugaacccgggagacagagguugcagugagccgagaucacgccacugcacuccagccugggagacagagcaagacuccaucucaaaaaaaaaaaaaaaggcagagucuuguucuauuaccuacauuagagugcauuggcaugauaucggcucacugcaaccuccgccucucaggcucaagcaauccucccaccucagucucucaaguagcugggauuacaggugugcgccaccacgcccagccuagaaauuguacauugaauugugaauuuugaucuguuucugggccagcgauacgagguacaugcucucgagaugcucagcagggacagugagcugcagcucccauuuagccccacaaacaugaggacaaauggccagucacaagcuuguccaacccgagacccucaggccacaugcacucuggacagcuuugaaugaggcccaauacaaguccguaaacuuccuuaaaacauuaugaaauuucuuucuuuuuuuuuuuuuuuuaagcucagcuggagugcaauggcacaaucucggcucacugcaaccucugccucccagguucaagugauucuccugccucagccuccugaguagcugggauuacaggcacgcgcaaccacacccagcuaauuuuguauuuuuaguagaaaugguguuucucuauauuggucaggcuggucucgaacucccaagcucaggugauccgcccaccucguccucccaaaguguugggauuacaggcgugagccaccacacccagccaguguuaguguauuuuauguguaguccaagacaauucuucuuccaguguggcccagggaagccagaagauuggacagcccacuauagagucuauagugugcuguguugccaggugguuuuguccaacuguaggcuaauguaaguguucugagcacauuuaagguagggaaggcuaagcuauaauguucaguagguuagguguacuaaauacuuuuuuuuuuuuuuuuuuuuugaguuggaguguugcucuaucgcccaggcuggagugcaguggugcaaucucugcucacuacagccucugccucccagguucaagccauucuccugccucagccucuugaguagcugggauuauaggcgugugccaccacacccagcuaauuuguauuuuuaguagagaugggguuucaccauguuggccaggcuggucucaaacuccugaccucaagugaucugcccgccucagccucccaaagugcuggaauuacaggcgugagccacugcaccuggcccuaaaugcauuuuugacuuaagauauuuucuauguaugguggauuuauugggacauacuucauuuuaagucaaggaacauuuguauuaaacaguauugcugguauuucuugucccaauauuaccgaacagggaguggaugugacuuuuuuucuuuuuuuuaaaaagcaaaaacaaaaaacuuuuaacagauagggccucaccucuguggcccaggcuggagugucuaugggcugaaguacaguggcgcgaucaccacucacuguaacuuugagcuccugggcucaagcaaucuuccugccucagcuucccgaguagcugggaccacaggcacaugcuaccacaccuggcuaauuuuuauuuuuuguagagaugaggucuauguugcccaggcuggucuugaacuccuggccucaggcaauccuccugccucaaccucccaaagcauugggauuacagaugugagccacugcaucuggcaacuuuuucuuacacugaacaagccaguauuggggccggggucucagacacugugacugaugcuguuuauuuaccuguuugcauccagcauugcugacaaggcaagaguaaguaacugcugcucacugacauuuggguaugcacagcaaagggcuccauguaaucugaugguuaugcccaugaaagcucauuaagagagcucagauacuaggcccagaggaucagggcuucuuaggugugcagggacacuuggugaaaaugguuguaucaguuagcuauugcuauauaacaagccauccccaaacaguaacuaaacagcagcgauuuguuauuguucuccaucuuuuggguucguuggguucuuuguagaucuugcugagcuuacucauauggcugcauacaguguacagcuggacuguccugggguggaagcuccaagauggucuuacccauacaucuggggcauugcuggggacagcuggaagccugggaguucccucuauccucuuggucucccaacauucugaucacucaguagucuagcuugaguuuuauuuacaugguaguuuccaaggccacuuaaggccuaggcucagaagucccauaacaucacuuaccaaguauucugucggucaaagcaagucacagggccagcccagauucagggagaggggaaauacaugccuguuguuguuguuguuguuguuguuguuguuuugagauggagucucucucuguugccugaguagcugggauuacaagcaugcaccaccaugcccagcuaauuuuuguauuuuuaguagagacaggguuuuaccauguugcccaugcuggucuugaacuccugagcucaagugauccgcccgccucggccucccaaagugcugggauuacaggcgugagccaucgcgccuggccuuuuuuguuugcuuguuuguuugacagaaucuggcucugucgcccaggccagagugcaguggcacgaucucagcucacugcaaccuccgccucccagguucaagugauucuuuugccucagccucccaaguagcugggauuacaggcaccugccaccacgcccggcuaauuuuuguauuuuuaguagaggcgggggucucaccauguuggccaggcuggucucgaacuucuaaccucaggcgaucugccugccuuggccucccaaaucacugggauuacaggcaugauccaccacaccuggcaggaaauauaugccuuuuaaugagagaagcuacaugugcaaacaggaaugggaggagugguaggagccacauuuucgaauaauccuccacaagggccagaccucaaagaaugggucuuagagggaacgugcugccuguccugauguguggccagcagagccaggaccaggugcagaagccgacuggaaucacaacccugugaaucaggguuaaagaacaaaggacaccuuccuaaagguacugacucauagaucccauacccuguucucacggccuuauguucacuuccacaaagcaaaccacacaaggucgggugcaguagcucaugccuguaaucccagcacugugggaagccaaggcagguggauugcuugaggccaggaguuggagaccagcuugggcaacauagugagacccugucuuuacaaaaaaauuuuaaaacuagccagguguagcagcaugcaccucuaguccuaguuacuugggaagcugaggcaggaggaucucuggagcccaggaauuugagguuacggugagcuaugaucacgccacugcacuucagccuguguaauagagugagacccugucucagaagaaaaaaaaaaagcaaaccacacagguggccaugaugcuggaccgcuaagcaaucuauuccucuuuguguugagccuucauugcaggccaucacccaaaccaucuccucuucccccuccaaguguccugcaggccaggcuuugggaacacucuucagaggagcccacaccugcccugcccuacccagcacuaccaugugaauauccuuaauuuucuguaguacuugcaauaggauggacucaugugucugugcccagcaguacaaaaccaggcaggaaugagaauagcagaggguacagucgggcucaguacucccuuugguuuggaaguggacaguguggaggucucuugccuuaaggagcaugugugugagugugugguguaaacagauuucucucuucugcccuucugaacacaaggguagagugggccugccuuaguuuacuauggcugccauaacaaaauaccacagauugggugcuuuaaacaaaaugaauuaucuccuaguucuggaggcuggaaguccaagaucaaagugccagcagggcuggguucugaggcccuucuccuuggcuugcagauggccaccuucucccuguaucugcacaugggccuuccucugucugcauccaaaucucuucucauaaggaccccagucagacuggauuagggccccacccuaacagccucauuuuaauuuaaucauccccuugaagacuuuaucuccaaauacaguugcauuccgagguacugggguugggcuucaacauaagaguuuugggggcaggccgagcaugguggcucaugccuguaaucccagcacuuugggaggucaaggcgggcagaucgcuugaggucaggaguucaagaccagccuggccaacauggcaaaacucugucucuacugaaaauacaaaaaauuacccaggcgugguggcaggugccuauaaucucagcuaccaggaggaggcugaggcaggagaaucucuggaaccagggaggcggaggcugcagugaguuaagaucaugccacugaacucuagucugggugacagagugagaccccaucucacacacacgaaaaaaaguuuuugggagagaugcuauucaacuauucagcucauaacagggccauuccccuuuccaacugggacagcaaucacuacuguuuguaaugggaggcauuucagaaggucauucccuauugguaaugaauuucagggacagcuucacccauagggugcauuugaaguguuugggaggagguuaaggaaggggaggagcuuggccagcaaucagaauaauuagcucagcuauuuuguucugaaagucucugucaaagccaauuuucuuuucuuuucuuuucuuuuucuuuuuuuuuuuuuuugagauggagucuugcucuguugcccaggcuggagugcaguggugcgaucuuggcucacugcaaccucugccuccuggauucaagcgauucuccugccucagccuccugaguagcugggaccacccggcuaguuuuuguauuuuuaguagagacagaguuucaacacguuggcaugcuggucucaaacuccugaccucaggcgauccaccugccucggccucccaaagugcugggauaacaggugugagcuaucacaccuggccugaagccaauuuucaaagaaacugaccuauucccucccaugccagggccucagagggagaggcugccgaucguccccaucugguauccagcagcuucauaagaccccuggccccugagaaauguugggaucuugguucucuuuguggaggucagcgguugcggggcagagguaaagaaaagucuuggacugagugugcucugcaucucucaccaggauuuccaccccggcaguucuguccugcuuguuaaauagaccauccagccagaaaagccacccagacacaugugauuccucccuggacuguguggcgaggagggagggaagaccgagauucuggcaugucggcguauuuaccuccagguuaacagggagcugccucagagcuggaguucagauuguccaggguguuuugcucacuggcuguuggcuuggaucugagcagaagcauuuggaccucccccaccccggcccuguugugaaaugcucucccucucccuggaaugggaacagcaguucuaggaauuccauccucguacucucacuaagccucacguccccacauccaauggaagaaugcuucugccaaaggaaccccaggggaaagugagggccaugcgcggcucaguuuacagaaguccuauccagccgcagaguaugggcacuggagggcuauggggaagcgcucaaggcagggaacauccuguucugacaagcacccagaagucuaagaccuccuaauuuuuccagcugagaguguuagcuaaggggugguagccuggucugccuuacuaauuuuauuuuauuuuguagagacagggucucacucuaucacccaggcuagaguacaguagcaugaucccagcucacugcagccucaaacuccugggcuaaagcgauccuccugccucagccucuggaguagcugggaucauaggcgcacgccaucaugccaggcuacuuuuuaaauuuuuuguagagaugggggucucacuguguugcccaggcuggucucaaacuccuggccucaagcaauucucaugccuuggccucccaaagcauugugauugcaggcaugauccagccuugcuaauuuuaaacaguaggaggcauuuaggauuggagucgagguggguuagguuggccucuggacggcugugaggggacagccuuucugggccucaguuuccucuucugcaaggugaagcuccugcguggggaguuguaagggggaauaagaccuagcacgucaggcugugagcacagaccggaggggaugacagauggcaacgauugcuguaugcaccucgcccgaaaaucuaagccuucauucaugcagcacuccaaugcuccuuggccuccaaaaaugcuuccuguucccggcuugugacaucuuucuuugguugcguauguucucccaagugauuuucucuuuaacagcaauuaugugagugucacuuuauucucacacaaagaaucuugauguucuuuauuuuauuuaaucuucacgauacuccucugagguguggauuuuguuauucccucccucuuauaacugaggaaugaaagugcaacuuggaguucagggacugacauguggcaagcucagguuugagcccagaacaucugccuccaagcacuaugcuauuuguacauuaaguaccugccaacaaggagauccuaaaaauaaauggcacgugccuggugcuuucaaaauaguuugaaugagccuaguacaaugccguuguuuuacaggugaggaaacuagaaccuaagggaaugucucuauggcuuuauuuauuguaaucccagaacuuugggaggccgagguggggggauugcuugagcccacaaguucaagaccagucaaggcaacaugacaaaaccuugucuacaaaaaaaaaaaaaaaauuagcugggcaugguggugcaugccuguagucccagcuacuugggaggcugaggcaagaggcucacuugagcccaggaggcagaaguugcaguaagccaagaucacacuauuguucuccagccugggcagcagaccgagacucuaucucaaaaaauaauaauaaugauaauuaauuaauagaaauauuuccuuacuuuuuuuagagacagaucuuguucugucucccagacuaccgugcagugguaaaauuguaguucccuacaaccuugaauucuggguucaagccauccuccugccucagccuccuaaguagcugggacugcagacaugcaccacaacaccugacuaauuuuuuuuuuguuuguuugagacagagucuugcucugucacccaagcuggagugcaauggugcgauuuuggcucacugcaaccucugccuggguucaagcaauccuccugccucagccucccaaguagcugggauuacaggcgucugccaccacgcccagcuaauuuuuguauguuuaauagagacaggguuucaccauguuggucaggcuggucucaaacuccugaccucaagugauccaccugccuuggccucccagugugcugggauuacaggcgugagcuuccccacccggccuacaccuggcuaauuuuuaacuucuuuuguagagaugggaucgugcuuuguuacccaugcuggucuugaacccccccauugcuuuauauauugaaagcaaacuacugucaccacaaagcaugccuugaaaaaaaaauaucauuccuauauuuggugcacauuuggaguuuaaaauccugaaggauacuggcuaacaaacaugcugaaguuuaugaugguucuugguuuccgugggccuaaaaaggagggaggacacccucacccugucccuuccaagugucucuccugaguugcuuaccuguccucugauuuaucccugcuuugacugauaauugguugcugguauggauggaacugaauaaauggugaaauuaugucaccuggacccugcaggucaugauaauaacuagaauuguauggggcuuacauugugucagccacuguucaaauccacacaguaauccuaugaaguuggcacuaccaucaucaucaucaucauugucgucgccaaucuggagaagcagaaacugaggcacaaagauuuuaagucauaacuugcccagagucaugagagcuagcaaauggaaugacagagcuggguuuccaaaggauuucagguagaaugagccucaguuauuguccccagauaguucaagaccgaaccuugaacucuacccccagcacacaacgggcuggaucccagcuacacaaaugguuugagguguaggggugcuccucucuucuucccuugcccugcugggaggcaggguucuggguuucccugcucugcaucucuggguuggcaaucaaggucagccuuagcucaccucccucaccccucgggcacuggagaacuggggugagauggauguuucucugggccggggguuuagggucaggcugcuuggaagcaggaagauggaggacuugggaucugugucccuuggugaucuccucuuacgccugucuguggacuucacacacuuggcuguaaucacuuguuuacgggucuuucucgacuaaauuacauaagguuuggaucuaggcacuuucacuacaucugacuuuuuuaaaucccuagcaccucgcauggugcuaguacaaaguagagguucagugaguaaguaaaugagaccagcacaccuacuuucaggaaaaaaggauugagcaaagaccggcaaauauguggguaaggauuaacauuuuugucccuggauugcaguagucucuauacuugaauacaguucaugggaguuaagguguaguguaggguuuuggguuuuguuuuuuuuuuuuuuuugagacagagucucacucucuugcccaggguggaaugcagugaugcgaucucaacucacugcaacaucugccucccagguucaagcaguuuuccugccucagccucccaaguagcugggauuacaggcacaugccaccacgcccagcuaauuuuuguauuuuuaguaaagacaggguuuugccauguuggccaggcuggucucgaacuccugaccucaggugauccacccaccuuggccucccaaagcacugagauuacaggcaugagccacugcgcccagccugaaucacuuuuuugauaaaugagguuuuuuuuauuucuguauuuucucucuuccucuccccucauugucccaauaaaauuacauuucaaaguuuuaaaaauccagccaggugcaguggcacacaccuguaaucccagcuccucaggaggcugaggcgggaggaucacuugagcccagaaguuugagucuagccugggcaacauagcaagauucugucuuuaaggaaaacaaaaaacaaaaacaggcugggugcaguggaucacuugagcccaggaguuccagcccacccuaggcaacaugguaaaacccugucucuacaaaaaaguauauacaaaaauuagcuggguguggugacacuugccuguagucccagcuacucaggaagcugaggugggaggaucaccugagcccaggagguccaagguugcagugagccaugauggcaccacugcacuccagccugagugacagagcaagacccuguuucaaaaaaaaaaaaauuuaaacuaaaauuaaaaguaaacauuuguuguuuuuauuaugaugauucuugagccaaguacuaucuauaauaauagcauuuccacuuuuauauauauauauuuuuuaaaaaaagcagaguuaauaauugcuuuguuuuaaaaaugugcuuaguuuucauuuagguuuucccaaaccuuccagaagcucucuaaaaugccucacaguaaggucuugcacacaguuggacuucuagauuuaucugcccauuuuuucccucucuccuaaacuaagacaagauuuggaguaacaguuuggcugcuccagcccugccacacaacugucaaugugggguucccugaagcccuagucuuucuauaauuuuggcagaacacaucuuacuguauucuuucugaaaugucucuauggccaggugcaguggcucacaccuguaaucccagcacuuugggaggcugaggcaggaggaucauuugaaaccagggguuugagaccagccuggguaacauagcgagacccugucuccaaaaauaaaauuugauuuaauuuaaagaaaaaagagaggccggguacgguggcucaugccuguaaucccugcacuuugggaggccgagacggguggaucaccugaggucaggaauucaagaccagccucgacauguagaaaccccaucucuacuaaaaauacaaaauuagccgggcuugguggugcaggccuguaaucccagcuacucgggaggcugaggcaggagaauugcuugaaucugggaggcggagguugcagugagccgagauugcgccauugcacuccauccugggcaacaagagcgaaacuccgucucaaaaaaaaaaaaaagaaaagaaaagaaaaaagagaaguaucucuguuauacuuuuacuugauuuguguuuggcaggggauaagaugcagguugaagugaauuuucugucagauugugaaggcgucaaggcaccguuugcaggcuuccagucuugccauuuaagacauuuuacgcccuucucauucccuguccuuguguauaccugaaaauccuauaaaggauuuucucuuuaucgccaguauugugaauuucacaaugauguuaacugaguguuuugaauucauugcacuacuuacugaaaggggagcuucaauuucaagacaucucuuucaauucaggaaaauuuccgucuucuuuuuuuuuuuuuuuuucuugagacagguucucgcucugucccccaggccggagugcaguagcgugaucucaacucacugcaaccuccaccuuguggguuuaagcaauccuccugccucagccucccgaguagcugggauuauagacacacaccaccaugccuggcuaauuuuuguauuuuuaguagagauggguuuucaccauguugucuaggcuggucuuaaacucuugaucucaagugaucuacccaccucggccucccaaagugcugggauuacaggcgugagccaccacaccuggccuuucuucauauuuuuaaaguaaauucccuuuuauuaguuucucuuuucuccuucuggacuuccugccauccaauauuggaccccuaauuuauuaucuuuuugccuauuguucaucucuuuguccuuuuucuuuuuucuuuuuuuuuuugagauggaauguuucucuguccccaggcccggagugcaguggcacaaucucggcucacugcagccuccgccuccuggguucaagcgguucucgugccucagccuccugaauagcuggacuacaggugugcaccaccacacccagcuaauguuuuguauuuuuaguagagacgggguuucaccauguuggccaggcuggucuugaacuccugaucucaugugauccacccgccucagccucccaaaguguugggguuguauacgugaaccacugcacccggccucuuuuguuuuucuuuaagauuuucugcuuccuuuauuaccuguuuccuccuguugauuugcuuagaucucgccuuaaaugcuacaagccuuucucagaaaugugugggaacauuugacugguugguuuuuuaaauuuuuuaaaauuuaguuuuugacacaggguuucacucugucaaucaaacuggaguauaguggugcagucuuagcucacugcagccuuggaccuccugggcucuggugauccucccaccucugccuccuggguagcuggaacuacagacgugugccaccacgcuuggcuaauuuuugucuuuuuuguaaagacaggguuuuaccguguugcucaggcuggucucaaacuccugggcucaagcaauccgccugccucggucuuuucuuucuuucuuucuuuuuugaaagacagggucucgcucuuucgcucaggcuacggugcaaugucaugauuauagcucacugcagccucaacuuccuaggcucaacugauccucccaccucagccuuccagaguguugggauuacuuacaggugugaaccacugcaccgggccuggcuguuuuuauuuaaggguggggaacucaggagcugaccaggagucccuuguguggcccagagacugauggguuccaucugguggcuagcugguuuuauucacuguggacccccaugccacaaucaguuucuguaggucuuuaucuucacucuuuauucugaagcaggggagaggagagggcuuaaggcucaccauucaggaggucaacuuuaauuucucugucaccccucuccuuggggcaagggacaccuggcaccccucugguaaguuugcuuaagagaguaaaccucagggcagcugcuagaugcugguaagaaccugggguuuccauuuuccauacagacuuccaagcagucucccuguuaucagcccccauccccagauuccaugcugugccuaauuccugaaccuuccugggguucucuggggcaaacggagaacuugcuccacccccaccucccugcauuucagugucacccgcuuccuccccaugagaucguugaccgcuccuguacuugccucugucuuuaccuguugugauuuggggugacaguuggagcucucccugcauccagguuggagaacgugcuuguacuucucauucuugguguuuggcaugacuuuugagaggaguaggagaaaaaugucauggcucugccaucuugaagucacuuugauccucaaaaguacuucauacucuuuguagugaccuaguggaggugggucauuuaccccaguguacagagggguccaagacaggccugcugaugacauaggaccucaguuaaagagguuuuguuuuccuuuuauuuauauuuuuuuuuauuuuuuugugacagagucgugcucugucucccaggcuggagugcaguggcacgaucucggcucacugcaacccccgccucccagguucaagugauucuccugccucagccuccugaguagcuaggauuaggugugugccaccaugcccggcuaauuuuuguguuuuuaauagaggcgggauuucgccauguuggccaggcuggucucgaacuccugaccucaggugaucugccugccucggccucccaaagugcugggauuacaggcgugagccacugcgcccagccuguuuuacuuuuaaagaugaggucucgcuguguuggccaagcuggucuggaacucccagccucaagugauccuccaaccuuggccucccaaacuguugggauuuacagaugugagucacugcgcccagccguagcccccaccuuuggcuaaagaguuuuauguggaggccacccuagcgugaugccacuccaccugcugaacacacacacagguuucugucagaccacaccugaccagcagcccugaagggaccuuggcauccaucccacccacucguguuuccauuuccugaccuuguacaugggccaaguguccccagcaccaaguagcucugcagcaggugucuucagccaggcuuuaagguuugucuuuuuuuuuuuuuagacagggucucgcucugucucccagacuggaguccaauggugcaaccacugcucaccacagccucaaucucucaggcucaagcgauccucccaucucagccucccgcguagcuaggacuccaagcgcaugccaccaugccugguuaauuuuuuaaaaauuuuaguaggccaggugcaguggcucaugccuguaaucccagcacuuugggaggccgaggcaggcggaucaccugaggucaggaacucaagaccugccuggccaacauggcaaaacccugucuccacugaaacuacaaaaauuagccaggcaucuguaaucccagcuacuugggaggcugaggcaaggagaauugcuugaacccaggaggcagagguuacagugagccgagaucgcaccacugcacuccagccugggcaacagaaugagacuccaucucaaaaaaaaaaaaaaaauuguagauaaggucuugcaauguugcccaggcuggucucaaacuccugggcucaagugauccucccaccucagccucccaaagugcugggauugcaggugcgagccaccucacccagccuucggcugacuuucugcaugcugcuguuuacuccucacagaccccuccccaacugaaaucucugcuuuuauuagguaaaauuaggauucuuauuuuuaaguaacugugguagccauagaacaaagggcacagaggcuuuuucuuucacuuuuaaguauaauuaaugauuuaauuuuuuuugagacagagucuugcuugcucuguugcccaggcuggaguguaguggcaugaucuuggcucacugcaaccuccgccucccagguucaacaauucuccugcuucaaccucccaaguagcugggauuacaggggugugccaccacgcccagcuaauuuuuguauuuuuaguagagacaggguuucaccguguugaccaggcuggucuugaacuccugaccucaggugaucugccugccucugccucccaaagugcuaggauuacaagcaugagccacuguaccuggccuguuuuuuuguuuuguuuuguuuugagacagggucuuguucugucgcccaggcuggagggcagcggcgcgaucucagcucacuggagcgcaguggcgccaucucagcucacugcagccucugccucccagguucaagcgauucuccugccucaguccagaguagcugggauuacaggugugugccaccacgccuggcuaauuuuuguauuuuugguagagacgggguuucaccaugcuggccaggcuggugaaagcaagaucuucaagaaguauuuguauucccauguucauagcagcaugauucacaauaacugagaaguggaagcaacccagguguccaucagucagaggaaaggauaagcaaaaugcgcgcacacucucaaugggauauuauucagccuucagcaggaaggaaauccuaucacaugcuacaguguggagggaccuugaggacauuaugcuaagugaaauaagccggucaugaaaaagcaaauccuguaugauuucacuauauaagauaccuagaguagucaaauucagagagacagaaaguagaacccugcuugccagggccuagagggaguggggaaggggaguuguuguagaguuucaguuucacaugaugaaaacguuuuggagaugauuggcggugaugguagcacaacacccuaccgaaaauguuuaagauggucaauguuauguguauuucaccacaauuuuuaaaaagucaccaggggcugaugaccuuuaaagaggcucuccagaugguugcuggccccugggcgcuucuuugagacuguugaaucuuuaacucuuagguuucacgcuaugauaaacaaaccaacaacaacaaaaaaaguguggcucaugucuguaaccccagcacuucgggaggcugaggccaguggaucacuugaggucaggaguucaagaccagcuuggccaacauggugaaacccugucucuaccaaaaaauacaaaaauuagccgggcgugauagcacaugccuguugucccagcuacuggggaggcugaggcgggaggauugcuagaacccaggaggcagagauugcagugagccaagauugugccacugcauuccagccugggugacagagcaagacuccaucucaaaacaaacaaacaaaaagcaaaguuggggggaaacaagaaggggggcacucuugccgagucucaaagauuaagaaacaacagaaaaaaaguggucccaucuggagccaggauguccagccacuuguccacugaguccccaccccgcugccuggacccuggggucucugggcuucccuccccucuggggaggagagauuguacaaccccaagccuugcagaguggagcagugccacaucuggccucuagaaccaaaacaaaucugggucacuuuuuaaaaaaaagaguuagaaauuggucuucccuuaccuccccucacugucaccccagcccugcaaagagagggcaccacugcucuccauuuguaaucugggcucauaggcacucagaccuagaaggugcaugggucuuuauuuuacagaugaggagauggaggcccaaaacagggggugcaaggagcaaggugcauagggucacacagcugacugggaacggagcccaaaugcacccugguucuuuacaccccuccuccuaagaaacagcugugcgcuggagucccauaggcaaugagcagggcugucagcuucaguaucacugccucuccugcaaggggacaggagaguaagaccagugacugccuggaggggccacagccagacuagaggaacacagccagcaggugaaguuuaucuuuagguaucucucugcauuccucugcccuucagcaucucacgucauccucagcacagagccccguuucaggaacucacacucagacuccgagauggaaauugguuccuuuccagggguuuacagaguccagugcugagcaucaagaaaugaaucucaauauguacaacuauuauggauccauaaaaauuaaaaaucaaaaaaguaaaauaaaguguaagaaaugaaucucagcuguuggaaugcuacucaucauagccccuaagugaaggagagauuucaagguuauugcuaaggaagggcauuccugaaguccuuaaaucaugauucccaaacuuggguuauucauauuuuaucugcacaauuauuaccauaccuugcauuccacuuguacagauauuuaauauuucuuuauaucaccuuagcuuuugaauuuaauuuacauuauuuuauuauagaaucuauaauauauuauuauauuauuguauauuaaaaggaauugcuaucacuacuauauauggaacaccggauucacuugccauaaauagaagguagcuauaaaaagauacaaaggggccgggcacgguggcucacaccuguaaucccagcacuuugggaggccgaggcaggcagaucacgaggucaagaguuugagaccagccuggccaacauggugaaaucccgucucuacuaaagauacaaaaaauuagcugggcaugguggcacgcaccuauaaucccagcuacuugggauggugggguagaauuccaaggucagugacacacuggcaggacacacugggggccucacaaaggaggggcucagcaggagagcccacccuucacuccugccucuggcucuucuccgcaaagcccaggcauuucucucuuuuuuuuuuggaacugucuuuuugagauagggucucacugcagccuggaccuccugggcucaagcaauccucccgucucagcuucccgaguagcugggacuacaggcacguacccaucaugcccgacucauuuuaacauuuuuguagagaugaggucucucuaaguuguccaggcuagucucaagcuccugggcucaagcaguccucccacgguggccucccaaagugcugagauuacaggugugagcuaccacaccuggcaaaaguucuuauuuuuacuacucugguugaaucacaaguauuuucuguuuggucauuuguaaaaugcagcuauucuggguaucccacaggagugcuguaaggacaggacugaauaaugacuagaaaugcauuuuuuccaccgugguaugugauugucauggguaauuaacacuaagcccaggugggugagugagcugaggggcuauagggacagagcacagugugcacagagcucugggaagacacaggugcaguugguggccugcagaccccuuccauuggaucauuccaugugaaggggaguuggggccguuuggagguagcagaguucuggguggcagccaggcccccaaauaagccucacuacucuggcuuuuuuuuuuuuuuuuuuaugaaaaggagucucgcucuguuacccaggcugguguacaguggugcaaucggcucacugcaaccucugccucccagguucaagugauucuccugccccagccuccugaguagcugggauuacaggcuaccaccaccacgcuggcuaauuuuuguauuuuuaguagagacgggguuucaccauguuagccaggcuggucucgaacuccugaccucaggugauccacccauguuggucucccaaagugcugggauuaugggcaugagccaccgcacccagccuccucuggguuuuucaggagaaucugcugccucuacugcagccacgccuuuaaaaaguggaaaaaccggcaggcaagaggcugcagauggcuugaccaaccucccuguucccuucuagguaccaggaucaucuaugaccggaaauuccugauggagugucggaacucaccugugaccaaaacacccccaagggaucugcccaccauuccgggggucaccagcccuuccagugaugagccccccauggaagccagccagagccaccugcgcaauagcccagaagauaagcgggcgggcggugagugucggggcuuggccaggcucuaccuugggaaagggaauguaugaggcuccuggaguccauccacugggggcaauuccagggaggaggaacaacagggacucugcccuacccucuaaggagcagcucagagcccagagggugagaguagggguggggagguugaacucuucauugguagcaacuuucccccugaaaggggcccaggcaccucaggaaaggugaucuggcaccuuugggucauguaauuagcggggaguuuguuugaaauggcagcggcugcacacagcaacuuucguaagcaugugccucuguauaauugucucugaagcauuuccacuuggaacacacccaugauguuuguggugcaagagacaaguuaucaaagacacaguguacuuguccuuugggaaauuauaugucuacaagauaagaaauacauccgggaugccuccuguugggcuguugguccccuaguggaucuucaugaaggcagguagaaacaaugcagccaguugucucugccgauuugacauuugguagcuggguccuuccugcuguccccaccucccgaguaauuagagcagccacugugguagugguguaagugaaugcacucuuuguggcauccugacuggcuuggcagaguguuggaguucucugcugcaagaugaugcagcauaagcacuuccgggcaacuauaaucagauuggaacccgccgacccuucacccggaaggccguaccccaggcccagacaggaagcagcagggaccucagcuuggcuggcucugcuaacagcagcagaauuaaucuccccagggccugcaggacaugauucauaauuaccuugggaaccucacaguacaagacagacaauaguugccugugucuuagucuguuuuuuuauggcuguaacugaauaccugagacuggguaauuuaugaagaaaaaugguuuauuucuuacaguucuagaggcugggaaggccaagggcauggugcccgcaucugcugggcuucuggugagggccuccugcugcaucauaacauggcggaaggcaucacagggcaagaggggcacaugagagagaaccaagcugccuuuuuauaacacucuugugauaacuagcccacuccugugguaacccauuaauccaggaaugggcuaauccauucaugaggacagagccuucaugacccaauuaccucuuaacggccccaacucuuaauacuguuacauuggggauuaaguuucuguaugaauuucaaaccauagcauuccagcccuggaccccccaaacucauguccuucucauauacacauauauuaauuugguccccauauccccaaagacuuaacacguugcaguccuagcucaaaaguucaaaguccagaauuucaucugaaucagacaagacucacagcaugauucaucucaagcuuaauuuccuuccagcugugagccugugaaacuaaacaaguuaucuacuuucaaaaaauaggggcugucccuggccccuaaaaacaucagcugguggccaggcacaguggcucaugccugaaaucccagcacucugggaggcugaggcaggaugaauacuugaggccagaaguucaauaccagccugggcaacaaugcaagaccccaucucuacauaaaauuuuaaaauuagccaggcaugguggugcaugccuguaaucccaacuacuugggaggcugaggccagaggaucauuugagcccaggaggucaaggcugcagugagcuaugauugcguaacugcacgccagccuggccaagagagugagacccugucucuaaagaaaaaagcaaaaacaacaagagucagacgaaaugauauagucuggauauuugucccugcccaaaucucauguuaaauuguaauccccaguguuggagguagggccuggugggagguguuugggucguggggacagaucccucacagcuuggugcuguccucaugauagugaaugaguucucucgagaucugguuguuguaaagugugggagcgccacuccacccucucucuugcuccugcuuccuccaugugacaugccugcucccgcuuugcuuuccaccaugacgaaaagcccccugaggccuccccagaagccaagcugaggccggcgucaugcuuguacagccugcagaaccgcgagccaguuaaaccucuuuucuuggcugggcacgguggcucgcaccuguaaucccagcacuuugggaggcugaggaggguggaucaucugagaucaggaguucgagaccagccuggccaacauggcaaaaccccgggucuacuaaaaauacaaaaauuagcugggugugguggugggugccuauaaucccagcuacucuuuugggaggcuuagguaggagaaucgcuugaacccaggaggcggagguugcagugagccgaaauugggccacugcacuccagccucggagacagagugagacuccaucucaaaaaaaaaaaacaaaaaaacaaaaaaaaacuuauuuucuuuauaaauuacccaaccucagguauuucuuuauagcaaugaaagaauggccucauauaccaagcauucacccauuguugaccuggcccucuguccccucucuccccaggugaagagucacaguuugagauggacauuuaaagcaccagccaucguguggagcacuaccaaggggccccucagggccuuccugggaggagucccaccagccaggccuuaugaaagugaucauacugggcaggcguuggcguggggucggacaccccagcccuuucucccucacucagggcaccugcccccuccucuucgugaacaccagcagauaccuccuugugccuccacugaugcaggagcugccaccccaaggggagugaccccugccagcacacccugcagccaagggccaggaaguggacaagaacgaacccuuccuuccgaaugaucagcaguuccagccccucgcugcugggggcgcaaccaccccuuccuuagguugaugugcuugggaaagcucccucccccuccuuccccaagagaggaaauaaaagccaccuucgcccuagggccaaga

SEQ ID NO: 191859 - RNA, 27227 nt, Homo sapiens
ggaggggagagaaagagcgagagaaggggaaagacaagucgggagaggccgguaggcgugaggcgggccugaagcggcagcgggcggccuucguccggcgagagcuaggccgaggacccgcgccgcgcuccccggcaccucaccgcguccuucaccgacucccgcggcgcgcggccgggcggggaagggcgggcgggggucuccuccaggcugcgcgcucggagccgccugcugggcuugggcggggcgcggggcccgcggccgcccuacccggcucaguccucccccugugggaccuggcgacggcggcggagggagaggggagcggcgcccgggccggggccgggggcggguggggaggggggagggcggcggccgggcuggggcucgggauccgcaucgggaucgggccgccauggacgacaaggcguucaccaaggagcuggaccagugggucgagcagcugaacgaguguaagcagcugaacgagaaccaagugcggacgcugugcgagaaggugagggcgccgcgggggcgagugcgggagcgcggggcugggacgggccgccgcuuuccugcccgccccggucccguccgccccuggcccggcgcggcccaccgggggccugcggggcuguggguccggcuccggcguccaccuaggcggccggcccaucgguucagggcccggggcguugggcugcccucgccugccccuuccaccuccgccucacgcccccggccggcugcccagaucccgggcguggggggcucgggugcggacgggcggggaaacguagcccccugagccaagcaggagguuggucggggucgccugcgcuccacuggggaguuccugccacucuagcauuucccgaguggacuagcgagagcgacguccgaaaaggaccauuuucagaccaguuucugaaaaugcaacuaaaauuaaccagaaugucgugcguauuaaugaacuuguuaauaaaugcagaauuuuugucaggugaacggggcaccucagaaaucacuaacucaagccgggcgugguggcucacgccuguggccacagcuacucgggaggcugaagcgggaggauugcuugagcccaggaguuagagaccagccugggcaacauagugaggccccgucuccacacacaaaaaauuuuuuuuaauuagcagggugugacggcgggugccuguaaucccagcuauucgggaggcugaggcgggaggaucgcuugagcccaggagguggaggcugguugcagugagucgagaucgcgccacugcacuccagccugggcgacagcaaaaaaaaaaaaaaaaaaaucgcugauucuugaaugugccaagcguuuguuugcggagagguaggcgugauggccaacugugauuuuuaaaauagagguugacuuugguggaaacagauggugacuggucuuuguguugaguggcucuuggaaguaaaguguugauuuucagaaacgagagccgaucuuaaguuugggaacaguguuugcuggaaaugauaagugggauguguguuuucaugcacgauagcacuuugcagaaaguuauuuuuguuuuuaauauauauaaaguuuuuuuccaaagaauaauaaaacaugcgggugaucaguucguucuuguacaucgugagugugugaucuucacuuuguaaauucuguauccauuguuuucuuaaccccugaaauuauuucgaucucuccaucuuugaagucuagaguuguccacauucauccuuuacaagguggacuaaauaauuuucauguauuuuuagguuaaaaauucucacuugaagugcaugaagaaguaacgauguuauuuuaaaacguaaucuauaaaauuuucuuaaccguaauguuuagaagucaugauguggcagaagugcacuggagaaggaaagauuuuguuagucugauuuuaggguacucuuaagaucaugaaauuuacuuagaaaaggagcacuaauagaugguguuaaguuacaauauuuuuaacggguguaauguuggucggggccuuuguguauuaaguaacuauuuguuaacacaggaggauuuauuuuuguaaauagaagugccaagcaagugguauuuuucucuuucugaaacaaacugcuuacuuguggcuucaguugacauucauuuuuauugugauaaccuguaauuucaugagucuuaaaauuuaugccuuaaacaucucucuccagcucuaaugcgaagugaaauguacagguuugaaaugaucugagucaguuaaccugacuaugagcaucagaauacagacuugaaguuauggguaaaguguuaguugaaucaguuuuucccauugacuuccuuuuuuuguuuuauuuuuguuuugagacagaggcucagucugucgcccagacuggagcgcaguggugccgucucuguucacugcaaccuccaccuccgggguucgagggauccuccugccucagccucccgaguaacugggauuacaggugcaugcagccaugcacugcuaauuuuuguauuucuaguagagaugggguuuugccaugcuggccaggcuggucuagaacuccuggccugaagugaucccucagccuuccaaagugcugggauuacaggcgcgagccucgugcacagccccuauugacuuucuaauaauuuuaagaugaacuucuagagaagaauauuguaccacugcuguacuuugaaauaaucacaccggagugucaacgaucacuugaggaagcuuucuguauuugucaaaagagauuauuuuuacuucggcuccuaaauaaaucagacuaacaguuccuaggacuucacagguauauuuaagauuaucucuuguaucuuacuagccuuuuuugggggcgggggggggacgcagucuuggugugucagucaggcuggagugcaguggggcaaucaccgcucacugcaaccucaacuucuggggcauaagggacccucccacuucagccucucaaguagcugggaccacaggcaugugucaccacaccgggauaauuuuuuuauuuuuuuuauggggucucaccguguugcccaggcuggucucgaacucucgggcucaagugauccucccgccuuggccucccaaagugcagggauugcgggagugagccaccacuccuagcccauuuuuuuuucuuugaauauuuguccuuacccacaaagcaugaauuuguuagugaaauucauucaucuuuguucucuacccccauugauggaguugccaauggguuggaaaagugugauaauacucauuucucucuacucuuuuugagccgugcuuaguuuugcagcccucuucuggcagcuaugaccuagcuuugugguuuguguauguaugaguauauauacauauauauguuuucugaccuuaguuucuaguuccguuuuauaucccuaccccauccuccuuguugauacauaacaaguguagcauucauccugucugaguuccaguccugcuucacagcuugcuagcugucagucuuucugcaccucugauuccuuaugacagagauaauauguaccaauccucccggguugguugugagugcuaagauauauauucauuggccgggcacaguggcucacgccuguaaucccagcauuuugggaggccgaugcagguagaucacuugaggccaggaguucaagaccagccuggccaacauggcaaaacucugccucuacuaaaaaaaaaaaaaaaaauuagcugggcguaguguugcacucccagcuacuugggaggcugagacacaagaaucccuaggaggcagagguuacagugagcagugaucauaccgcugcacuccagccugggugacagaaugcaguuuucucaaaaaaaaaaaaaaaaaaaaaaggccauguaaaguccuaaugagaaguaagcacgcagugaauguuaacuaaaggaaggcugaaaguuuuaaucauaagugucacccauuuucuuuuguaagaaaugcaaaaugaauagaugugccaauaugccuuuucuuugguaaauauacuucaaaggaguuuuuuuuauauaguggcuauagaacccugaaaaguaguggugccuguuaugugaaccacacaguacuggaauuaauagcaguugugugaaguaucuuuacuccugacuuggucuacuuaauacuugcccuaccuuucuagggcaagaguagcaggcauguagaaagaaaauaugagaaaaauaaagagucaaaccuaauuauauaaacuaucuuuaauccuugugauucaauuuuuggguuuuuuaaaaauaccuuuuuuuauucuauuggaaauacuauucuauaggaaguuacaucguaugauggugguuuuuccuuaaauuucuauucuaauucagauugccuaaaaacugaaggagucggcuggucaugguggcucaccccuguaauccuagcacuuugggaggucgaggugggcggauugucugagcucaggaguucgagaccagcacgggcaacaugguaaaacccuaucucuacuaaaauacaaaaaauuagccgggcauggcggugugugccuguagucccagcuacucgggaggcugaggcaggagaauugcuugaacccaggaggcagaaguugcagugagccgagaucgccacugcauuccagccugggcgacagagugagacucugucuccaaaaaaagaaagcugaaggaguccacugaaaucaagaccagaguaguacuaguaaaggccuauuuugagguaguugcaaaaauaaaaucuauccuagugccagugggugaaugacuacaaaaaauaaagaguaugaaugguauggugugucuggcuuccaagguuaauuucugccuagugaaaaauuguuugcauaaaauagcaaggcaugucuucugagaagacuagcucuuaacacuagcuuaaauuagcaauccagcuuuugaagcuaauugugaauuugacuccucuugugugugcagagaaauugcuucugugauucauuccugcaucagcaguaugcaguuauuuuagaagauugugugccaagagagccaggcuggcacugcucaggacacucugugacuagaacuauauuuaacuguugucucagaaagaguaaaaauuuuaagcucuuugaccuguuaaauuuuauaacugaagaaccuuggugaugauucuuuagguggggagggaaauucagccaaugugugugcuggcagaucuuuauucugaugauuauaaaguacguauugagaaaaaugucgaggcuuguguagaaguauaaauauguaaauuuuauauugaacugauggaaauguuucuaaguccuggcguuagccuugaaauaagcagaaauaacuuuaggauaugacuucauuccuaaugugaaauaguaugcuuguuccugaauacccaaaaccaucuuaaugaagauuagauucugguaaaaaugagugauuuuugugaauugagaaaauuuuuuuagauuacuuucugugauugauuacagcuuaaaaaauaaaaauaguggucuugacaggcaaaaugccuaacugguacuuccauuuuuaauuucccucgaacaaaaauuagugccagcuuuggugguccauugauaaaaucuaaaaugcagugauaaaauagcuccuuucuuaguauaaugaagaauggcaugauuacagugaaauagagggucaagacccaauucuagugacugaacaaaucauuguuuuccuugcuaagccagccucuuaguggacagguaaagaaauuaaaccaaacuagacuagcaugaacuauugcuaauggcgggaaaguggacuuuguuacauuucucuacuuuauauaugacgugucaaauauauaugacuagguaaauauauuuaauacuuaauacugcccuuuaacaauaauauacccuugccauaagauauuuaccuaaguagauaaagugaagauauuugcaauguaaaauuucuuuucauugccugcuuuuauugccgugugugccuuuuauucuuauuugaagaucuugcagaaauuuuuucuucacagucuuuucucuucaguacgaauguuauaaaagacuuggugaaugaagcccuuccuugguaaaaggaaaugaaaaugccagaaauugaagauggaauuaaugcuuaauuaauuuuccuagauuguuuucugaauguaguuuuuucuaagaagaaugauauuaaaguuacagaaguaaucuguauaagaaaucugagucuguguuaaauagaaauuuuuuauuguuuugaacugauuuccuucaaguaaauguaaugaaauguaaaccuaauccagauuguuuaaagaaacuuguaugaagacaucuuuucuuccuuaaugaccaaaugugaucuaauaguuccuguacguuacuuuucaacucuaaauuucauuaauaaucauauuaacggccgggcauggugguucgcgccuguaaucccagcacuuugggaggccaaggcaggcggaucaugaggucaggagauccagaccauccuggcuaacauggugaaaccccgucuccacuaaaaauacaaaaaaaaaaaaaucagccaggcgugguggcaggcgccuguaggcccagcuacucgggaggcugaggcaagaggauggcgugaacccaggaggcagagcuugcagugagccgagaucgcgccacugcauuccagccugggugacagagggagacuccaucucaaaaaaaaaaaaaaaaaaaucauauuaacccugggaaggaguucuguguauuacagauuccguuuccuuuccagagaaugggagagcucaagcacucaagcuuagaacugguuugcuguuguguccuuuguaauuuagaaauauuuaucaucauuccuuguaaacuguuuuuugacugagauacuuuugugaucaaaugaauuaaaagacaauccugaggugcaaccugagauuccugacuugcguuauaauagcaucauguuacaccaaaaauguggaagacuccauuggagaucuauuaagugaauauuuuauacaaagacaaucguuuuuauguugagacugggauacaguggugaauuuaaguguucucaccuauucaaucuuagaaaaaagcuuauuugaauuaacuuuuuagcauaguuggauuuuuuuuaauaugcaggauacgguguguaggcuguaguuuaauuuugcucaaaaucucuuuuuuuuuguuuuuuugugauggagucucucucucugucauccaggcuggagugcaguggugccaucucgguucacugcaagcuccgccuaccggguucaugccauucaccugccccagccucccgaguagcugggacuacaggugccugccaccacucccggcuaauuuuuuguguuuuuaauagagauggaguuucaccaugugagccaggauggucucggaucuccugaccuugugaccugccugccucagccucccaaagugcugggauugcaggcgugagccacugcgcccagcucaaaaucccaucuuauagagagggaaauaauuuucaucuucguuuaaaagaguuccgcaugauauuuauguccuggaugaugagagcucagaauugguucaguguauucucgacuuggcuugaguagcaaaagaggcgcuuguuccugugggcagugaagaagaaaggagaggauugguugacagaaugcugccacuguguaguuaucccguacauucaacagauuuuaguugaaccacuauguaccagacuguucaaagugcuagagauucagcugugaagaggggacacgauuaaugaacaccaggcauugauucuugcuggcaagaaaaagcagaagauggggacagugaugggcuugaauucaagagacucuuuuuuuuuuaauaggguggucauagaaaaccuuccaaauucuuuauaaugugguuuacuuuuguaauuaaaaaggauuuugcgagaguuagaaggcacagucccuaacacuguucucaccucugacaccaucuucaaaaguuuagucaugauguaccuucagaacagcagacaaaaaauaaaguucagugaacuauaaauuacagggaacacugcccaggacugccucaguuuuggcaccaauauacuaguucaguggguuccgaaaaccacucuuagguucagugauucacaggaaugacucacagaacucacuuuaagcuguuacacugaugauuaugguuuauuacagggaaugaauacaauuuaaaguaagccaagggaaaagacucauaagggcagaguacaagaggggcugacaucuguaguguccaguccuccagagaccaaacugauagugggaucauccaaaguccgcaucgugagucacauuguuaaugguccgcaggucagagcccccaggcagagaucucuuuaccaagcaggaaauuccaggggcaaaggccagaccucuccucgggugagguuaauucuucacuauacagauuuuuauuccauagcaaauucugagggacgagaaccuuaauaauaauaaauggcaauaccaaaauacaugaagaaaacaaggcuagauuuaucagaauuguggagugugugcaaugugagggauuuuuccaguugaguuggcauauucuuuuuuuguuuuaaguuuguauuuugucaacugggcacaguggcuuaugccuguaaucucagcacuuuaggaggccgaggcgggcggaucacgaggucagggguuugagaccagucuggccaacguggugaaaccccaucucuacuaaaaauacagaaauuagcugggugugguggcacgcgccuguaaucccagcuacuugggaggcuaaggcaggagaaucacuugaauccaggaggcggagguugcagugagcugagauggagaucgcgccacugcacuccagccuggacgacagagcaggacuccgucucaaaaaaaaaaaaaaauuguauuuugucuuuucuugguuguauaaauucuccaaaaguuagccauuuaaaaauguuuaaggucuuauuuucuacuuugugauauguguguauaauuuuuacugugcaaguuuuagcauuuuuguauagucugauuguccaucuuuuccauaaacuuuaagcgcacaugagaaucacuugggaaagaaauaggaaauucauguuccuugacuccauuccagagacugauugacaugucuugggcagguccaggaagcugcuuuuuuuuuuuuuaaaggcaggaucuuacugucgccuaggcuggaguacaguaacaugaucauaguucacugcagccuuguacuccuggacucaagccaucuucacgccucagucuccugaguagcugagacuacaggaauacacaaccacaccuggcuuuuuuuacucauuuuuuuguagagacagggucuccucauguuguccaaggugaucuugaacuccuggacucaagugauccuucugccucggccuccaaaagugcugggauuacaggugugagccacugcccccggccuccuuugugcuuucagugucaugaaauaccuguauuugucaagaagauuaagaccaugucuuaaaaaaaaacaaaagcuagugagauacaagagauaaucuuaaauauaccuauaaaguccuaggaacuguucgucugauuuauuuaggagccgaaguaaaagugaucuuuccugacaaauacagaaagagauuuuugcuagcaucacuucuuccaaaacaauuuuccucauuuaugcaauaaguuuggauuuucacuucuuuaugucacuaaguuucugcguguugcuaaguuccuggcugcauauuuggagucucuccaacagcagcauugucagcauucccacagucgguucuuccguguacuuuugauuugaauuucauuuccaggguuaugucuuguguguuuggcuucucucuuuuagcauaauauauccaagauuccuccauauuguagcauguaucuggacuucguuccuuuuuauggcugaauaaaauuccauuguguggauauuuuauaauuacugccaucuggaauuuguuuugaaguuuaagaagccagguuuuuuccguuugaaaaaguaauacagaauuuguuuuuuaaaauuucgagcauuggccagucacgguggcucagaccugcaaucucagcacuuuaggaggcugagugggaggacugcuugagcccaggaguuugaggcugcagugagcuacguucacaccacugcacuccagccugggcaacagagcgagacccugucucaaagaaaauuugugcaagcaccucagaaagguagcaaggaaagcaaaugcacucuacccaccauuccuguccccugcccuccuaccucccagacaaccauuauguuucuguauauaaucuccucagccauguucuucauaugcaaaaaauauguggugugcagaauguuugugguguauugggagcuguuuuguggaauaaacuuggcuucugguaaaauuauuguuuaauuugugaucucaggaaaagaaacugaaggguauaaaggccuuaagauuacacaauuagauuaaaacugaagagaacccauguuuucuggaagacuucauugcauauaaucucauucuaauuaauuacaagcaaggagaagaaaguaugggcuacauuguccauaacucuugggaauccuaccaggcuauaagcagaaaaggcauuuguagaagaauacaugguagccuagaaucaaaagaaaagcuggagaaccaagcaugagcauuuugcagaaauuaagggagguuagaggugcagucagaaucauaccuuagaaaugauuuagaacacuagagagaacacuucuguuggaauagaacuugccauugucccugcucuuuagaguugcuucaaauuaagagucugggcugggcgcaucuaguuggcauaaaguaaucuggggcuagaguaacuuugugauuccuacaguguguguacaaacuauuguguguuuugaaaaucgcuacagguugaguaucccucaacuaguguuaaagucuguugacaaaaaugcagaguagcaggaaauacagugaaacucaaaauccauguuuuaaauacucuucagauuaucaaaucacugaagaggcagagaacugucugucccuaaaauugugcucucucccccaccagucuaagcugucaucugcuuuuacuuuaagcuucauccuguuugacuuuuuuuuuuuuuuucugugacugaguuuugcucugucgcccaggcuggagugcaguggcacgaucuuggcucacugcaagcuccgccucccagguucaugucauauucuccugccucagccuccugaguagcuggggcuacaggcgcccgccaccaugccgggcuaauuuuuuguauuuuuaguagagaugggguuucacuguguuagccaggauggucucaaucuccugaccucgugauccaccugccucagccucccaaagugcugggauuacaggcaugagccaccgugcccggcccuguuugacuuucacugugcuguguuguugccuuuuuuuucuuuugucucacucucacccgggguuaacugcaaaguggugcgaccauggcucacugcagccuugaacuccccagcucaagcugucuucccaccccaccccacccuccuaaguagcugggacuauaggcacacaccaccaugcccagcuauuuuuuaaauuuuuuauagagaccagaggucucacuauguugcccagccuggucucaaacuccuggauucaagcuauccuccccccucggccucccaaagugcuggaauuacaggcaugagccaccgcgccaggcugcccuguguuuuagcuaugcuagccauccgguuguuucuuccucucgguuugcauucuguauuagucccaguucucaucucuuagcuuucgugguuuucuguuucuaauuucucauggaccuggaaacucgguaaauagcuuguuggaauuuuguagauaacaguaggcccagaauaaggccugagagucucuucugguggguuagauacauuuuuaugaugucuguuuuguuacuucagaggcuuuuaaauuuuucuuccugauucugggaucuuuugcuauuaggcagagaggccagaucgaugagccauuagugaacuucgauuuagucagaacauuucauuugccaguguuuaagcauaaauucuguacuucagggccaccuaaugguauuuucuaacuuaauucuauaaauauaaaauaauuggaauaaagaaauucaagguuggccuaugaauugguguaagaauguuuguucacacaagaauuugcauaauuugugacuuuuuucuuucauugaccuuuuuaaacuugugaauaauaagauuauucuuuuuaaaacacagaccuucugccuugaagauuugccuauucuggacauuucauguaaauggaauuguacauuaugugaucauuugugacugacuucuugcacuuaccauaaugucuucaaaguuguagcauguaucaguacuucauuucuucauagcugagugacuauuccauuguaugaauauguuauguccauucaucgguugaucaauaucuggugguuucuacuuuuuggcuguuauuaauaaugcugccaugaacauguauaaacuggauuucauuucucuugaguauauaccuaggaguggaacugcuggauuacaugguaauuuuagguuuaacuuuggaggaacugccagacaguuuuccacagcagcugcaccauuuugcauuuccaccagcaguguaugaggguuccaguuuauccacauguuugcaacacuuauuaacugucuuuuuuauuauagccuuucuaaugaaaguguuaucucgugguuugguuuucacauacgcuuuuauaaggcacuuuucaaguguuuuuuuccccaaauuuucuuuuaauagauaagaaaugauaguuuuaacuuuguaauuguugauuucacuuuucuaacaggcaaaggaaauuuuaacaaaagaaucaaaugugcaagagguucguugcccuguuacugucuguggagaugugcauggucaauuucaugaucuuauggaacucuuuagaauugguggaaaaucaccggauacaaacuacuuauucaugggugacuauguagacagaggauauuauucaguggagacugugacucuucuuguagcauuaaagguaugauuauugaaauucaauuuuuuuuucaagauuuaaaccaggcaaaaggcaagaaugacaguauugcauaucaucuguuuuauggucuguucaguuuauagccccuuaaaauaauaauugguuuuacaucuuuuuaaaggagaggugaaaaggauaacuucuguguauucccgauaaauguaucauucucucgaguaguccauagcugaagucuuggaaucauauuugacuuuaucacuuauccguuauauugagucaguagacaagucuuuuuaaauccuugcuuugaaaagucuguuguuccugucucuuucuauuuucacacaguuuaucacuucacaauucgauuguuacaauagcuuaguaacuaauauuucugccuccaagaucugaucccccccaaauccaccuggcauacgcuggccgaugaaaucucuuauuuaacccuuuuauauuguuacuuccuguugauugccuguugccuauagaaucaaauucaaacuccuugccuggccuucuauagucuagucugaauuuuugccugccagcgguugguagcauaaacucuggcucaaaucaaaguuucuucuuauucagugcucuggacucuguuuauuuccauagucgauuucccccacgagguuauccugucccugauuucuuaccuuucugccaagacucagcucaggucucacuuccuccauguaaccuucaaccauuuuagccuuauuccuucugcucuaaauuacuaugaggaaacuuauucucccagcccuuauuuaugcugcaaaaguggcuuauugccuucuauuacuuauuauuuuacauauguccuuagugagguuagucccucaacagcagaagccauauauuacauggucaugggucacuuaacugcaggcauacauucugagaaaugugccauuaggugauuuugucaucuuuggaacuuacacaaaccuaggugguauagccuacugcacacaaaggcuguaaugguauagucucuugcuccagccaacaucguacauguaaucuguuaacaaaaaugcugcccagcacaugacuguacuuguguagaucuggcaucuggcuuuauagcaccaaacuuacguuagacacauaacggaugcuuaguaaaauauguaugaauugaaguacauacuugcagcuuuuagcuuaauuugcagaauccagugcuuuuucguauuucuuaucagaugcauuccuaacuaaauagucgcuuauguuuuuuaauagaaaggaaacuauuaauacauuugaaaucuugcccaguuuugucaagggccuguuuuuguguuauuauuggcaaauccaaucuuccugugggaaauaaaaauugaaaagggaagaaguuaaucuguagaguuugucucagcuucaaaccugugauuuucacuacucauucagcaguaagaagucauaguguucuagaaagauuuaggaaaguaguaauaauuugaugaugaagauaauagaagcaaaguaucagauacaaguuuauuauaguaauauaaguauuaguuaaagguucugaugaggguugucgaaaccugaugaaaaaggaugauuauaauaaacacgucaaauguuaaccaguaagaccugguuaugaauaagcaaguuuuuuauuuugaaacugaaauuaacauuuaauauacugguggccaaaagcgccguguuuaaaaaugggucagagacugguguacuucacaugacacuaguaaaaaugugauuuuacuauggguuuuacuccuuuucuuccaggugcguuauccagaacgcauuacaauauugagaggaaaucacgaaagccgacaaauuacccaaguauauggcuuuuaugaugaaugucugcgaaaguaugggaaugccaacguuuggaaauauuuuacagaucucuuugauuaucuuccacuuacagcuuuaguagauggacagguauguauaugugugcuuacaucuugggaggagguaaauggaagcagagauugacuauugguaagcuggggucuagauucauaugaccuguguuucugcaucuccucggccuuuuccuccuccuucccuuauacuuaaaauuucaaagcagggaaguggauaaguuucacauacauuuggaccagcaaauuuuccuguuguucucagauauguauguaaaucuuuuaaccaaagaauaugcugugcuuuuuaagauaucgauaaacauuauaaauaaauguuuaagacacugauguauaguacuagcaaagcaagauguuauuuaaaacuaucucugcauauacaugcagugucugcugguuaccaugaauaacuuuucauuucuauuuucaugguaacugcaaauguuauauuguguauuacaccuucccugagaagugaaugcuuggcugggcacaguggcuaguacuuugggaggccaaggcaagaggaccgcuugaguucagggguucaagaccagccugggcaauguaguaagacccugucucuacaaaaaaaaaaauuuaaaaauuagcuaggcauaguggcgcgugcuuguggucuagcuacucaggaagcuagaggugagaggaucucuucagcccaggaaguuaaggcugcagugagccgugauccagccugggcuucagccugggcaacagcaaaaccccaucucaaagaacaaaaaaagaaaauagaagcaaaugcuauuucugcauuugcuguaacaaguagugcagacaugucaugaaacauucaaaaguauaagaagaaauuaugcaaauuuccuauuucaauuucuagagauaaucacuguaagcaugaacugauuuaaauuuaaauauaaaacaaaagccgggcaaguuggcuccuaccuguaaucccagcacuuuaggaggccaagguggguggaucaccugagguagggaguucgagaccagccuggccaacauggugaaaccccaucucuacuaaaaauacaaaaauuagccggggauggcauugcaugccuguagucccagucccagcuacuugagaggcugaggcaggagaaucacuugaaccugagagagacagagguugcagugagccaagaucguaucacggcacuccagcuugggugacaaagugagacuccaucucaaaaaauaaaauaaauaaauauaaaacauauaauaaaacuccauaauucuuaaauuaugaaagcccagaguugucaagaauguaauaaauucucucuuagacugcucgugggaauauaauuugguuauaacuuucccuguguaauccugacagucuuuuuucucagccaugauuuuggacacugccgugauuaauuugaaaggacgauacuuugccuggacuuguuaaaagaaaaugugaauuuaaaagauguuaaauuuuaauuaagguuguuuuuaauuguuuugaagcaacauagucuucauuaauaauaaaauugcuggacagaaugauuuuuaaaagacagccuaucaguuuuaaugaaguaucuaguuuuuaaaaugggugcguuaguagagcuuuuauauauuuuucccuuccuccuuccuuccuuucuuucugaaaaguuacuagaaaagaaauaauagugaacaaaacugaucuagaagaaaagauggaaggcacauaaaacacuaggaaugaaauaaggcauaauuauaacuaugcaggagcucguguaucacaagaacaggugcagcuuuagugcacuaaguuugaaaagcugaaugaagcuuacuauaguaaaauaccaguuauuaaaauuggcuugcagaaauucguccaauauaaguaaacaaccaauagcaaccagguguaaauaguuuuauaggcuaauucuaccaaaccuuuaaggaacauauaauuucuguguucuagaacuugggaaaagauggagaguucaaaacucacaccguaugccuaguauaaccucaaugccaaaccagacguggcacgcacagaaaaauaaaaucagaccaaagucauuuggaaaaaaaauuccuauauuuaugauucaaaacucaguuauuuuauaaaauaauaauauuaaguggauaaagaaacgccaguuguacuaucagcuaaacauuagaaaccuucucaucaggccaggugagguggcucaugccuguaaucccagcacuuugggaggccaaggcgggcggaucaccugagguugggaguucaagaccagccuggccaacauggagaaacccugucucuacuaaaaauacaaaauuagccaggcaugguggcacaugucuguaaacccagcuacucaggaggcucaggcaggagaauugcuugaacccggaaggcggagguugcggugagccgagaucacgccauugcacugggcaacaagagcgaaacuccgucucaaaaaaaaaaaaaaaaaaaaucaaaaucagaaagaaaaugcuuguuaaaacuuacguuauucucucugauucagaauaccuagagcauggacuugaaacuagguaguuuacaaaaaacaaaacagaaaacauuuguauuauuccauuuuauuuuagaaguccuggccaaugcacuaagcaauaaaaagaauuaaaacguauaaacauugagaagaaaaaacaaaaauaguuuugcaaaugacuugauuauguacuuagaaaauaugaaggaacugaaaauuuauuguagccaguaacaggaaucagaguguuugcuguaagagaaacaaaaaauuguauauaucagcaauaaccaacagaagcuguaaugacagcuggguacaguggcaugcaccuguaauccuagcuucccaggaggcugaggcaggaggauugcuugggcccaggaguucauggcugcauugcgcagugaucaaggcugugaauagcuacugcucuccauccucagcagcacagcaagacuccaucucuacagaaagaaaagaaaggagggaaguggggagggagaaaaaaaagaaagaaagaaauuuaaugguagguaccaaggauggggauaccauugaccagagaaaaggaagggagggagggaggggaaaaaaaaaaaaagaaauuuaaugguggguccccaaggauggggauaccauugaccagagaagggguaaagaagaaaaaaugauggacaaaauauguuuaaauguuggcacuauuuggacugacacuuuuaaccauuauuuacucuuuguuaacuguuuggaguuaguaaaacaaauacauucucuuuuguuaauucauacauagauauucugccuccaugguggccucucuccauccauagacacacuggaucauauaagagcccuggaucguuuacaggaaguuccacaugagguaaacuuaauuuaaaaaagaagaagaaaggaaaagaaaauauaaccacauuuugaggaugauaaaguaugacugauaauaauuuguaacauguacuuauuuuucuuggccagggcccaaugugugaucuguuauggucagauccagaugaucgugguggaugggguauuucaccacguggugcuggcuacacauuuggacaagacauuucugaaaccuuuaaccaugccaauggucucacacugguuucucgugcccaccagcuuguaauggagguauguacuuuccugacagaaugaucuuuauuucagauuaguauauacuucuguaauaaggcauuaugacuuaacuaagaaacauuccucaccauuuauuaccuaggugaaaagaggaaaaacuugcugguuuuagcaaguagggaaagcacuaguagaccagagcagaauuauaacucauuuuugaaauugagacuuagaaaaaaguuacaaaaauaguaccccauaauucccuguaugcuucauucagauuccugacuguaaauauuuuacuauauuugcuuuaucauuuugugucucucuuccucuucaccccucacacuuucuucugaaccauuugaauaucuguugcagacagauacuccuuuacuaccaacuuucuauguguauuuuguaaaauuaaggacacacugucacauaaccaccguauaguuaucacaguugggaaauuuguguucauauaguacuguuauuuaauaugaacacuuuauucaaauuuugcuaauugucucacuaaugucuuuaauagcaaaauuuaauuuuuugugcauacuguaugugcauagucgaauccaaagauuagguuguauucauucuacuuugauguggaaauccuccgauuuucauuguuuuccacauucuugacauuuuggaagaguaggagcauuuuaucuuacagaaauaucccucaguugggguuugccugauguuuuccuugcaguuagggauucaauguaugcauuuuuggcagucaugacauagaaagaugguguguccuccuccgugcauuguaucaagugguccuaaaaucugcuugucucaaugcuggugguggcaacuuuaauugcuuaguuaagaugaugucugccagauuucuccacuauaauauuaacuguuauacaacuacuaagggaacauaaacaacauaaucccugcagaccaguagggaguggcuucaagauguuuagagaaaacuucgccagcccaguagaaacaagggagcaugauaaaaaaaacacaaauuuacauaguaaaaauaaauuuaauuauaucagugauuauaagaaagagacuaaaauuuuagccugaaagagacucuuagauuggauaaauaaucaaaauuuagcuguuauuugggauguaccuaaaacauaaaugauuggcuggacaaaguggcucaugccuauaaucccagcacuuugggaggccgaggugggaggaucucuugagucuuggaguuucagaccagccugggcaacauagugagaccucaucucuauauaaaaaaaaaaaaaaagucaaaaaguuagcugggcaugguggcauaugucuauugucccagcuacucaggaggcugaggugagagggucacuugaggccaggagguugaggcugcagugagcuaugaucguaccgcugcacuccagccugggcaaaagggugagaccuugucucaaaaaaacgaggaaaaagaaaaagacaccacaaacuagagguaagaguuggaaaaugguauauugguauaucaaguaauuaaucaaaauaucaaaaauauagcuaaugagcuggcgugguggcucgugccucuauucccagcacuuugggaggcugaggcaagcggauugcuggagcucaggaguucgagaccagccugggcaacauggugagauccugucucuacuaaaauacaaaaaauuaaccuggugugguggcacgcaccuguagucccaacuacucggggcugaggcaggagaauugcuugaacccaggaguuggagguugcagugagucuagaucgcaccacugcacuccagccugggcaacacaggauguguguguguguguauauacacacauacauacacuaauguauguauauauauguauacauauauacacacauguauguguguauacauauaugcacacguauauauacacauauacacacguauacauauaugcgcacacauacauguauacauacauauauacguguauguauauacacauguauauacacauguauacauauaugcacacacauauauacauauauacacguauauauacauauguauauacacauacauuaauuagcauguauguauacacacuauauauaauacuauagcuaauaauaugaaugagauaggcucuaauaaaagguauuauuagaaauaaagagauuauugaugaaaacuggcccaguucucuaggaagaaaguauucuaaauuuguauuuaccuaguaauagcuucaaaauauauaaagaaaaaauuggcauaauucaugagggaaaauugagaaauuaauuaugauugugggagaaauucaguacacauccuugccaagauuucaagcauagauacggcaaaacaacaauuagcgagcugcauuuaacagacuccuaggcccacgaauugcacaguauucuuuacagguacacaaacuauuaaagauggagaccuuauauaguaauauagacgacuacauuuccacagagaguaccuguaguuuuugaguuuaguuuuuuuuaaaugugucugugucaaaaucauaauauuauaaugaaauaaugaauuuguuuuuauccugcagggauacaauuggugucaugaucggaaugugguuaccauuuucagugcacccaauuacuguuaucguugugggaaccaggcugcuaucauggaauuagaugacacuuuaaaauauuccuugugaguaacuguaaauuuuaauuguauauacuuucagaaggaaaauuuuaaauguuaaaaauagaagauuucuguuucugaaauuggaugaggaguauagcaaagccccucuccagcaaaaauaaccauuagcuggagaacauuauuuuuaaaaaauaauuuuucaaagcuuuuggaaauuguccuaagggcauacagcagguggagaaacaguuaauucaagaaaaccuacuaaaucucaguaauaauagccguagucuguggcauuugagcuaugacuugcccccuccaacuccucccagaucccucucacagaaacgacuacaggcgcucuacgcuggguugguauagucaggaggcuaagggauucccccucuucaucagcucccagggcuggggcuguggguucacucccagagaucagaugccagcauaucucaccucuccuagucuggaguuacaaaagcucuacuccugguagacacagucaagcaggcugaggcccccuucccugccccagcuccuggggcagaagcucugcuccaggcaugcauggcagaugagaaugcuggguuucccaaugcuguuaccccagcaccugcuuauaaaccaggugguaucacugagccugcacuggcacagaaguucugcucaggaggaaaggcaggucacagaaguuccucagcucugccucagaggacuuaucuuacuuaggugauggagaauuccaaaucugagugcuuuguggaaagcaguagaugucaugguggagaccaauuaagagggcuguaauagcucccaugauacuaggagcaacauacaaaagagcagagcaacauguuguucaacaaauagcaccagggaaaaagccaagaagagcccuucugggaucacagucagcccugggggacaagaaggcugugcacaugcacuagccauacccacucaggagcagucaagaguaggaugugggguauucauauaauauuuucaagccacacauagauuguacugaguugaauaauguccccccaaaaaaauucauguccacccagaaccucaaaaugugauguuauuuggaaauaggaucuuuacagauauaauuauuaaagaugagauuguacuggauuagggugggccuaaauccaauucgaaugggauuuuaguaagaggaaaagaaacacacacaggggagaaugcugugugaagccagagauucaagugaugcaucuaccagcuaaggauugccagagccaucagaagcuagggagaggcuaggaaggauuuuuccuagagccuucagagagagcgugguccucccagcaucuugcuuucagacuuguagccuccagaacugugagaggauaaauccccguuguauaagcuauacaguucgguaauuuguuacggcagccccaggaaauggauaaguagauugaucaacaaaugguguaaccaucacuaguaugugaggcuuaaacacaaccucucaucauugacugaacgacauucaguuacucugauccaggagcaccuccuagguagucaggcuuuaaaauaaaaucacacucaucccugacagucuggcagaauaugugcaugcccaagguuauacccucucuggacugagugcaguaugaagauccaacuauuagucccuggcugaaugggaagccaaaauauaaacuccuucagcuuugauagcaaucugcaagucacauaacauuuccgguggccauuagggugagcuuuaagaucuaacuggccaagggggcuuaaguacaaucuuugaucaguaaguggcuuaugccuacccagagacagccccucaguagccaggcugugaaagauuaaaagaaguaaaaacggucaggcacgguggcucaugccuguaaucccagcacuuugggaagccgaggugggcggaucaccugaggucgggaguucaagaccagccugaccaacauggagaaacccagucucuauuaaaaauacaaaauuaguugggugugguggcgcaugccuguaaucccagcuacucaggaggcugaggcaggagaaucgcuugaaccugggaggcggcggcgaucacgccauugcaguccagccugggcaacaaaagugaaacucaaaaaaaaaaaaaaaaaguaaaaacauccgagcagggccacaggggcugcacacuaugggggaaguagacuuuacaguuaguucagcuaagucacuaaacaaaaauaauaaaccaccaaaaagacaagaucaguccccaaggacaugaauuccagagcuacugcaauauguuaucuauaauguccaauuuuucaaccacagauuauaagacauggaaagaacaaggaagugugaccucuacacaggaaaaaacuaagcaacagaaacuguuucucuuggauagaacaacuaggcaggagaugaaggcaggagaagacuugagcaacacuguaaacugacuguauaccucaugucuguaaaacaacacccaacaacagcagaauacuuuccucucaaguaaacaugaaacauagucauaugcuagacuguaaaacaugccucaggcaauuuaagaagauuagauucuuaaaaggauauucuccaaacacaaggaaaugaaauuagaaaucauuaacauggcuggaugcuguggcucacacaaguaaucccaacacuuugggaagccaaaguaggaggaucacuugaggccagccugggcaacauagggagaccccgucucuacaaaaaaauuuaaaaauuagccagguauggugccaagcaccuguagucucagcuguaugggaggcugagauggaggaucacuugagcccaguugaucaaggcugcaaugagcuaugaucacagcacuacacuacagccuaggcaacagagcaaagacccugucucagaaagaaaaaaacaaaaaaaaaaacaagaagauuugaaaucaguaaccuaucuuuauacuugaggaccuagaaaaagcagaguaaacuaaaccugauguaagcuuaugaaacgagguuuagaguagaaauaaacaaacaguagaaaaucauuacagaaaaaucaacaaaacccaaaguugaugcuuugaaaagccuuaacuagacuggccaagaaaaaaaggaguaaagacucacauuaccaaaucacuagagaccuuacugaaauaaaaaggauuauaagggaauacaauaaauaacuauaugccagcaaauucaguaacuuugauaaaacguacuaauuccuaaaaagaaacuacugaaacugacucaagaaauaugaaaucugaaugaccuuucaaaugugaaaauauugagccagcaugguggcucacaccuauaaaucccagcuuugggaggccaagcugagaggauugcuugagacuaggaguuugagaccagccuggacaacauagcaggaccuugucccuauuuaauuuaaaagaauauaaauaaaugagugaaaaaguuaaaacuccccacaaauaaaaggccaagcccaauuggcuucauugaugaaguccaccaaauguuuaaagaaaggaauuggccaggugcgguggcucuaaccaguaauccuagcacuuugggaagccaaggcaggcagauugagcccaggauucaagaucagccuggguaacaugguaaaacccuguaucuacaaagaauacaaaaauuaaccuggugugguggcucagccuauagucucagcuacucaggaagcugaagugggaggaucaccugagcccagggagguugaggcuacagugagccaugaucacaccacugcacuccagcuugggcaacagagugagacccugucucaaaaauaaaaacgaguuaaugccaauccuucacaaacacuuccaaaaaacagaagaggaggacuacugcauucauucugucacaccugcacuauuauccuugauaccaaaaguagacaaaggcaaaaacagaccagcauuuguuacgaauacagauauaaaauuuuccaacauacguaccagcaaccuggaucuagcaauauguaaaaagauuauacaccaugagcaagugggauuuaucccaggaaugcuagguugguucaaaacaugaaaaucaauauaauaaaccauauuaauauuaagggauuaaaaaacacaugaucaucucaauagaggcacaaaaauaauuggaaaaauccacuagccagaaacacucaagaaaauagugauauuaggccuggcgcgguggcucacgccuguaaucccagcacuuugggaggccgaagcggguggaucaugaggucaggagaugagaccauccuggcuaacacggugaaaccccgucucuacuaaaaaaaaauaagaaaauuagccgggcaugguaauggguuccuguagucccagcuacucaggaggcugaggcaggagaaugguaugaacccaggaggcggagcuugcaauaagccgagaucgugccagugcacuccagccugggcgacagagcaagacucugccucaaaaaaaaaaaaaaaaaaagugauauuauuauuauuauuaaauaauauuaaacaauuauuguuuaauuauuuaaacuugauauuauuuaaucuuuaauuauuuaagcuuuuaaauaauaauaacauuuagaaauuguuaugccaggcaccaaaccagacauucugucuucuuaaauuuucaccauagcccuaugaagcaguuaguuggaaugggagcaucugcagugauuugcccauggccauuccagccguaagugauguagucauggugggaaagcaggacugcuguuucuacuacagugucuuguucuuuauucauuuguuuucuuugcaaagucagauccuuuauuugcuuccuuuuuugccauuuacagccuucaauuugacccagcgccucgucguggugagccucauguuacacggcgcaccccagacuacuuccuauaaauuucuccugggaaaccugccuuuguauguggaaguauaccuggcuuuuuaaaauauauguauuuaaaaacaaaaagcaacaguaaucuauguguuucuguaacaaauugggaucugucuuggcauuaaaccacaucauggaccaaaugugccauacuaaugaugagcauuuagcacaauuugagacugaaauuuaguacacuauguucuaggucagucuaacaguuugccugcuguauuuauaguaaccauuuuccuuuggacuguucaagcaaaaaagguaacuaacugcuucaucuccuuuugcgcuuauuuggaaauuuuaguuauaguguuuaacuggcauggauuaauagaguuggaguuuuauuuuuaagaaaaauucacaagcuaacuuccacuaauccauuauccuuuauuuuauugaaauguauaauuaacuuaacugaagaaaagguucuucuugggaguauguugucauaacauuuaaagagauuucccuucauuuaaacuaaauuacuguuuuauguugaucugcauauuucuguauauuugucaugacagugcuugcauccuauuugguguacucagcaaauaaacuuuucauuuuaaacaaaaacauuca

SEQ ID NO: 191860 - RNA, 27227 nt, Homo sapiens
ugaauguuuuuguuuaaaaugaaaaguuuauuugcugaguacaccaaauaggaugcaagcacugucaugacaaauauacagaaauaugcagaucaacauaaaacaguaauuuaguuuaaaugaagggaaaucucuuuaaauguuaugacaacauacucccaagaagaaccuuuucuucaguuaaguuaauuauacauuucaauaaaauaaaggauaauggauuaguggaaguuagcuugugaauuuuucuuaaaaauaaaacuccaacucuauuaauccaugccaguuaaacacuauaacuaaaauuuccaaauaagcgcaaaaggagaugaagcaguuaguuaccuuuuuugcuugaacaguccaaaggaaaaugguuacuauaaauacagcaggcaaacuguuagacugaccuagaacauaguguacuaaauuucagucucaaauugugcuaaaugcucaucauuaguauggcacauuugguccaugaugugguuuaaugccaagacagaucccaauuuguuacagaaacacauagauuacuguugcuuuuuguuuuuaaauacauauauuuuaaaaagccagguauacuuccacauacaaaggcagguuucccaggagaaauuuauaggaaguagucuggggugcgccguguaacaugaggcucaccacgacgaggcgcugggucaaauugaaggcuguaaauggcaaaaaaggaagcaaauaaaggaucugacuuugcaaagaaaacaaaugaauaaagaacaagacacuguaguagaaacagcaguccugcuuucccaccaugacuacaucacuuacggcuggaauggccaugggcaaaucacugcagaugcucccauuccaacuaacugcuucauagggcuauggugaaaauuuaagaagacagaaugucugguuuggugccuggcauaacaauuucuaaauguuauuauuauuuaaaagcuuaaauaauuaaagauuaaauaauaucaaguuuaaauaauuaaacaauaauuguuuaauauuauuuaauaauaauaauaauaucacuuuuuuuuuuuuuuuuuuugaggcagagucuugcucugucgcccaggcuggagugcacuggcacgaucucggcuuauugcaagcuccgccuccuggguucauaccauucuccugccucagccuccugaguagcugggacuacaggaacccauuaccaugcccggcuaauuuucuuauuuuuuuuuaguagagacgggguuucaccguguuagccaggauggucucaucuccugaccucaugauccacccgcuucggccucccaaagugcugggauuacaggcgugagccaccgcgccaggccuaauaucacuauuuucuugaguguuucuggcuaguggauuuuuccaauuauuuuugugccucuauugagaugaucauguguuuuuuaaucccuuaauauuaauaugguuuauuauauugauuuucauguuuugaaccaaccuagcauuccugggauaaaucccacuugcucaugguguauaaucuuuuuacauauugcuagauccagguugcugguacguauguuggaaaauuuuauaucuguauucguaacaaaugcuggucuguuuuugccuuugucuacuuuugguaucaaggauaauagugcaggugugacagaaugaaugcaguaguccuccucuucuguuuuuuggaaguguuugugaaggauuggcauuaacucguuuuuauuuuugagacagggucucacucuguugcccaagcuggagugcaguggugugaucauggcucacuguagccucaaccucccugggcucaggugauccucccacuucagcuuccugaguagcugagacuauaggcugagccaccacaccagguuaauuuuuguauucuuuguagauacaggguuuuaccauguuacccaggcugaucuugaauccugggcucaaucugccugccuuggcuucccaaagugcuaggauuacugguuagagccaccgcaccuggccaauuccuuucuuuaaacauuugguggacuucaucaaugaagccaauugggcuuggccuuuuauuuguggggaguuuuaacuuuuucacucauuuauuuauauucuuuuaaauuaaauagggacaagguccugcuauguuguccaggcuggucucaaacuccuagucucaagcaauccucucagcuuggccucccaaagcugggauuuauaggugugagccaccaugcuggcucaauauuuucacauuugaaaggucauucagauuucauauuucuugagucaguuucaguaguuucuuuuuaggaauuaguacguuuuaucaaaguuacugaauuugcuggcauauaguuauuuauuguauucccuuauaauccuuuuuauuucaguaaggucucuagugauuugguaaugugagucuuuacuccuuuuuuucuuggccagucuaguuaaggcuuuucaaagcaucaacuuuggguuuuguugauuuuucuguaaugauuuucuacuguuuguuuauuucuacucuaaaccucguuucauaagcuuacaucagguuuaguuuacucugcuuuuucuagguccucaaguauaaagauagguuacugauuucaaaucuucuuguuuuuuuuuuuguuuuuuucuuucugagacagggucuuugcucuguugccuaggcuguaguguagugcugugaucauagcucauugcagccuugaucaacugggcucaagugauccuccaucucagccucccauacagcugagacuacaggugcuuggcaccauaccuggcuaauuuuuaaauuuuuuuguagagacggggucucccuauguugcccaggcuggccucaagugauccuccuacuuuggcuucccaaaguguugggauuacuugugugagccacagcauccagccauguuaaugauuucuaauuucauuuccuuguguuuggagaauauccuuuuaagaaucuaaucuucuuaaauugccugaggcauguuuuacagucuagcauaugacuauguuucauguuuacuugagaggaaaguauucugcuguuguuggguguuguuuuacagacaugagguauacagucaguuuacaguguugcucaagucuucuccugccuucaucuccugccuaguuguucuauccaagagaaacaguuucuguugcuuaguuuuuuccuguguagaggucacacuuccuuguucuuuccaugucuuauaaucugugguugaaaaauuggacauuauagauaacauauugcaguagcucuggaauucauguccuuggggacugaucuugucuuuuuggugguuuauuauuuuuguuuagugacuuagcugaacuaacuguaaagucuacuucccccauagugugcagccccuguggcccugcucggauguuuuuacuuuuuuuuuuuuuuuuugaguuucacuuuuguugcccaggcuggacugcaauggcgugaucgccgccgccucccagguucaagcgauucuccugccucagccuccugaguagcugggauuacaggcaugcgccaccacacccaacuaauuuuguauuuuuaauagagacuggguuucuccauguuggucaggcuggucuugaacucccgaccucaggugauccgcccaccucggcuucccaaagugcugggauuacaggcaugagccaccgugccugaccguuuuuacuucuuuuaaucuuucacagccuggcuacugaggggcugucucuggguaggcauaagccacuuacugaucaaagauuguacuuaagcccccuuggccaguuagaucuuaaagcucacccuaauggccaccggaaauguuaugugacuugcagauugcuaucaaagcugaaggaguuuauauuuuggcuucccauucagccagggacuaauaguuggaucuucauacugcacucaguccagagaggguauaaccuugggcaugcacauauucugccagacugucagggaugagugugauuuuauuuuaaagccugacuaccuaggaggugcuccuggaucagaguaacugaaugucguucagucaaugaugagagguuguguuuaagccucacauacuagugaugguuacaccauuuguugaucaaucuacuuauccauuuccuggggcugccguaacaaauuaccgaacuguauagcuuauacaacggggauuuauccucucacaguucuggaggcuacaagucugaaagcaagaugcugggaggaccacgcucucucugaaggcucuaggaaaaauccuuccuagccucucccuagcuucugauggcucuggcaauccuuagcugguagaugcaucacuugaaucucuggcuucacacagcauucuccccuguguguguuucuuuuccucuuacuaaaaucccauucgaauuggauuuaggcccacccuaauccaguacaaucucaucuuuaauaauuauaucuguaaagauccuauuuccaaauaacaucacauuuugagguucuggguggacaugaauuuuuuuggggggacauuauucaacucaguacaaucuauguguggcuugaaaauauuauaugaauaccccacauccuacucuugacugcuccugaguggguauggcuagugcaugugcacagccuucuugucccccagggcugacugugaucccagaagggcucuucuuggcuuuuucccuggugcuauuuguugaacaacauguugcucugcucuuuuguauguugcuccuaguaucaugggagcuauuacagcccucuuaauuggucuccaccaugacaucuacugcuuuccacaaagcacucagauuuggaauucuccaucaccuaaguaagauaaguccucugaggcagagcugaggaacuucugugaccugccuuuccuccugagcagaacuucugugccagugcaggcucagugauaccaccugguuuauaagcaggugcugggguaacagcauugggaaacccagcauucucaucugccaugcaugccuggagcagagcuucugccccaggagcuggggcagggaagggggccucagccugcuugacugugucuaccaggaguagagcuuuuguaacuccagacuaggagaggugagauaugcuggcaucugaucucugggagugaacccacagccccagcccugggagcugaugaagagggggaaucccuuagccuccugacuauaccaacccagcguagagcgccuguagucguuucugugagagggaucugggaggaguuggagggggcaagucauagcucaaaugccacagacuacggcuauuauuacugagauuuaguagguuuucuugaauuaacuguuucuccaccugcuguaugcccuuaggacaauuuccaaaagcuuugaaaaauuauuuuuuaaaaauaauguucuccagcuaaugguuauuuuugcuggagaggggcuuugcuauacuccucauccaauuucagaaacagaaaucuucuauuuuuaacauuuaaaauuuuccuucugaaaguauauacaauuaaaauuuacaguuacucacaaggaauauuuuaaagugucaucuaauuccaugauagcagccugguucccacaacgauaacaguaauugggugcacugaaaaugguaaccacauuccgaucaugacaccaauuguaucccugcaggauaaaaacaaauucauuauuucauuauaauauuaugauuuugacacagacacauuuaaaaaaaacuaaacucaaaaacuacagguacucucuguggaaauguagucgucuauauuacuauauaaggucuccaucuuuaauaguuuguguaccuguaaagaauacugugcaauucgugggccuaggagucuguuaaaugcagcucgcuaauuguuguuuugccguaucuaugcuugaaaucuuggcaaggauguguacugaauuucucccacaaucauaauuaauuucucaauuuucccucaugaauuaugccaauuuuuucuuuauauauuuugaagcuauuacuagguaaauacaaauuuagaauacuuucuuccuagagaacugggccaguuuucaucaauaaucucuuuauuucuaauaauaccuuuuauuagagccuaucucauucauauuauuagcuauaguauuauauauaguguguauacauacaugcuaauuaauguauguguauauacauauguauauauacguguauauauguauauaugugugugcauauauguauacauguguauauacauguguauauacauacacguauauauguauguauacauguaugugugcgcauauauguauacguguguauauguguauauauacgugugcauauauguauacacacauacauguguguauauauguauacauauauauacauacauuaguguauguauguguguauauacacacacacacacauccuguguugcccaggcuggagugcaguggugcgaucuagacucacugcaaccuccaacuccuggguucaagcaauucuccugccucagccccgaguaguugggacuacaggugcgugccaccacaccagguuaauuuuuuguauuuuaguagagacaggaucucaccauguugcccaggcuggucucgaacuccugagcuccagcaauccgcuugccucagccucccaaagugcugggaauagaggcacgagccaccacgccagcucauuagcuauauuuuugauauuuugauuaauuacuugauauaccaauauaccauuuuccaacucuuaccucuaguuuguggugucuuuuucuuuuuccucguuuuuuugagacaaggucucacccuuuugcccaggcuggagugcagcgguacgaucauagcucacugcagccucaaccuccuggccucaagugacccucucaccucagccuccugaguagcugggacaauagacauaugccaccaugcccagcuaacuuuuugacuuuuuuuuuuuuuuuauauagagaugaggucucacuauguugcccaggcuggucugaaacuccaagacucaagagauccucccaccucggccucccaaagugcugggauuauaggcaugagccacuuuguccagccaaucauuuauguuuuagguacaucccaaauaacagcuaaauuuugauuauuuauccaaucuaagagucucuuucaggcuaaaauuuuagucucuuucuuauaaucacugauauaauuaaauuuauuuuuacuauguaaauuuguguuuuuuuuaucaugcucccuuguuucuacugggcuggcgaaguuuucucuaaacaucuugaagccacucccuacuggucugcagggauuauguuguuuauguucccuuaguaguuguauaacaguuaauauuauaguggagaaaucuggcagacaucaucuuaacuaagcaauuaaaguugccaccaccagcauugagacaagcagauuuuaggaccacuugauacaaugcacggaggaggacacaccaucuuucuaugucaugacugccaaaaaugcauacauugaaucccuaacugcaaggaaaacaucaggcaaaccccaacugagggauauuucuguaagauaaaaugcuccuacucuuccaaaaugucaagaauguggaaaacaaugaaaaucggaggauuuccacaucaaaguagaaugaauacaaccuaaucuuuggauucgacuaugcacauacaguaugcacaaaaaauuaaauuuugcuauuaaagacauuagugagacaauuagcaaaauuugaauaaaguguucauauuaaauaacaguacuauaugaacacaaauuucccaacugugauaacuauacggugguuaugugacaguguguccuuaauuuuacaaaauacacauagaaaguugguaguaaaggaguaucugucugcaacagauauucaaaugguucagaagaaagugugaggggugaagaggaagagagacacaaaaugauaaagcaaauauaguaaaauauuuacagucaggaaucugaaugaagcauacagggaauuaugggguacuauuuuuguaacuuuuuucuaagucucaauuucaaaaaugaguuauaauucugcucuggucuacuagugcuuucccuacuugcuaaaaccagcaaguuuuuccucuuuucaccuagguaauaaauggugaggaauguuucuuaguuaagucauaaugccuuauuacagaaguauauacuaaucugaaauaaagaucauucugucaggaaaguacauaccuccauuacaagcuggugggcacgagaaaccagugugagaccauuggcaugguuaaagguuucagaaaugucuuguccaaauguguagccagcaccacguggugaaauaccccauccaccacgaucaucuggaucugaccauaacagaucacacauugggcccuggccaagaaaaauaaguacauguuacaaauuauuaucagucauacuuuaucauccucaaaaugugguuauauuuucuuuuccuuucuucuucuuuuuuaaauuaaguuuaccucauguggaacuuccuguaaacgauccagggcucuuauaugauccagugugucuauggauggagagaggccaccauggaggcagaauaucuauguaugaauuaacaaaagagaauguauuuguuuuacuaacuccaaacaguuaacaaagaguaaauaaugguuaaaagugucaguccaaauagugccaacauuuaaacauauuuuguccaucauuuuuucuucuuuaccccuucucuggucaaugguauccccauccuuggggacccaccauuaaauuucuuuuuuuuuuuuuccccucccucccucccuuccuuuucucuggucaaugguauccccauccuugguaccuaccauuaaauuucuuucuuucuuuuuuuucucccuccccacuucccuccuuucuuuucuuucuguagagauggagucuugcugugcugcugaggauggagagcaguagcuauucacagccuugaucacugcgcaaugcagccaugaacuccugggcccaagcaauccuccugccucagccuccugggaagcuaggauuacaggugcaugccacuguacccagcugucauuacagcuucuguugguuauugcugauauauacaauuuuuuguuucucuuacagcaaacacucugauuccuguuacuggcuacaauaaauuuucaguuccuucauauuuucuaaguacauaaucaagucauuugcaaaacuauuuuuguuuuuucuucucaauguuuauacguuuuaauucuuuuuauugcuuagugcauuggccaggacuucuaaaauaaaauggaauaauacaaauguuuucuguuuuguuuuuuguaaacuaccuaguuucaaguccaugcucuagguauucugaaucagagagaauaacguaaguuuuaacaagcauuuucuuucugauuuugauuuuuuuuuuuuuuuuuuuugagacggaguuucgcucuuguugcccagugcaauggcgugaucucggcucaccgcaaccuccgccuuccggguucaagcaauucuccugccugagccuccugaguagcuggguuuacagacaugugccaccaugccuggcuaauuuuguauuuuuaguagagacaggguuucuccauguuggccaggcuggucuugaacucccaaccucaggugauccgcccgccuuggccucccaaagugcugggauuacaggcaugagccaccucaccuggccugaugagaagguuucuaauguuuagcugauaguacaacuggcguuucuuuauccacuuaauauuauuauuuuauaaaauaacugaguuuugaaucauaaauauaggaauuuuuuuuccaaaugacuuuggucugauuuuauuuuucugugcgugccacgucugguuuggcauugagguuauacuaggcauacggugugaguuuugaacucuccaucuuuucccaaguucuagaacacagaaauuauauguuccuuaaagguuugguagaauuagccuauaaaacuauuuacaccugguugcuauugguuguuuacuuauauuggacgaauuucugcaagccaauuuuaauaacugguauuuuacuauaguaagcuucauucagcuuuucaaacuuagugcacuaaagcugcaccuguucuugugauacacgagcuccugcauaguuauaauuaugccuuauuucauuccuaguguuuuaugugccuuccaucuuuucuucuagaucaguuuuguucacuauuauuucuuuucuaguaacuuuucagaaagaaaggaaggaaggaggaagggaaaaauauauaaaagcucuacuaacgcacccauuuuaaaaacuagauacuucauuaaaacugauaggcugucuuuuaaaaaucauucuguccagcaauuuuauuauuaaugaagacuauguugcuucaaaacaauuaaaaacaaccuuaauuaaaauuuaacaucuuuuaaauucacauuuucuuuuaacaaguccaggcaaaguaucguccuuucaaauuaaucacggcaguguccaaaaucauggcugagaaaaaagacugucaggauuacacagggaaaguuauaaccaaauuauauucccacgagcagucuaagagagaauuuauuacauucuugacaacucugggcuuucauaauuuaagaauuauggaguuuuauuauauguuuuauauuuauuuauuuuauuuuuugagauggagucucacuuugucacccaagcuggagugccgugauacgaucuuggcucacugcaaccucugucucucucagguucaagugauucuccugccucagccucucaaguagcugggacugggacuacaggcaugcaaugccauccccggcuaauuuuuguauuuuuaguagagaugggguuucaccauguuggccaggcuggucucgaacucccuaccucaggugauccacccaccuuggccuccuaaagugcugggauuacagguaggagccaacuugcccggcuuuuguuuuauauuuaaauuuaaaucaguucaugcuuacagugauuaucucuagaaauugaaauaggaaauuugcauaauuucuucuuauacuuuugaauguuucaugacaugucugcacuacuuguuacagcaaaugcagaaauagcauuugcuucuauuuucuuuuuuuguucuuugagaugggguuuugcuguugcccaggcugaagcccaggcuggaucacggcucacugcagccuuaacuuccugggcugaagagauccucucaccucuagcuuccugaguagcuagaccacaagcacgcgccacuaugccuagcuaauuuuuaaauuuuuuuuuuuguagagacagggucuuacuacauugcccaggcuggucuugaaccccugaacucaagcgguccucuugccuuggccucccaaaguacuagccacugugcccagccaagcauucacuucucagggaagguguaauacacaauauaacauuugcaguuaccaugaaaauagaaaugaaaaguuauucaugguaaccagcagacacugcauguauaugcagagauaguuuuaaauaacaucuugcuuugcuaguacuauacaucagugucuuaaacauuuauuuauaauguuuaucgauaucuuaaaaagcacagcauauucuuugguuaaaagauuuacauacauaucugagaacaacaggaaaauuugcugguccaaauguaugugaaacuuauccacuucccugcuuugaaauuuuaaguauaagggaaggaggaggaaaaggccgaggagaugcagaaacacaggucauaugaaucuagaccccagcuuaccaauagucaaucucugcuuccauuuaccuccucccaagauguaagcacacauauacauaccuguccaucuacuaaagcuguaaguggaagauaaucaaagagaucuguaaaauauuuccaaacguuggcauucccauacuuucgcagacauucaucauaaaagccauauacuuggguaauuugucggcuuucgugauuuccucucaauauuguaaugcguucuggauaacgcaccuggaagaaaaggaguaaaacccauaguaaaaucacauuuuuacuagugucaugugaaguacaccagucucugacccauuuuuaaacacggcgcuuuuggccaccaguauauuaaauguuaauuucaguuucaaaauaaaaaacuugcuuauucauaaccaggucuuacugguuaacauuugacguguuuauuauaaucauccuuuuucaucagguuucgacaacccucaucagaaccuuuaacuaauacuuauauuacuauaauaaacuuguaucugauacuuugcuucuauuaucuucaucaucaaauuauuacuacuuuccuaaaucuuucuagaacacuaugacuucuuacugcugaaugaguagugaaaaucacagguuugaagcugagacaaacucuacagauuaacuucuucccuuuucaauuuuuauuucccacaggaagauuggauuugccaauaauaacacaaaaacaggcccuugacaaaacugggcaagauuucaaauguauuaauaguuuccuuucuauuaaaaaacauaagcgacuauuuaguuaggaaugcaucugauaagaaauacgaaaaagcacuggauucugcaaauuaagcuaaaagcugcaaguauguacuucaauucauacauauuuuacuaagcauccguuaugugucuaacguaaguuuggugcuauaaagccagaugccagaucuacacaaguacagucaugugcugggcagcauuuuuguuaacagauuacauguacgauguuggcuggagcaagagacuauaccauuacagccuuugugugcaguaggcuauaccaccuagguuuguguaaguuccaaagaugacaaaaucaccuaauggcacauuucucagaauguaugccugcaguuaagugacccaugaccauguaauauauggcuucugcuguugagggacuaaccucacuaaggacauauguaaaauaauaaguaauagaaggcaauaagccacuuuugcagcauaaauaagggcugggagaauaaguuuccucauaguaauuuagagcagaaggaauaaggcuaaaaugguugaagguuacauggaggaagugagaccugagcugagucuuggcagaaagguaagaaaucagggacaggauaaccucgugggggaaaucgacuauggaaauaaacagaguccagagcacugaauaagaagaaacuuugauuugagccagaguuuaugcuaccaaccgcuggcaggcaaaaauucagacuagacuauagaaggccaggcaaggaguuugaauuugauucuauaggcaacaggcaaucaacaggaaguaacaauauaaaaggguuaaauaagagauuucaucggccagcguaugccagguggauuugggggggaucagaucuuggaggcagaaauauuaguuacuaagcuauuguaacaaucgaauugugaagugauaaacugugugaaaauagaaagagacaggaacaacagacuuuucaaagcaaggauuuaaaaagacuugucuacugacucaauauaacggauaagugauaaagucaaauaugauuccaagacuucagcuauggacuacucgagagaaugauacauuuaucgggaauacacagaaguuauccuuuucaccucuccuuuaaaaagauguaaaaccaauuauuauuuuaaggggcuauaaacugaacagaccauaaaacagaugauaugcaauacugucauucuugccuuuugccugguuuaaaucuugaaaaaaaaauugaauuucaauaaucauaccuuuaaugcuacaagaagagucacagucuccacugaauaauauccucugucuacauagucacccaugaauaaguaguuuguauccggugauuuuccaccaauucuaaagaguuccauaagaucaugaaauugaccaugcacaucuccacagacaguaacagggcaacgaaccucuugcacauuugauucuuuuguuaaaauuuccuuugccuguuagaaaagugaaaucaacaauuacaaaguuaaaacuaucauuucuuaucuauuaaaagaaaauuuggggaaaaaaacacuugaaaagugccuuauaaaagcguaugugaaaaccaaaccacgagauaacacuuucauuagaaaggcuauaauaaaaaagacaguuaauaaguguugcaaacauguggauaaacuggaacccucauacacugcugguggaaaugcaaaauggugcagcugcuguggaaaacugucuggcaguuccuccaaaguuaaaccuaaaauuaccauguaauccagcaguuccacuccuagguauauacucaagagaaaugaaauccaguuuauacauguucauggcagcauuauuaauaacagccaaaaaguagaaaccaccagauauugaucaaccgaugaauggacauaacauauucauacaauggaauagucacucagcuaugaagaaaugaaguacugauacaugcuacaacuuugaagacauuaugguaagugcaagaagucagucacaaaugaucacauaauguacaauuccauuuacaugaaauguccagaauaggcaaaucuucaaggcagaaggucuguguuuuaaaaagaauaaucuuauuauucacaaguuuaaaaaggucaaugaaagaaaaaagucacaaauuaugcaaauucuugugugaacaaacauucuuacaccaauucauaggccaaccuugaauuucuuuauuccaauuauuuuauauuuauagaauuaaguuagaaaauaccauuagguggcccugaaguacagaauuuaugcuuaaacacuggcaaaugaaauguucugacuaaaucgaaguucacuaauggcucaucgaucuggccucucugccuaauagcaaaagaucccagaaucaggaagaaaaauuuaaaagccucugaaguaacaaaacagacaucauaaaaauguaucuaacccaccagaagagacucucaggccuuauucugggccuacuguuaucuacaaaauuccaacaagcuauuuaccgaguuuccagguccaugagaaauuagaaacagaaaaccacgaaagcuaagagaugagaacugggacuaauacagaaugcaaaccgagaggaagaaacaaccggauggcuagcauagcuaaaacacagggcagccuggcgcgguggcucaugccuguaauuccagcacuuugggaggccgaggggggaggauagcuugaauccaggaguuugagaccaggcugggcaacauagugagaccucuggucucuauaaaaaauuuaaaaaauagcugggcaugguggugugugccuauagucccagcuacuuaggagggugggguggggugggaagacagcuugagcuggggaguucaaggcugcagugagccauggucgcaccacuuugcaguuaaccccgggugagagugagacaaaagaaaaaaaaggcaacaacacagcacagugaaagucaaacagggccgggcacgguggcucaugccuguaaucccagcacuuugggaggcugaggcagguggaucacgaggucaggagauugagaccauccuggcuaacacagugaaaccccaucucuacuaaaaauacaaaaaauuagcccggcaugguggcgggcgccuguagccccagcuacucaggaggcugaggcaggagaauaugacaugaaccugggaggcggagcuugcagugagccaagaucgugccacugcacuccagccugggcgacagagcaaaacucagucacagaaaaaaaaaaaaaaagucaaacaggaugaagcuuaaaguaaaagcagaugacagcuuagacuggugggggagagagcacaauuuuagggacagacaguucucugccucuucagugauuugauaaucugaagaguauuuaaaacauggauuuugaguuucacuguauuuccugcuacucugcauuuuugucaacagacuuuaacacuaguugagggauacucaaccuguagcgauuuucaaaacacacaauaguuuguacacacacuguaggaaucacaaaguuacucuagccccagauuacuuuaugccaacuagaugcgcccagcccagacucuuaauuugaagcaacucuaaagagcagggacaauggcaaguucuauuccaacagaaguguucucucuaguguucuaaaucauuucuaagguaugauucugacugcaccucuaaccucccuuaauuucugcaaaaugcucaugcuugguucuccagcuuuucuuuugauucuaggcuaccauguauucuucuacaaaugccuuuucugcuuauagccugguaggauucccaagaguuauggacaauguagcccauacuuucuucuccuugcuuguaauuaauuagaaugagauuauaugcaaugaagucuuccagaaaacauggguucucuucaguuuuaaucuaauuguguaaucuuaaggccuuuauacccuucaguuucuuuuccugagaucacaaauuaaacaauaauuuuaccagaagccaaguuuauuccacaaaacagcucccaauacaccacaaacauucugcacaccacauauuuuuugcauaugaagaacauggcugaggagauuauauacagaaacauaaugguugucugggagguaggagggcaggggacaggaaugguggguagagugcauuugcuuuccuugcuaccuuucugaggugcuugcacaaauuuucuuugagacagggucucgcucuguugcccaggcuggagugcaguggugugaacguagcucacugcagccucaaacuccugggcucaagcaguccucccacucagccuccuaaagugcugagauugcaggucugagccaccgugacuggccaaugcucgaaauuuuaaaaaacaaauucuguauuacuuuuucaaacggaaaaaaccuggcuucuuaaacuucaaaacaaauuccagauggcaguaauuauaaaauauccacacaauggaauuuuauucagccauaaaaaggaacgaaguccagauacaugcuacaauauggaggaaucuuggauauauuaugcuaaaagagagaagccaaacacacaagacauaacccuggaaaugaaauucaaaucaaaaguacacggaagaaccgacugugggaaugcugacaaugcugcuguuggagagacuccaaauaugcagccaggaacuuagcaacacgcagaaacuuagugacauaaagaagugaaaauccaaacuuauugcauaaaugaggaaaauuguuuuggaagaagugaugcuagcaaaaaucucuuucuguauuugucaggaaagaucacuuuuacuucggcuccuaaauaaaucagacgaacaguuccuaggacuuuauagguauauuuaagauuaucucuuguaucucacuagcuuuuguuuuuuuuuaagacauggucuuaaucuucuugacaaauacagguauuucaugacacugaaagcacaaaggaggccgggggcaguggcucacaccuguaaucccagcacuuuuggaggccgaggcagaaggaucacuugaguccaggaguucaagaucaccuuggacaacaugaggagacccugucucuacaaaaaaaugaguaaaaaaagccaggugugguuguguauuccuguagucucagcuacucaggagacugaggcgugaagauggcuugaguccaggaguacaaggcugcagugaacuaugaucauguuacuguacuccagccuaggcgacaguaagauccugccuuuaaaaaaaaaaaaagcagcuuccuggaccugcccaagacaugucaaucagucucuggaauggagucaaggaacaugaauuuccuauuucuuucccaagugauucucaugugcgcuuaaaguuuauggaaaagauggacaaucagacuauacaaaaaugcuaaaacuugcacaguaaaaauuauacacacauaucacaaaguagaaaauaagaccuuaaacauuuuuaaauggcuaacuuuuggagaauuuauacaaccaagaaaagacaaaauacaauuuuuuuuuuuuuuugagacggaguccugcucugucguccaggcuggagugcaguggcgcgaucuccaucucagcucacugcaaccuccgccuccuggauucaagugauucuccugccuuagccucccaaguagcugggauuacaggcgcgugccaccacacccagcuaauuucuguauuuuuaguagagaugggguuucaccacguuggccagacuggucucaaaccccugaccucgugauccgcccgccucggccuccuaaagugcugagauuacaggcauaagccacugugcccaguugacaaaauacaaacuuaaaacaaaaaaagaauaugccaacucaacuggaaaaaucccucacauugcacacacuccacaauucugauaaaucuagccuuguuuucuucauguauuuugguauugccauuuauuauuauuaagguucucgucccucagaauuugcuauggaauaaaaaucuguauagugaagaauuaaccucacccgaggagaggucuggccuuugccccuggaauuuccugcuugguaaagagaucucugccugggggcucugaccugcggaccauuaacaaugugacucacgaugcggacuuuggaugaucccacuaucaguuuggucucuggaggacuggacacuacagaugucagccccucuuguacucugcccuuaugagucuuuucccuuggcuuacuuuaaauuguauucauucccuguaauaaaccauaaucaucaguguaacagcuuaaagugaguucugugagucauuccugugaaucacugaaccuaagagugguuuucggaacccacugaacuaguauauuggugccaaaacugaggcaguccugggcaguguucccuguaauuuauaguucacugaacuuuauuuuuugucugcuguucugaagguacaucaugacuaaacuuuugaagauggugucagaggugagaacaguguuagggacugugccuucuaacucucgcaaaauccuuuuuaauuacaaaaguaaaccacauuauaaagaauuuggaagguuuucuaugaccacccuauuaaaaaaaaaagagucucuugaauucaagcccaucacuguccccaucuucugcuuuuucuugccagcaagaaucaaugccugguguucauuaaucguguccccucuucacagcugaaucucuagcacuuugaacagucugguacauagugguucaacuaaaaucuguugaauguacgggauaacuacacaguggcagcauucugucaaccaauccucuccuuucuucuucacugcccacaggaacaagcgccucuuuugcuacucaagccaagucgagaauacacugaaccaauucugagcucucaucauccaggacauaaauaucaugcggaacucuuuuaaacgaagaugaaaauuauuucccucucuauaagaugggauuuugagcugggcgcaguggcucacgccugcaaucccagcacuuugggaggcugaggcaggcaggucacaaggucaggagauccgagaccauccuggcucacauggugaaacuccaucucuauuaaaaacacaaaaaauuagccgggagugguggcaggcaccuguagucccagcuacucgggaggcuggggcaggugaauggcaugaacccgguaggcggagcuugcagugaaccgagauggcaccacugcacuccagccuggaugacagagagagagacuccaucacaaaaaaacaaaaaaaaagagauuuugagcaaaauuaaacuacagccuacacaccguauccugcauauuaaaaaaaauccaacuaugcuaaaaaguuaauucaaauaagcuuuuuucuaagauugaauaggugagaacacuuaaauucaccacuguaucccagucucaacauaaaaacgauugucuuuguauaaaauauucacuuaauagaucuccaauggagucuuccacauuuuugguguaacaugaugcuauuauaacgcaagucaggaaucucagguugcaccucaggauugucuuuuaauucauuugaucacaaaaguaucucagucaaaaaacaguuuacaaggaaugaugauaaauauuucuaaauuacaaaggacacaacagcaaaccaguucuaagcuugagugcuugagcucucccauucucuggaaaggaaacggaaucuguaauacacagaacuccuucccaggguuaauaugauuuuuuuuuuuuuuuuuuugagauggagucucccucugucacccaggcuggaaugcaguggcgcgaucucggcucacugcaagcucugccuccuggguucacgccauccucuugccucagccucccgaguagcugggccuacaggcgccugccaccacgccuggcugauuuuuuuuuuuuuguauuuuuaguggagacgggguuucaccauguuagccaggauggucuggaucuccugaccucaugauccgccugccuuggccucccaaagugcugggauuacaggcgcgaaccaccaugcccggccguuaauaugauuauuaaugaaauuuagaguugaaaaguaacguacaggaacuauuagaucacauuuggucauuaaggaagaaaagaugucuucauacaaguuucuuuaaacaaucuggauuagguuuacauuucauuacauuuacuugaaggaaaucaguucaaaacaauaaaaaauuucuauuuaacacagacucagauuucuuauacagauuacuucuguaacuuuaauaucauucuucuuagaaaaaacuacauucagaaaacaaucuaggaaaauuaauuaagcauuaauuccaucuucaauuucuggcauuuucauuuccuuuuaccaaggaagggcuucauucaccaagucuuuuauaacauucguacugaagagaaaagacugugaagaaaaaauuucugcaagaucuucaaauaagaauaaaaggcacacacggcaauaaaagcaggcaaugaaaagaaauuuuacauugcaaauaucuucacuuuaucuacuuagguaaauaucuuauggcaaggguauauuauuguuaaagggcaguauuaaguauuaaauauauuuaccuagucauauauauuugacacgucauauauaaaguagagaaauguaacaaaguccacuuucccgccauuagcaauaguucaugcuagucuaguuugguuuaauuucuuuaccuguccacuaagaggcuggcuuagcaaggaaaacaaugauuuguucagucacuagaauugggucuugacccucuauuucacuguaaucaugccauucuucauuauacuaagaaaggagcuauuuuaucacugcauuuuagauuuuaucaauggaccaccaaagcuggcacuaauuuuuguucgagggaaauuaaaaauggaaguaccaguuaggcauuuugccugucaagaccacuauuuuuauuuuuuaagcuguaaucaaucacagaaaguaaucuaaaaaaauuuucucaauucacaaaaaucacucauuuuuaccagaaucuaaucuucauuaagaugguuuuggguauucaggaacaagcauacuauuucacauuaggaaugaagucauauccuaaaguuauuucugcuuauuucaaggcuaacgccaggacuuagaaacauuuccaucaguucaauauaaaauuuacauauuuauacuucuacacaagccucgacauuuuucucaauacguacuuuauaaucaucagaauaaagaucugccagcacacacauuggcugaauuucccuccccaccuaaagaaucaucaccaagguucuucaguuauaaaauuuaacaggucaaagagcuuaaaauuuuuacucuuucugagacaacaguuaaauauaguucuagucacagaguguccugagcagugccagccuggcucucuuggcacacaaucuucuaaaauaacugcauacugcugaugcaggaaugaaucacagaagcaauuucucugcacacacaagaggagucaaauucacaauuagcuucaaaagcuggauugcuaauuuaagcuaguguuaagagcuagucuucucagaagacaugccuugcuauuuuaugcaaacaauuuuucacuaggcagaaauuaaccuuggaagccagacacaccauaccauucauacucuuuauuuuuuguagucauucacccacuggcacuaggauagauuuuauuuuugcaacuaccucaaaauaggccuuuacuaguacuacucuggucuugauuucaguggacuccuucagcuuucuuuuuuuggagacagagucucacucugucgcccaggcuggaaugcaguggcgaucucggcucacugcaacuucugccuccuggguucaagcaauucuccugccucagccucccgaguagcugggacuacaggcacacaccgccaugcccggcuaauuuuuuguauuuuaguagagauaggguuuuaccauguugcccgugcuggucucgaacuccugagcucagacaauccgcccaccucgaccucccaaagugcuaggauuacaggggugagccaccaugaccagccgacuccuucaguuuuuaggcaaucugaauuagaauagaaauuuaaggaaaaaccaccaucauacgauguaacuuccuauagaauaguauuuccaauagaauaaaaaaagguauuuuuaaaaaacccaaaaauugaaucacaaggauuaaagauaguuuauauaauuagguuugacucuuuauuuuucucauauuuucuuucuacaugccugcuacucuugcccuagaaagguagggcaaguauuaaguagaccaagucaggaguaaagauacuucacacaacugcuauuaauuccaguacugugugguucacauaacaggcaccacuacuuuucaggguucuauagccacuauauaaaaaaaacuccuuugaaguauauuuaccaaagaaaaggcauauuggcacaucuauucauuuugcauuucuuacaaaagaaaaugggugacacuuaugauuaaaacuuucagccuuccuuuaguuaacauucacugcgugcuuacuucucauuaggacuuuacauggccuuuuuuuuuuuuuuuuuuuuuugagaaaacugcauucugucacccaggcuggagugcagcgguaugaucacugcucacuguaaccucugccuccuagggauucuugugucucagccucccaaguagcugggagugcaacacuacgcccagcuaauuuuuuuuuuuuuuuuuaguagaggcagaguuuugccauguuggccaggcuggucuugaacuccuggccucaagugaucuaccugcaucggccucccaaaaugcugggauuacaggcgugagccacugugcccggccaaugaauauauaucuuagcacucacaaccaacccgggaggauugguacauauuaucucugucauaaggaaucagaggugcagaaagacugacagcuagcaagcugugaagcaggacuggaacucagacaggaugaaugcuacacuuguuauguaucaacaaggaggaugggguagggauauaaaacggaacuagaaacuaaggucagaaaacauauauauguauauauacucauacauacacaaaccacaaagcuaggucauagcugccagaagagggcugcaaaacuaagcacggcucaaaaagaguagagagaaaugaguauuaucacacuuuuccaacccauuggcaacuccaucaauggggguagagaacaaagaugaaugaauuucacuaacaaauucaugcuuuguggguaaggacaaauauucaaagaaaaaaaaaugggcuaggagugguggcucacucccgcaaucccugcacuuugggaggccaaggcgggaggaucacuugagcccgagaguucgagaccagccugggcaacacggugagaccccauaaaaaaaauaaaaaaauuaucccgguguggugacacaugccuguggucccagcuacuugagaggcugaagugggagggucccuuaugccccagaaguugagguugcagugagcggugauugccccacugcacuccagccugacugacacaccaagacugcgucccccccccgcccccaaaaaaggcuaguaagauacaagagauaaucuuaaauauaccugugaaguccuaggaacuguuagucugauuuauuuaggagccgaaguaaaaauaaucucuuuugacaaauacagaaagcuuccucaagugaucguugacacuccggugugauuauuucaaaguacagcagugguacaauauucuucucuagaaguucaucuuaaaauuauuagaaagucaauaggggcugugcacgaggcucgcgccuguaaucccagcacuuuggaaggcugagggaucacuucaggccaggaguucuagaccagccuggccagcauggcaaaaccccaucucuacuagaaauacaaaaauuagcagugcauggcugcaugcaccuguaaucccaguuacucgggaggcugaggcaggaggaucccucgaaccccggagguggagguugcagugaacagagacggcaccacugcgcuccagucugggcgacagacugagccucugucucaaaacaaaaauaaaacaaaaaaaggaagucaaugggaaaaacugauucaacuaacacuuuacccauaacuucaagucuguauucugaugcucauagucagguuaacugacucagaucauuucaaaccuguacauuucacuucgcauuagagcuggagagagauguuuaaggcauaaauuuuaagacucaugaaauuacagguuaucacaauaaaaaugaaugucaacugaagccacaaguaagcaguuuguuucagaaagagaaaaauaccacuugcuuggcacuucuauuuacaaaaauaaauccuccuguguuaacaaauaguuacuuaauacacaaaggccccgaccaacauuacacccguuaaaaauauuguaacuuaacaccaucuauuagugcuccuuuucuaaguaaauuucaugaucuuaagaguacccuaaaaucagacuaacaaaaucuuuccuucuccagugcacuucugccacaucaugacuucuaaacauuacgguuaagaaaauuuuauagauuacguuuuaaaauaacaucguuacuucuucaugcacuucaagugagaauuuuuaaccuaaaaauacaugaaaauuauuuaguccaccuuguaaaggaugaauguggacaacucuagacuucaaagauggagagaucgaaauaauuucagggguuaagaaaacaauggauacagaauuuacaaagugaagaucacacacucacgauguacaagaacgaacugaucacccgcauguuuuauuauucuuuggaaaaaaacuuuauauauauuaaaaacaaaaauaacuuucugcaaagugcuaucgugcaugaaaacacacaucccacuuaucauuuccagcaaacacuguucccaaacuuaagaucggcucucguuucugaaaaucaacacuuuacuuccaagagccacucaacacaaagaccagucaccaucuguuuccaccaaagucaaccucuauuuuaaaaaucacaguuggccaucacgccuaccucuccgcaaacaaacgcuuggcacauucaagaaucagcgauuuuuuuuuuuuuuuuuuugcugucgcccaggcuggagugcaguggcgcgaucucgacucacugcaaccagccuccaccuccugggcucaagcgauccucccgccucagccucccgaauagcugggauuacaggcacccgccgucacacccugcuaauuaaaaaaaauuuuuuguguguggagacggggccucacuauguugcccaggcuggucucuaacuccugggcucaagcaauccucccgcuucagccucccgaguagcuguggccacaggcgugagccaccacgcccggcuugaguuagugauuucugaggugccccguucaccugacaaaaauucugcauuuauuaacaaguucauuaauacgcacgacauucugguuaauuuuaguugcauuuucagaaacuggucugaaaaugguccuuuucggacgucgcucucgcuaguccacucgggaaaugcuagaguggcaggaacuccccaguggagcgcaggcgaccccgaccaaccuccugcuuggcucagggggcuacguuuccccgcccguccgcacccgagccccccacgcccgggaucugggcagccggccgggggcgugaggcggagguggaaggggcaggcgagggcagcccaacgccccgggcccugaaccgaugggccggccgccuagguggacgccggagccggacccacagccccgcaggcccccggugggccgcgccgggccaggggcggacgggaccggggcgggcaggaaagcggcggcccgucccagccccgcgcucccgcacucgcccccgcggcgcccucaccuucucgcacagcguccgcacuugguucucguucagcugcuuacacucguucagcugcucgacccacugguccagcuccuuggugaacgccuugucguccauggcggcccgaucccgaugcggaucccgagccccagcccggccgccgcccuccccccuccccacccgcccccggccccggcccgggcgccgcuccccucucccuccgccgccgucgccaggucccacagggggaggacugagccggguagggcggccgcgggccccgcgccccgcccaagcccagcaggcggcuccgagcgcgcagccuggaggagacccccgcccgcccuuccccgcccggccgcgcgccgcgggagucggugaaggacgcggugaggugccggggagcgcggcgcggguccucggccuagcucucgccggacgaaggccgcccgcugccgcuucaggcccgccucacgccuaccggccucucccgacuugucuuuccccuucucucgcucuuucucuccccucc
